United States Patent 9,328,346 (POLYCOMB-ASSOCIATED NON-CODING RNAS) - sequence listing, part 20

SEQ ID NO: 3194 - RNA, 15309 nt, Mus musculus
gcagcuuguaaaaaguugguuuauuugucauguuuucacuguaucucaguuaagccauuuugguguccacagugacaguccucuuggaagccaggucauccccacucacccacuaauagugaccaucaaccacaagccaccagguccagcugacagcuacagcagcaggugaggcuguggacuccaggccugacacuccccagcacagcccagagcuggggacucugcaccugcuugccagaagcuguggagucccuaggguaggugggaagcugcucuguggcaguggcagaggaggggcagugggaagacccuguggacugggagggcaccaggcuccucugcucaggacugggucuagacaaggccacgugugauauggugugcgcccugggcugugugcaagggaucuggcccugaugcugaccugugucggggcaaguggcuaauugucccuugauugccauuugcuggcaagcauagcagcaagagucccuaagagccccgggucagggaggcauucugcuacuuccacugaggugugguggacccaggugucuugcugcuggcaggcugugaccacauggcugcacacccaccagagcuccugcccccuugugugaacagcuggacccucuguguuguaagguaagcugacaagcgcuaauugcucuggccucaaacuacagccuuuguacccuugcuguuaaaccguuucugucuuaagaggggccuuuccuauagaccugagggcucccucaggcccauguuaucuguuaccccagacaccuuaacuacaaacaggauuuugagcaacuucccuaagagaucucugaaccugugauuuccuuacagguccugagccagucuacauuugguccuaacgacaauaagaaaauucuaaaaccuggaacaggaaguucucaguaggaagacagagguggccaccacaggagcgccuuuucuagugggaacuggcaaagaacaagcacgaggacccuuuauauacguccagcuaccuagcuggccaggcuccagguaaagccagugacccccuuugcuggcaacagcagacacguggacccugcugauccucaccugucugcacgcccagaugagaugcagacaucuaguuugugcuuccuucaaccagggccacagacugccucggggcagcugggacccuugcagcugccaggcacugagaagugcaaggguuuaaauaaaaauuacaugggauacuugaggacaauuuguuaucacacccccuggccaucagcuaacaauucacuucuacugguuuuuugccaaugccagaaaaagcaaaauuucaaauuggaaauuuccuagcacuuuacacaguggaaugaaaagauaugaaauuuuaaaaaaaauuaaaaaaaaaaauuaaagucccuaugccacaguagcaugcuccagcaguaagagcacccuuccugggcaguucuggagccugugcccucacccugguccacgggcacgcaaggcucagaagagaagggcucccaugcugcccaccucgcucuguuccuugacgaagaucucaaaguacugguagaugauggugaccgcaagcaggaucccaguuccagacccgauagcacccaggaagucagccaggacagagagggccccaaugcacagcccaccaaaggcugcggcuguggggauguaccugcagacagacagacagcucugugagcccauuaagccagccacacagguaaugugaccagcacaaacccaagcauggaugaugccacucuagauccuaaacagccucaagacaagagcguugagacaccaucuuggcucuugugcuacuggaaagcugaaaccaucugcagucauacccagaccggugcacugugaacagcaagggucucugccugaggcugcugugcauuucugcugggcaguccgagucaggggccuuaagaguuauggacucaaaugaaagcccugcugccccuggcucagagacggacauuucugguauuccuugugguggccuccucagcgagggcagcaagcuucccaucaccacaugcucauucuacagagcaccuggcugcccugagugaccaaagaaaaaccagccaugacgaugcacuggacagaaagccucaggcacuucccacccaccaagcagcaucuucagaacagugacagggaggugugugcaggguugccugcugcucccaaagcucucaucuuccucucugcaaggugacuacagagacuagagacgacuacuacauuccuccaucucacguggcugaagcuggcaaucucuggccucugguuuggucuuauuucugaacacuaaccaccuguuccaggccagcucuugcugguaccuuggcuucaucugugccagaacccacccagcccaaaccagcacugcucaaucaucucuguccuacaccauuucaacacccuggcugcgugcugucuucuuuggucaggggcuauauggggcucugcuggcauuucuaguauuuggacuugauugcccacacuuaccgguugagcucaugcaccauggaggucucccuguggccccucaucaccaucugcugcuccuucagcugcuuugcaaccuacaugacccaggcagaagcacaugagccagaggcuggggggcuucauaguggaacuaaacaauuuuacauuuauuuuauuuaauuuauuuaauuuuuuuuuuugagagucucucuguguagccuugcugcccuggcugaccaggcugguguccaccucacagagaucugccugacucugccuccuaagugcuaggauuaaaggugugugcuaucaucucccaggcagguauuuuuuucgcccauagcucagacagucuccauggaggaacuuuaacuuacagcaauacacucagucacacacuagucuaucuuucuagucuggccucagguugucagagccaacucuguuaaugcccauucguugugcucagggcuuccacacugcucccaaaugggugguccaacuguagaauggacggcucauaucacaaacuacuacauauacacuggugacaaguggagcucccuggaugccgcagcugcccaucucuacgcaggauguggacuuagacuuacaucuuuggcagaagaaccugagacuucgauccauguuuuggagaagaaugcacaggagcccagcaugaacacgauguacacgaccgcauggacaggguccuccagcacugagccgaacgauuccggaggagacagguaguaacacaggccaccaacgggguaagcucgggcugggcccccagaugauguauccuaggaguaagauauagaagucuucuggaggcugcuucaacacgacacagcacagagccaaaguacucccaggagaugcuuguggugucauucgcacacccacagcaagcucaccaaacugcuuuuaagaggcaauucagaaagaccucugggugacaugugugguccugagcuaagauacccugccacaagcacagcuacugcaucaguacaauccuaucuuacccagugacacuuaccgaccaggugcccagcaggcuaaccagcagguugccacugaagcgugcugacagcaucugggagaugacauacagguuggacaccagagcagacugcaagaugauggggauguuggagguguagaagagcuugaugggauagguguuguacuggccucgguaacgcgccgacuugauuggaagguccacucggaagcccuguaacacaaacacaacaacacgaccuuucacuguccuguucugccuggugucccguguggucagggacagucaggcuggccauaggagagcuaguccugggucaguucugccacuggacucccagccaugauggcaucugagggcacauauauagaaaggccuuuccuauauagaaaggccugcaugggcaccuccagauccuauugguaguucucaggcagugaucacaugugaugugaucaucaacaaaaaucccuaagcuuccuaccaauaccacccacccagcugaaacgcuggacaccagaguugcuuccuucuuuaucguuauaaacucagugcccagaacacuacaacaggacagaagacucaaacuucuuacugauucaaccgcagucaucgccuugcuccgaaaaacagacucguuacuaagcaagcaggcagcuagcugagacucagcaggagucacuacugaaauacuuggccucaaaaaaauauugcucgucacaaaacaugugcuaucccuuuuuuaaaaauuuuacuaugugugugugcguauaugcaugggacaguguaaguagggaucaaaggacagcauagaaaguuaguucucuccauguggguccugggaaucgaaccugucacuaggcagguucaaugaucaccuguauauacugagccaucucaccgaccuuguuuguuuucaaacagaaucucacuacauacacuacgccaucccugaacuccuggucuuaugucccaucuacuaaaugaaacaagccaccacaccugaacaacugcuguaauuucuuccaguuaauaucaaaauacuacaaaccaugccgggcauagaggcauaaaccuuuaaucucaacaccugaaaggccgaggaagguagaucuguaugaguuuaggauagccuaaucuacauacugaguuucaggccagccaagguuagacagacccugccucaaaccaaccaaccaaccaaccaaccaaccaaccaacccacccucucauccacuuucaaauacaaaaacccuacuaagccugaggguggguauaauucagacagcucuccguucaggugucuuacucagaaacaaccugagaacugugaagcaggacaacaccgaugcugagccuggcugcugcucaaggcagaccugcucucagcugccuuuggacacaccuggaaauagaugacaacggcaaagacgaagaugguggcaaucagguucaugagguuggggagguucuggcgguagaaugccucucgaagggcucggaccuugucugugcggguggccagcagguggaauagcgcuaugauggcgccuucgaauuccaucccuaugggcagaguaaaacaugugguguguagagaaauuguaauuuagcagcauggcuguuccugcaagggaucacauccaaagauaugauccagccagaauacagacacacccuuaguucacaccuuuaauccuuaacuauaaagacaagguuagcuuguagaaggaagcagccauguugaaagugauguguaacugaggugcagacaaagcgacaaaucagagaaagaucugacagaaugagaaugagauaagauaugcccaacucucauaagaacagcagaggaagaaaggcuacuuaagaauugccagagagaaaaggugguaguaaugggugguggguguguauggcagcuuuacugggacaggucuacagagacagguuacagagagaacaagcuagacacaagcgaagacagaaugagccagcaaauaaggagccagaggguuagagcagauugucaaaguuaguaugaggccagacagagcaauucagucagaagcugagaaaagccagauugagucagucagcuuggaaguuaagacuguauagaggcuagaagcuuccaggucuaggccuagggagaaugaaaacagaaacauuuugggcuagugcaaggcucucguuucaucacuucaucugaggaaauaagagcaacauuuauagaaguggaggaugaagagugcucauuuugccccucaguuucuuuuuuuuuuuuuuuaaagauuuauuuauuauauauaaguacacuguagcugucuucagacacuccagaagagggagucagauuucguuacagaugguugugagccaccaugugguugcugggauuugaacuccgggccuucggaagagcagucgggugcucuuacccacugagccaucucaccagccccaccccucagcuucuuaaugaucaaaacugagaggaaaaugaaggaguucagagaagcaacuacagcacuggacucuucucuucugagaugagcuggcugggcuuauuuuuuuaggccagcagauguguggaagaacaauuaccaauuuaaacacauuugugacacaaucugccuggaaaaggccaagucuuguuccgggcaguaugaacauucaucccagucccugaagagggcugccugcccccagugggagagaguggggaaugcuugaguucucagcuucaaacaccaaauaccaaugcuacaaggaaaacuguggcugccacuguguguguguauggcugagaucaugguuuccacccucccauaggucgugccuacuaguaggccuggcaaauugaugggcuccugaaagcugaagggagcagaagagugucccaaauaucugcaggguaaggggagguuagagcaagccuuccuaccuuucaguuguggccuaucuucuauucagggauaagggaguggcagccaggccaagccuuauaucuaacaaggaggugugccgagguagaccagggaagaaagaauggcuccugcuuucucccuugcagccuuucuaagcuccccaucaaacacucugcuucugcugcccuguuccagcuucauggagacaaccucagcucaggguacagagcugcugguugcuuccuucaugucuuuuaagacugcucaacugagaugauacccggaucaacucucuaacaccuuccguguggcccuuucuuucuuauugcugucacagugacccaagaccucaagaugcuguaugacaacaaugucuuagaacccacagcagugucaacaauggugcaauuagguccuggcucuucuaauuuuuacaauuaucugucaaaucucugggaacaaggccaucuccacauacuuagcaccauccccguggcacacccaagcacacuguccacacuuucccaguccuggacuuuagcacugcccaggaaggcagcagugguaagccagccaagcuguagcagccauucuggcuacacgucuccuguguccucuauacacuucugguccuuguaccucaucagugcuauccuccugcugugguucaucccgucucagcagcaaguaaaucaaaccacccuugcagacuccauucccaccaggccuggccaugagacauguccagggauuucucaguuuacaccuuggccccaucucccacaccuccccuaacagucaaucugugcuucacauccuguaugcucaaggcagccauggcacuugcccagcaguguacucugcaguaugagugcaucaguccuuccauacuccaucagccccagaaugcaaccauucucuguucugagccuugacugaccauccuacccagcucccuucuuugcugucauuuccagugcuggcacuccagaucaugucaucuucuaaacaguacacuccaacugcagucaccugcugccucuccaccuaggucugagaagcugugccuuccgcugccccagucccucucaaugccauucaucucacuagaggacagcuuuuguucacuagauauauggggcuguauggccucugaaggcagaaacugccucagcaucaauuuuauaaaaacauacacaaauauuuuucacaagucucuucuaauaacacauuuagcaacaaaagucucuuucccuagucuuauuuuacagcguccguuguauuuacacauuuugauuacaaacauucccaucucggggcacccuuaauggcuaugccaccgcaugcuaauaucugaccaggcaucacgggaucacaugguauucuguggugccaggugucaaccuugcacaaaccucuaccacugaguuacauucucaguucuuaguuuucagagagcauggccucaaauucaaaacccuccugccucagggucuggagagcugaaacuaaagagauaugucaugaccccucacuacaugaugacccagaucagcaguagaggaaugugcucacaccacauacggauaauagaucugagcccuagggcaagcaggaucaaaugcuuugguguaguaguuccagguuuuuucuaguuugcuuccuuuuguuuuuuuuaaaaaugauccagaguaaacugccaaaauaaaggagaggacgcggacaagcucaaugucaacaaaguggcugugccuugaaguccacacaagacagaggcuaaaacaaaaggcacuuccuccugugaugcagcucucacugugcugagaacccaggcccacucagaucuggcacaccaaccaugacgaggcauaugaaaaucugggcaguaaaaugccacgagcaugagcugaccuguacuuaaaagccguggaugcacagcaaaaccaggagcuugugccuuugccaaacucuggccugagcucuggggcccuaccucggccugagcucuggggccuuaccucggccaguguugacagugguggggcugaaugccuuccacacaauggucucacagauguuagucgcaaugaagagagaaaugccagagcccaagccguacccuuuuugcagaaguucauccaaaaguaggacaauuaagccagcaacaaagagcuguggaaaaaagaaaaaaguaaagaaacccaaauagaucauguuacugcucccaguggauguggcucucuucuucaauaauagaguucuugaguauaaaaacagaaagccgaguggggugugcccucagccuucaucugcucuuaacaagggcaaaccuacaaccuccagcuucuuuuaaggcacagcugagauuugguauuuggggguggggguugggggccacagcacaacaguuaccugaauggugaucagcaggcagauuccagcacccaucuccgaaggguccccguacaugcccgucaucacauacacaauggacugaccgauaguaaugaucauuccaaacacuagagaucaagagagcuguguucucaaagcaggacaguacaaagaagaggaaguggcuaaugaacacccaaaugcccaacauugagaagaaaaaacauagugcugacacugccgccgaggagcuggaggaaucccaacagucacacugucaaagccugagauaacacaggcgcccucaacaaaagcacaucugcucuccagucucuugguaauguagaaggaguugacauguggcaaauguggucuuaggaaaagcauggaaugccaagcaaauucagagacgcaaugcagugcuggcgucccugaagcccaggugcacaagacccugggauaugaagaccucuacacugagccguagguggacuaccuugaaagcucaccauucagguccaguccagagcguacaagacuuugggauaaaaccaauccuuuuggaucuaaguuuauauuucaggugucuugaaagggaacccacagugccaguggccuggcuauugaucccauuuccucugacugagcuccucugcacaguuucucagaucucacuauauuucauuccuaggcacauuugaauugacacagaucauugguuucucagcauuaguugguucuaaauaggacuuaaauuucaguauaaauuuccaagugucccccuaauacaguuccuauuugaaauuugaaaaaacuguucagggacgccaagauguccacacuuuaaaaauacuugccaugcaggccggaugaccugaguuucauccuuagauuccacaccgaaaaaaaaaagagaacagacucuacaauauccucugaccuuucucuacacagacccauggcacauacaugcacgacaacacaauaaaaaaauaaauaaaauaaaaacuaaccaaugaaacaaacagggccagcaaaaugggucagcagguaaggacacuugcugccaaguuagauaauuugaggaugguggcuggaacccacauggcugaaggguagaaucacaccuacaguuguucugacuuaccacacacacacacacacuaugccacaugcacaugaauaaaaaaauguaaaaaauuaacacuauuguucaguaucccugcuuuauuuaaaauuuuuuuuuuuuuuuuuuuuuuuuuuuuuuuuaaguaucagcaaucaaacccagggauuugggcaugcuacaaaugcuuucccaccgaguuacacacccagucuaauacucaugaauucuucaggcagaaaagguuugaaaacuuauuccugaauaaccgauuccaguucagaggaaggacaccaaugcugguagcuagccaugguuaccaguuacaccuaucacuugcuguauagcaaacaucacuaucucuguagaugaaaaacugaaccuucagaacgaccaccucacuuucuucacuucaaagcugauaaggagcacaggucacacaggacacacagcagugccucucuucccugaccccgcuucacacagacaggagcuugguucagugaagcucugaugugugagugccaacuguacacggugagcucccagcccugcuccuugcacccauccugccucuuccuagccccagcccuggacgcagaggggcagccaaggaggucagagcagagcacagcugcuucaaccccagaagcuuuauagcaaauucacacgggcaacugcggacagcagaaucuacaguauuucuuacacuucugggcuccauugaagagagcucggucuuucgggguguccccaacuucaauuaucuuggcaccagcuaagagcugcaugauaagaccggaggugacaauaggagagaugcccagcuccauuaagguaccuugaggaagggaggcaagacacagccacaauaagcuuggaagaacaaacacuguuaaacccugaucaacacuagggcacuaauguacaacugcaacagcauucaguuugcuagcagcaguuaacuuacagaacaacccccaaauaucaaugaccagagcacagcuuaacgcaauccauucacccugccaggcagcaucucauucuguccaggcagucacauguuauucagacuggcgcauuucaauucagcaacagauuuacucuagccucauggagauaagagaggccggucuccccaucaguuaguaagaaaggauaacacuggaggcauucccagagucuggaaaggggccaguacaaccauaucuggcugugaacaaacucccaccuuccauuaugcuaaauccagucauaguucugauuuccaacuuaaugugcacuguauuuuuaaauugaguuaaucaaaugcaguauggacauauauacucaaaauccgcccauagguagguaaauggucuagggcucacaauaaauaaauaaauuggggguugaaguggggugggcagacacuguaaccuacagauaugaaaugagauucagcugagaaacaaauuacaccuucuaaagaauguuaucacuuuagguauuccaauucucccacguuuuaaacaauuuuccacaaugcugccuuaucuuguuguuacagguucuguacugcauacagacccacagggugcauucaucagagaacgcuggguuacuuucccacaccaacauccucuagcuacacaucuucacaaacuuucugagcuccauauaaagccaaauccugucagggaaguaaccaggcuuuucauccccaaaccacagggcagggccgcauaagcagaguccuaccucuguuagaggccagaaucacucgcauccaguagaacgggucagcugagucugaagacaugaugccaaacagggggaucuagaaacaggcggagggagagcugcaucacgcguguguccucagcucacucaccccuaacgccgccugagcagagcuuaccugacagcauacuaagaagaugaagagggugauggcuguccacagaacuuucuccuuaaacugaaucuggaaggcaaggaaugaaagcaauggcaucacacaggcaaacaaacacagaugaagccaaacaagaucacauuccccauuucucagaggcugcucaaaaguguaccaaacacagcaccguaacauuaaguagcacacaucguguuucucuguccaagacaugauacacagaccuaugugggucuucacuucagagaagccucucacuucacagauuaucuucaugugacaaugagcaaaguaaccaagaaaguuuaaucugucucaaauccugcagcacaagugaaucugagccaaagcugugcucuuaaccauccacaguaacagcugagacucaagauggcuucccgucaucccuucccagguauaggucugauggugaaccuugacugucaacuucauaggauucagaaucaccagggaaguaaacagcucaggucugacugugguggaguuucuggacugaguuaaugaaagugggaagacccagcuuaaaugugggaggcagcaagccacccgcugggauccagagcugaaugaaaaggagagugaccugagcaccagugcucgugucccugcuuccugacagggagugcagucugaccaacgcgccucacguccucgcugucgcaaacagugggcccaaacacaagccuuccuuccuuccauuucuuuugucaggaaagcugucacaacaaucagaaagguaacaaaccgagcaaguuaaacagucaacacaaaucacuuuacucucuagccugaucagaaaccucugggcuccuccugugcaagagagcucugucacuagguagggagagcaccuuaggagugccugacccaacaccacacaggcugagacaggucugacagacagcuaaagaccuacgauguuaagugaauguaaagccaaaaagaaaaaaaaagaaagaaagaaagaaagaaagaaagaaagaaagaaagaaagagaaagaaaccaagaaaggaagaaagaaagaaagaaagagagagagagagagagagagagagagagaaagaaagaaaccaaggaaggaaggaaagaaggaaggaaggacagacggggaagcaggcgggugggcuccaacaagcacuggcucgugcaaacugucaggucagaaccugaaguccucugggucuagucacuccuggaaagacacagaauuggaccccauggguggugugaauuugaaguucagacccugcagaggcagcuggggagcucacauuccuccucuuucucucaagaacacagccuuuccaacgugccaucuuaucacacaagaacucagcaccuaacgagggggaagcaacaccauuccacaggaaucagaggcaagcaguggagugaauguguacacggacuaucuacugugcugaugauggacaccagacacagggccucaugccugccgcuagccacuuucccagcccagguaaugaaacuguuagaaaacaaaaaggauacacauuuuucaagacuacuuuaaaugagcaagccucgucuccuggucaauuuaaaagcaaaacauccaaagcuuuucaucuaaguccuaaaucaucugccucugaagcagcugcaaacucacacucauucaguaccaugauuugcccccuuuccugcacggcucccaagucacacuccaggccccuccccuacugccaaggccacuuaucugcccaccugacucaccggaaccuuuacauuuacaaccuaccuaccauccacaggcacuauauuauauauuucccaucucccuuguucugccaggccaaggucacaggucuaugaagaaagaauguaaagcgugggacuuggguuucuuggcccucgagccagaaucucugcacugagguggaacagauaaaguucugaacaucauccuggcaaaggcagcaaggguacugcaaggcauuugcauagaacuauggaaaguaaaaacuaaauuagaagcacaaaguauccaugugaaugccaacuacaaaugccagaugugaauauaugacagucugaaaaaaaaaaaaaaacccaaaauaccaaaaaaaacaaaacaaaacaaaaaaaaccccaaaaccaaaaccaaaaaaaacaccaaaaaccaaaccaggaacacaaaguagauuuacuguuuucugagcccaugggccuggacuuuccuucaccgggcacucucacacuaggaacauuuauucuugggccgaagcugccugccacagaaauucugauuaagauucacauuaagcauuaaggugcuacaguucucuccuuccuuguuuuagagcaccugcugucaauggcagcagacuucacuagugcauguaaacucgaugcuggggcagcauacauucaaauaaaaaccacaaacacguucauaucgauuacacgacucgauuuuuccuuuggaaaccagauaccgaagucaccucccacacgaaacaaacaccccaucaucugcuccugcuggaggugaagaacggaggguaacucaaucugggauccuaacugaggucuuaaucaaucacugcucagacccacuuucggacuaggcaaaccugaggcuuuguuaaccacuauccacuaaagaugcuccuaacgagacaagguguugggagaauucccacacaaccgggucaccuuucaacggcucccgugaguaucccagcacacacagcuacacuccagaggggcaguuuucacucggugugcugaggccauuuuuaauuguacuguaaacucccagcgcccaauuuugcaagucuucuuugaccaccaucuggggacuuaccuuucucucuggcuucugaauuuccggcaagaugacacagaauggcuugaugacuuccagaaauuugacuuugauggaagaaacagaaagagaaggaguuagguacggaguaacuugagggcaccugagggagcccggcacgaugagagccgggcgugggcgugcggggacccagaaggcucggucuaggggcgcgggaacgagucccccaggcaggccgcguuccgccaggaucgggaagcacggcgggcgagcgcccaaacggggaaaggcgacgcauccuggcugcgccgggguggcccccaggaaacucacucgccauggcggcggcugauccgacuacacgcccggccccgacugcgcuccacuucgagugaggaggcgcugcuagcuccggagcgcgcuuccucgaccgagagacacgucagugauagcccggcggcgagcggcgcggcgaggcggggccggggaugggccaccggccgcuuccgcuuccugccacgcgcgcccgccgcgccgccugcgccaagaccaca

SEQ ID NO: 3195 - RNA, 979 nt, Mus musculus
guccaggggugagaucaauuucauugucauuuugguggagauguccagauagcugccggaaccccauuuuguguugagguuggaaucaauauuugaauuggcagacuggauuaagaugaccgucuuuuucuccauuaaaggccugcagaacaaaagagcaaaagaaaggaaaguucucuugcucuuccugagcagagcaucugccuucuccuacuccuggacaugacagcccuagucuucagagcugauggagaauuacauaauugagucccuuggcucucaggucuuugaaccagaacaggacuguaccaucagcuaguugccuguaucucuagcugcagaugacagucuguaggguuuccugggcacuggagccaugagggucaauucuuuaccguuacuuauuucuccguugcucuuuagcucucuggggcuuaucuuugacuccgguuuuauccauggcuguguuucugucuuuguucugucuuugucucucccccucucucucccucuccuccuaccccucucccucucucccucucccccucccucuccccucuccauuucucugucucuauccuugacucucugucuauuccucucugucucuaucccucuuuuaacucuaucucuaccccaucuccaacucugucucuucugucucucucuaucucugucucuuuuauuagugaacucuggcuaacagcagaguugaaagucugguagauuguagugccccaaagguucaaaaugugaacauuugacccccaguugguagcaguuuugggggaggguuagggaguucagccuugcuggaggaaguugugcugcugguagcaggcucugagaaucaaaaaccccaccugcuuccaguuugcucucuucuucaugcuaggagugggaaguguaagccuucagcauccugcuccuguuccugcugccaugucuggcacuugcugcuucgauggauccucauccc

SEQ ID NO: 3196 - RNA, 979 nt, Mus musculus
gggaugaggauccaucgaagcagcaagugccagacauggcagcaggaacaggagcaggaugcugaaggcuuacacuucccacuccuagcaugaagaagagagcaaacuggaagcaggugggguuuuugauucucagagccugcuaccagcagcacaacuuccuccagcaaggcugaacucccuaacccucccccaaaacugcuaccaacugggggucaaauguucacauuuugaaccuuuggggcacuacaaucuaccagacuuucaacucugcuguuagccagaguucacuaauaaaagagacagagauagagagagacagaagagacagaguuggagaugggguagagauagaguuaaaagagggauagagacagagaggaauagacagagagucaaggauagagacagagaaauggagaggggagagggagggggagagggagagagggagagggguaggaggagagggagagagagggggagagacaaagacagaacaaagacagaaacacagccauggauaaaaccggagucaaagauaagccccagagagcuaaagagcaacggagaaauaaguaacgguaaagaauugacccucauggcuccagugcccaggaaacccuacagacugucaucugcagcuagagauacaggcaacuagcugaugguacaguccuguucugguucaaagaccugagagccaagggacucaauuauguaauucuccaucagcucugaagacuagggcugucauguccaggaguaggagaaggcagaugcucugcucaggaagagcaagagaacuuuccuuucuuuugcucuuuuguucugcaggccuuuaauggagaaaaagacggucaucuuaauccagucugccaauucaaauauugauuccaaccucaacacaaaaugggguuccggcagcuaucuggacaucuccaccaaaaugacaaugaaauugaucucaccccuggac

SEQ ID NO: 3197 - RNA, 425 nt, Mus musculus
ugauuguugucugcuagagagccuuggcucccuccaugguccuuccuuuaaaagacaaaugccaaacagagcacaucacucauuguaagccauuuguaccucuccuuacuucccaccccucauccagguucccuugaaaauauccaacucggauuuccagguuguuugacuggguggugcuuuccugagucacuuacauggaggaagggaggaggcuugggaagcaggggucaaguucaaugugggcuucugaaaaacauuguugguuucucugggggaagccaacccggaaggccggacgagauauacaguaggucagaguggaggugaagguuuaggaguugccauuugugagcagugaugucaugagcaggcuuuacacagggaaugugaucuggaaggacgauguguccuggggcgcuucc

SEQ ID NO: 3198 - RNA, 6412 nt, Mus musculus
ucagguccccagagugaauucaagcuuuauugccacacacccccuacguccuguccagcccuguaugcggaaauagccgaagcaagccagggcugggugagaaccaggagggagcagguaggacgcugggggagaugggacuaaguucaaagccuaccguaccccaguuuucccugaguggugccugccccaaaucuuggggcuuccuugugcacuggaggaggaggcucaucccaaggacauccugugagguccccucugcccauuguaaugccaucuugcugcgugcacacacugcgcaugccugucaccguggcugcccuggccacggaagggcuuagcaguccaagccaauggacacgagcagguccucgagugcccgcagucgcugcugugccucuucaauggcacuguaugucuggaccgugcuggccacauggaagcggaugucaucgacgagcgggauggagucugucuccugccgggccgcuacagcugccgccucuucccgcacggccuccacgaaauccucccgcucuaccagcugcagagaagcaggcucagcacaggcugcaucccacccucucaggcucccccucucugcaccccugcccaccuucucuaugacuuuggccauauacucgguacacugguccuccagccgggccagccggaacaucuuggcuaugcgccaaacacccaccacacuguccuccuccagcagcugggccaggcugcggccacacagccgcuucaggccaggcagaagguacaugucagccacacucagaacaucguaggccaacucaggaggcagcugugacacgaaaagggacaacaggacacaggggaucaucaagggcucccaggguccagggaggaaaccccaguggaaauacaagagacucacaucucuggagccuggcccaggucuuugggggugcaaggggcagaaucagcucaggagagggggguuccaugccucagucagugcuuaggacuacaggccuuuuaggaaaagcagugugggcucaggcauagaccugagcucuccccauccagcuguggggucccaggcaagucccuucaccucuguaucucaguccccucaucuguagaggauucaugccagccuuggaagacuugaaagaaaguaaagugagcuggagguuucuauuccagcccacagcuugggaauggcuccuuccacugugaaagaccacacaaguuugaggaggagacugcuaggccuuggcuaaggucaagaauccagcuucagaccuuggguggccuagggacugagcagaggggaaaaaaaaauagagggacuaugccaccacacuucuggaugucacucugccaccuaacuauucucuggucguuuggucauaugcucaagacucaaggaaacauacuauucuccaucuucuggggaauacacugaaacacagagcagggauauaacuugucuaagaucacacagcucccgagacuaaucuacuguuugacaauguucagaggccaguccacacucugagcuauuaaaaauguucuugggguaccaagcuucuuccagagagagcuugcgacacaggauuucagacucaaccucagaaugaguggcaggccaugagaaaggaagugaggggaagugacagaaggaaggcuagugacaaagccuaauacagagggggcagguuggugggagccagauggccaggacuggggucaccagaaaaugauguagggacacagauuccuguaguuccaucucaguaacagagaacaaagaggaugggggagccacagccugggggucagggccaccauuucuacaaagaccuuuccuggaggcugaacagcccugacaauaccauauggcccaccagccuuaaaacauuaccuuccuagggaagauuuguggcaaugcccuggaaaaaccagacaaaggggcaccugggaccccagcaagccaccucaccccucagacccaauggaaaauacacuucucuccuguauagugcccugcuacacugccaugaacacauaccaacagagggaaccuuugguacugucuaaagccacccacaggccuggcucaggaacucugggacagcuaagugcaggaaugacccaaggacugugacaacacuacggcagacggcccagggcuuguucaccacugcccuccugcugggcgccacuucaccucgguauggucacuauauacguaguacaacacgugaaugaagauguccggggagaugucaugcagggugacaacugggggaucuccagaggcugcaggcuccucacucucuugaaaguggucauccagaagggcccggaaguagucacugcggccacagaagaaagccugaggaagcaaggucacaaaggaccagggcucgaaucugccccaaggggccagcccagggcuugagcagcgcggccaggggugggacagguaccuuguagcagaggaagcuggagucagccacucggaagcagauaucggggcagcugcugaagccaucgggacaugggaagggcagcucuccaaggucacccugguauaggaaagagacgacucagagcaaagccguucaugaaagggaaguagcuucuagguuggccuaggaagggaacccagcucuguggaaccugccccucacagccccaucccuagacacccaucaugcccaccaagcuggcaugcccuucaauacccgcagcucagauggcagggcacagucagcuagcagggccauaucugcccguaaccggggaucugcuggaggagguucaauagucagcaccuucacacacgugccaggcuuggaagccacuggggggagaagacggcagggacuuagagagguggaccagagcugcaggcuguaacccaagaccuuggacugagacccuguacacaccaaauucagacaccuucucgcacuuagccuccaggucauccagcaggucccacagcuggcacugcuuggccaggcgcucacagucacucacguguucuacaccgauguccaagcggccugggggauugaggaggcugagucaggaccugagagugacuccuacucaauaccuugguuuucucauccggaaggaccuaagaccugcucaauuuguagaugggaccuguccucuccaaacagguuaagucaugcugggcacacuccuccuccccaaaggugacaucagcucugggccacccugggugugcugcugucccagcccacggggucggucagucaccuguauacagguacugcaguagagccccaaaggccaccggguugaucugcaggcagaguagaaagggaaggucagaggcuaccacccagcaugaacuaucuguucucccagaaacuggcacucucucccaaggcagauggacacaccagggggugccugagaaccacgacgcucuugcccuuccacuugguguccagcauguuggcgaaguagguacugcgagcaccgaggauacagcgaugggcccggaacggcuuuccguguaccacaaagaccacaucgcuguggaugcccuguuccagaagccugggaaaagccaggaaagguugcaucauccugacaacugcuggcgcaccaggaccacucagcaaacccacccaccagaacccacugagagugcccagcaaccccagcaguacugcaagcuccacccccagcucaccgcugcaggaaaucgucauaguaaucccgccuccugcaggacgcagugaccuguuuguagucucucagugcacggcgaauagggucgcuuagcgcuccguagagacaccgcucuccaucaaagguguuggccucacagcgggcuccuacaaagcaaugcucaucagucagagucaagggaacaccuagucuggggagaucucuggccuccccagcuccccagaggcccuuccuugccacagaggcccaggcaacccuucgguccuugggaaggccaaggcauacaaucugugcacuuagauguaggcauacucaugaauacacauguaaauauuggacuauaugcaguuaaggccagacugaggggcuggcccuguaaauagccaucuuggugacuagcagaucccugccccaacugaaccuaguggagcccaugcauaguuuauuauaugacagccggcauuauuacaaaacagaaccaagggugacuauggcaguggcagccacauggggagaacugugaagugagguggcuaagcacagggacuugaaagaagcgggagaugcauagaucuaggaaggaacuccagucuaagcaggaaguacugcaacugagaagacccugagguaggagauggguaggucuaguggggcagccagcaggugggagacccaaggaaggcaaagugagaggaggucagagugggucucacaauguagcccugacuagcuuugaacuuaagauaaucccugucucgacuuuucucucucccaauaauuuaauugcaggugugggcaaccaugcccacgugcuuuuaucccaaacacucccaucagcuuugcuguggaaagauccuccugccugcaaauauggagaucagagagucaguuuagcagaccaauggugguacaguacaggagacagccccagaacuggccugggugucaaggguaacgugagaaaguggauagaggguuagagaguacuauguguugacuuuagggaguuaacaagaaaucaagggugcauacaaacauggagcaaggucucagagcuuacaggcagacccugacccucucucaccauuagccaacagguagcgcaccaacuccucaugcccacagaggcaggcauaguaccuaggaaagggggaagcugucaguaggguaggcccacccugcccacccagcuaccccaccgcucacacucacaaaggggugcugucccacuuaucccgcacguucaccuccacgucucgcugcuccagcagguaccugggcaggaaguucaaagccugggucagaauugcuucucaucugggagagagacaaccaggaaggggaaggaggccacaucucucugggcuagggaaugccucugagaaggguaaggccugggacuacacaggucugcaagggucugcaacugugaguugggugauggcuucauggacagaggccaagccccagguucagaaggcugagaauuuggucuuuuaauaucugggagagagaaggugauggggccccuaauucagccuggggagccaauggcagggaagucagaagaaagcugaugcaggcacugggggcggggaaggaggggaacagaacagaucuauggaagaaguggaaaaaacaauugauaaaauguugaggagaagaggucaugaaccagaaagcgaucacugggacauggcagcccaaggaggcuaucugaggcaagaccugaacucucagagcugcauucaaauugagggacggaucauuaacucugagguggcaucuggugucggagagagcugcagcuuggucacaucuguugaggaccaggggacuuggaaggaagggccaugggagaaaggagucuaucaaagaaaagggucaggauccuucucuucccugccugcccacggagaucacggucucggcgccaggcugguaacuggcugcaccagcggcgccugcgccucuuggaaccuccacggagaggagucguuucccugcaccgagcuaaguaagggaccuagagcccgaucucccugacucggucagcuucgggagccccacggcgcccaaccccacacccgugcccgauaagcccugcggacgccugcccgccuccugcacuucagguucucaccgcacacggcccacguccccuuuccugcagcuggcaaacaagucgcugguauccauggcgaaagagacuggacccccggccgagugaucucgggagucgucugugcccggccggauguaaacacucaccgccccgccccucgcggcacggccuagcuaugcccgccugcgacuccgcagcggcgccugccgcccggaggaccguccggcccgaaccccgcccucgcauccagaaggccgcuccccaaggccgcacccaguaaccuuaaccacgcccacuuagccucuggggacuucuagccuucaccccgcccacccgucuagaggacaacucaauucccccagguuccgcccacucgcccgaagaauagcucacuaccaagaccccgccuccucagaagagcuucaccggaagagcaguucgcugcaggccccgcccacauuucuugggauccguucugaaaacagcaccucccacaggcuuggaacgcuugucaguccugagucuagcucgguucaggucccgcacaucaggccgaggccucgcccacca

SEQ ID NO: 3199 - RNA, 6412 nt, Mus musculus
uggugggcgaggccucggccugaugugcgggaccugaaccgagcuagacucaggacugacaagcguuccaagccugugggaggugcuguuuucagaacggaucccaagaaaugugggcggggccugcagcgaacugcucuuccggugaagcucuucugaggaggcggggucuugguagugagcuauucuucgggcgagugggcggaaccugggggaauugaguuguccucuagacgggugggcggggugaaggcuagaaguccccagaggcuaagugggcgugguuaagguuacugggugcggccuuggggagcggccuucuggaugcgagggcgggguucgggccggacgguccuccgggcggcaggcgccgcugcggagucgcaggcgggcauagcuaggccgugccgcgaggggcggggcggugaguguuuacauccggccgggcacagacgacucccgagaucacucggccggggguccagucucuuucgccauggauaccagcgacuuguuugccagcugcaggaaaggggacgugggccgugugcggugagaaccugaagugcaggaggcgggcaggcguccgcagggcuuaucgggcacgggugugggguugggcgccguggggcucccgaagcugaccgagucagggagaucgggcucuaggucccuuacuuagcucggugcagggaaacgacuccucuccguggagguuccaagaggcgcaggcgccgcuggugcagccaguuaccagccuggcgccgagaccgugaucuccgugggcaggcagggaagagaaggauccugacccuuuucuuugauagacuccuuucucccauggcccuuccuuccaaguccccugguccucaacagaugugaccaagcugcagcucucuccgacaccagaugccaccucagaguuaaugauccgucccucaauuugaaugcagcucugagaguucaggucuugccucagauagccuccuugggcugccaugucccagugaucgcuuucugguucaugaccucuucuccucaacauuuuaucaauuguuuuuuccacuucuuccauagaucuguucuguuccccuccuuccccgcccccagugccugcaucagcuuucuucugacuucccugccauuggcuccccaggcugaauuaggggccccaucaccuucucucucccagauauuaaaagaccaaauucucagccuucugaaccuggggcuuggccucuguccaugaagccaucacccaacucacaguugcagacccuugcagaccuguguagucccaggccuuacccuucucagaggcauucccuagcccagagagauguggccuccuuccccuuccugguugucucucucccagaugagaagcaauucugacccaggcuuugaacuuccugcccagguaccugcuggagcagcgagacguggaggugaacgugcgggauaagugggacagcaccccuuugugagugugagcggugggguagcugggugggcagggugggccuacccuacugacagcuucccccuuuccuagguacuaugccugccucugugggcaugaggaguuggugcgcuaccuguuggcuaauggugagagagggucagggucugccuguaagcucugagaccuugcuccauguuuguaugcacccuugauuucuuguuaacucccuaaagucaacacauaguacucucuaacccucuauccacuuucucacguuacccuugacacccaggccaguucuggggcugucuccuguacuguaccaccauuggucugcuaaacugacucucugaucuccauauuugcaggcaggaggaucuuuccacagcaaagcugaugggaguguuugggauaaaagcacgugggcaugguugcccacaccugcaauuaaauuauugggagagagaaaagucgagacagggauuaucuuaaguucaaagcuagucagggcuacauugugagacccacucugaccuccucucacuuugccuuccuugggucucccaccugcuggcugccccacuagaccuacccaucuccuaccucagggucuucucaguugcaguacuuccugcuuagacuggaguuccuuccuagaucuaugcaucucccgcuucuuucaagucccugugcuuagccaccucacuucacaguucuccccauguggcugccacugccauagucacccuugguucuguuuuguaauaaugccggcugucauauaauaaacuaugcaugggcuccacuagguucaguuggggcagggaucugcuagucaccaagauggcuauuuacagggccagccccucagucuggccuuaacugcauauaguccaauauuuacauguguauucaugaguaugccuacaucuaagugcacagauuguaugccuuggccuucccaaggaccgaaggguugccugggccucuguggcaaggaagggccucuggggagcuggggaggccagagaucuccccagacuagguguucccuugacucugacugaugagcauugcuuuguaggagcccgcugugaggccaacaccuuugauggagagcggugucucuacggagcgcuaagcgacccuauucgccgugcacugagagacuacaaacaggucacugcguccugcaggaggcgggauuacuaugacgauuuccugcagcggugagcuggggguggagcuugcaguacugcugggguugcugggcacucucaguggguucugguggguggguuugcugagugguccuggugcgccagcaguugucaggaugaugcaaccuuuccuggcuuuucccaggcuucuggaacagggcauccacagcgauguggucuuugugguacacggaaagccguuccgggcccaucgcuguauccucggugcucgcaguaccuacuucgccaacaugcuggacaccaaguggaagggcaagagcgucgugguucucaggcacccccugguguguccaucugccuugggagagagugccaguuucugggagaacagauaguucaugcugggugguagccucugaccuucccuuucuacucugccugcagaucaacccgguggccuuuggggcucuacugcaguaccuguauacaggugacugaccgaccccgugggcugggacagcagcacacccaggguggcccagagcugaugucaccuuuggggaggaggagugugcccagcaugacuuaaccuguuuggagaggacaggucccaucuacaaauugagcaggucuuagguccuuccggaugagaaaaccaagguauugaguaggagucacucucagguccugacucagccuccucaaucccccaggccgcuuggacaucgguguagaacacgugagugacugugagcgccuggccaagcagugccagcugugggaccugcuggaugaccuggaggcuaagugcgagaaggugucugaauuugguguguacagggucucaguccaaggucuuggguuacagccugcagcucugguccaccucucuaagucccugccgucuucuccccccaguggcuuccaagccuggcacgugugugaaggugcugacuauugaaccuccuccagcagauccccgguuacgggcagauauggcccugcuagcugacugugcccugccaucugagcugcggguauugaagggcaugccagcuuggugggcaugaugggugucuagggauggggcugugaggggcagguuccacagagcuggguucccuuccuaggccaaccuagaagcuacuucccuuucaugaacggcuuugcucugagucgucucuuuccuauaccagggugaccuuggagagcugcccuucccaugucccgauggcuucagcagcugccccgauaucugcuuccgaguggcugacuccagcuuccucugcuacaagguaccugucccaccccuggccgcgcugcucaagcccugggcuggccccuuggggcagauucgagcccugguccuuugugaccuugcuuccucaggcuuucuucuguggccgcagugacuacuuccgggcccuucuggaugaccacuuucaagagagugaggagccugcagccucuggagaucccccaguugucacccugcaugacaucuccccggacaucuucauucacguguuguacuacguauauagugaccauaccgaggugaaguggcgcccagcaggagggcaguggugaacaagcccugggccgucugccguaguguugucacaguccuugggucauuccugcacuuagcugucccagaguuccugagccaggccuguggguggcuuuagacaguaccaaagguucccucuguugguauguguucauggcaguguagcagggcacuauacaggagagaaguguauuuuccauugggucugaggggugagguggcuugcuggggucccaggugccccuuugucugguuuuuccagggcauugccacaaaucuucccuaggaagguaauguuuuaaggcuggugggccauaugguauugucagggcuguucagccuccaggaaaggucuuuguagaaaugguggcccugacccccaggcuguggcucccccauccucuuuguucucuguuacugagauggaacuacaggaaucugugucccuacaucauuuucuggugaccccaguccuggccaucuggcucccaccaaccugcccccucuguauuaggcuuugucacuagccuuccuucugucacuuccccucacuuccuuucucauggccugccacucauucugagguugagucugaaauccugugucgcaagcucucucuggaagaagcuugguaccccaagaacauuuuuaauagcucagaguguggacuggccucugaacauugucaaacaguagauuagucucgggagcugugugaucuuagacaaguuauaucccugcucuguguuucaguguauuccccagaagauggagaauaguauguuuccuugagucuugagcauaugaccaaacgaccagagaauaguuagguggcagagugacauccagaagugugguggcauagucccucuauuuuuuuuuccccucugcucagucccuaggccacccaaggucugaagcuggauucuugaccuuagccaaggccuagcagucuccuccucaaacuuguguggucuuucacaguggaaggagccauucccaagcugugggcuggaauagaaaccuccagcucacuuuacuuucuuucaagucuuccaaggcuggcaugaauccucuacagaugaggggacugagauacagaggugaagggacuugccugggaccccacagcuggauggggagagcucaggucuaugccugagcccacacugcuuuuccuaaaaggccuguaguccuaagcacugacugaggcauggaaccccccucuccugagcugauucugccccuugcacccccaaagaccugggccaggcuccagagaugugagucucuuguauuuccacugggguuuccucccuggacccugggagcccuugaugauccccuguguccuguugucccuuuucgugucacagcugccuccugaguuggccuacgauguucugaguguggcugacauguaccuucugccuggccugaagcggcuguguggccgcagccuggcccagcugcuggaggaggacagugugguggguguuuggcgcauagccaagauguuccggcuggcccggcuggaggaccaguguaccgaguauauggccaaagucauagagaaggugggcaggggugcagagagggggagccugagagggugggaugcagccugugcugagccugcuucucugcagcugguagagcgggaggauuucguggaggccgugcgggaagaggcggcagcuguagcggcccggcaggagacagacuccaucccgcucgucgaugacauccgcuuccauguggccagcacgguccagacauacagugccauugaagaggcacagcagcgacugcgggcacucgaggaccugcucguguccauuggcuuggacugcuaagcccuuccguggccagggcagccacggugacaggcaugcgcagugugugcacgcagcaagauggcauuacaaugggcagaggggaccucacaggauguccuugggaugagccuccuccuccagugcacaaggaagccccaagauuuggggcaggcaccacucagggaaaacugggguacgguaggcuuugaacuuagucccaucucccccagcguccuaccugcucccuccugguucucacccagcccuggcuugcuucggcuauuuccgcauacagggcuggacaggacguaggggguguguggcaauaaagcuugaauucacucuggggaccuga

SEQ ID NO: 3200 - RNA, 15442 nt, Mus musculus
aacccaaaguacaggacacauccacaaagcagaucuaaccagaccuacuucauuuugaaacugagggcaggcagaaagggccuucaaaaagcucagggaagccuuguugguacauuaaaccagaaccaaagggauagcgcuauuuagguuuuauucaaaucuauuaaaaaauaaacuacaagaaacuguacaacaagcaaaugaaggcacuggcuaggugggaagaaacccaugagaggagcaugggcccucagcagacagggucuugugcuccuccaucacaggcuuugagaauguucuggaaaaguuugcaaauacuucuaaguugcucuuugucuaaaggggaaaacaaaacaguccagaaacacaacucaugccaaaacagcaauaguuuugauaaagucugucaccugaacacaaccccagccuucuaaugagccuuggacagagggucuggccaagaagagugcucuagaggggggcagaagaauaaauagucauuuaaugcuacagccuuggccuaggggcucacagguaaaggucugcauuaagccauccucccaccccuacagggcaccaagccccaguggaagugggaagugacguaggcucagcguggugaccgagccucauucagacauagaggccccugugcuggucucagaacugcuguaggaucaguuugcguuucaggucacggcugaacuuguugaauuugaagaggucgcugucguagaaggcagagagguugugaauauugaucugccuggccuggagaaagaacagcaucagagccauuagcaggagaagacgccggccuucaccucuggaagggcuguguugguucagagcuccagaccugagcuucaccagccacagguacucggacaaggcugcugguaccuguuucccuuugccuaucgcuagcucaagccuguuacugaugguacaccccaaauggccaagagcuccccagagcaacaagcccugcccugcccuggcccgccccgccccgccccacccagcucuugcauaccuuguccaucagauccuucucagguauuucaaugguguccugcugggccccaaagcgguugcguugauaugucaccugcucagccaccaacugcuucaguaugaagagcagcagaucauuguuaucucgccggaaggagagauaccgggcaaaagucugugaaaagaggacagaggucagaagcucacuugccagccuugucaagccaccuucauggcuuaaggggccacagcuaaccaaggcuccaggccacuuuuccagucccuaaaacaggccaggaaccuggccucagccauacacaccuaccuugcgcauacuccgcaugacgcugaacuucugggugucaaugaagcucuccaucaucacucggauggccauguugacaucgucuuccaucacguagucccgcaggugcaugcgggcaugggccucggccaugcggaucauggacucgauguggcgcaccgugaugggaaugcugcccguugccugcagagaacaauguugaugcuuuccucagaggaggagggggcagaagggaccagaggcaaaugccaggcagccagagccaagaugaccaacggagcagcaucuccggccaugcucagcuccaaugccaggugcaaaacccuggccuguguggcugccacuggcaccacuggcuauucugcucuuagcuuguaccccccccccccccagucggcuacaccugcgucuagcuuacauggagcgcugugagauccagaacagugagagugaagccaucguuucuguaugaaccaagacaguggauaauguggauaacagaaaggacaaaagcaaacccccgcaaacgaaaaaaguccagcuggcuucuuggugagguguuguaagauagccaguggcuggccuugcaaucugguaccaaaccagcuaauacagaacuuuagcaaucaaaacacuaugacacuugugaugguuuguauauucuugggccagggaguggcaccauuuggaggugugaccugguuggaguaggugugccucugugggugugggcuuaagauccucacccuaguugccuaggagucacucuuccacuagcagccuuuggaugacauagaacucucagcuccuccugcacccugccugccuggaugcugccauguucccaccuugaugauaauggacugaaccucuaacauguaagccagccccaauuaaaugcuguuuuuauaagacuugccuuggucauggugucuguucacaguagcaaaacccuaacuaagacaacacucuugcacacaguuaaaguucaucuguaacucaaugguuaagauauggaaugccauuuuuuuuucuucccagugcuggggaagguaccaugcccacacaaggcagacacucaccagaguggugccaagccauuuaauacugccuguucugaccccaccgugucuggcaccagugcagggucccacuggcucaccauggacuccuuccucaggucacuguacauccuggccacuuuauccugguccaucugguugagcuucgggcggacccucuccuuggcauagaugauauacuucuucagcaccuccugaggcaggggcuccacgccauauguguugggcauggcuggcuccaaggugccaccauuagucaacccuucauccuucuuguuacugggguggugucugacguggcugccaaccacaaagcgggccagcaucucauccuaggacaagaaaucaggagagcacaauaaggguguggguaggaaggcaggaaaagcuacacagcaaggagagugacugccacacuugacugaggccaggcaggcucgcgagcgugcagaguagugcuaggcuuagagggggcaggagacagccgugcaccagugacaagcccagcuacucaggagcagagacaagacuugaacccaggaauuaugguaaauuaagggaaacacagugauaaaaaaaaauggaaccacggcgaaucaagugguccagaagccucucaccacaggagagucuaagaggcaucugugggggaaaaggacacuccagcagaaagagcacauucaaagcccgaggucaccucuugggagaagaggcaauggguucauuuaacaugaagacagcagcugcagagcuggcuggggcaaugcacagcagcuauuccccccccacccccacccccagcaggugcagggcuggcaggggcagugcacagcagcuaucccccacccccaaccccagcaggugcaggguggauguggaacaugugcuggccacaaagcagagcuuuuguggguccccauggaggacaggugccguguaauuuauucuuuuaacuggcaggcaaauaagcaaccauccuagacaacagcagucucuuggguuagagggcagagcuagaggaagggauauaggacaggguauagucugugacuagacugaguaggcagccagggaggaccuggagaagcccuaaaaggucaggaugacaccuggguaugaagacauguccacccagcacccagcacagcaggcaauggcccagaaccugcagguggcaccagggauaugggaauguaccugaacuggaucaacagugucccucaccacacacaggacaucaaagcgggaaaugaugggcucugugaggucuacauucucugagaaggucagugaagggucguagcggccuccugaaagauuaagaggcaagcucucaguccauccauccauccauccacccauccacccccccccccccccgccagggcucuggauccuuuuucaggaccugggugccucuagggcagagugggggguagaggaaagggaagggauuggagacacuaugccucauuccauuaaaaccagagcugcuccaaagcaaaguucuacucuaauaagauaaacgggccccuagguguuagucaccuccuggcugggcaugggugcagcuccagccccaucuggacaaagaaucaaagcacccaaaggugguguaaggaacagauggacaaucacccuggguucccacguccuuccucugucccccucugguaggucauguuggauggggcugugugugcugucauucccaggccuguacuacagcaggcauaccuaugggguuggcagcagcuaugacagugcagcgggcuugcagcgagguaacgaugccagccuuggagauggagaugcuuugcuguuccauggccucguggaugcugguccuguccuggucauucaucuacacaacacagggcaucccaagaggccuuaauacucucuaauaaagcccucccaccacagagagcucagccccagagcccagauacccaccuugucaaacucgucaaugagacacaccccccggucagccagaaccagggcucccgccucuaagguccacucucugcugacgggaugccgcugaacguacgcggugagacccacugcugacgcacccuggccaguggugaagauggcacggcuagacacuuucucgauguauuugaggaauugggacuuugcugugccaggguccccacacaagagcacauuaaugucaccucgaaccuugugcuuuccaccugcaggaggagggccagaggacaggcuagaucccuccaacucaaaccuguuccucagcaaagagagagagaccacagccaagcagcagagacagcccaucagaguggaccagggugagcauguccacgcucccugcagccucuuguuaacucuuaugcuuaauccccucagugagggcuggcaagggggguggggcucaccuggguucuugggcuccccuccaaacagggccagagccaggccucucuugaugucuucaugcccauagauggagggugcaaugcuggcaaagaucugagggauagagggagauucaugaaacugaaccuaacaggcagguaagaaauuuaaguuccuaccuucucucaaugaccgacuacuaucagggcaugaagccaaauaaacucuuuccuccccaagcuacuuuuggucguggucuuuuuuuuuuucccuuaaagauuuauuuaauuuauguauaugaguacacugucguugucuucagacacaccagaagaagacacuuggaucccauuauagaugguugugagccaccaugugguugcugggaauugaacucaggaccccuggaagagcagucagugcucuuaacugcugagccaucucuccagcccagucauggucuugauauagcaagaaaaccaaccacaacagcaguuucccuuagagcugauagagccacacauaaaaucucacugagaggcucaaagcagcaagacuggcuaugacugacagcuaugaccuggggcagaguguccagugcugugacuguuauccccagaagccacaguccuagccccagacacucaguuuccaggacgaccaucaggcuggcacggcuugguaccauauaccauaggcugaaccuuugcccuucugguacacaacaucuucugucaugucacggaggcccuugccucggguaaccuuugauccuagacuuccagagccugccaccaagacccauauuuugaggcccugcccagcagguagggggccuggucccuggaucccagccaccugccuucucuccaauuugcugauccuuggagagaccggugaucaucuucacguccucaucggugagcucccccacagcuacuuuguuguccuucuuggcaacaugguuggccaagauaauaguggcaaagacuggaaagccguuggcgguguuaagcgagccgucauaguuauuaugguaaaugccggucagcuccugggaaagggcagucacaagucagagggugcaaccugagguccugagcuaucguagggcccacauccaugcugcuuucccuggcuccaccccacgcuccccacacugcaaacaagaugaacagcccaacaggcucagaaacacgagcuuugucccacggugcuuugcaugagagggagcgcaaggggcagaggaaggagcuguucauuaagguuucauucucaucuuggcacaacuacaaaguguuagugaagucacuuaaguugugcccuugagaagggacucucuagacccugacacaucucccaguucucucugcucucuagcuccaugagauguguggcuaccuccacagccacaggcccaaagaccaugaacugaggccucucuggcacugacccaaguuaaacuuucucuccuguacuaucacagcaagauggagcaacacccgccacuccaaccagcaggaaaaaaagcucuccuucugacucaagagcuggugccaggcugaacgcacccauggacacggacccuaccuccacuggccacagcagauaccaccaguuucuaacagucacucacuaucucguccccuggcuugcagcuguccaccagaucagcgaggagaauggcauccuuggaacggggcagucggccagccgccaccuugccgggacucuccuggaugcggauacguugguaguucugauagauggucugcacaagacaaaggucaugguuccuacacagccaaccgcucuccucaaagcacagcuuucucaugugcucugaccuuacugcaggccacgaaagccagagaccaaagggcaggccaacuaugacucagaaagucucuucaccugccacgaucccuagacagugucuucaucccugcccgaggcuccagcaucugcuaggccccagagccuagauuuaaguguguccacaguuggcagaaggggaugccgagcuuuaagcaugaccgaccuuaugagggucaagcugggccaugugugcggcaucuauagcagcacccucaagcggcagagcaagaccaaaugguagagagucccacuaguucauuuacuauccaaaaagagacaacauacuacagucugggcugcaaaugucccccauggccuauuuguggggcacuaauucuucaguccauguaugagaggcgaugaagccuuguggagggccuuaggucacagagguaugcccuugaaggggacuauaggauacuggccagucucuuuucucuucugugucucugaugugagaugagcagccugcugcaucacacacaggcacaaagccacagggucaacugaugacucuaaaaccaagccauaaaucaacuuuucuucaaguaauugauaccagggguuuguacaggcacccagagcugacugauccacaagacacagcagcuaaaagagcacacucucacacucucaggucauggugguguacaccuuuaaguccagagcuccagagguaaagcuagguagaugucugucaacuugaggcuagucauggcuauauaguaagccccugucccaauaaaagaagcauacaucacaucuauacgcuugccugauccuuaagaucacugcugcccaggagaccuuagacaaucaagccuccaaauacccauuuuuuuccaugagaagagagccucggaaccucucuccccaaacguaaucaagacuaagacccaaggaacacacugggcagccagcaaggccagcacauacuugaccccucuugcuaauccccgcacaguacagcucagugucccggggccagagucuaaguuugagacacagcuaagguggggcugcaauggaaggagagggcacaacuaaauagagccgggucacgcggguuaaagcagaccuggacuuaaaacacugucauaggcaacuuccuggccagacagcucuaaacuagacagcucagaaccacagaaagcaucaagugugcuaacacuccugaagccaggcauuaugagggggugggggaggggaggggcagcugcagaugaagacaagcacaggcaugcaugcuguacccaggauuucagaguccagggguacaugagccuucaaagcagggcucuacaugauccaaggugguuauaacccuggaaacacccacaaaagguaccaggagccagucaagcccaccagauaagaugguccagauucccaugugaugggcaaguagugcucuauuggggugggcaggaauaagagggcccugcuugcccaucucucuagaggucacaaauguggacacaccaaacaggaucaccuaauuucaaauauacugaauucuugaagacaugaggccaaucuaguucaugcugccauguuuaacugccuuaaagucuucuggcccuguagaugggcuaggucuuucuugcacacucaagauggcguggcaggucuggguuacucaccuccuccauguugaucucaaagggcccagcagacuggcacucagggcaggagccaggcuucaccuccugauucugagacuggcagaaaggccccaguacaaaguugcacuugcuacaguuguacuugaccaugcugagcuggggcaggacuccggugcagcuggucaccacgccacugguacggaucagcugguucaggugcaacugccuguguugggaggugacaggcacaccagaaguuaugggguuacuuccuccaccgcucucugggcaagggagaccccacucucucccccugcucaccucagugaacgcagcuccuccaccagaggcaggugggagaugcgcacauggaugugguuggugauacggucauauuuaggguacauggccaacacgaccuccagggcagccucgucaaagaucugcagcaacucagccggugcuuccggcaggaaguaugccaacacgugcucccgggcugccaggucuucauaauuuaccaccaaacucucacgguucucuaaggaggauagagggugggacugaugacauagcuggggucaugaaaguagcuaacaucuuagaacccugcuggucaaagcccucucuacccaaaccaaaccuaagagggccagaaaguccagugugcacccuaggcccacucuguggcugugcaauggagacccaagugguaacauuaacagcauacaaaucucugaggaugucauuuccaggaggaauagagcccucaggcuacagagcagugugccccaggccauagagaagcuacagaagaacuacagccauugcuggagggguugccacagccccacgcugucauacccuguaaagccaaugcugucacacagaaagacugccauuuuugcaucaaaguugaaaugcacaggcuggagaguggcccagugggagaacacuggcuuagaaugugcuaggcccuaggcucaaccugauucugcaaaaaccaaccaaccaaacccuccaaaaaccaaaacagggucguaauacauuuuuaaacauguccccaaacagccuagcucuggugcagauacaggagaccuugggguccucagguucaguccuugucacccaaugcuccugugcauucugaguucagugcggcacacagagccagcaggauacagaagccaggccaccuucaccccccagugcugagacugauccaggaccucacucaagagagaugcugcaccucugagccuugcucgccccagccuaucaggaccauaccuuugcacauaucacugaugcgcuccuugaagacguuguggccauggcuguccacgugggugcgcaggaaguucuugaagcggugguggaucuccagccugggcccugccaugcucacccacucgcgcaccgaguggcccuugagguccuccagauucucaauacucucgaucaucucuucauccuccucgccauccucuguggcgcguucuacguggcggcgcuuacgggcaggccgcuccucaucuuccucgcugcugucuuggguagcaaagcacccccgugagcaagccucucccagcauccucuacacaacacucgcugcccacgucuuccccauuccugaugcuuuggacguccaaguggcaccucugggaugcccaccacacauaccauagagcagcccccggcgcaugcgucccaggccucugccagccucacggucccgcugccucaugguccgcucagcugccucucucugacuggcugucagcuccuccacaucuucaucauccagggccaaucccucggccucguagacaucgagcuccggaaugggacgguagucucugcaagagaccaacaguggacaaugaauccccaaacaacccacuuaagaauuaggucugcuccacgggcuuacaaaguccuugcuggacagcugcaaacaggaaguugaaaguuugaagaauaugauuuaggaacuccgucaaggaggccgaagcccccaggauggaaaagggagucuuuuuccgugcaggagguacacagccaugugaaucuggguggagagcaagccccacauccacagcgccaccugcuggugguauaugauggauguggccagugcuuccucuagaugcagucucccccaaucuugagaaaauuaccaaccaaguaucaaacaaggucauuuuuacaaucuucaaauggcaccaucuucaucagacacuagaaaacaugaaacugucagggaggaaaugggggaaucaugacacagaacagaaacuaugaaaaccuaauaaaagcaauagaacacgcucuuuggauaacaaacgugcaaaaucucuagaauuccacgaccccaggggaaaugcaagguacugacuggcuaacccaagucugcucucaacagugugaacacguauggggcuagagaugcuucggggcuuaagagcaguguacuaauacucuuucuuuuuuugacacaggauuucucuguguagcucugguuguucuggaacucaagagaucuuccugucucugccucccaagugcugggauuaaagccgcguaugugggugccacugugccuagcucagacugcucuugcagagaaugagaauucaauucccagcacccauagcgggcaccugcacucucaaauguacauacccacagaugcacccucauauauaaaauaacguuuuaaaugaaaacaacaaaacaauuuaaccagguauaguagugccggaagaccgccaggcagaucugagaguuugaggccagucaaggcuacauagugagaaccaaauuuagcgguauuaucccaggguggucaauggauaaaccuacacuguagauuaucacucaaccuuaaaacagaaggggacuauaagaggugaagcugcucggaucaaucuugacauuacaccaauggauaaggccauaaccacucccaugggggccagaggggucagacccagaaggacagccaaauggggacggggagguagcguuuuggggggaagauuuaaguuuugagacgauaaaaaaaaguucugguggaaugaugcagaugaacgccacugagccacauacacgaaaaacggagaaggcacuuugcuguguauuuacaacugaaggggcugggcuggagcgaaggcgcagugcgaccugaguucccagcacuccgaucaggcagcccauaaaccaaccuguagaacuccaacgucaggcaggggauuugacacuuucuucugacuucugcgggcaucuauacacucaugcgcauacacaccagacacucaaguauacacaaguuuuuuguuguuuuuguuuuuaaauauggggaaaucuccaaagagcuccuaacucccaguaagaaaaggaguuaagggcuggagacaaggcucagugaagagcgacagguacucuucaggaagaccuggguucaauccccaguacccauaugguagcucauaacugucuguaaccccaguuccaggggaccugauacccucacagagauacacauguaggcaaaauaccaaugcacauaaaauaaacaaauaguuuuguuuguuuuuacaauuuuaagaagaaaauaaaacagaaauagaggaagccaagaccuugacaccagcaaggucagagagcagauuccagguguccagggacuauacccucccuaucugucuaugccuuucccccagcugaacacaacccagccagacuggcugacugaaaggcucacacccacuggcucaacugucugagcaguuucuuuccagaugaccacuuguuaggucuuugaaaggaagaaccaucuaacagagagccaggcccagguucccuauggugugagucccaguccccucaaggcgaugcccuuucaucuuugaagggugaugugauuuuauaguagaucaggacacaaggggcagaugcagugcuacaggcugcaagcucuuuccucaucgccacauggccuccccacaggagggggcaccuagcagagaaacagaccccggaguucucccuucuucagggugacuggcuaauguucucaaacuacccucucaaagcaaccaguuucaaaacaccagaggcaaagcagguagaagugcagacugguccuacguagaauguagugguuucugaggaaaguguguucugacccuuaaaggaucucaguccaccggaaacacacgcacucagugagauucuaguuagucuacagcggaacaggccacacagucugggguuggucaaauuucaacuccagaagcuguccuugaacuuccacacgugugcuauggcaugugcacccauacacaaacacacaaugagcaauguaaugaaauauuuaaaaaaaaaaaaaaaaaaaaaagacuuuuaaagaaaugacccggcugcucuugcagaaaaccugggcucaguugucggcacccacaagguagcucacaaccauggggucugacgcccucuucuggucucuacaggcauaggcaugcaugugguaaaacacucaauacacaccuucaaucccagcacuugggaggcagaggcggggguggggugguucugaguucaaggccagccuggucuacagagugaguuccaggacagccagggcuacacagagaaacccugugucggaaaaaaacaaacaaacaaaagacugaacuuugaaaacuccagaguaaaauguuggcacaaaaggaugaacaccaagacuccaguucugguaauuugauuaaaacugggaucaacaggcagaagagaauggcuugcagaaagcuugcacacaccgucuuugcacugaaggcuuauaauauaaaacuucguuucuuuccauacaaacccugagucagauaguccucagacaucucuaaagugucucucacuuuaaagaagaggagguggcccuggagccccccuacccccccccgcggcccccccagcaacucugcaggaaagcccuugcugcugagcccaggaugaucaacuccaucaguccauggacacucacugcagacccagucucuucacaccuagccuggcaguguguaaagaaaagaaccagauggugcagacagcccagugauggcucauaccccucagauauccccuacggaaagguacaaaagcaaggugccaaaagccuccuaaguggccacauaacuggugucgguaagggagaucucccuaccuccuggcaaagcucaguuuccugacggccucagucaccuucuguaugucugcuuacaacucugaacacuugugacccagagccugaugcaggcugggugcaaguuugcugacugaaccaucuuuccgaguuggugccacccuucagggcucuucagaucagacucuauggguccccuucuccuaagcgggggcuugccugggcuuuagggucuagucugagguguauacagugagcuaaaugcaucuucccagugggugaugaaccuccacaucccaaccaagccauauacaaaggcaaagucaccagguuggcucauacacucauggguccccaaggccaggccaccagacacggggggggggggggggggggguccuucugcuaagccaccuaaccacagccuaccucuccaugccaucaccaaugaguuccucuccauccucuucuuccuccaugggccccucugugcccagcagccccucagacucaucuucaaauggggggaggucucugccagggcuggaggucagggcgucagcacgucuggagcugcggccugggcuggaggugaggggaucacugauccggcgccgcugacgggcagggcuagaugcugagagagacucagaagacuccuguaggagaaaaagucugccaucagacacuggagggacacaggcugacagccuccugguuaccauggggccuucccacagucugucuccuguacacuaggcauuguucucagggacauauuagucccucagaucuguccaugucugucuuaugaaaaaccucgggggcuauguaguuuuuuuuaaaaaccuguuuauaaucuauuuucacaccccacuuagcccaaaccccacaauaugcugggugcugaaacaagaggugaagauaaaagaggcaucaaggaacacuauucuagaagugaaugguggaaagaacagaucuuuaaccuuuaaugaaaacgcuaacaguaagaguagggaagccgagccaggcagugguggugcacgccuuuaaucccagcacuugggaggcagaggcagguagauuuccgaguucgaggccagccuggucuacaaagugaguuccaggauagccagggcuauacagagaaacccugucucgaaaaaaccaaaaaaaaaaaaaaaaccaaaaaaccaaaaaaccaaaaaaccaaaaaaaaaaaaaaaaaaaaaaacaaaacagaguaggaaagccgggccugaugucacaggcaugaaauccaaaauaccuagaggcugaagccugaugaucgccaaguucaaggcuaacccgcacuacagagcgaguucaaccccagccuggguuacuuagugggacccuuucuacuuucuuucuuuuugaggaaggguuucucugugcaguuuggcugcccuggaacucacucuguaaaacucaaagacccgcuugccuguaacccccuagugcugggauuaaaggcauacgccuccccggcccagcuaugagacucucaagagagaagggaugcacgcagcuacgugguagccggcuuucccuacaugcgcggggcucuggguuccauuuccugcagccucaccaccauaagugcguguaaacccggggccuagagacacaugaggagagcagagacgacccgucccagacuggugcagguagccccgcacucaagccugccacuagaggaagauaccggccaagcuagccgagaucgcugaauaccgcccgcccgggaucagcccauuccucaccgccaugucugcgcuagcuccaccgcaccagcugccaccgguuuucgcgcgaaaacuagaccacgugacccgcccaugcccgggaagcgccgggaggacucagacgucacuacguccucgucaaucuagagcggaag

SEQ ID NO: 3201 - RNA, 10166 nt, Mus musculus
cuggaggccgagggggcggggaugagugccacaaacagggguugugacuguuuucacaguuuugcuuagacgaaaaacacuagccaaggcgccugagagucgccgcugccaggggaggaccggggaaguccgcgggucccgugaguccugcgcgcuggcggcguccggccaccucugaccgauccacguagcaucucagcugcgguucuugcgcgacgcuccccgguucucgcuaccucgcaggggucggagucccgcggccugcgcagcccugcucucagguaagcgcggccgaguccucaucuccugcuccgccaagcuagcgaggaggcccugccccugcuccuucuucggguucgggccuaccgucuccuucuguccccgugccacuugggguacagccgcaagacaaccuuugagaaguuucuggggacccuagcggucaggaccggauccuggauggagcuggacacccgccgcuccgggugcagccagagcucagcggcagccggaaagaccagcccaugcucugccucugccuuccuggccuugcggaaggaagggcaacuccacuuagcuccguagcgaggagggggugguggggucugggguccagacacccccaauccuuguccagccugguugcauugugcuggaaaugugugcgcgucauagcauuuuuuugagaucuuaccuguucuagaggguugggucacaagaccuaggacagacaagacacacaagcauguaaauacaccugcugccgauggagucccaguucuauaaacagcacaccaaagaacuggguggugguggaggaaucgggagguggaggcaggggggaaaucagaaguucaagaccugccuuggcuuuuugcagaguuggaggcuagccugggcccaaugagacccuaucuuuaaaaacaaucauugaaagaacaacagccaggugggcuagauaaaguccacuuagagggggagguaaugagucaaaugaugggaucaagcugcggguaagcaaacacaaaggccccugagguaggggagauauaaguugguggcuaaagaagggcaagaaggauugucaggaggcagagggcaggucaccuggaccaucccuucuuccuguuguccacaguggccucuuaggacacaaucucuccucuaucacugaggcugacagauucagagaggcauggaacuuagccucuauccucuggggauuuccuaugcugcucugcagcuagauuuagaggcuuagcagccuaggagggaagggagagaacuuuggggggcugcuugcacugcuaccuucuacuggguaggaaucccauaaaagaacucagaagguuugggcaaucccauugcacagaugggaaagacaagcucucucaaccucucccagggcagggagagaaggcccuuggggaggugucugggguguccgaacaggucccaccuaggcccaacaagcuagccacagaggguaggaggaaggcgaggcuugagucgugggcaggagccuggccucuggagaaugcgcugaggucagagcugcccuuucagguucacggguggaagaaaccuuaccucaguucccccggucuccagaggccugggcuccuccaugaugcucuguugcuccuucaagaugucauagcucuucuuugucccagucugcccccucuccuuccucuuuucccuggugggccagcuccuuucacuucucuaucauugcaugugcccaaggccagaagaucugggggagaagcccugggcccuaggauagaggguggggucuguggauccccugggccaugccugcuccuccuuugauugggguccugauggugcuuguccaguguaccuaggaaggaagcacagggcauggaggcugugcacuggaagagugucuaauguguuuguuaccauuacuucaguuauuucaguagcacagucauggcagugcagugaacuugaccuccucccagccccaguacugcuggaguagggguauuucagguugggaguuuguccacuugcucagguagaaaggaguaccuugagcuauugcuagguguagaaguggcuaugauguugggcucuggaggggacagcugaacuaugggucgccacaucugugaacauugugacuccuagggauggguucccaauccuacagggaagugucacagguggcagcucacaccucacccuguguucauuccuucaaccuguugccuguguucucguucucucucucauguaugugaguguucugucugcauguucaccugcauguccgaagagagcaucagaucuuauaacagaugguugugagacacuugugguuucugggaauugaacucaggaccucuggaaaggcagccagugcucuuaaccgcugagccaucaucucuccagcccuuugguagacauuuucacagcucgccuuuuuugacugucauagaaucuugcugugauugucccugugacucucagaagggaagugacucacucaucaaaggucacagcaagcaggaggcagggccaggaaugccauccuagccuggcuugccaauuccauaaccuacaggagaugggaaccaggccuggggacacaagccuguugccacccuagcuauuaggaagcugggacaggagaaucacagguucaaggcugggcaacaugggcagccuagggagacccugucucaaaagugaugacgcaagucucacugcucauuguccagugcuugccuagcauagauccaguguccagcaaugcaagacaaguaaacaucugaucuauuuggaaaauugagaagucagacucaaacacccugguagugaaggggaccuggccgucucaugacugggaaggaugggugucguauguggcagaguccgggguuacuaggaguccaguguuucucucugcauccaccuugugacuuugcucuuugugagcuuucucuccaaggccccagcccagagucacacuuggccugcugaccucagcagggugcugggacuuucugguuggcuggauuugaaaaugcucgcauuuccugacauuugugcuguauggagcuaaucccaucuaagucuguggacagagccgaaguucggagugcccccggggaaagugugcccauuggcugccuggcccuaucccaccuucuccauccugcugcugucucuccuuccugucucaccuagaccuguccauucucugcaguggccuaagggaccccacccacaguggcuuggggucuuuggaaagagccuuuucaguaccgagaaugaaaucauguuauaggugugccaccccaucugacccagucuuaccaacuguuuucucuuuccagccgcccuggccuagucuuuuuugucuuuggccaagucuguuucuaccucagaacuuuuguauuugccauucucucugaggaauguucuuuauccagaguuuuccaaggcugacuccccagucaugcguccucuugacagaacaccaacccaaaucaaccuuccuauguucccuggaauucagccuuaacugggacacaaggccaugguaacuagauagaggacugcacuguuucguuuggcuguggaagcagccuugggcauucauggagagaccuacuucuaucucauggucuaacauggcugcucuuguuccuaucggcacaucaguauuccggcugacaggaaggaagaagggcacgaccugaagcuggcgaguugcacucuguugguguccuuguggccagucccuccuucaggggaagcuggagaaagcagacugaaaucccggguucugcugguaagacguguggguccuggagacuugucugcgcucuguucccgucauagugaaccacuccacugucuucucagcccuuaucccuagcagaacuuugcuuuuuaaguacaaagguuuguguuuccccacucccacccccauccuugggagggagccggcaagaggguaggccuugcuugcccugucccacccacaccugagcagcccagugaguugcugguuauaccaaccacauggucagauccgcugggcaagcagagggugcguggguggaggaugguugcucccuucaccuuugccgaucgucaggacugggaaaaaguggaaaugcccuacuaggaaccagggacauacuucccuccuugccccuccccaucagaaaguuggagguguaacaaaucagagaaggcugaggacagggucuuggcugccugcucagagguuuccugucccuuucagcagagacagcacuagaguguaaugacccugccaaauccaggauguccccgagugccccccaagcccugccuuuuccugcuacugcuuagaguuaguggaccacaaugcuccuuuugaguuaccgcugacacugaacagggggcaccaagcucuuugccacuccugccacagacagguaggucccuaagccacgaccuuuuccucugaaaagauuuaaguguuccuggcaguauacaagcucgugcacccacgucuggagaaaggagugucugggacgaagugugccaccgggucuacagagucaaucccggccugguucuguaguggucacguguauggcucuguugagucuggauccacccacaucccauuugggaggcccauucauuuugccgcaguucaggcuccuucuuucuacugccaucuuguggucaacggcugacacugcuucacccgugcacuaccuuugcccagcugcuggcuguuuuggauagaggcgauuaccuucugaucacugaucagaauacaguuaccuaugagucccgaggcucagcuuguccugcaggaggccccacuaccaucccuacacaguccucucaccaagguuccucgucuaggguuuucuggccaccauuagucuucucccuccaagacauuucugggaccccagaucaugagcucucucauccucuaggcugaaugucagacuuuccuccccaaauugccacaaagacacuggccucugggcuacucuggccuccagcuucucuggggagccugaccuucucagaugaccucuuuggcccucuuugugccuagagaccucugugugcuucagguguccccuccaccugcagcugcuuuuccagugcagcagagaggguucugggcuccuuugaggaccucagcgggugugugaccucagaucagauggugggugggguuugcaagguggaauugggagcauaucacuuagccuucccaauagaguccugcugaggcauucuccaucaccauggccucacuuuuuagucucagugccauuucagaggggacacugaagcaccaggaggccaaguggcagaagcaggcuggggaccaugcucugaacuccuucaucucuggaagaacaauuuggauggugccuaucauugcucucuggcacaugaugcucaguaacuggagguggcuuguguaucugucaggggcaaaggcuuaaggcagagccugagaggagagagcaggcccuguguggagcuaagaacccccuucucccagccucccgcucagugaguccuaguacagccugcacucugcgcugccauuuuggucuucccugguagccuuagacggagggaggagggccagggcccugugcccuaaccacaugggcuugucuucagggccacugccgguggaauggccagccugcaggaggccaauggaagcacagcguggccaccgcccacagcauccaauaucagugagccccaccagugccugcugcugcuauaugaggauauuggcuccuccagguaggguuccuggccccacugagggagggcugugggugggcucucagggugcuaugggccagggaaugugucccuaccuccccagugagccagcaucugugcccccugcaggguccgguacugggaccuccugcugcucauucccaaugugcucuucuucaucuuccugcucuggaagcuucccuuagcucgggccaagauccgugucaccuccagccccauuuuuaucaccuucuacauccuggugaguucccucccaucagugacagaaagcccaucucugcuuuaagcauaagcuuuuccagcugcaccagggagccccucuuuccuggcugcuaggggaacccuaaacuauccuuggauuggucuaccuaggaucccacauucaugccugagccaauaacaggcuagcaaggaaaggaaagguuggggcaggucggaagaccaugcugacugagggagccaggagauuccuaugggaaacugggagcuggcacuagaggggugcaaugaacgcuggguuaggaaaaauguacacaguagcuagguucaguccaccauuccuccacuuagguaaugucuuugcagcaagcucaccugaggggccuguggucucagccuuuggugggcucuaugcaugcugcuuuuaggauauggagaagcuccauauccuaggauaugaggcagaggcucuaagggugaccauucuagggugccgggcucuuuuuuucugcaaggagaggagaccgacuggaaugcccccacacugaaacucucagacgucaucccaagagcugaguggcucccuggucccuucuguggucaggcucugagcuucucacuaaugguuggugggcauguagggagacgugaccuggggagcacugggggcuggggacauggccucaaggcacuaacaggcuagugaggcugguguccucugagauggugggaaugggcagaggcuggcuuuccuaagucauagagcaggggagcagcagagauaggccggaaccccagcugccugguucucuaaccacaggucacugucaggcccuugggugggcggcaguggagugguccaugccugaagccuguauuggacccucccugcccccuuccucgucuaguuaaaaccuccuauucuugaguggauccugaggaagcaaagccuuguugguccugacacagcacucuguccuucucuugcccugcagguguuugugguagcccugguaggcauugccagggcugugguuucuaugacagucagcgccucugaugcugcgacaguugcugacaaggugugcgggggcagccagucugguggaagauacgaugugcccucuguauccucauccuguuggagauccucagggacaucuagcuggguggagcccacccuuaguugacccugugccucucugugccccagauccugugggaaaucacccgcuucuuccugcuggccauugagcugagugugaucauccugggucuugccuuugguaugugucuuuggacccaggcccacucucccugcccuucuugcagugacccagagauggccccuggaagaaggggcugacucaccccuguaccuuauaggucaccuagagagcaaguccagcaucaagcgggugcuggcuaucaccacaguauugucucuggccuacucagucacccagguaugugguggugguagggucgagggucacauuucuaaacuauguguuccuaaggagucacauggacuaggcaggguccacuuucucuagacacagacuauaggugaagcucgagaaagcuauaaaugugugagagcuggugccuggacagacagccugagaggauaugcgaugggaauguuguuguuuuaaggcuagauagggcuguccuuaggcuuugcccacaaaggacucaucagggucugagcugcccuuggaguuaggugggugggcauggccaaggcauaggcagggguagggccuggcaugcaggagagcccugagcugugcaagggaaagccaggagaggcuucagugguaggacugagcugaccuccucgccuacuacaggggaccuuggagauccuguacccugacucccaucuuucagcugaggauuucaacaucuauggccaugguggccggcaguucuggcucgucagcucuugcuuuuucuuccuggugaggucuggcgugcucccugggggcaggugaaguagcuuggccuggcccggccucccugucaccccuaucucugcaggucuacucacuggugguaauucuccccaagaccccacugaaggagcguguaucccugcccugugaguaccugcugggguggggguaugaggguacuggccugcucccaggcugcagcuggggagcccugggaaggggcaaaacgccaagguuuauacgugggccuggaggguagagugguucagaacccaugacccuugccccccagcacggaggaguuucuacguguaugcaggcauccuggccacacucaaccugcugcaggguuuggggagugcucugcucugcgcuaacaucauuguggggcucugguaagagggugcccacuauggggauggggugggcaugggguacaguggccaccacuguggcagagggguccucauuccuuugggcaaggcuugggguuggggcaggagcacaggcccuggccgugcugaccugcucccuaccacagcuguguagaugccaccaccuuccuguacuucagcuucuuugcaccacucaucuauguggccuuccuccguggcuucuuugggugagugauggccaggccucugcaugcuaauguggcggcaccugcaccuucugugugugcguggcaguggaggugggugugcagagggcacagagcggcacgugagugcaucugcguagaugcucugugugugugcggugagaacaggugcacaccccagagucagggcugcaguucggcagugcacacacaccuuaccuagugugucagcaagcaccuacugugagcuacuguacagacagcaggggagcaaagcaggccugagugugugccuggaagggacccugagggaccacagugagcuggugcauaggugcagguggggaguguccgaggccaggaugcagggacaggacuagcugcaguaugaucugguggcgugcaggcagggguuugcuguccugucggggcugggcgguagacaugggcugucucaggggaagccuaggugaggcuguaucaggcugcugccuguuccaucugcacaggcugcugcucuguugaaccucuucuagcuauccugaagacagugaccagguucagggguaguggguagucauaugcugcaggcaugggggacacacuuggccaggguuggugaaggcuaggguuuaauuauugucucccacaaggggcugacacacccaugguccugccccagcucucaggaguaggugggaccagcuucagagcaaaccguggugggucagggguuccuucagagaccucggauucucagaugagcuaggcuucugucuggccccauuccuccugacaacauggcuucucuaugcacucuccccagcucugaacccaagauccuuuucucuuacaaaugccaaguggacgaggcugaagagccagacaugcaccugccgcagcccuacgcuguggcccggcgcgagggcauagagucugcaggaccugccugcgccucugccgccaacuacuccagcacacaguuugacucugcugggguggccuacuuagaugacauugccuccaugcccugccacacgggcagcaucaacagcacagacagcgagcgcuggaaagccaucaaugccugagugggcaccuaagccucggggaggccuguaaagacagaugggaacucguguggauagcccugggcaggugugccugcacccccagccucuuccugaucuccacccccauccuccuuugccuccugugcucuagugugggaccgcagccuucccagcacuccguuccugcugguguccugccugcccagcaacuuguccuucuuccauugcucucgaccucuuggccacaaggcugcaguguauauauuuucuugaucuauuuuuuaauaaaaauaaaaagaguaguaggugugagcugaugccuuucagcagcagggccguacaagugguagggaggcacccccaaaagggaugaccccagaacuggcugccagggcagguuggaggggaggggacccauguagagagaagggaguucuguggagcugaggucuuucugccauguuuaaugcaguauaggggagccug

SEQ ID NO: 3202 - RNA, 2932 nt, Mus musculus
aaugucauuauuugguaccaagaggaagacuuuuuuuuuuuucuaaaggcaacaguaagaggcuccaaagcacagggacugugacccugggcuguagcccacuccucaccuggggagggagaaguucaggcccagcuggguccucccuccagcccucccuuccccccagcccccaccccucaccugucacacugagugaacuuaaaucaaaggaagggggcuucuguccaaaauccucugccaggccuggacuugguagagaauucuucaaacccucaaaauucuuuucuccuugcaaauggggaaucuucaagaccuccacuuuccucacccuagacuugaauaaaagacucucccuaaaauagagcaggaggcaaccuggugucugucaagugagcugaccccugcuccagcccugacuccugacuuucacaacugucaucuagccgcaggcacagggacuggaauggggaagagcuuagacacucgccauuuggccaagcuguacauaaaucuguuuccuucaucaaugugugguuccuuaucucucuuaaaaauacaggagaacugggugguugguuucuaggacaaacugcccaaugccagguuugugcuagagcacagguucucaaccugugggucucaaccccuuuggggguccaaugacucuuucacuggggucauacaucagcuauucugcauagcagauauuuacauuauuauucacaacuauagcaacauuacaguuaugaaguagcaaugaaauaauuuuaugguaggagugucaccacagugcagcauuaggaagguugagaaccuuugaucuagagccacaaaggccacucugcucuccugucagcuggacuccucugcauacaagcaacaagaauccaguucaaacuggcuugaaguaaaccagaggccugcaggcauccaaaaaaaucuagcugugccuguucacacacaggcaaauccaaaugcuuccaggcugacuggcucgugugcuuagucccuguucuagcucugcugugugccugggaaggcuuccuccucagagaugcuaaagggaaagaagugggguggagcacguggacauuugcaucuucagugaguaaccacauacucaggauaugccuggaaggugacaguccagcuuggccaguguugagggugcugaagaauucauggcugaguagauacuagcugggcgacacugacuucaagaagagagucugagauccaggcuagcacagggccccaugaugucaucuuugaccuaggccccucggugauguacuguccuaagccccacuucucuuucacaggaugguggcuccaacugucuaguccuacagagugucucccugguaccacugucacccugugugugugagaagggugccucauaucuuacauuugccucauuggucaaacauugcuagaagugucaccucucuaugauggcagcuggaccugucuggcuuccuuugggggacugcuacuuuucauaaaugaauaagaaagaaaagagauggauauuaagcaggcagcuggcagguggcugucaggacugaaaaugguaacaaaugggcucagaggcuggugugguucacuccaucccuggcugaagccauugcuuuggggaugaagcaucauggguacaguggaaauccccuuuguccauccauucuuucccaaucuggucccacagcaggcaacugaacuuugugcuugcuucugcgcuccccugccucugucucugucuuugucucugucucugucucugucucugucucugucucucuuucccuguuucucucugucucucugucucugucugugucucucucacuguuucucucugugucucugucuguguguguacauguaaacagcaggaccucuguugucucugcuuuggaguaaaccaaaccaguuuguucugauucaccuuccccaacuuacugcucaucucacuuugauuuagggacugguacuaauacucaagauacccauaugccgcuguuccauaaaugguaucauuuauuugccaauuugaguugcuugguggugguaacaagggaugcugggacacauguucugugucugauuuucuugagaacccuucuggguguuguucugaggaacagagucacuguggucauagcauacacaugucaccuauuugcuucccagugguuuuuuacaauuccugaagauuuugaagcaggggcaugacacagaccaggaauucccaaacuggaguccugaguucuuaaggucaaaacuauuuuuaaagaauguaagacaaccccugccuucucauuaucucucucugauguccaguagaacuuucuaggcagaguauguguugacuucauagcucuggaagcuaaagggacaugcauggguguaugcauguucuuuaaaagccucuucggcuggguguggugacacaucugcaauccuagcauuugagagguugaggcaggaagauugcaaauuuaaggccagccuggacugccuaaguacuacugucaccaaaauaauuuuuauaaaguccauuuuaggggucaaucaggauagaucagcagguaaaggugauugcugccaagcuggacaaucuaauuuggauccugggacccacaugguagaaggagagaacuaacucccacagguuguccugaucucaguauguacaccaugauauguaugcccacacacacaauacauuuuuuuaaaugaaauuuaaaauuauuuuaaaaaagucuuugccagguggugauacacgccuuuaaucccagcacuuaggagggagagacagguagaucucugaguuugaggccaaccugaucuacagaguuaguuccaggauagccaaggcuucacagagaaucccugucucaaagguaaaacaaaagaaaacaaagca

SEQ ID NO: 3203 - RNA, 1502 nt, Mus musculus
aucaggucuuggaaagccaggaucccaucuuuuuauacggccucucauuggagucuauucugcacgauucaaugaguugugugguuccuuuuccucuuccucuuccucuuccucuuccucuuccuccauaaaguugaaaaaaucuccuggcagagugaagaccaccauggguuuggguuuuucugguuccacgacacgaugacauggggcagcuggggcagcuggggcagcuggggcagcuggggcagcugcggccgcuaugccagcaaugugcugcuccuccucuuguggagaaaaucuguagguccacauugaccacgcuaccgacgaagcaagagucaaucucauccaguugucugucucuucggggguccagucagacauuuggacaucagcgucauacacuaaguggcuggaacgugggagcuucuugguccguggcucgaccugggucaccgagguggugucuuccucugagaacuuccuugcccgaaaccagggaucuugcugcaucggcucuggggcugugucuucuucauucaucucugaagggaacaggcugucagaauccggggucugagagucauuuccauucugguggcccaucaugacagcucuuaggggcucugaccaaucuguggggaagagacacagaugauuguaagaccuugaagaagaggacaagaccaagaaacuguacugagaugaacaccuggagaggagaccaaaagucaagggcacagccuguggggguggcacugggucaugacaggggccaauccccagagcagcuaggaagccaguuucagacacacaagcuugggcaccuaaacacaaccucugaggcaggaggacuccaaguucaucaucuaccugaccuacaggacaaguuccaggccuagaucucaggccagccugccugcuucugagagacccuuucuuacaaaacaaagucauaggaucaaaagagcugaggggcuggcuucggacucagggccuggcaagggccuccaugggugagaaccagggauccgaccugagaaccacagggggaaaaauaaauccuccacgugauauuccuuuugaaauccccccaugucauucaccagaaaucccagugcuguucaugagcccagagaggaccuagaucauuccccuaaccccagcaugguacuacaucccuacuccuucugcccgacuccaaaccgcuccugacucccauucaaccagcacacuagccaagaaaccaggagcacaggguaacacguucuucaacucaacaccaccacucccugccaagagggagcuuacuucccuccaggaugagaaagucccuaccuggaccuccaaauaggcuguagguguugugugacucgucuuccaggcuugaucuuccuaacauuauguuggugagguuucuucuucaaaucugccaaacuguccuuugacagggcguaccuucgauccuaccuucuucuagaagcugugucuccggaggucug

SEQ ID NO: 3204 - RNA, 1502 nt, Mus musculus
cagaccuccggagacacagcuucuagaagaagguaggaucgaagguacgcccugucaaaggacaguuuggcagauuugaagaagaaaccucaccaacauaauguuaggaagaucaagccuggaagacgagucacacaacaccuacagccuauuuggagguccagguagggacuuucucauccuggagggaaguaagcucccucuuggcagggaguggugguguugaguugaagaacguguuacccugugcuccugguuucuuggcuagugugcugguugaaugggagucaggagcgguuuggagucgggcagaaggaguagggauguaguaccaugcugggguuaggggaaugaucuagguccucucugggcucaugaacagcacugggauuucuggugaaugacauggggggauuucaaaaggaauaucacguggaggauuuauuuuucccccugugguucucaggucggaucccugguucucacccauggaggcccuugccaggcccugaguccgaagccagccccucagcucuuuugauccuaugacuuuguuuuguaagaaagggucucucagaagcaggcaggcuggccugagaucuaggccuggaacuuguccuguaggucagguagaugaugaacuuggaguccuccugccucagagguuguguuuaggugcccaagcuugugugucugaaacuggcuuccuagcugcucuggggauuggccccugucaugacccagugccacccccacaggcugugcccuugacuuuuggucuccucuccagguguucaucucaguacaguuucuuggucuuguccucuucuucaaggucuuacaaucaucugugucucuuccccacagauuggucagagccccuaagagcugucaugaugggccaccagaauggaaaugacucucagaccccggauucugacagccuguucccuucagagaugaaugaagaagacacagccccagagccgaugcagcaagaucccugguuucgggcaaggaaguucucagaggaagacaccaccucggugacccaggucgagccacggaccaagaagcucccacguuccagccacuuaguguaugacgcugauguccaaaugucugacuggacccccgaagagacagacaacuggaugagauugacucuugcuucgucgguagcguggucaauguggaccuacagauuuucuccacaagaggaggagcagcacauugcuggcauagcggccgcagcugccccagcugccccagcugccccagcugccccagcugccccaugucaucgugucguggaaccagaaaaacccaaacccaugguggucuucacucugccaggagauuuuuucaacuuuauggaggaagaggaagaggaagaggaagaggaagaggaaaaggaaccacacaacucauugaaucgugcagaauagacuccaaugagaggccguauaaaaagaugggauccuggcuuuccaagaccugau

SEQ ID NO: 3205 - RNA, 4070 nt, Mus musculus
ugaagaagaaaauuuuaaggaaaugcauucagaaagggauuauguaggucauaagugauggagcagucaugugugagagcuauugccaacucuaauuaagcacagauuuaaaauauauauauauauuuacacugagaucaagucaagauuccaaacaaccacccagagugcuaggagcuucacagaagacaacacaggaugguaagcgucuucuuuccuuggaggggaagagcgaugucgguugcuaauuugagauuaaacaaaugugaaccgagucaaauuauuaauugaaagauaaacacuggcaguaucacaaaaaguguguuugguaacaauauccucagacaaaauacaacucagggcugaaccucuggagaauucagaguugggucucuaugaagacugcuguuugggguguccaugcugagucgugaaugaagggacuaauuuuggaauccuggaaagcaggaaaaaaggaugggggaggggugaagugccuagagguauauaaacaaugaccucagugccaauucuggccugagaagguagggcuggugagauaauggggaucccccagagcaguauucagggagagccggggcucagacagaggcuguugacugcacuugggguaccaaguauaagaucugaauugcugggguccaaaacaccaaaacgacccaagcagucaugaaaguccagcaaagcaagaucuuuauuuaaauuaagcagcaaaaauugacuggucagagacaacagcacagacucagggccugauuucaucuucaaacauucaucuuaguaaguaauuaagcagaugacacacauuuauucuaaccaggcugcugcugauugaucagggaaaccaaaaaagacucagcaggugaacuuggaccccaagccaaaugguagagagauuuuaagcucaaaaucuucaaaacucugugccaaguuaugccaccaaucggaguuuggggauaagagacucccuuaggagcacgaacacuuauccuguuccaauugguuggcuuauucagcagugccggggcaacuugccuagcauucauguugcaauuuaacaaccaggaagucaguugccuucugacauaucucuuucugccaagggauauguaaguuacccagagaggucuaggggacuuaaacuuuauuugaaagcuguucaaaauggagauuuuauugaaaauggcuucaguuuaguuccuucuuacagaauaagacaaguguaaaccuuuuguacaagguuuuuuguuuuguuuuguuuuguucuguuuuguuuugcacaggagcugcacggaacucuggcaaagacugucaaggucaaagcaauggcaccuuaauucaacuucagcauccuucaauguaaaugugaucuuggaacaguuacacucccaaagccauuuguuggcucaaauucugauaggguccaacucaggcugauugcaguguccugcugaacugucucuccagguauuuauugucuaauugggacaaauaaaacaugacuuugccugacaccuugcaacaacugggaauguguguuucauuacucuuuauguugggacugauacaugaguuuuuggaauauacaucggcuuugcuauuuuuucguaauugauuuuuuucuggaucccacugugggcuuccuaggggagagugggauuaauggagguaagccuaaaaucuguucagaacagaucuugguacuguuuuagaagaggcaggggagaagaaaaagcaaguacacauagauuuccgaauucuguuccugagaacuacuuguucugauguaaaaucuagacaucaucaggaacuagcuauuuaaaaauagaaacuagcauucuuauagccuaggcaggaggguuggggucuagauggcugaagcaaucuccauaggauucacaugacacugagugaaauggcucuacagguuuaucucuugacaguuuucuauuucaaaguaggcugagcacaaguaucucauauacaugugaauauauccaucaaggaauauauacagauaaauaaauagacaaauauauaaagacauaguaagauauauagauaaauagagagauacaaagacacagaaauacaagauauacagaaaaauauuuggagacaagccuccaaaauaaucuagaaaguaaaccacaaaacacucaacugcugccacucacaccucaggcaacagggcagagaccaagguuucugacagggcuuguuuguuucuguuuguuaguuugagacaaaguaucuuuacauagccauggcucuccuggaacucacugugaaaaccagguagaguuugaacucagagauccaccugccuccccagugcugaaauuaaaggccugaggcaccacgcccugccuuacauauugacugguuuuuguuuuguuuuauuuauuuuuuugauucaccugaaacaagguuggugucucaauauuauacacuuuuuuaaaagucaugucaagggccccaaaaaaccuacuuguaauguauauguaagcauguguaaguacaggaaugguggaagcuucuguccucugcaugcuaccuuuggccucaugucccaguccacuccuuccuugggauuacagacuauuuggggacagggggcagcaguaugcagcuguauagagaaucucagcugagaccuccagcuuugaagccuaaacaucucauagauacucagggcuugcaaucugaggcagccucuuuuggauuacuagcagcacagccauugagucauuugaaggaaagaaaaaaucugcauucacacacagacacagagaagcacccaaguaccucucccgaaggcuuugcuggguccaucaguuucauguggggaugagucacacaacaccuacagucuauuuggagguccagguagggucuuucucauccuggagggaaguaaacucccucuuggcagggagugguuguguugaguugaagaguguguuacccugugcuccuggcuucuuggcuagugugcugguugaaugggagucaggagcgguuuggaguccggcagaaggaguagggauguagugccgagcugggacuaggggaaugauguagguccucucggggcucaugaacagcacugggauuucuggugaaugacauggggggauuucaaaaggaauaucacguggaggauuuauuuuuucccccugugguucucaggucggaucccugguucucacccauggaggcccuugccaggcccugaguccgaagccagccccucagcucuuuugauccuaugacuuuguuuuguaagaaagggucucucagaagcaggcaggcuggccugagaucuaggccuggagcuuguccuuuaggucaggcagaugaugaacuuggaguccuccugccucagagguuguguuuaggugcccaagcuugugugucugaaacuggcuuccuagcugcucuggggaugggccccugucaugacccagugccacccccacaggcugugcccugacuuuggacuccucuccaguuuuucaucucaguacaguuucuuggucuuggcaucuuuuucaauggcaucuuguaauccccugucucucuucugcacagacaugugggagacccuaagcacugucaugaugggugaccagaaucaaaaucgcuuucagacccuggauuuugacagccuguucucuucagaggugaaugaaggagacacagccucagagacaaugcagcaaaaucucugguguccagcaaugaaguucucagagcacacuaccucugugcccaagaucgagccauggaccaagaagcucccacgauauagccacuuaguguaugacgcugauguccaaaugucugacuggacccccgaagagacagacaacuggaugagguugacucuugcugcagcuguaguguggucaaugcggaccugcagauuuucucgacaugggaggaacaacacauugcuggcauagcggccgcagcugccacaugucaucaucccaugggaacagcaaaccccaaacccuuguucaucuccacucugacaggagauu

SEQ ID NO: 3206 - RNA, 1320 nt, Mus musculus
aggccucucuuccagguucccauugccaugauauccuguggccagcguaguacuccagccauccagauggacuccacucugugugaggaucugaaugaggccaagcucuggggagcacaugaguaguaccccacccagaagaugagcagugucugucucagaaccccuggccugggauccgggccggggccucaauacacacagucacacaaauggagaaaccaggccuuccguagacuaucugcuuccccuaugagcuggagacagagccaccguaggcucagucuuauccuuggagucccugguagguggaacuccagggugcagguuucuagagacuuguggucuuucaugguguuuaacuuuagucucccugauucuuaacccuaacccaaccuugggggaguucccaaguuaccuucggucaugguguuuuagagcaguaauagaaagcaaacuuuaauuuacuucaguuuauaacuagcagucgaccaugaauugaaggcagagccaguauccaaggcaggaacccaggggcaggagcugaagaggcuguggaggaacacugcuugcugacuuacuccucaggcugacauccagguacauuucuucgaccucccaggacuaccugcccaggggugccaccacucauaguaaacugggcccuuguacauuaaccauuuagaaaaugccucacagacuugcccacaggcuaaucuuacagcaagcaucuucucaguugugguuccucuuuccagauaacucuagcugagucaaaauaacaaaacuaaucaggucaccaggccuuaagucaucugccacagcccugccccgccugccccagcuccagcccagcucuucucguuguugcagacacugcagaacaacagcuacagcuacuguagaaagacuacggugccuuccugggcucccaacacuaaucagccaaggcugaccuggaagcccagucaggucuggcuuucuugagcacagaagucuauguccaccuaggugaacagcagcaagaugagagaggagccuaucucaagccagcagccugccuguggcauucccagccuccucacccugacuccagugucugcaguucugcuauucaagcaccgccgccccccccccccagcccaauauccugcuccuaaaccagccuccagggaauucagggucuggacccagccccccugcuugccccuggccaaagguucuguagccacacaaggacuucauggagcugcaugucccuucaggguugacacaucccuuguggcaugugguaucaucauuauacagcauuccaaagcg

SEQ ID NO: 3207 - RNA, 22994 nt, Mus musculus
cagagaacuuagcuugugcucaagguuggaaugaggaaauauaggucagugggugcugggcucaggguccaccuggguuccucuauaggucuuccuggguaccaggucauccccuacugugggacccugacaaagucacgugaccccaugggaaugucggguucccucuguuguagagauggaacaugucuaagcagaaagggaagguaagcacaagggagugggagacuccuaggcccuggaaugcuacagcugcauagagggagggaacucugaauugcaucaggaggccagcuuggaccaagcauccucacuucuuuuuagucaggacucucaguaaccacuuugggcacaccccugugaguacccccaggauccuucacuugccugcccccagucacucauucauuggacaaauuugcugaaagagaagacaaggaaccauuacaugagauauuacacagcaaggaagacggagaggacucagcagagauguaguagaacagugagacagagcgugagagcuacaaguuuaaagcucaaaucaaguagcuggggcuggagagacgacucaguggcuaagagcacuggcugcucuugcaaagaaaugggguucaauucucaucacccacaaagcaucuggcccacaaccaacuguaacuucaggagaucugacuucuucuuuuggccuccacagguaucaggcacgcaugugacacauacauacauagaggcaaacacucacauaaaaaaauaaaaguaagucuuuuaaaaguuuucuuacauaaguaaucgaggaaagucuuuuuuuuuuaaccuagagcuuugaaugacacaaaaggacaaaaacaacaaaacaaaacaaaacaaaacaaaacaaaacaaaacaaaacaaaaccagccaggcaugguggugcacgccuuuaaucccagcacuugggaggcagaggcagaagaaguucugaguucgaggccagccuggucuacaaagugaguuccaguacagccaggcuauacagagaaacccuguuucgaaaaaccaaaacaaaaaaaaccaaaaccaaaccaaaacaaaacaaacccaaaaaaaccacaaaaaacaaaauucaaaaaacccaaacaaacaaccccccccacccacacccacaaauccauggguaucugaggcaaagggcgcaggcaacaaagacuaaagagcacuuaagguuaugcaggagaaucaggaagugacuucuaauccaugcuugcuaggaaagcuggcaaaaaggacaaagcagauguagcugugccugaauagaaagaaggaugucucugguaaacucuaacugcaacaaucagcaaucaggagacuguugguggucccuagagagugguggcugagggauggcaggaggaauggggcuggguggggcuggcugagcaggaggcacaccugugacagacaggagggaacacacugggaaggaagcccuucucccuaagguagcuagacaggagcucuguguagagcucuggagagucuggagucagagucuggaaugcucugugagagaaaggaaucuggcuugguucuugacagggcugcccagacuaaccaugacccuguuuuugaaucugagacaagccaagcaugauggcucauaccugaaaucccauuacucagcacugaagcaagagaauuucugcaaacuagaggucagucugugcuacacaguaaggccaagcuucccccaaauacaaagacaugagauaaaccuaugcaggcaccaaugagcugcuagccacuggauguucuugcagugacagggagucccuucuagaggaguacaucucuguggcugccauggccacaugaccagagcagcacaaggggaacauggacacagauauagcauacuauauuuauacacuauacuuguuuuugugugaggaaaacuugcucccaacagcuaugacaugagggaguaugacaguggggagacugugagaagccuauuuucuucuaaguuguuuuucuaaguugcuuuucaucaagauauguguuacagggauagaaaugaaacuagacaccauaacauaugacuuaaagaaggagacaaugaagcauuagugucaaguacugaagaaaugugaauucccagcuaggauucuauacccagccaaacuguccccugcacauuguucacaccaagauuuucacaugcucaagucacuuacagcaaauggugccauauuuacauguaacccaugcaaaccuucuuuacacuucaaaucaccucaaggucacuuauaaaaauaugauaugcauucacuuacaugaguagguagauuaaauaaaauagcucauauauggaguacuuaaaaugccuuguaauauaguacauugguguugugcauaaucccaguguuguggaaacugugucaggcugcauuguccuuugcagguaaugcuguuuggggaggugggaaaccauuaggagucagggccugauuggaggagauggguguuuggggggugggucuugagauuuauguccacuuuguucaccauccugucucugcuuccucaugcacccaaaugugagugaggagccucaggcuccugcugccauggcuuccccgccaugaugaaccauacucuuagacugugagaacaaagcuagcuguaggaccaacaaaguggcucagggguaaaggggcaugccacuaagccugacaaucagaguccuguccucaguacccaugggguguaucuuguucucugaucuucgcaagugcuuggcauggauaccuaccguacauguacauacaauacaaaauaaaugcaagaaaacccacacauaacaaaacuaaauggacaaacacaagugcccuuugucugaaaauuuuaauucucuucccccccucccccuuucuccucuaucucucucuggagagcaaagauaaauuuacuaaggaaaagugagaaagaauuucugagaguagaaggggcuccagaggaggaaugugcccauauauauuauuuauggacauauguguuugccugcauguaucugugcacgacguguauguagugcccucagaggucaggaguggacugcaaaaacuuggggcaggaguuacagacaguugugagccaccauguggauucugggcaucagaucccaguccuuugaaagagcucucaaccacugagccaucugucuagccucuaaagcuuucucucuuuuaauuauuuacguuuauuuaucuacuguguguauacauugacauauauauagguuggagggaaacuugcaaaagccaguuuucuccuuacaucauguagagccagugauugaauggaagacuucaagcuugguaguaagcuccuuugccugcugagccaucgagucagcccuuguucucucucucuuaaccuuggugcucauguuccucagaggaaaauuuacagcccugguguuaguaagaagagcuggagguaauuugaucccauuuccaacuuaagaguuaggagaacaagacauucaugacuguucuucaggcccuccugugugugaacacagucuccaagaagagcagcccucagagggaagcugaugcuuaugcuggucuuucugcaugggcccaggugguucucccaugcuaaggaaagcuaaccugggcaauagcgcaggugacuuucaaggcugaccacagcaggcaccagggccuuccucgggcuuccucucgggguaucuucccuggagaagacagcugcuguguacuaaggaugccugaguggcucccguggggauugccuaacaacagugacaggugugccaguguccucagcaucaacugcagcagaguaaggagcaggacuucaaggggaaaacuggugacacagacaagcaagaaugguggcagcagccaccauagccaugagagggugcagaucagauaagacccagcuggacauaccagcaaggacaacucuguagccagucugugacuuaacuugcuaccucuggggguacgagguguccccauagugcccuucugcaagcucuguuccauauaaaucagaggucacccugcuguccacaggaagcucuggccucugcaucuggcugacucuggcuguguuuggccagcacagcugggcaguguuaucacauguaauguguacugaccuccugaggggucacauaccaaggaauugagcaggcagcuugaaccuacugaaggccucaugacagagguaguccuggagagcaacaguccgcuaggacuuaaaaagaugaugguaaggccucacccaccauuagcaaaucaccuacuguuccaaagaaagacucagcuaaugauaucauuuuagccuuaaaguaugggcacacccaggacuaaaauaugcacucacgacugagguaaacaaugagcugguguggcccccggaggcucagcacacacugggcaggcaggggagcagggacccacuggguugaugugcaaagacuguguaauucagggcagagcauggcacugugggaaacaaaaaccugaagcccauggugacuucugcacaggaggaacacauggagucuguccccagagcuuccagcgacacagagauggcagcugggaucacgaggaagagccagccucaggaaaaguuugcaauuucuccaaaacacucaaguuuuguucugggacaaggaagggucuggauuggaaaugucccccaauaccuacacaggcugagugguggcagggucuccauugcaaguggagcugagcugggucucuggagagguaccagcaucacaaggcucuuaccucaucuuggaucacuccacugaugaacuucuaauacugugguagugcuggcaagggauagaguuaggagguggcccagauggaagaggcagguugcuagggucaugccugggcagguuuucuuugugcugugccucuccugucucacuaucuuugccucuuggacaaugugaggugagaaguugggugcaguuugcucucucuccaugaugcucagcuccaucccagucucauagaaggaacaacuagaucaaaaucgccaagccuguagccaaaauguccuucuccauauuuaaguuauuucccugagauauuuggucgcaaggacaauaaauugaucaauacaacagcccaucauaguagggccuggcagggcccugggaccuauuggaaaagucaaguucaagggagaugggugacagccuggugcacuugccuagucacaaaugggacacgguccacagagauguacagacugcaugugugccaagacuagcauguggucauucauccacucagcaaacacgugaugagcacugugugccacauaccauccuaaugugggauggagacagaccagucuaccuguccucacaggccagcaagauaaacaaagcaauagcagugugccgugacggggaaagauuguuguaagguauggcuauuuugaauucaguggccaccaaggagguaacacugauguaccuggagggagaaagaagaaccacagccuuucagagaaacuaaccugauguccuuucuagaacccaggggcaaagcagcccucagccaggcccugccaauccuagugagucgaugaagauccugcauugaguggggggaaaaggcccaccaugggagaggaugugagccagugacugugggaaaugggagcuugaagcuggcaagaacuccaaagucaugaccacccgcccgagcuucgagggccucugccugcaagacuuaaugggccguuagcagcaugcugagagcaugcuggaaccaaguggcucugcgcuggcagcguccuaauccaggauuagcccaccgugggauacagccuuggcuuuacccuuuguguugacgucugcaagugagucacaguggucccugacuugugggcagaagccugaggggacaguuucaggugcaugaugugugugugugugugugucugugugugugugugugugucugucugucuguccaacugagcauacugcagucucuaaguuguccauaucagcucugagcagacaccuggucccaggugacagaugaagggccauuugccucucagaagggacagccacgcucugcagaccugucaggccucucaggcugauguggcugagggugggaagcagaugggcaauggucauugcaugggggcaguauagauaccucaugucuugggucccaacccuuagaaugagcuucauagcuggacagcccaaagaggacccacaacucucucuucacagacucugccccuuguuacaaaguaaaaucaaaccaaaccugccacuuuucuuucaaggaagaaagcugccucuaugguagccuggugagcucuaccucacggagcaagcucugauuugccagaugucacaugucugccagcccucagaggaggaggauugcgacccccgcacugcccucagcuuguggcaucugucguuaagugcguauacacacagcucaguuggguuccccgaugugcuuccaaaccaucugugacuucuccaauauugccccacagggaggcagggucagaccucagacuuuaaaacugccucaaucccaugcuauuaaacacaucuuuuuuagcagucucuguuuugaaaaugucuugguuccagaucaucuuucccaagagaaauggcugcucccuuccuuuucuucuuccccagauggcuuaaggucacccauggcacagcacgugggucuccugacacuaggaaagagagcucaggucccuugucagcuccagaggaaaugucaccuugaacagcugggcaggcuaaacacugaaugucaccaugggugaugugagcacagacuguucucuugggugcuguaucccauacagcuuggguccuggaaucccaauuaggagcagugagggaauguaggaaggacagucagauggacauauguacagucaagcugggaugcagugaaauucugcucccuuagcauauuuauuagguauagcacgagagugggguuuuugcuagucucuacaggaagucuauagggaacagucucagacuguacacauccuggaggaggaaguugcaguuguuagucuuugcacacacugauaaucauucauaauacuuggucuccuaaggagagcauggcccucuugagucuggccccauaggucugaggguuuggaguccuucacaugggucaucgaugucaacaacagccauucacucaggaugucacccaugcagggcuuccuuagcucagcuucccacaccuuauaacucuccucugucccucagcccugaauggcccugucaguuacuuguucuuuugaccccagcagccuucuccuucacuuagcuccugggucuugacaggcugcagccaacaucaggggcacaguccaccccaggaaauguccucuuguacagcugggcagguugucuccuucccucucuucagucccaccaggaaaggcaggaucuuucuggccugaccucuuaccccuugaucucuacacaugaacucuucugaugggcacucaaggcagcucaaaggcuuagcuacuccuccuucgugcccaucaccaggauguuucaaacaguaagucagccugucugacuuuuucacaagccuuccccgacuucugccaguggcaaagugcaguaaggaggugauccgauguuccugcccagcucagcuacccugcccaccgcauuaguggacacaagugcaucuaagucauuuacuccuagaaagacaagugggauucugggucuucuaaaaucuuauuagauucacucacucguuuguuucuuuguuuaugagcaaauagggcggguacuuaucgguuccaggggugcaacuuagguugggucauuagguuagguuagauaauaagugauuucaccagcugagcucaucuugucuguauacggcucuugcuugagcaaaaauucuguguucuuccucugguccuuuuggucuuagccaaugagcaaaagccgggaggaaugugucaguuccucuguggagccuuccagguuccuggcuugcgcuuuugggcuucaguuugugugggccuggcaccgcuggguaugguaaguucccuaccacacagauaugacauggaaccgcagcagagacccucccagguaaaaaugaggggaucuggaaagggaagcacacaggaucacagaaacaguaggacagagagcuugacuggggacagcucugaauaaagaucauggccagacccaagcuguagguaagcuggugggcugacagugaaaccagaguucauggacaagaagagcuaaguuucuguuuuaguucaaaggugugaacaaacaucucuugauaguagauagugcuggggacccuucugaaaugaagagcugaaagagcugggcgggcucucuuugacagccaaaagccacaacugguuggagugguccagggacaaucaagagguuccucugccaccaucuguccgccuucuuaccucucaguuguucagguagcaagagaaugaaacacauguucacgcacaugcacacacgugcacacacaaacacucacacacaaacucacacccugacuggugcaaagcccacacaagaacccugggaugcagcaggcuguauugggcuguauugggcuguauugggcuguagagaggauugaacaguucuggacuuuugauaaggcugccugguuccaaguccccaggauccuuaagcaaguucagucuccgggcgggcaguacaccaaacaagaaaagcuucggggagauucccaccuuuccaacuuucucugaaacaugaaauaggcguagguaucucucaaaauuugguggguuucucuuuucucuuugcgguuugauagcucuucgcuuauuggucccauuuuauaucuuauuugcauggacauacauucagccaaucauuguucacuugguccaacaucaacccuuucaacacuucucuuugcagcauacuuugauggagagaaggcuucagagccagcuccuggcucuggucaaguuuccacauccucuguggagaagaaagacugaccucaaaauuuaagggggacaguccugucagaggcguccaugccugaggguuccagaaacccucuagacucuggaguuguaagcuugcugccagucucugggcugguaaccuaaagucugccuagaacauggagcuguauguaagaccugaagccucucuugguugguauccugcugccacugaggcucucaggauucccacuuuccuguuauguaaaucuucacuccugugugacaauguagguccccucauucccuccucucucugcucacucucuuguuggaggcaaaggacaagcauccaagaaagcagaacuaaucaucucaauugggcaccaaugacugaccaaagaaacgauuccacccaagccucacuuagggaaccaacaaguuuauuggugcaugggugacuucguagcagcugaaccacugaaaagucugaccuagcguggagaaccacucucagaauuugcaucccuagagcucccugugcaaccuucaggcaguuccacagggaagucuccugcucagaaguugucauuacuuacuugacuggggaaagggggggggggggaggggagcaugucucauggaucuuacagcuucaugagucuuagaagccucccuuuucucuccaggagggaaugcuacaauggcaaagaaguugggcuuaggacugugugcauggacacaacucugaaugauuggcaaaacucaggcucaagugcacuggccauucuccugggcaugugccuauguccagcuaaccagacuaccuccuccaggccagauuaacgggcucauacacuuguagcggcccuaaagguggccaaugaaaucaccuaaaccaaaaagaccacugcccugcaauucgacagccaucagggaacuaauuugaggagauaaggaagacaggaggagaaagacggggugcugugaccucacagccaccuaccagagaugucugcauccagccaagaauaaaguaccacugggguugcuauguggcagaaucuagucucugauuaucuaugaggugacugaccacaccuaguugggcaccuggggucuccuggagugagguucucagagacuaccagcacagccaccugccagagaugucugccacucggcccucccaggggaugaagcugagcuuuggcagaugccucccagcagccuuugaugaccagcuggagccaccaagagcaaaccuaagucagcuuccugcuucccaaggacuggcacccucauuccucuguagcagccuggccuggcuugucucacacaggccucuccuaggucuuuacacuggcccugaugcuuaggucauuccugccucugcaaauggcccuuccucucucggggcuacacgguuggcaggucuucauucuuucucccgcuccugauccggcccucugagccucugcuaggcuuccccacguccuugaggcuuucaguagacaucuucuucuaacaugguuuucaucccagcuuacugcuuuguccucugcuggagucguggggcugcucuuggacccaggaaagaaaugcaguaaaaacuccccuugauccaguguugaggacaggccucaagccucugccuuaggugcucagagccaccacagugcuguauggauggauugcugccuucuauaaacuguguggcaaucagacccugcuugcucuaaucaugcuugaucacccugugcaagggcacugauugcuucuuugagagguugccucagucucggugucagggcuggagccuguggcagccuaacgaggguaauucaggcagagcugauugugccagaaaguugggagggcucaagagacagaaacgggccaugucacaccccaaacgggaccacauuugcuaaaucuguuucccaugcaauuuuauggugauuacauugccuuuuuuuuuuuuuuuuaacugagcaggcuggcaggacaguucggcuaggaauggaggacugauuguggcuuauggaaugccuucagagcccaggggaagcaguguggccuggggccucugcuccccagguugucugaggacaguucaccucaccacugggaagcuuacucccuagccuugugcaguaggugaacgaucaucagacaugguuccuagggaggugguaugccuccacagcagaaagcugucagugcuacugugcccaacucaacacaacaccccgccaagcugaggagggcaaggcgagguaucugagccacaucaucaaacagcagacuuaugaacucuuccgcccaugaaacuggaugggugugcacaugggcggucccacaccaggcuccuuagugggaggccauggugauccugccuuauagauggguggcucgcagugacgacuguacaugguccugccacacaaccacugaggagguucccgcucuguuccaaugaggggauaugcuguuuguuuucugcauuagauaaaacuguggggcaggaguuccacggugcccacugucaccccugaggauauaagcuauuucuguggucaccucuuggauucccaucccacuaagacucagagccacgagcuuuagcaaaaauguuuaaucucuccuuaauguguguuuauuuacaaguacuaaaucugaagaaccguaaaauaggaaauagccguauauuuacacaucugauggcugagcguauuggcucugccgcuuccagagaagcaauggccgaggccuggucuacucagaccauccaaaugaccagggauuuuuuuugggugggggugggaggaaggggguaagagggaguguucugcggcauuaaaggacagcuaaucaugggcuucaccuuaaaaauaucuuucucucucuaaauauaucuacucuagcuuguguagcaccgaugugagccaccagauccaacuggggaaacuggaguagaggguggcagucggaccccucugaaccaacagagguugcuggccugugccuggacucaaugcagugucucuuggggacacaucaaggcccucaccccugcugcucugucuagcuguccaaccauaagagaguggggcagcuggagagcagagccagcccaaggcauguggaggccaggcacccaggcccagcuuggaauggcccaggcacuccugaguccaggugcaaagggaaagaccaggcaggaagggggauggggcccauggcaggacggcaguaccaagaguguuagggccaggcuggcuggaguagugcuugcccaccucccugggcccuaggccuguagaggguggcucugagcauccaccacccagugugcaguuggcuccaaccccaagccauauugaggcugaaacggaacccuuugcaggauaccacagagauggauggcucuagaagaccaaggacaagcagaugucagagcccaguccagaaguagcagggaaaugaggccuggcccugauggcugugccgagaagaugcgugguaagaacagcuagggcaguucgcauguaaacagaaaugcuaaagugcuugcgaacaaacacccugggaagcugcuccaggccaccucaccuccuaccugacacccacaugggcaagguggccuguaggacaaagugaggcuggccuauucugagggagccuggggacguggggcuggauagugaaggcauugagccuagaagcugugcguguuccaggcagagcuggaagaacugggggcuuccaucugaagccuacaaccagggaagacuuuaggggaaacugaggcucccacccaggcacagccuggaggcaucagaaggaagagagggguauauccauggguaaaaccccaggcaacaacaggggcuucugagaaacggcuauauccaggcucugacccuaguaucagcccagggaaugagccaaagaguuggggugggagucugaccagaauucauggcccagggugucuaggcucaugacuaccacagaggaguugcucccugaguccuuguaccugccccauagcuaauaaaggugcagcucuaaucugaccuccacccugucccaucggcucccuagcuuggagugugagggaccacaagacuagcagcccauggauguggggugugcuguccccagcacugauaaugguccuggccacaguuagcugucccuuaaaauccauuauaaucuuuaguaccaucaaaaaggugaacuugaaaagggaguaggccgcuugcuugcuuuuccaaugacuaauuaaaaaaaaaacauuuaaaaaaagggucuaaccaccucuaguauucaacacuugcaguuugaaaagaucaacucagacuaaacgcuagcacagucaugcagguccacagcucugcacccaaagcucggggcacggaaucgugggcagcggcuucuuccaucugggggaaguagaggccacaucagauggcagcuccagggcccuugguuuugcucucuuccaccuggguuccuccugaauugccuuuccgugucucuucccucaaauaauuguacagcaccccauuggggccagggccacacacacauauauauauauacacauacauacauauauauauguacaggguccauuaaaaacguacuguugcuccuugagggcagagguggacacaguugaccuccagucccuugggucacugcccauggucagcaggguggcagaaaugccccccacauccccagggcaaaauaccacaggauuucuuguucccuuaaaagcaguacccagaugucccacugcagaggggccaggacaccguugagaggccagacuggaagccaccgggaacaucaggggaggggaggauaaaggauggugggacgguggccuguuauccuccagagcuccguggugggcugcgauaggagcaggaggcggggaauaaauaacgggaacaugcacucugacuggagccccaggaccaggagcucccagaggcacagcccugaggacagagaaggguucgccuagccauuguccacaugucacuuggaaguggggucugcaggcccuccauaggaggggaguggggccucucuccccagcagaaggauguggcacuccagccuuggccgcgcagagcacgcggugaaucugagggugguggcaagcacagggugcuagaguagaggcuggugggacagccccaggcugugacuuauguggccuagccuuggguaucucaccucucccucagacucugccugcugguagcagcugaagaagccaagaaaugugaauugguccagccccuuguccugcugcccuccuucuggagggccuggccuucuaucucggccccucagaggccaccucucucucaggaaaaccacuagcagcucuugccaagcagcaaauaucccugggcagaaccagccacgcugugcuauccuugccccacggcagcaagccccaggcacagaggcggcucagcaggaacccuuacauccacagcgauaagaauuggcccugcauggcagggagaggaaggcgagggccaggacccaaccacagcccccacaccuggacuugguacaggugggccaagggcugucuccuggguccucugcugcccuccugcucugccuccugcugggugggcacuuccagggcucagcugcucagggccauuguguccaccaccugcuccaguuugcuucgaagccgcugccuucgagccuguucaucuuucuccagagccaccagaaucugcaaggguggggugaggggugggauagggucagagucaggguuagcuacccacagauaugggcuggaagcucuaagggaagcagcuggaccaagacacaugaccuuggugugucugacucccaguuccuagcugugccaacaguucugauccagaguacuacagcacuugagggugagcccccaagcucauuaccuccacccucaucucccucaucaacaggcuguggcuccuggcuauggccucucccaccuugcccuucucaggcuucugggagucuucuacggcaguguuccacacccugcuucugauguggcauggccacuguucucuacuguggcuggguuucuuaugcucuucgguugucuucucgaguaucacacuccuaccucagucuaugugggagcucaggcccagccucccauccuaucccuuaaucacuacaaccugugagcccuuccauggcugguuugaacccggagcccuucugagcccaaggcuucacgaucuuagaccugucucuguggcuucccaccuccagacaagcugccuggcuaucuaccucacuggcucagcacagccaagcagaccauggucucccugccugucuagaucuauaagaauccaucaggcucugggacacagccaagcuccaagccuccacaccuaggucacccuggucuguauaucuucugccucuucccaggugggcccuagcucagccauguagacucuauggaucuuggccugccaggcccucucauugccuuggccagcacugcccacacauacccaguccuuggcuauugguacccauaagcuccagcccagagucagagacaaguuaucccagagagaagagguaggggagcugcuucuuggcaaaggacaaggagcaaccuuugccaagcccagagauaccauccagcccaauaaacuacuauaggaccacagcuauccauuccaggaaaccacugucacccugucuccccacccugccccagagagccuucuuugugcccagaaucucugauuuucuuacuagcccuaggaaaaucugggcugucagauacagaagcaaagcaaguauugggugagcucugagacauagguggaacuggggucggggaaggacgcaccucguccuuguacuuggcgauguaggaguagaucucgugcagggcacucaugcuguugaacuggcugagaugcagccgggacugcucugccagguaggcgcucaugucuuggucacugauugcaggcaucuuggcaaugucagcauaguaccugacaguagguagcagggucagcauggguggggucacagggccuacucacccaccaaccuguggccccugcauggccccugcuggacaccuaccuuucaacccagcucuuguaguuggggauguccuuggcauagagcaacuuguuggagggugagucuuugcccagcuugugcucugauguagagcaggaguccaugaaggucugcgcuaccacugagaggcaggcaucuguuaugcuguucuuguggaugucgaacacgaacugaggguucuuaaucacauucacccagaagcgcagaggcaggcuguggacaagcaggcccaagagugcucaggauggccauucugcagcccauccccuucuggacagcagcuagaguggccugacucugucccccagagaaugaguggaugcccacaugcucaacuaggacaggccccucaccccacuggccagacaggacaugcugccaacaaccuggugccucucagagcaucaauccucacguucagcuuacguccauggccaucccugaggccugcacuggcuuauauccugccccugugcucaucuccaguccaagcacauaugccuucacaccuacccccuaugcuccacaaggccucacagacagccuuggcugggcacccaaucauaacacaugcuuuucaaacauuaacuaaauaaaaauggagacugaggcuauugugaccauaggcaugugccaaaagccugcuaacuccacauggcugaggcaguugcucuagaauagccagugcugucucucagcagcuccucccuugcugggaccccugacaggcagcccagauggaccugggucuuaggcucccacagcccuggagggagacaacagauaaaaaccaagagggaucgugagaaggggagaggaggaguacagggcucuaggcugaggccaggaccauccagcacacuaggccaagggucaugagauuaggaaagugaauggccaacucuacuugaaggucagagcacaaauucaggguaaaaggugcuaacggguguguggacaugaaagguacucccuggagggaauguagaauggaggucuggugcaaacuuguaggcgaggaaggucaacugaccagucuucaguccaaguggcccuccucuaaagucaugggcuaugggggugggaagaccacacacagugguagagccugcugggucaggguuacauacagcagaagcccacaacuguguuugacaguuaaagccagagaauccugagcagccccaauagggagcacggggcugaggggcccauggcuaggcugcaggcaucaaggacuggucuaaaaguauagguggucuauucugggagaaggcaggucagggcugagcacacaggagucacaggaagcacuggaguggacccacuggggucuggguggcuugaauucucaacugcucucugaacacaggcuugugcuaugaacaucacuuccucuauguuaucaauugggucuggcccaccaaacucuguuucuuacaaggcagccccucacccauggaauuccuacaggccagaguagugggguuguggcaggauccagggcuggaaacugggaagguccugggugauccugacacuguaaggcccgggcccuggcagucccaccccuaugguagucgcaccaauugcucuuccagguauggcgcacaucugagucguggaucugaugcuugucggccugcucaucuaagaagucaaacauguacuugauggccagagguagggcugagccacggugcgccgugcugaagauggucucgaacaggucauccacgaacuuuuguaguguucccugcagggugaguagugagcuucagggcggcccagggcacuacccuccuaggaccuggacaggucuguaggagcucuggauuuggucaugugugcugggcaucuucccauacaccuaccuugguggccagcagccugguuagguagaucucagagaccaucuugcugccacggucgccuucacguugguccagguggucgugguucuucaccaggugccacaguuuuguuccacuuuccaggucuggcgugaucauggguguucgugagcguaggcugucggggcuacuggcuguacgcagcaugcucucugcaggaauagccugucagcuggcagggacgugucccucacccauggccagacccugcccuaccccagccaguuuuccuucagagggcaccaaggcuccugcuagguauguuggggaauagccacuguggucacccgaggucccuuguuuauaggcuauggggacaggcauuguuucagaacugacaggaaggccacgagccacauguccccuuaguccuggcauccaacacacuggcagagcaguaggaagggcaucccauccaaguccacugcccacccacuuccugcuugcaacccugccggucccucaccguaucugcugagggacuuagugaagguagaggaguuggagauguuguaggccgaugucugcuuggguacuagugccaccgaugacccauccgucaccugugggcagacaucaaggauacaagucccagggugccacuaaguguccagcccaaccugggaggaccuaaagacacccgugguucugccccucgagagaagucaugccaccacucugaaucuccacugggaugguuccagggcagauaauuacuugggcauggcacaguccacaccugacuaggcauguuccaguuuaagggaaagaaagcccacaguggucccuggaugguagcguuaccugauagugagcuaguguguucagccucuuccagucauugucaauuuuaguggugacguccucguccugaaggaugaugcgugccaugcgacccuggcgccacucuacaggaaguaggguauuagaggugggacccccccuuccuucucucccuccuuuucuuccucucuaccuucuauccagcuccucauucuacuggcacauagaacaagggagugggggaagagaggaagacagggaggggcuugcucugcacuugaggaagagccugggauagagccagaagccgaggcuccuccacuggauagcuacacucacaggcucagagguggcauagucugcccaugggguuggccuuucaucuggugcuugguugagcccaagagguaggcccugcucuacccagguuccaguuucaacuauuccagacauaucuccuuaggaucccagaacugugucccacauuuuuuugacuuuugacuuuccccagugcaaaguucucuuccuucagcucagacagcccuggcuucccagagaauaucaaacuuacacccagcuucuucuccacgggucuccuccaucacucuacucuggccugcaaacccuagcuuacccugucaccucccuugaaugccuuccuaccauaggacagcaucaagggacacuugcccaccacucacccagguccauguccccggccuucggccgcugugaguaaggcacacccuuguacacagcauccaggagcuucuccuugaccugggucacggugucacaguucagccccuucacaggaaccucgggcgcauucucauguucaggguucacgcaguucagggucugugugugaggagggugguauuguagcaccagccacaccccucacuucugccaguccuguccacucaguucaguucacuggaaggggaggacccaggacgggggcaggggagugggugggcucaccagggucuuguagucaaucugcugccgaaugagcuugucuucgcucagagaguagcgggccuccccugugauggcgucaauagggcccuucuccaucugcugcuugauggcacaguacagcauaaagagcggcuccccagcacacuccuguguggggugguaggguaugaggcugggauuggaccugucagcccuuuaagggcuaucuagcuauuuucagaagcuccaucucuucuugaaggcaagccugucucuggagccagcaccaggcaaggauaucuaaugagcgacacccccaguguccuuaugacuguagacacagaaauccuugagauacuacccucacucacaccaagugcgaucaugaucugcuggaugaucagccuagaggccagccuagccagaaguccagcaucacgaagagcaugcuuucaccacaaucaccagccaaacacugacuccugauguuccuuaucaccaagggacagaggaacccacagacugguggcaaggagaaacagggacuggcaggguagccucugcacacuuggcaagagccugcauugucccuacccucagcugucaucuggcuuugugcacugcagguguggggccagaaguagggccacauuacucagcaaggugagcggggcaaaugcuggcgcucaggcugcucccauggcccugaaggcccaccccugacuguagcagucacuccucacagaggcugcugcuggcugagaaugccuaggccagaggcuagcccaggugagcccuuggcaagcccauggugacucuguacccagauguccuagccccuuauuagcaucugaggcaauuaaagagacagcugcuaaggaaggaacagccaggagcaucgaucaucccuagaccuucagacaacacuccugucuuugaaauuauguuucauuugcaaacuuggcuucauuaagucagcuaggaagugggagggagggggagcagguugggacucagagccaucaauagcugccucuuuuggcaaacacucccucauaagguuuccccagguuagauugccugcccuuagguuccugagcagaguaaaaggagcagaggcggcaggccagugcccaaagccuuggaugcagacccguccaacccuaaugcaucugccccagcaaagccagggcuucuaagagaaagcucagacccagaaggaccugaaggccuggacuaucacuuucaccagucuuuccaagaccgugaaagagcagucagagaucagagcccagggaggaggccggcccagaacaaagcagaccuaagccuagggcuuucucucucugggucucauuucccugucccauuacaggggaaagguagggccccagcuuccucucagcccugcugagaaggugcagagaauaguccuuucauagagaggcaacagcgcaggaggagcauggcaguaaaugaggcacggcaccagcuuuccaucuucaaggagagccaaguugaccccuaccucauaccaugcacuuguagcauaaacgcuacagaugauggaauguuguauuuaaaauaccacccccccuuaccaaauuaaaaaaaaaaaaacccuagaaaauacacaauuguggcuucaaagaugaagguggcuagucaagcaaguuguuuaacuuguagaauaaacggcagccaagaaagcaugcuguccguacucaugcacaucuccagggauggugucacagcacccaggccaggaaggcucuaagucagcacagcuuaugcugcaaaugaggaugcagcugugcucauucuggaagcccucacagcuccagcagaaggcugcuguguuggggagaauucacauuccccuaacacccucugccagugugacagaggacagugaaagugacaguacccugugccaccugaagacaugggccuaacccuccuggggugggguaaaaggaagugaggagcagggugggguaccaggaccccugugaaaagcacuggggggguaggcguggcaaccacagccuuggagguaggagggguagggggugaacuucggaccagcacgucacuacagccagaccucaagacaaaaaaucugaacaaaaccuguuccucuaccuguagacauuugcuuccauucaguucagugacccacacugaauauugauggcugugaccaccagagcuggggcccugcccccuuaccucacauuguugacaguguagugacagacaggcagagcaacuaccucccucauacauucuagucccaggcaucugugagcaggggaugggcucagacccugcccaagugcagacucaugagaacaccaugcauucugcuuucuuucccuucuguucuccccaggcaaacugagcugugugugggggauggcuaugcuggccaggcagggugauucucauucuaggaagggaccgcucaugcuucucagagaguucucauggcuuaacacacccgcaucucuaguuguccauuacauacugugugcuguagcugaccacagcaacugacccgaaggaaagcucaguagcggugcaggccgcacauggcugucagaagacacagcucugcagccacacaccuggucaaaccagccagcaaugcaaggccuucauggauaauucugcuuagagggcacccccacaucagucaaauucauaggcagaaaggagaaaggugguacgguggagggagaggagagggacaaggaguguaccaugaagacaagaccaauggugcagaagauguugacaagggcugcacuuuacagauguauugacucuggugaccuguacacuccagaggcugaagcacgaaggucaugagcuccaggccagccugggcuaucuagggaggccuugucucaaacaauaagauaagggcuggugagauaacucagcaaguaaagaagccugcugccaacccugccaacuugacuccgaucccugggacccacauggugaaaggagagaacccaccccugcaaguuguccucccacuucugcgugugcauuguggcauacacccacauaauaaagaaaaaaauguaauuuca

SEQ ID NO: 3208 - RNA, 22994 nt, Mus musculus
ugaaauuacauuuuuuucuuuauuauguggguguaugccacaaugcacacgcagaagugggaggacaacuugcagggguggguucucuccuuucaccaugugggucccagggaucggagucaaguuggcaggguuggcagcaggcuucuuuacuugcugaguuaucucaccagcccuuaucuuauuguuugagacaaggccucccuagauagcccaggcuggccuggagcucaugaccuucgugcuucagccucuggaguguacaggucaccagagucaauacaucuguaaagugcagcccuugucaacaucuucugcaccauuggucuugucuucaugguacacuccuugucccucuccucucccuccaccguaccaccuuucuccuuucugccuaugaauuugacugaugugggggugcccucuaagcagaauuauccaugaaggccuugcauugcuggcugguuugaccagguguguggcugcagagcugugucuucugacagccaugugcggccugcaccgcuacugagcuuuccuucgggucaguugcuguggucagcuacagcacacaguauguaauggacaacuagagaugcggguguguuaagccaugagaacucucugagaagcaugagcggucccuuccuagaaugagaaucacccugccuggccagcauagccaucccccacacacagcucaguuugccuggggagaacagaagggaaagaaagcagaaugcaugguguucucaugagucugcacuugggcagggucugagcccauccccugcucacagaugccugggacuagaauguaugagggagguaguugcucugccugucugucacuacacugucaacaaugugagguaagggggcagggccccagcucugguggucacagccaucaauauucagugugggucacugaacugaauggaagcaaaugucuacagguagaggaacagguuuuguucagauuuuuugucuugaggucuggcuguagugacgugcugguccgaaguucacccccuaccccuccuaccuccaaggcugugguugccacgccuacccccccagugcuuuucacagggguccugguaccccacccugcuccucacuuccuuuuaccccaccccaggaggguuaggcccaugucuucagguggcacaggguacugucacuuucacuguccucugucacacuggcagaggguguuaggggaaugugaauucuccccaacacagcagccuucugcuggagcugugagggcuuccagaaugagcacagcugcauccucauuugcagcauaagcugugcugacuuagagccuuccuggccugggugcugugacaccaucccuggagaugugcaugaguacggacagcaugcuuucuuggcugccguuuauucuacaaguuaaacaacuugcuugacuagccaccuucaucuuugaagccacaauuguguauuuucuaggguuuuuuuuuuuuuaauuugguaagggggggugguauuuuaaauacaacauuccaucaucuguagcguuuaugcuacaagugcaugguaugagguaggggucaacuuggcucuccuugaagauggaaagcuggugccgugccucauuuacugccaugcuccuccugcgcuguugccucucuaugaaaggacuauucucugcaccuucucagcagggcugagaggaagcuggggcccuaccuuuccccuguaaugggacagggaaaugagacccagagagagaaagcccuaggcuuaggucugcuuuguucugggccggccuccucccugggcucugaucucugacugcucuuucacggucuuggaaagacuggugaaagugauaguccaggccuucagguccuucugggucugagcuuucucuuagaagcccuggcuuugcuggggcagaugcauuaggguuggacgggucugcauccaaggcuuugggcacuggccugccgccucugcuccuuuuacucugcucaggaaccuaagggcaggcaaucuaaccuggggaaaccuuaugagggaguguuugccaaaagaggcagcuauugauggcucugagucccaaccugcucccccucccucccacuuccuagcugacuuaaugaagccaaguuugcaaaugaaacauaauuucaaagacaggaguguugucugaaggucuagggaugaucgaugcuccuggcuguuccuuccuuagcagcugucucuuuaauugccucagaugcuaauaaggggcuaggacaucuggguacagagucaccaugggcuugccaagggcucaccugggcuagccucuggccuaggcauucucagccagcagcagccucugugaggagugacugcuacagucaggggugggccuucagggccaugggagcagccugagcgccagcauuugccccgcucaccuugcugaguaauguggcccuacuucuggccccacaccugcagugcacaaagccagaugacagcugaggguagggacaaugcaggcucuugccaagugugcagaggcuacccugccagucccuguuucuccuugccaccagucuguggguuccucugucccuuggugauaaggaacaucaggagucaguguuuggcuggugauuguggugaaagcaugcucuucgugaugcuggacuucuggcuaggcuggccucuaggcugaucauccagcagaucaugaucgcacuuggugugagugaggguaguaucucaaggauuucugugucuacagucauaaggacacugggggugucgcucauuagauauccuugccuggugcuggcuccagagacaggcuugccuucaagaagagauggagcuucugaaaauagcuagauagcccuuaaagggcugacagguccaaucccagccucauacccuaccaccccacacaggagugugcuggggagccgcucuuuaugcuguacugugccaucaagcagcagauggagaagggcccuauugacgccaucacaggggaggcccgcuacucucugagcgaagacaagcucauucggcagcagauugacuacaagacccuggugagcccacccacuccccugcccccguccuggguccuccccuuccagugaacugaacugaguggacaggacuggcagaagugagggguguggcuggugcuacaauaccacccuccucacacacagacccugaacugcgugaacccugaacaugagaaugcgcccgagguuccugugaaggggcugaacugugacaccgugacccaggucaaggagaagcuccuggaugcuguguacaagggugugccuuacucacagcggccgaaggccggggacauggaccugggugaguggugggcaagugucccuugaugcuguccuaugguaggaaggcauucaagggaggugacaggguaagcuaggguuugcaggccagaguagagugauggaggagacccguggagaagaagcuggguguaaguuugauauucucugggaagccagggcugucugagcugaaggaagagaacuuugcacuggggaaagucaaaagucaaaaaaaugugggacacaguucugggauccuaaggagauaugucuggaauaguugaaacuggaaccuggguagagcagggccuaccucuugggcucaaccaagcaccagaugaaaggccaaccccaugggcagacuaugccaccucugagccugugaguguagcuauccaguggaggagccucggcuucuggcucuaucccaggcucuuccucaagugcagagcaagccccucccugucuuccucucuucccccacucccuuguucuaugugccaguagaaugaggagcuggauagaagguagagaggaagaaaaggagggagagaaggaagggggggucccaccucuaauacccuacuuccuguagaguggcgccagggucgcauggcacgcaucauccuucaggacgaggacgucaccacuaaaauugacaaugacuggaagaggcugaacacacuagcucacuaucagguaacgcuaccauccagggaccacugugggcuuucuuucccuuaaacuggaacaugccuagucagguguggacugugccaugcccaaguaauuaucugcccuggaaccaucccaguggagauucagagugguggcaugacuucucucgaggggcagaaccacgggugucuuuagguccucccagguugggcuggacacuuaguggcacccugggacuuguauccuugaugucugcccacaggugacggaugggucaucgguggcacuaguacccaagcagacaucggccuacaacaucuccaacuccucuaccuucacuaagucccucagcagauacggugagggaccggcaggguugcaagcaggaagugggugggcaguggacuuggaugggaugcccuuccuacugcucugccaguguguuggaugccaggacuaaggggacauguggcucguggccuuccugucaguucugaaacaaugccuguccccauagccuauaaacaagggaccucgggugaccacaguggcuauuccccaacauaccuagcaggagccuuggugcccucugaaggaaaacuggcugggguagggcagggucuggccaugggugagggacacgucccugccagcugacaggcuauuccugcagagagcaugcugcguacagccaguagccccgacagccuacgcucacgaacacccaugaucacgccagaccuggaaaguggaacaaaacuguggcaccuggugaagaaccacgaccaccuggaccaacgugaaggcgaccguggcagcaagauggucucugagaucuaccuaaccaggcugcuggccaccaagguagguguaugggaagaugcccagcacacaugaccaaauccagagcuccuacagaccuguccagguccuaggaggguagugcccugggccgcccugaagcucacuacucacccugcagggaacacuacaaaaguucguggaugaccuguucgagaccaucuucagcacggcgcaccguggcucagcccuaccucuggccaucaaguacauguuugacuucuuagaugagcaggccgacaagcaucagauccacgacucagaugugcgccauaccuggaagagcaauuggugcgacuaccauaggggugggacugccagggcccgggccuuacagugucaggaucacccaggaccuucccaguuuccagcccuggauccugccacaaccccacuacucuggccuguaggaauuccaugggugaggggcugccuuguaagaaacagaguuuggugggccagacccaauugauaacauagaggaagugauguucauagcacaagccuguguucagagagcaguugagaauucaagccacccagaccccaguggguccacuccagugcuuccugugacuccugugugcucagcccugaccugccuucucccagaauagaccaccuauacuuuuagaccaguccuugaugccugcagccuagccaugggccccucagccccgugcucccuauuggggcugcucaggauucucuggcuuuaacugucaaacacaguugugggcuucugcuguauguaacccugacccagcaggcucuaccacuguguguggucuucccacccccauagcccaugacuuuagaggagggccacuuggacugaagacuggucaguugaccuuccucgccuacaaguuugcaccagaccuccauucuacauucccuccagggaguaccuuucauguccacacacccguuagcaccuuuuacccugaauuugugcucugaccuucaaguagaguuggccauucacuuuccuaaucucaugacccuuggccuagugugcuggaugguccuggccucagccuagagcccuguacuccuccucuccccuucucacgaucccucuugguuuuuaucuguugucucccuccagggcugugggagccuaagacccagguccaucugggcugccugucaggggucccagcaagggaggagcugcugagagacagcacuggcuauucuagagcaacugccucagccauguggaguuagcaggcuuuuggcacaugccuauggucacaauagccucagucuccauuuuuauuuaguuaauguuugaaaagcauguguuaugauugggugcccagccaaggcugucugugaggccuuguggagcauaggggguaggugugaaggcauaugugcuuggacuggagaugagcacaggggcaggauauaagccagugcaggccucagggauggccauggacguaagcugaacgugaggauugaugcucugagaggcaccagguuguuggcagcauguccugucuggccaguggggugaggggccuguccuaguugagcaugugggcauccacucauucucugggggacagagucaggccacucuagcugcuguccagaaggggaugggcugcagaauggccauccugagcacucuugggccugcuuguccacagccugccucugcgcuucugggugaaugugauuaagaacccucaguucguguucgacauccacaagaacagcauaacagaugccugccucucagugguagcgcagaccuucauggacuccugcucuacaucagagcacaagcugggcaaagacucacccuccaacaaguugcucuaugccaaggacauccccaacuacaagagcuggguugaaagguagguguccagcaggggccaugcaggggccacagguuggugggugaguaggcccugugaccccacccaugcugacccugcuaccuacugucagguacuaugcugacauugccaagaugccugcaaucagugaccaagacaugagcgccuaccuggcagagcagucccggcugcaucucagccaguucaacagcaugagugcccugcacgagaucuacuccuacaucgccaaguacaaggacgaggugcguccuuccccgaccccaguuccaccuaugucucagagcucacccaauacuugcuuugcuucuguaucugacagcccagauuuuccuagggcuaguaagaaaaucagagauucugggcacaaagaaggcucucuggggcaggguggggagacagggugacagugguuuccuggaauggauagcugugguccuauaguaguuuauugggcuggaugguaucucugggcuuggcaaagguugcuccuuguccuuugccaagaagcagcuccccuaccucuucucucugggauaacuugucucugacucugggcuggagcuuauggguaccaauagccaaggacuggguaugugugggcagugcuggccaaggcaaugagagggccuggcaggccaagauccauagagucuacauggcugagcuagggcccaccugggaagaggcagaagauauacagaccagggugaccuagguguggaggcuuggagcuuggcugugucccagagccugauggauucuuauagaucuagacaggcagggagaccauggucugcuuggcugugcugagccagugagguagauagccaggcagcuugucuggaggugggaagccacagagacaggucuaagaucgugaagccuugggcucagaagggcuccggguucaaaccagccauggaagggcucacagguuguagugauuaagggauaggaugggaggcugggccugagcucccacauagacugagguaggagugugauacucgagaagacaaccgaagagcauaagaaacccagccacaguagagaacaguggccaugccacaucagaagcaggguguggaacacugccguagaagacucccagaagccugagaagggcaaggugggagaggccauagccaggagccacagccuguugaugagggagaugaggguggagguaaugagcuugggggcucacccucaagugcuguaguacucuggaucagaacuguuggcacagcuaggaacugggagucagacacaccaaggucaugugucuugguccagcugcuucccuuagagcuuccagcccauaucuguggguagcuaacccugacucugacccuaucccaccccucaccccacccuugcagauucugguggcucuggagaaagaugaacaggcucgaaggcagcggcuucgaagcaaacuggagcaggugguggacacaauggcccugagcagcugagcccuggaagugcccacccagcaggaggcagagcaggagggcagcagaggacccaggagacagcccuuggcccaccuguaccaaguccaggugugggggcugugguuggguccuggcccucgccuuccucucccugccaugcagggccaauucuuaucgcuguggauguaaggguuccugcugagccgccucugugccuggggcuugcugccguggggcaaggauagcacagcguggcugguucugcccagggauauuugcugcuuggcaagagcugcuagugguuuuccugagagagagguggccucugaggggccgagauagaaggccaggcccuccagaaggagggcagcaggacaaggggcuggaccaauucacauuucuuggcuucuucagcugcuaccagcaggcagagucugagggagaggugagauacccaaggcuaggccacauaagucacagccuggggcugucccaccagccucuacucuagcacccugugcuugccaccacccucagauucaccgcgugcucugcgcggccaaggcuggagugccacauccuucugcuggggagagaggccccacuccccuccuauggagggccugcagaccccacuuccaagugacauguggacaauggcuaggcgaacccuucucuguccucagggcugugccucugggagcuccugguccuggggcuccagucagagugcauguucccguuauuuauuccccgccuccugcuccuaucgcagcccaccacggagcucuggaggauaacaggccaccgucccaccauccuuuauccuccccuccccugauguucccgguggcuuccagucuggccucucaacgguguccuggccccucugcagugggacaucuggguacugcuuuuaagggaacaagaaauccugugguauuuugcccuggggauguggggggcauuucugccacccugcugaccaugggcagugacccaagggacuggaggucaacuguguccaccucugcccucaaggagcaacaguacguuuuuaauggacccuguacauauauauauguauguauguguauauauauauauguguguguggcccuggccccaauggggugcuguacaauuauuugagggaagagacacggaaaggcaauucaggaggaacccagguggaagagagcaaaaccaagggcccuggagcugccaucugauguggccucuacuucccccagauggaagaagccgcugcccacgauuccgugccccgagcuuugggugcagagcuguggaccugcaugacugugcuagcguuuagucugaguugaucuuuucaaacugcaaguguugaauacuagaggugguuagacccuuuuuuuaaauguuuuuuuuuuaauuagucauuggaaaagcaagcaagcggccuacucccuuuucaaguucaccuuuuugaugguacuaaagauuauaauggauuuuaagggacagcuaacuguggccaggaccauuaucagugcuggggacagcacaccccacauccaugggcugcuagucuuguggucccucacacuccaagcuagggagccgaugggacaggguggaggucagauuagagcugcaccuuuauuagcuauggggcagguacaaggacucagggagcaacuccucugugguagucaugagccuagacacccugggccaugaauucuggucagacucccaccccaacucuuuggcucauucccugggcugauacuagggucagagccuggauauagccguuucucagaagccccuguuguugccugggguuuuacccauggauauaccccucucuuccuucugaugccuccaggcugugccugggugggagccucaguuuccccuaaagucuucccugguuguaggcuucagauggaagcccccaguucuuccagcucugccuggaacacgcacagcuucuaggcucaaugccuucacuauccagccccacguccccaggcucccucagaauaggccagccucacuuuguccuacaggccaccuugcccaugugggugucagguaggaggugagguggccuggagcagcuucccaggguguuuguucgcaagcacuuuagcauuucuguuuacaugcgaacugcccuagcuguucuuaccacgcaucuucucggcacagccaucagggccaggccucauuucccugcuacuucuggacugggcucugacaucugcuuguccuuggucuucuagagccauccaucucugugguauccugcaaaggguuccguuucagccucaauauggcuugggguuggagccaacugcacacugggugguggaugcucagagccacccucuacaggccuagggcccagggaggugggcaagcacuacuccagccagccuggcccuaacacucuugguacugccguccugccaugggccccaucccccuuccugccuggucuuucccuuugcaccuggacucaggagugccugggccauuccaagcugggccugggugccuggccuccacaugccuugggcuggcucugcucuccagcugccccacucucuuaugguuggacagcuagacagagcagcaggggugagggccuugauguguccccaagagacacugcauugaguccaggcacaggccagcaaccucuguugguucagagggguccgacugccacccucuacuccaguuuccccaguuggaucugguggcucacaucggugcuacacaagcuagaguagauauauuuagagagagaaagauauuuuuaaggugaagcccaugauuagcuguccuuuaaugccgcagaacacucccucuuacccccuuccucccacccccacccaaaaaaaaucccuggucauuuggauggucugaguagaccaggccucggccauugcuucucuggaagcggcagagccaauacgcucagccaucagauguguaaauauacggcuauuuccuauuuuacgguucuucagauuuaguacuuguaaauaaacacacauuaaggagagauuaaacauuuuugcuaaagcucguggcucugagucuuagugggaugggaauccaagaggugaccacagaaauagcuuauauccucaggggugacagugggcaccguggaacuccugccccacaguuuuaucuaaugcagaaaacaaacagcauauccccucauuggaacagagcgggaaccuccucagugguuguguggcaggaccauguacagucgucacugcgagccacccaucuauaaggcaggaucaccauggccucccacuaaggagccuggugugggaccgcccaugugcacacccauccaguuucaugggcggaagaguucauaagucugcuguuugaugauguggcucagauaccucgccuugcccuccucagcuuggcgggguguuguguugaguugggcacaguagcacugacagcuuucugcuguggaggcauaccaccucccuaggaaccaugucugaugaucguucaccuacugcacaaggcuagggaguaagcuucccaguggugaggugaacuguccucagacaaccuggggagcagaggccccaggccacacugcuuccccugggcucugaaggcauuccauaagccacaaucaguccuccauuccuagccgaacuguccugccagccugcucaguuaaaaaaaaaaaaaaaaggcaauguaaucaccauaaaauugcaugggaaacagauuuagcaaauguggucccguuuggggugugacauggcccguuucugucucuugagcccucccaacuuucuggcacaaucagcucugccugaauuacccucguuaggcugccacaggcuccagcccugacaccgagacugaggcaaccucucaaagaagcaaucagugcccuugcacagggugaucaagcaugauuagagcaagcagggucugauugccacacaguuuauagaaggcagcaauccauccauacagcacugugguggcucugagcaccuaaggcagaggcuugaggccuguccucaacacuggaucaaggggaguuuuuacugcauuucuuuccuggguccaagagcagccccacgacuccagcagaggacaaagcaguaagcugggaugaaaaccauguuagaagaagaugucuacugaaagccucaaggacguggggaagccuagcagaggcucagagggccggaucaggagcgggagaaagaaugaagaccugccaaccguguagccccgagagaggaagggccauuugcagaggcaggaaugaccuaagcaucagggccaguguaaagaccuaggagaggccugugugagacaagccaggccaggcugcuacagaggaaugagggugccaguccuugggaagcaggaagcugacuuagguuugcucuugguggcuccagcuggucaucaaaggcugcugggaggcaucugccaaagcucagcuucauccccugggagggccgaguggcagacaucucuggcagguggcugugcugguagucucugagaaccucacuccaggagaccccaggugcccaacuagguguggucagucaccucauagauaaucagagacuagauucugccacauagcaaccccagugguacuuuauucuuggcuggaugcagacaucucugguagguggcugugaggucacagcaccccgucuuucuccuccugucuuccuuaucuccucaaauuaguucccugauggcugucgaauugcagggcaguggucuuuuugguuuaggugauuucauuggccaccuuuagggccgcuacaaguguaugagcccguuaaucuggccuggaggagguagucugguuagcuggacauaggcacaugcccaggagaauggccagugcacuugagccugaguuuugccaaucauucagaguuguguccaugcacacaguccuaagcccaacuucuuugccauuguagcauucccuccuggagagaaaagggaggcuucuaagacucaugaagcuguaagauccaugagacaugcuccccucccccccccccccuuuccccagucaaguaaguaaugacaacuucugagcaggagacuucccuguggaacugccugaagguugcacagggagcucuagggaugcaaauucugagagugguucuccacgcuaggucagacuuuucagugguucagcugcuacgaagucacccaugcaccaauaaacuuguugguucccuaagugaggcuuggguggaaucguuucuuuggucagucauuggugcccaauugagaugauuaguucugcuuucuuggaugcuuguccuuugccuccaacaagagagugagcagagagaggagggaaugaggggaccuacauugucacacaggagugaagauuuacauaacaggaaagugggaauccugagagccucaguggcagcaggauaccaaccaagagaggcuucaggucuuacauacagcuccauguucuaggcagacuuuagguuaccagcccagagacuggcagcaagcuuacaacuccagagucuagaggguuucuggaacccucaggcauggacgccucugacaggacugucccccuuaaauuuugaggucagucuuucuucuccacagaggauguggaaacuugaccagagccaggagcuggcucugaagccuucucuccaucaaaguaugcugcaaagagaaguguugaaaggguugauguuggaccaagugaacaaugauuggcugaauguauguccaugcaaauaagauauaaaaugggaccaauaagcgaagagcuaucaaaccgcaaagagaaaagagaaacccaccaaauuuugagagauaccuacgccuauuucauguuucagagaaaguuggaaaggugggaaucuccccgaagcuuuucuuguuugguguacugcccgcccggagacugaacuugcuuaaggauccuggggacuuggaaccaggcagccuuaucaaaaguccagaacuguucaauccucucuacagcccaauacagcccaauacagcccaauacagccugcugcaucccaggguucuugugugggcuuugcaccagucagggugugaguuugugugugaguguuugugugugcacgugugugcaugugcgugaacauguguuucauucucuugcuaccugaacaacugagagguaagaaggcggacagaugguggcagaggaaccucuugauugucccuggaccacuccaaccaguuguggcuuuuggcugucaaagagagcccgcccagcucuuucagcucuucauuucagaaggguccccagcacuaucuacuaucaagagauguuuguucacaccuuugaacuaaaacagaaacuuagcucuucuuguccaugaacucugguuucacugucagcccaccagcuuaccuacagcuugggucuggccaugaucuuuauucagagcuguccccagucaagcucucuguccuacuguuucugugauccugugugcuucccuuuccagauccccucauuuuuaccugggagggucucugcugcgguuccaugucauaucugugugguagggaacuuaccauacccagcggugccaggcccacacaaacugaagcccaaaagcgcaagccaggaaccuggaaggcuccacagaggaacugacacauuccucccggcuuuugcucauuggcuaagaccaaaaggaccagaggaagaacacagaauuuuugcucaagcaagagccguauacagacaagaugagcucagcuggugaaaucacuuauuaucuaaccuaaccuaaugacccaaccuaaguugcaccccuggaaccgauaaguacccgcccuauuugcucauaaacaaagaaacaaacgagugagugaaucuaauaagauuuuagaagacccagaaucccacuugucuuucuaggaguaaaugacuuagaugcacuuguguccacuaaugcggugggcaggguagcugagcugggcaggaacaucggaucaccuccuuacugcacuuugccacuggcagaagucggggaaggcuugugaaaaagucagacaggcugacuuacuguuugaaacauccuggugaugggcacgaaggaggaguagcuaagccuuugagcugccuugagugcccaucagaagaguucauguguagagaucaagggguaagaggucaggccagaaagauccugccuuuccuggugggacugaagagagggaaggagacaaccugcccagcuguacaagaggacauuuccugggguggacugugccccugauguuggcugcagccugucaagacccaggagcuaagugaaggagaaggcugcuggggucaaaagaacaaguaacugacagggccauucagggcugagggacagaggagaguuauaaggugugggaagcugagcuaaggaagcccugcaugggugacauccugagugaauggcuguuguugacaucgaugacccaugugaaggacuccaaacccucagaccuauggggccagacucaagagggccaugcucuccuuaggagaccaaguauuaugaaugauuaucagugugugcaaagacuaacaacugcaacuuccuccuccaggauguguacagucugagacuguucccuauagacuuccuguagagacuagcaaaaaccccacucucgugcuauaccuaauaaauaugcuaagggagcagaauuucacugcaucccagcuugacuguacauauguccaucugacuguccuuccuacauucccucacugcuccuaauugggauuccaggacccaagcuguaugggauacagcacccaagagaacagucugugcucacaucacccauggugacauucaguguuuagccugcccagcuguucaaggugacauuuccucuggagcugacaagggaccugagcucucuuuccuagugucaggagacccacgugcugugccaugggugaccuuaagccaucuggggaagaagaaaaggaagggagcagccauuucucuugggaaagaugaucuggaaccaagacauuuucaaaacagagacugcuaaaaaagauguguuuaauagcaugggauugaggcaguuuuaaagucugaggucugacccugccucccuguggggcaauauuggagaagucacagaugguuuggaagcacaucggggaacccaacugagcuguguguauacgcacuuaacgacagaugccacaagcugagggcagugcgggggucgcaauccuccuccucugagggcuggcagacaugugacaucuggcaaaucagagcuugcuccgugagguagagcucaccaggcuaccauagaggcagcuuucuuccuugaaagaaaaguggcagguuugguuugauuuuacuuuguaacaaggggcagagucugugaagagagaguuguggguccucuuugggcuguccagcuaugaagcucauucuaaggguugggacccaagacaugagguaucuauacugcccccaugcaaugaccauugcccaucugcuucccacccucagccacaucagccugagaggccugacaggucugcagagcguggcugucccuucugagaggcaaauggcccuucaucugucaccugggaccaggugucugcucagagcugauauggacaacuuagagacugcaguaugcucaguuggacagacagacagacacacacacacacacacagacacacacacacacacacaucaugcaccugaaacuguccccucaggcuucugcccacaagucagggaccacugugacucacuugcagacgucaacacaaaggguaaagccaaggcuguaucccacggugggcuaauccuggauuaggacgcugccagcgcagagccacuugguuccagcaugcucucagcaugcugcuaacggcccauuaagucuugcaggcagaggcccucgaagcucgggcggguggucaugacuuuggaguucuugccagcuucaagcucccauuucccacagucacuggcucacauccucucccauggugggccuuuuccccccacucaaugcaggaucuucaucgacucacuaggauuggcagggccuggcugagggcugcuuugccccuggguucuagaaaggacaucagguuaguuucucugaaaggcugugguucuucuuucucccuccagguacaucaguguuaccuccuugguggccacugaauucaaaauagccauaccuuacaacaaucuuuccccgucacggcacacugcuauugcuuuguuuaucuugcuggccugugaggacagguagacuggucugucuccaucccacauuaggaugguauguggcacacagugcucaucacguguuugcugaguggaugaaugaccacaugcuagucuuggcacacaugcagucuguacaucucuguggaccgugucccauuugugacuaggcaagugcaccaggcugucacccaucucccuugaacuugacuuuuccaauaggucccagggcccugccaggcccuacuaugaugggcuguuguauugaucaauuuauuguccuugcgaccaaauaucucagggaaauaacuuaaauauggagaaggacauuuuggcuacaggcuuggcgauuuugaucuaguuguuccuucuaugagacugggauggagcugagcaucauggagagagagcaaacugcacccaacuucucaccucacauuguccaagaggcaaagauagugagacaggagaggcacagcacaaagaaaaccugcccaggcaugacccuagcaaccugccucuuccaucugggccaccuccuaacucuaucccuugccagcacuaccacaguauuagaaguucaucaguggagugauccaagaugagguaagagccuugugaugcugguaccucuccagagacccagcucagcuccacuugcaauggagacccugccaccacucagccuguguagguauugggggacauuuccaauccagacccuuccuugucccagaacaaaacuugaguguuuuggagaaauugcaaacuuuuccugaggcuggcucuuccucgugaucccagcugccaucucugugucgcuggaagcucuggggacagacuccauguguuccuccugugcagaagucaccaugggcuucagguuuuuguuucccacagugccaugcucugcccugaauuacacagucuuugcacaucaacccagugggucccugcuccccugccugcccagugugugcugagccuccgggggccacaccagcucauuguuuaccucagucgugagugcauauuuuaguccugggugugcccauacuuuaaggcuaaaaugauaucauuagcugagucuuucuuuggaacaguaggugauuugcuaauggugggugaggccuuaccaucaucuuuuuaaguccuagcggacuguugcucuccaggacuaccucugucaugaggccuucaguagguucaagcugccugcucaauuccuugguaugugaccccucaggaggucaguacacauuacaugugauaacacugcccagcugugcuggccaaacacagccagagucagccagaugcagaggccagagcuuccuguggacagcagggugaccucugauuuauauggaacagagcuugcagaagggcacuauggggacaccucguacccccagagguagcaaguuaagucacagacuggcuacagaguuguccuugcugguauguccagcugggucuuaucugaucugcacccucucauggcuaugguggcugcugccaccauucuugcuugucugugucaccaguuuuccccuugaaguccugcuccuuacucugcugcaguugaugcugaggacacuggcacaccugucacuguuguuaggcaauccccacgggagccacucaggcauccuuaguacacagcagcugucuucuccagggaagauaccccgagaggaagcccgaggaaggcccuggugccugcuguggucagccuugaaagucaccugcgcuauugcccagguuagcuuuccuuagcaugggagaaccaccugggcccaugcagaaagaccagcauaagcaucagcuucccucugagggcugcucuucuuggagacuguguucacacacaggagggccugaagaacagucaugaaugucuuguucuccuaacucuuaaguuggaaaugggaucaaauuaccuccagcucuucuuacuaacaccagggcuguaaauuuuccucugaggaacaugagcaccaagguuaagagagagagaacaagggcugacucgauggcucagcaggcaaaggagcuuacuaccaagcuugaagucuuccauucaaucacuggcucuacaugauguaaggagaaaacuggcuuuugcaaguuucccuccaaccuauauauaugucaauguauacacacaguagauaaauaaacguaaauaauuaaaagagagaaagcuuuagaggcuagacagauggcucagugguugagagcucuuucaaaggacugggaucugaugcccagaauccacaugguggcucacaacugucuguaacuccugccccaaguuuuugcaguccacuccugaccucugagggcacuacauacacgucgugcacagauacaugcaggcaaacacauauguccauaaauaauauauaugggcacauuccuccucuggagccccuucuacucucagaaauucuuucucacuuuuccuuaguaaauuuaucuuugcucuccagagagagauagaggagaaagggggagggggggaagagaauuaaaauuuucagacaaagggcacuuguguuuguccauuuaguuuuguuauguguggguuuucuugcauuuauuuuguauuguauguacauguacgguagguauccaugccaagcacuugcgaagaucagagaacaagauacaccccauggguacugaggacaggacucugauugucaggcuuaguggcaugccccuuuaccccugagccacuuuguugguccuacagcuagcuuuguucucacagucuaagaguaugguucaucauggcggggaagccauggcagcaggagccugaggcuccucacucacauuugggugcaugaggaagcagagacaggauggugaacaaaguggacauaaaucucaagacccaccccccaaacacccaucuccuccaaucaggcccugacuccuaaugguuucccaccuccccaaacagcauuaccugcaaaggacaaugcagccugacacaguuuccacaacacugggauuaugcacaacaccaauguacuauauuacaaggcauuuuaaguacuccauauaugagcuauuuuauuuaaucuaccuacucauguaagugaaugcauaucauauuuuuauaagugaccuugaggugauuugaaguguaaagaagguuugcauggguuacauguaaauauggcaccauuugcuguaagugacuugagcaugugaaaaucuuggugugaacaaugugcaggggacaguuuggcuggguauagaauccuagcugggaauucacauuucuucaguacuugacacuaaugcuucauugucuccuucuuuaagucauauguuauggugucuaguuucauuucuaucccuguaacacauaucuugaugaaaagcaacuuagaaaaacaacuuagaagaaaauaggcuucucacagucuccccacugucauacucccucaugucauagcuguugggagcaaguuuuccucacacaaaaacaaguauaguguauaaauauaguaugcuauaucuguguccauguuccccuugugcugcucuggucauguggccauggcagccacagagauguacuccucuagaagggacucccugucacugcaagaacauccaguggcuagcagcucauuggugccugcauagguuuaucucaugucuuuguauuugggggaagcuuggccuuacuguguagcacagacugaccucuaguuugcagaaauucucuugcuucagugcugaguaaugggauuucagguaugagccaucaugcuuggcuugucucagauucaaaaacagggucaugguuagucugggcagcccugucaagaaccaagccagauuccuuucucucacagagcauuccagacucugacuccagacucuccagagcucuacacagagcuccugucuagcuaccuuagggagaagggcuuccuucccaguguguucccuccugucugucacaggugugccuccugcucagccagccccacccagccccauuccuccugccaucccucagccaccacucucuagggaccaccaacagucuccugauugcugauuguugcaguuagaguuuaccagagacauccuucuuucuauucaggcacagcuacaucugcuuuguccuuuuugccagcuuuccuagcaagcauggauuagaagucacuuccugauucuccugcauaaccuuaagugcucuuuagucuuuguugccugcgcccuuugccucagauacccauggauuugugggugugggugggggggguuguuuguuuggguuuuuugaauuuuguuuuuugugguuuuuuuggguuuguuuuguuuugguuugguuuugguuuuuuuuguuuugguuuuucgaaacaggguuucucuguauagccuggcuguacuggaacucacuuuguagaccaggcuggccucgaacucagaacuucuucugccucugccucccaagugcugggauuaaaggcgugcaccaccaugccuggcugguuuuguuuuguuuuguuuuguuuuguuuuguuuuguuuuguuuuguuguuuuuguccuuuugugucauucaaagcucuagguuaaaaaaaaaagacuuuccucgauuacuuauguaagaaaacuuuuaaaagacuuacuuuuauuuuuuuaugugaguguuugccucuauguauguaugugucacaugcgugccugauaccuguggaggccaaaagaagaagucagaucuccugaaguuacaguugguugugggccagaugcuuugugggugaugagaauugaaccccauuucuuugcaagagcagccagugcucuuagccacugagucgucucuccagccccagcuacuugauuugagcuuuaaacuuguagcucucacgcucugucucacuguucuacuacaucucugcugaguccucuccgucuuccuugcuguguaauaucucauguaaugguuccuugucuucucuuucagcaaauuuguccaaugaaugagugacugggggcaggcaagugaaggauccuggggguacucacaggggugugcccaaagugguuacugagaguccugacuaaaaagaagugaggaugcuugguccaagcuggccuccugaugcaauucagaguucccucccucuaugcagcuguagcauuccagggccuaggagucucccacucccuugugcuuaccuucccuuucugcuuagacauguuccaucucuacaacagagggaacccgacauucccauggggucacgugacuuugucagggucccacaguaggggaugaccugguacccaggaagaccuauagaggaacccagguggacccugagcccagcacccacugaccuauauuuccucauuccaaccuugagcacaagcuaaguucucug

SEQ ID NO: 3209 - RNA, 46945 nt, Mus musculus
uaacugagcaggcuggcaggacaguucggcuaggaauggaggacugauuguggcuuauggaaugccuucagagcccaggggaagcaguguggccuggggccucugcuccccagguugucugaggacaguucaccucaccacugggaagcuuacucccuagccuugugcaguaggugaacgaucaucagacaugguuccuagggaggugguaugccuccacagcagaaagcugucagugcuacugugcccaacucaacacaacaccccgccaagcugaggagggcaaggcgagguaucugagccacaucaucaaacagcagacuuaugaacucuuccgcccaugaaacuggaugggugugcacaugggcggucccacaccaggcuccuuagugggaggccauggugauccugccuuauagauggguggcucgcagugacgacuguacaugguccugccacacaaccacugaggagguucccgcucuguuccaaugaggggauaugcuguuuguuuucugcauuagauaaaacuguggggcaggaguuccacggugcccacugucaccccugaggauauaagcuauuucuguggucaccucuuggauucccaucccacuaagacucagagccacgagcuuuagcaaaaauguuuaaucucuccuuaauguguguuuauuuacaaguacuaaaucugaagaaccguaaaauaggaaauagccguauauuuacacaucugauggcugagcguauuggcucugccgcuuccagagaagcaauggccgaggccuggucuacucagaccauccaaaugaccagggauuuuuuuugggugggggugggaggaaggggguaagagggaguguucugcggcauuaaaggacagcuaaucaugggcuucaccuuaaaaauaucuuucucucucuaaauauaucuacucuagcuuguguagcaccgaugugagccaccagauccaacuggggaaacuggaguagaggguggcagucggaccccucugaaccaacagagguugcuggccugugccuggacucaaugcagugucucuuggggacacaucaaggcccucaccccugcugcucugucuagcuguccaaccauaagagaguggggcagcuggagagcagagccagcccaaggcauguggaggccaggcacccaggcccagcuuggaauggcccaggcacuccugaguccaggugcaaagggaaagaccaggcaggaagggggauggggcccauggcaggacggcaguaccaagaguguuagggccaggcuggcuggaguagugcuugcccaccucccugggcccuaggccuguagaggguggcucugagcauccaccacccagugugcaguuggcuccaaccccaagccauauugaggcugaaacggaacccuuugcaggauaccacagagauggauggcucuagaagaccaaggacaagcagaugucagagcccaguccagaaguagcagggaaaugaggccuggcccugauggcugugccgagaagaugcgugguaagaacagcuagggcaguucgcauguaaacagaaaugcuaaagugcuugcgaacaaacacccugggaagcugcuccaggccaccucaccuccuaccugacacccacaugggcaagguggccuguaggacaaagugaggcuggccuauucugagggagccuggggacguggggcuggauagugaaggcauugagccuagaagcugugcguguuccaggcagagcuggaagaacugggggcuuccaucugaagccuacaaccagggaagacuuuaggggaaacugaggcucccacccaggcacagccuggaggcaucagaaggaagagagggguauauccauggguaaaaccccaggcaacaacaggggcuucugagaaacggcuauauccaggcucugacccuaguaucagcccagggaaugagccaaagaguuggggugggagucugaccagaauucauggcccagggugucuaggcucaugacuaccacagaggaguugcucccugaguccuuguaccugccccauagcuaauaaaggugcagcucuaaucugaccuccacccugucccaucggcucccuagcuuggagugugagggaccacaagacuagcagcccauggauguggggugugcuguccccagcacugauaaugguccuggccacaguuagcugucccuuaaaauccauuauaaucuuuaguaccaucaaaaaggugaacuugaaaagggaguaggccgcuugcuugcuuuuccaaugacuaauuaaaaaaaaaacauuuaaaaaaagggucuaaccaccucuaguauucaacacuugcaguuugaaaagaucaacucagacuaaacgcuagcacagucaugcagguccacagcucugcacccaaagcucggggcacggaaucgugggcagcggcuucuuccaucugggggaaguagaggccacaucagauggcagcuccagggcccuugguuuugcucucuuccaccuggguuccuccugaauugccuuuccgugucucuucccucaaauaauuguacagcaccccauuggggccagggccacacacacauauauauauauacacauacauacauauauauauguacaggguccauuaaaaacguacuguugcuccuugagggcagagguggacacaguugaccuccagucccuugggucacugcccauggucagcaggguggcagaaaugccccccacauccccagggcaaaauaccacaggauuucuuguucccuuaaaagcaguacccagaugucccacugcagaggggccaggacaccguugagaggccagacuggaagccaccgggaacaucaggggaggggaggauaaaggauggugggacgguggccuguuauccuccagagcuccguggugggcugcgauaggagcaggaggcggggaauaaauaacgggaacaugcacucugacuggagccccaggaccaggagcucccagaggcacagcccugaggacagagaaggguucgccuagccauuguccacaugucacuuggaaguggggucugcaggcccuccauaggaggggaguggggccucucuccccagcagaaggauguggcacuccagccuuggccgcgcagagcacgcggugaaucugagggugguggcaagcacagggugcuagaguagaggcuggugggacagccccaggcugugacuuauguggccuagccuuggguaucucaccucucccucagacucugccugcugguagcagcugaagaagccaagaaaugugaauugguccagccccuuguccugcugcccuccuucuggagggccuggccuucuaucucggccccucagaggccaccucucucucaggaaaaccacuagcagcucuugccaagcagcaaauaucccugggcagaaccagccacgcugugcuauccuugccccacggcagcaagccccaggcacagaggcggcucagcaggaacccuuacauccacagcgauaagaauuggcccugcauggcagggagaggaaggcgagggccaggacccaaccacagcccccacaccuggacuugguacaggugggccaagggcugucuccuggguccucugcugcccuccugcucugccuccugcugggugggcacuuccagggcucagcugcucagggccauuguguccaccaccugcuccaguuugcuucgaagccgcugccuucgagccuguucaucuuucuccagagccaccagaaucugcaaggguggggugaggggugggauagggucagagucaggguuagcuacccacagauaugggcuggaagcucuaagggaagcagcuggaccaagacacaugaccuuggugugucugacucccaguuccuagcugugccaacaguucugauccagaguacuacagcacuugagggugagcccccaagcucauuaccuccacccucaucucccucaucaacaggcuguggcuccuggcuauggccucucccaccuugcccuucucaggcuucugggagucuucuacggcaguguuccacacccugcuucugauguggcauggccacuguucucuacuguggcuggguuucuuaugcucuucgguugucuucucgaguaucacacuccuaccucagucuaugugggagcucaggcccagccucccauccuaucccuuaaucacuacaaccugugagcccuuccauggcugguuugaacccggagcccuucugagcccaaggcuucacgaucuuagaccugucucuguggcuucccaccuccagacaagcugccuggcuaucuaccucacuggcucagcacagccaagcagaccauggucucccugccugucuagaucuauaagaauccaucaggcucugggacacagccaagcuccaagccuccacaccuaggucacccuggucuguauaucuucugccucuucccaggugggcccuagcucagccauguagacucuauggaucuuggccugccaggcccucucauugccuuggccagcacugcccacacauacccaguccuuggcuauugguacccauaagcuccagcccagagucagagacaaguuaucccagagagaagagguaggggagcugcuucuuggcaaaggacaaggagcaaccuuugccaagcccagagauaccauccagcccaauaaacuacuauaggaccacagcuauccauuccaggaaaccacugucacccugucuccccacccugccccagagagccuucuuugugcccagaaucucugauuuucuuacuagcccuaggaaaaucugggcugucagauacagaagcaaagcaaguauugggugagcucugagacauagguggaacuggggucggggaaggacgcaccucguccuuguacuuggcgauguaggaguagaucucgugcagggcacucaugcuguugaacuggcugagaugcagccgggacugcucugccagguaggcgcucaugucuuggucacugauugcaggcaucuuggcaaugucagcauaguaccugacaguagguagcagggucagcauggguggggucacagggccuacucacccaccaaccuguggccccugcauggccccugcuggacaccuaccuuucaacccagcucuuguaguuggggauguccuuggcauagagcaacuuguuggagggugagucuuugcccagcuugugcucugauguagagcaggaguccaugaaggucugcgcuaccacugagaggcaggcaucuguuaugcuguucuuguggaugucgaacacgaacugaggguucuuaaucacauucacccagaagcgcagaggcaggcuguggacaagcaggcccaagagugcucaggauggccauucugcagcccauccccuucuggacagcagcuagaguggccugacucugucccccagagaaugaguggaugcccacaugcucaacuaggacaggccccucaccccacuggccagacaggacaugcugccaacaaccuggugccucucagagcaucaauccucacguucagcuuacguccauggccaucccugaggccugcacuggcuuauauccugccccugugcucaucuccaguccaagcacauaugccuucacaccuacccccuaugcuccacaaggccucacagacagccuuggcugggcacccaaucauaacacaugcuuuucaaacauuaacuaaauaaaaauggagacugaggcuauugugaccauaggcaugugccaaaagccugcuaacuccacauggcugaggcaguugcucuagaauagccagugcugucucucagcagcuccucccuugcugggaccccugacaggcagcccagauggaccugggucuuaggcucccacagcccuggagggagacaacagauaaaaaccaagagggaucgugagaaggggagaggaggaguacagggcucuaggcugaggccaggaccauccagcacacuaggccaagggucaugagauuaggaaagugaauggccaacucuacuugaaggucagagcacaaauucaggguaaaaggugcuaacggguguguggacaugaaagguacucccuggagggaauguagaauggaggucuggugcaaacuuguaggcgaggaaggucaacugaccagucuucaguccaaguggcccuccucuaaagucaugggcuaugggggugggaagaccacacacagugguagagccugcugggucaggguuacauacagcagaagcccacaacuguguuugacaguuaaagccagagaauccugagcagccccaauagggagcacggggcugaggggcccauggcuaggcugcaggcaucaaggacuggucuaaaaguauagguggucuauucugggagaaggcaggucagggcugagcacacaggagucacaggaagcacuggaguggacccacuggggucuggguggcuugaauucucaacugcucucugaacacaggcuugugcuaugaacaucacuuccucuauguuaucaauugggucuggcccaccaaacucuguuucuuacaaggcagccccucacccauggaauuccuacaggccagaguagugggguuguggcaggauccagggcuggaaacugggaagguccugggugauccugacacuguaaggcccgggcccuggcagucccaccccuaugguagucgcaccaauugcucuuccagguauggcgcacaucugagucguggaucugaugcuugucggccugcucaucuaagaagucaaacauguacuugauggccagagguagggcugagccacggugcgccgugcugaagauggucucgaacaggucauccacgaacuuuuguaguguucccugcagggugaguagugagcuucagggcggcccagggcacuacccuccuaggaccuggacaggucuguaggagcucuggauuuggucaugugugcugggcaucuucccauacaccuaccuugguggccagcagccugguuagguagaucucagagaccaucuugcugccacggucgccuucacguugguccagguggucgugguucuucaccaggugccacaguuuuguuccacuuuccaggucuggcgugaucauggguguucgugagcguaggcugucggggcuacuggcuguacgcagcaugcucucugcaggaauagccugucagcuggcagggacgugucccucacccauggccagacccugcccuaccccagccaguuuuccuucagagggcaccaaggcuccugcuagguauguuggggaauagccacuguggucacccgaggucccuuguuuauaggcuauggggacaggcauuguuucagaacugacaggaaggccacgagccacauguccccuuaguccuggcauccaacacacuggcagagcaguaggaagggcaucccauccaaguccacugcccacccacuuccugcuugcaacccugccggucccucaccguaucugcugagggacuuagugaagguagaggaguuggagauguuguaggccgaugucugcuuggguacuagugccaccgaugacccauccgucaccugugggcagacaucaaggauacaagucccagggugccacuaaguguccagcccaaccugggaggaccuaaagacacccgugguucugccccucgagagaagucaugccaccacucugaaucuccacugggaugguuccagggcagauaauuacuugggcauggcacaguccacaccugacuaggcauguuccaguuuaagggaaagaaagcccacaguggucccuggaugguagcguuaccugauagugagcuaguguguucagccucuuccagucauugucaauuuuaguggugacguccucguccugaaggaugaugcgugccaugcgacccuggcgccacucuacaggaaguaggguauuagaggugggacccccccuuccuucucucccuccuuuucuuccucucuaccuucuauccagcuccucauucuacuggcacauagaacaagggagugggggaagagaggaagacagggaggggcuugcucugcacuugaggaagagccugggauagagccagaagccgaggcuccuccacuggauagcuacacucacaggcucagagguggcauagucugcccaugggguuggccuuucaucuggugcuugguugagcccaagagguaggcccugcucuacccagguuccaguuucaacuauuccagacauaucuccuuaggaucccagaacugugucccacauuuuuuugacuuuugacuuuccccagugcaaaguucucuuccuucagcucagacagcccuggcuucccagagaauaucaaacuuacacccagcuucuucuccacgggucuccuccaucacucuacucuggccugcaaacccuagcuuacccugucaccucccuugaaugccuuccuaccauaggacagcaucaagggacacuugcccaccacucacccagguccauguccccggccuucggccgcugugaguaaggcacacccuuguacacagcauccaggagcuucuccuugaccugggucacggugucacaguucagccccuucacaggaaccucgggcgcauucucauguucaggguucacgcaguucagggucugugugugaggagggugguauuguagcaccagccacaccccucacuucugccaguccuguccacucaguucaguucacuggaaggggaggacccaggacgggggcaggggagugggugggcucaccagggucuuguagucaaucugcugccgaaugagcuugucuucgcucagagaguagcgggccuccccugugauggcgucaauagggcccuucuccaucugcugcuugauggcacaguacagcauaaagagcggcuccccagcacacuccuguguggggugguaggguaugaggcugggauuggaccugucagcccuuuaagggcuaucuagcuauuuucagaagcuccaucucuucuugaaggcaagccugucucuggagccagcaccaggcaaggauaucuaaugagcgacacccccaguguccuuaugacuguagacacagaaauccuugagauacuacccucacucacaccaagugcgaucaugaucugcuggaugaucagccuagaggccagccuagccagaaguccagcaucacgaagagcaugcuuucaccacaaucaccagccaaacacugacuccugauguuccuuaucaccaagggacagaggaacccacagacugguggcaaggagaaacagggacuggcaggguagccucugcacacuuggcaagagccugcauugucccuacccucagcugucaucuggcuuugugcacugcagguguggggccagaaguagggccacauuacucagcaaggugagcggggcaaaugcuggcgcucaggcugcucccauggcccugaaggcccaccccugacuguagcagucacuccucacagaggcugcugcuggcugagaaugccuaggccagaggcuagcccaggugagcccuuggcaagcccauggugacucuguacccagauguccuagccccuuauuagcaucugaggcaauuaaagagacagcugcuaaggaaggaacagccaggagcaucgaucaucccuagaccuucagacaacacuccugucuuugaaauuauguuucauuugcaaacuuggcuucauuaagucagcuaggaagugggagggagggggagcagguugggacucagagccaucaauagcugccucuuuuggcaaacacucccucauaagguuuccccagguuagauugccugcccuuagguuccugagcagaguaaaaggagcagaggcggcaggccagugcccaaagccuuggaugcagacccguccaacccuaaugcaucugccccagcaaagccagggcuucuaagagaaagcucagacccagaaggaccugaaggccuggacuaucacuuucaccagucuuuccaagaccgugaaagagcagucagagaucagagcccagggaggaggccggcccagaacaaagcagaccuaagccuagggcuuucucucucugggucucauuucccugucccauuacaggggaaagguagggccccagcuuccucucagcccugcugagaaggugcagagaauaguccuuucauagagaggcaacagcgcaggaggagcauggcaguaaaugaggcacggcaccagcuuuccaucuucaaggagagccaaguugaccccuaccucauaccaugcacuuguagcauaaacgcuacagaugauggaauguuguauuuaaaauaccacccccccuuaccaaauuaaaaaaaaaaaaacccuagaaaauacacaauuguggcuucaaagaugaagguggcuagucaagcaaguuguuuaacuuguagaauaaacggcagccaagaaagcaugcuguccguacucaugcacaucuccagggauggugucacagcacccaggccaggaaggcucuaagucagcacagcuuaugcugcaaaugaggaugcagcugugcucauucuggaagcccucacagcuccagcagaaggcugcuguguuggggagaauucacauuccccuaacacccucugccagugugacagaggacagugaaagugacaguacccugugccaccugaagacaugggccuaacccuccuggggugggguaaaaggaagugaggagcagggugggguaccaggaccccugugaaaagcacuggggggguaggcguggcaaccacagccuuggagguaggagggguagggggugaacuucggaccagcacgucacuacagccagaccucaagacaaaaaaucugaacaaaaccuguuccucuaccuguagacauuugcuuccauucaguucagugacccacacugaauauugauggcugugaccaccagagcuggggcccugcccccuuaccucacauuguugacaguguagugacagacaggcagagcaacuaccucccucauacauucuagucccaggcaucugugagcaggggaugggcucagacccugcccaagugcagacucaugagaacaccaugcauucugcuuucuuucccuucuguucuccccaggcaaacugagcugugugugggggauggcuaugcuggccaggcagggugauucucauucuaggaagggaccgcucaugcuucucagagaguucucauggcuuaacacacccgcaucucuaguuguccauuacauacugugugcuguagcugaccacagcaacugacccgaaggaaagcucaguagcggugcaggccgcacauggcugucagaagacacagcucugcagccacacaccuggucaaaccagccagcaaugcaaggccuucauggauaauucugcuuagagggcacccccacaucagucaaauucauaggcagaaaggagaaaggugguacgguggagggagaggagagggacaaggaguguaccaugaagacaagaccaauggugcagaagauguugacaagggcugcacuuuacagauguauugacucuggugaccuguacacuccagaggcugaagcacgaaggucaugagcuccaggccagccugggcuaucuagggaggccuugucucaaacaauaagauaagggcuggugagauaacucagcaaguaaagaagccugcugccaacccugccaacuugacuccgaucccugggacccacauggugaaaggagagaacccaccccugcaaguuguccucccacuucugcgugugcauuguggcauacacccacauaauaaagaaaaaaauguaauuucaaagaaaucuaaaagguaguguauuuuguauuauguauguuuuaauccaguaaagcauuuuuaaagucuguggcaugguaaaaagagaccaacuauugaaccgugaaggggugaaggaacccgucuuaugacugaaagaaagcacucuggaaagcuauguagaaugugaauggagccuuaagacuccagagaaggcagaacuaugagcaggagaaucugcugcagcucagggaagggaggcgcugaaguguaucuucucucagcccacaaagcaaacauguaucaagaggccuauguguggcaccauggccacagauggggaagaacaagcccaggccaaucuggcucacuccugaguaucaguuuucacuguacagcuaaaagggccacacaaaaaccagagccgaggagacugagaggaccugagaguaacccugggguagucggcccacuucacuucucccuuugcugagcuuugcugccucccuucuugcugcucccccagucgccuugcuccccacccccaucagcauuccuacacccugacugcucugagacagaugcccuccgugaggccaucccagaugucugaugggcucugcucccccugccccacacugacaggugcagagccagcucugccagcuuccaguggcggccugccuccccacacugcagcagcagacauugcagagcuggcucaggaucugagaccaacggggugaacugcacccgcucuccucuugcuguggagaaugaugaucaaacggggucagcgcgugucaggacccagcaugggcacagcugcuggagcgcugacgcuuuugcucggccuugcugcuucugguuccgagccugcuuuaauggccauguaaacaacuguccacagagcggcacuuucauaggagaugugcacauagcuaucauuggggccgcuguacacacagguccccucuccucagcuguccuugugccauccaggucacuuuucuucaucucuggucccucagaccucccgucucuuacucacugccauguccuaucacuggcuuuccucccagcaaguaaaggcaucccaccagggaucuaguucugagcagacccacgugcuggcacuucuggcucauccagagcucagcagaagucuacuggggaggacagaguccaaugcuggcagacucagcaccagccccacccuugccacugaauccacagagcacuggucagggcugacacacacaaguuauacucccaggcagacccacuguuaccguaacucgugacaugcaucccauuggccaugaggucagaggaagccagacuuuggaacuguguaauuaaccagucucuuaggugcaggcaaccaguucaaucaaccagcccacccuggcaccugcagggauugugggagcucuggagagccagaagcccaggauagacucacaccccaccauggagcacucaagggccagugucaggcccucccucagaagccuaucuagauguauccuccuucugaggcuggcagccagcuccagguaccaagcagagauccaagcuuauaucuaaacucgagcuugggcacugacuucagagcgugaaugucuaugcucucucuguagcagcaaguaucaacacaagaaacagcuaagagcaaguagucuggguugcugcgcugggcccuaggaccuagccucugugccuucuuggcuuccuccccuccccagcccuucccuccacucauuaggccccugaggccuaccuugaggaacuuauacaaaaggaaggugaaccaguuggucaacaucuucucugccacugauucgguccuguggggagggaagcaaauggcaaagaggagucgcuuucagcacccagcaggcagguccccacaauccccacagugaccccaccagccaagcuucucucacuguaccuccguaacaggagcuuggggugguucuugcuuucuagguuuuucucgaugaggucagacagcaacugcuuuagcacuccuguggcauacuccaucucacccugcagggcugucaugaugagugaggccacguucccacggucacgcauggagaagcuacgcugggccucuagugugcggaugaagguuagcaggaaaugcuucuuggucaacagcuguccgaacagugucagcgacuucuccacauuggccugcaccugggggcacauaggccugcucagaccacgggguacauagcuccaacagcuaaggcaggggaaaggucuucugggacaccgagcuacuugggccuggaauacacagguagaccagauugcccucacugcacauugaagcucaguaccuagauccuccaagggacccaggcagguggauggcagaaaggcccacacaaccaagcauaaggagaggaaccaggaucucaggcuaaagggcaguuggcuugggugaagccuggggcacuguucuaugcuuagggucuccuuccagccuccugaagcacuaugagcaauggugucacccaaggcaagcuaccugcuccagaaaucaggcccuugccccagagcucagggucccaacccuguguuggcaccgauaugggucugacuccauacucccaacuuggccaagcccuggaacuuucucuggaaggucauaccagcccccauuuccuuggcugcccaccagcccccagggaccucuaagguggcaguccuaccuccaucuccuucaguacaggaugguccucaaucccaggaaacagcacucgcauggcauaugugcgguagucaaggaaggggaugccagcaccauccaggucacuggucagcucauggauguccgucuguagcucugcaaaagcuguggccaaauguggggucaggggcaaugugagauuaaggacagcacauuugagguuccucucccccuucucaguccuagucugccuacuguguggccaggaucacugguccugaccuuaaagaaaccaagugccuuucugugccucaguuucccuaguuuaggacagaggggcagggcaagcucuggagcaccuagcagguuuggugaagugccguagcuucacuuccugguugcugccaggcaucuggccuccccucucuagcaggucuuggcccugcacaaguuggcagagaagguauccacguacacuggauguucaaccucccucuguagguuggaaccaagggccuucauucuccaguccuggcucaugucugcuuccuguccaccaaaguggucuacagggcagggucccagccaaccauucgacuaucuaggacucucaggggcuaagcaugaucaccuguauguacucuugccucacuauggauauccaagggagugggcacuguuucugugcccauucgacagaccaggagacaggauacaaaagauuagguggcauaaaauuauagcuaaauuauagcuguauagaaggugguccuuuuaccagugggacgauucugccaucugucaucucccugggacugagccagacagagcccauagguggugacugacucagcacucagacuaccucccuggcucuggcccuacccaucucccugcugaccuuccuugcacucgagggccacccgugacuccagguuguccaucuggagcugcagccgcuugaggguacggucagcaucccgggauuugcguuuguaggcgaugagcacagccacgaugaccagcagcaagaggccacccccaccaccgauacccacaauggccggcagugucagcaggcuguccgaauacaccugcagcaucccaggugagaacucgaagcccccggcccgcaccugccagauggaguagagguacucagagggcaucggccccucagagcccgaggcccugugcaauggcccuucagucucccacagcaucuaucuaccugccugugggcaguaucuuuccagcaggugacaaaaguggauaauggugcaagaugcugggacaugagcagacagaugcccagcuaguuaacgcuagucgugagggggaaagauggcaaggcaaggacugaauggggccugcauuagaacucagcuccauggggauuuucucagaggugggguugcucuagugggggaggggucagcaggucaggaagaugguuccaggagaccauagauaggcugugacagggauuuccuggcccccugcauaaagaaagcuuaggguauguaccgugacuuugugcugccccgugagguugggugcuucacacagcagcugugucucagacacggugaggauacaagguguggagccgaugagcaccguguaguugagccgggaauugccaggagcagguggcaggagauuccgccccuacaggggucaggguaaaaugagggcaauccugaggucucuccacaagccccaucccagagcagccucugcagcaggaggccacaguggcugagaccuaccuugaggaugagcggggagcugggcuucagcuccaagagcccaguagggcuaaguggcuccaguacaggguccggguaguagaggaaggaggagcuguugaguaccagcagcgugcgcacauuguccaugaugaaaccaaucucaucuggccgcucucccaguucuggcgggcugcgcuuuggguugucuauagacggcgcccggcacaccaugguggugucauuguacaccaugcagcucugggauacagguaccaggaccucaggcaggcuugcucucccauugugggccagcuacccaauaacagccccacccugggaaugacagcucccuguguagaugaucuaggcaccaagggagagcuugcucaagaugucuauucuuuuguagucugagggcuggacaggcccagggaucagcccuagcugaccacuuuguccucaaggccucagcacagacagguaagcaggggaggcagaagcagggguguuagcagccgugguuaccggucgaggaaauacccauauggccaggaggggagugagaacagaacagagugagguaggggaucagaggcacaggacauccacucacauuuucccucucaaugccuccauacuuggcgcggauucgagguucacggacaguggccagguuggugcccgugacuguuaggagggucccaccacuaaaggaagaagagaggaaucagacaaugcccuaggccuagacauacaagagacacagucucuucuugcaugagcagguggucaaagcucagccggagcacuacuugccaggauuaaggaccuuaggaggcuguugcugaacaaaccaccauagaccacccuggagagggacucucugacccaacgugaggggcagggaggggcuucuggcuucacagcaggucuccuaccuauugaugcuccacucagggucgauccucaggauaguagggucuucaguauaguuguacuucaccucgggguuggagagcugggcacgauugauguugauaacaauaggggcgcugccaggagugugcccgggcggugucaggcagcggaucucucgugaguuucuccugggauggggugaaguugggcgugggcacugugagggcagcaugucaacacaccagcagcucucagguggcuacugggaugacuacuuuugaccuuugaaugcccacuacugucggucccuacccuaaacccugacuggccucucuccauccccaucuugggucucauccacauugggcuguacaccuaccucccuuagucuugccuuccaccgcacucuaaugacaucaucucuaaugcagauggaugaaauggauccugccuacugaugcuggcuauuugggagacccuggcuaagccugucuucuaacaaguaucagccagccgucccagucuacccugccagacuugggauaaagacaccuugcagaugacaggcuacugcucuggaggucaaagagacuaaauuacaggccugacccuucccaccugucagcacugccuuccucagaccccugaguauagagucccauuacuaccuaccaagugcuuugaacaaaccagcucccuuuucccuacuguacacacaccuggaaaagacccugcaccuagcaacaguaagcuggccuggggcauggggucacaggucaccuucacuagcagucagcaaggcaauaccugcucugaggcccugucccuuggcuaugucacugcagccuggaggccucauagccuccagacuacaaacaccaaugauuaguuugauaauggguaauuaccacaggaaaauauuuaaagggccuuuccauuaucauccuuaaucuaaaauuaucugcuucaagucucaaggcuuuuguuaagaugucuguuuucucuauuaaacuuuuuaaaaauacuuuuuauuuugcuuguaagauagaugucccccucuucuuaggaggagcuacuggagccaauauaggcaguacccucugaggccaggccacacccccuuucuacucuggaggcuggcccccuaucuccauggcaaccucuccugccucuagguuuccauagugaucaccccaaccagguuuuccauacccguugcccaggcaacaggaggggacagcagagccaggagggaaagcccuguguccccugacuccucucaccccauaccaggagaaggagcagggccgaccgccaauggacacagcuacaucacugccagcauucagauggcucccuucgaugccaauccagguaccuccagacagaggcccacgggaggggcucacacgguagaaggucggugucugcaggaagaugacuuguuagagggaauucccucuuaggugcauccucuagcaucuguguucucacacaggcagcucugggggcacggguaaccauucccuuguagcugggcucagccuagguaugggcaacgggggcagugcccuauacuagagaugaguccaggccuacuucugcaguauccuuaacuacuuucugggggcagcaggaagcagagggcagugggguggggcuuaccacaaaagugaagcguuuaggggacagcgcucgguaguggagggagcagucccgcacacacaccuccaccagggcaucaugggcccgcagcgugcuggcaucuccaaucucgcagacaauccuguggguacgguggggcucagcacuucaaaaaagcucccccggccacugaggcccucaccacccagccuagucugccuuacuguucugcgcugauguacucgcucuccacagggcugcaaagcaccuugcccacgugcacgccuagccgcacauccucaaaccggaggcccagauucucaccggugaugguuagucgagucccucccugccgagggccugucucuggggacagcugcaggaaggcagaggcuggggcggacauagcaaggucuaccgugcagggugggaggagauacugggugggcuuacaaggguggggcugccuagguguuggacugggucucuagcuccuaccuugagaaucuuggggucugugcagcggcugcugccauggugggcaugcauccaggaggcuggugagucagcugggcaguggugacgaagggaacagcggcgcucagcuacgcaccagccgcacucaaagcgugggucugccuugaggcagaggccacaacucuggcgcaaggcugggcacuuguagaggugggcuaugauggugggaagguuagucagcauggaccauccaccauccacccacccaggccaccagccccgcuacucacccuggauguucuggggguugucaaugacaaaguugccauuccacacaaccgacagguucacaggcagaucgcugacaucauuccccucauaggaguacuguuggaagcaggcacaguggucaugcuuaggguggugguccaccaccccgugcuacaugcaaggucauuggugccugugggggccccucaacaucucugaaacugacuacugaaugggcuugccuacaugcaagcuggacuagaacacauacaguucuucuggucaucuuuccacacauggcuucuuuucuagcuccauggcccuguucccuccugccaaguucuaucuccuacagccaugaagaaaccacaucaacugccagucuccauguguuauccuccaaggcugucucagacacuacuuuuaagagcagggccguccugccugagaggaggugcagucagcugucugggagaguaggcuagcugagcccaagagcaucaggaaagcucugugaacaugagucuuugucuucugaguuggccaggacuucugaggugugugguauuugugaucccacggccucagcauaggucagaagagcacuggugguccuggggaguaagugcuguucccaccucuccccaggcuaccuugcacuuaggguacagccccucucaagggcugggccuaggcuuaguugccucccacuuucugcagcugaugaccucagcucuguacuguguuugggcccaggccugcagcuuggcaucucaaagggguggcccagcaauucaucacuauuuuaucucgaggaauuuaauuggauccuaucaaauuuccugauacccuuccuucccuuuaaacacugcugaaggaaagauaaaugggggucugcagagaagaggacaacagagacagggauggagagacacaggaagcagaagcaagaaaaaggggugauaagagucagaggggagggaggguggggggugcagguuaugugaggagccaguaagagaaggaugggaagugaaagagguugaguacagccuucccuauuugguagaaagcugucuacucugaccccaacuccuacccugcaggauauuccugucagccaagggcugcuggaaccaggggcgaggacaacugaagucuugccaacaacccgguguauacaacucuaauaaucugggccuaagccuguuccaaaaaauucauuguccuccugacuauacacuuccuggauggggaaaaugaggccugccaguagucaggagccaaaggagagcucaagccugagcucaggugucccgugcacauccuggaaggguuuguucucuaaagaacucucugcucuaggaaaguccucgguaccagacugcuaaacucaguggaaacuuugggaacgucacugugagauagaagauuuccaccauggguuuucccuacccacccagcaaggcuaccugcugaucuucagacggccaugguguggguagccuuccuuuauggccaaaggacacaaaaccaggcuuuggucgcuuuaccuggcuguuucacuuaagaaccugauagugcagccccaccaccaucccacucagcuacaccacccauacucacccaaggacucaguguuggccaggaagccaacagagcccucagaucuuggccuuucuuugcuaacaaaccaggucugggaccaagcgggcaaugacccacuccaaaguauggagcgccccaccugcccgcccgacugcuauucucucaccgaggaguucuggcacugcaggcuggagcuguugaagcgcagugcagugacucgggccgggcugccugggauguggaaaaggcacucguacccucgcugacccgacuguggcugcggcagguuccgugcagccagggugaugggcuucaccacacccacuggcacauagauguggguagaaggcaggaucugugggcaguccugaggacagcaaagcacuggcugagcugggucugauggcagcaagaggugcaaguuccacugcagcccaggcuauggggacucacaaagcccagguucccugugucacucugaaugugggcaccgcaaagacaguggucuucagguccugcuccaaccaggauguggcugcacggggcuagccuuuuacucuugccauauucuaggcccucacuauucacucucguggccacagguaccccaucuggcccauagcugcaaagacuugaagcaggagccaaaaacagggugcugggguagcaggcucucagcugggggcccguggaguguaaaaauagccugggcccuguagaaaaacagcaggguuccccagggccaggguuucagcaacaauaacugaugcaacgcccggcuugcuugcagcauggcuggcagcagccucaggaggaggcgacccgugggagcguguggagcagcuuuaaauagggacgcugaaaacaggccugaucccuggggacuggcuuggcucccaagauguaggcccaggaucugcucugcagagcccaaagagccugaccucugacccagccucucacgguuugacccuagaagaucuggacaggcgcagugggcaagacugugggauggcccuguguucacuggccaccagccccaacucagguggcagcccuggagaagacacugguaugcagggccacauccacauugcugucuuccauaccaucugaggagcacuuggagacuauaccccaagacucaggcugugaugggaccuagcugagagaacagcaacaacuuagugucagccuccccuaagccuccaacggccccugugagcugagcuuaccauccaccuaguauagcauaccaggcccagagcccagcauugcucacugaccccuguaauacccuugggugacugcagcagacugagggcagacauggcugaauggagccuagcaaauccuccugccugcuccacuaacccaacacugucuucccagcucaguccagcagccacauccuggauggaagaccugcuugggccuccgguguagcuuccaccucaccuagccuccuguauccuauccaagcccagcagcacaucuucuaauuauagauucuagaacucauaggccaggcugagugggacccuuggggcacacagggucaagcugaauuaaucccaccagacacuuauaccucagacccugcuaagaggaggucacagagucuuuggggucuauugguucagggaucagcagcccugaaaggucuaacuauuuccuuguuucucagcagcccaaggcaugccugggagacacugcaaacacuguggaguggaaccagugucccugccuaagggcuccugauuaugccuucacuccaggaccaaccuggaaguagucaagacaaggggauguuuucggacucuggucagcuccuagucaucugacccacagcccucucccucaugcagacaagucuacuucccuagugggaacucaaggucauccuagggcuuagcgagggagagaagccaagaguaagauccaccagaccacugggaaggccacucuccaccccuacagcaaggucagaauguggaacuacuaggacaugccagguucccggacugucagcgugagcucugaugaccagguuucugugagguuccuucuagggccuagcaccccaugccggcugccuaucucacgaccuguuccgcaagcccccgaguacaggguggcaaggugagcgcuuacaggucuuucugcaucuucgagccaguauucugggcacagaaaaggaucuuggguuagaacgucugaaucugcaugaggucccccagagccagaggcagggagauggggugugcugccugccacuguauaugcuaugucuauugcuauauaacacuggugaccuuccauacaaagcugcaacuaaagaagaguaugcacacaugggaucaacucguucuccaaaagucccuucccugacgcuagcccugugcagacaaaccaggcucuaugcugcccaucccacccagaauacuauggcugcuuggguaugagaaccugaguagguuaccacuccagggggaguccucuguuaauaaaacuuccuagaggcgaugggcuacucagagcaggauuagagggacaccagagaagaaaccuggacugccuuggcuucaggaaccaccaacaggggucuccccugccuucuacuagcauacugcugucuccagggcacugcacaggccucuggaaguggccucaggccagcccuggccaggucccaaggccccugacuuggcuccuuacuuccuacccuagauacugugauccaguucuccaacugcuacccuccuagaaacacccccucacccccacugugucccggcuccacccacugucacagcuccccucaccauuagguucagggucuuguauuuuacugccaccuugucuaguagacaugagaccaggaagcagcagaauggugggaggguauaggaaggagggacagaggagggcagcucauggggccccacucacauaugaccuucugccaaguuuuucagauaaguccagucuggcugcagcucccacagacccaaguaacagaauucacggcuuccccuucccaaacucagcauaguauucauaaugaaaugaauggguccugacuuagguccugcuccacaccaacauggacccuaggacccuguccccacuucccauccuguaugcccaggaugucauagguuccaggagaaguggcuuuccacucauacagucagacacagcagcaauuaccauguggagcuucagaaacccccacagcaccacugguaacuucccucccugucugggaaaagaacuauuaugaaacgugcugcucaggcugcccuggcacaagcuauuacagggccucugucuccuaaggacuacaaaggacacccauggccaccagcaaauggucccaguuuggccucaggcuaugacauucaggaagaugucuccaccuuagucacaccucauaguauacaacuggcacccuaggcacccauggguauuguugggugauacccugaggcucacugguacuucugaagccuucaggcuacuuauccagccuuaccucagacauguugacucggccuuccagaaaggcgcagucagccgcauuguuggugcaaacauggcgguauuugcaccaauggcaggggaaggagccguugacacaugccaggcagcugcagggagaaaugagacaguuaggccuagggaguuucagcuugugcuuccaccacgaggaccuaaugugcugcuucuccuugaagugucgucaccucagggccuuugcaauggcugccccuggcugagagaaggucaccagaccugcugccugcugcccaggccucauugagaauggucuuaccuccucugacucucuuccucuucaacccaguacuagucacuacagugaccccugguccccaugacagaaccagacuguacuugcaaguacaccagaagcaugugucacacgcuccacuucaaugggcucaggcuggugcacguggggaguggcucccuuaacugcucagaucucaguccuccuccgccuguccuauccaaaccuguucuacuuagguaggagcuguucagugugcaucucauaauccugggggcuugcaaagagacagccucauggccuccagaauacaccucccugcccuauaggacagcccuaccaguucuggucaccuugcuccugaagacagcuccaagaaaacuguggagugucucaauaaaugaaagcaagauugaaaagccagccaaccccauguccuaggccaagccugauaugauugucucugaaauccccacccuugcccuggucuucuaaggacccucucuugaccaguaaugaaccuuaauauguccccagcuuccuuauaucugaagcuaggcgcucacagcuaagaugggaagaagcaaacaauguugccccugcccaacucccugugccacccagaagccccaagaaccaagcagaagccaaugccuagguguccuacugugcagcaacuauuuccaggcccagaaucagcacacacugaguugucaugucuggguuucacaauggcccagaucaaugucucccuuggaggcccuggucccacucugcuggccagcagggcuucucauaggucauaucucucccacccaguuccuaaaacagcucuccacaggugcugcaauaccagccacagccuccuuccaugaugcccucagggccuugcccagauagcucuucaacuggcaggcugcuuuugugggggucucuuauccugucugcuugacuggaugucagcugcaggagagcaggccugcaaagaaguguuugcagcaagaccacagggaugcgagugcagcaagggcaggaucuagggacacucacgacuggugaacacugcaguuauagaagacaaaguccacagaugcaaacuucuucccugucuccuuggacuugagguagagcuucaccacccgcuggucuccugcagaacaugaaggcuaagccaucagggccagagaccacaggaccuggcacucacagagaaagcccagauauaaaccaacacaucacuccucuagccugggccccagguagcugaugccccauccuuaacuggccaguaaggaaucagaacacagaucccucaugaagguugagcuaaaugggcuacuugccaaguaaaauggaccuuagcaggcagaaaggcaugugcucaaaccagcaccaggcuuuccucccacgcagcacagacauuccccagcuccacucugaucccuucugaagcuucgucuggcuccacacaccuccugcuuuugacucuccuccuaaccugcaacugcugagcaggaagaacccacucacccugacccugugugaugggcgccacuucccgggcagaaggugaguggcaauggaugcggccaucuuccaggaugcucucagucuccgugaaguccucaaaggagcaguugacaccagcugagaggucaggcacauuccaagccugcagcacgagcuggccauggcagaaggaauggguaagugcuuaccugccccacuuaccuccccccccacccccaacugcucccucccagccaucuccaacagccacacucaccggcaccugggacauggugacugacacauugcgcggcuggacaguuaacugcacacacugcagcaggucagaggcaaaacgcuggggcucuucugcccgcucacaggcauccugccuagagcagcugcaggaagaacaugccuagguuggguuuauagguccagagucuccagggccacuggagaggggucccugggccgagggcauggauuccuuugcccccaccuguuaacacucccaucacuugucaguggggucaaaugagaccuagggcagcuaugacuaucugagauacacacagcaggccuccaggggccacuaggccaaaugucacccaccucuucaagccagaccucccagacucacaugcugugcaggacacaccagccacagugggggucccgagaccccaggcacagcucacaggaaguauacuggacacagcuuuccacaggcaccugcgucaccuggggaaggaucacagugagaggccuagcuagacccauccaucccagguucccagcccaucccgaagagcucaguguacucaaaagccaggccaagugggucaauagggacaagaguuccaaggcaggcagcuagcugggaccuacaguugggaccacacuuugucucccaccugucuggacuccuuuauggccuggacuacugaggaauggagacuugucagcuuggugaaggaaggcuggggccagcccaguggugcagaggagcaggccaacucugggucuccccaguucucaggacccaccccagaggcagaaccaagaaggauugcagaggagaagcaagagcugauguucugccugcucccuuccaacuacuaccugcccaucugccauagggaugccaguuuacauagaaaggaggaacaggcaacaagcugguaaagcugggcacauaagaauaccuugaagaccuaagcaagccaggcuggccaggucucgccaaggacaaagccacaacccacuguagacagccagagccugagccagagaagcccagcccagcgucccaguucaauccuccaaaggcaccugugcuuggacagugcagucacccaaguaccaacuuccagggcuagaggucacagggagagaacgagggccuuccaugaggcccuggggagucugaggcuacauggauaacauggaacccucauaaccacaccucuuagcaggcccacucaucugucuguagagugucaugucagguauuagagccaacaggacaccuccaugggggaaagcagccucuugacuccaggcaagccauuccucagguuccuuugacugggaucucugacuggggaucccaccccagucacccuaaaagcucaugccaaucagccagcagcacccaccugcuucuccgucauagcauagagguacuggcgguuggggcugaggaccaggucacgcaggauaggguugcccuccugagccaccacacuuucauaagccagggccggccugccgcugggguuugcaagguccaccagaaucuguaguagcaaagggugcucaaugaggcagguccacgacacacuauccuagacccaccuuacccgaugcaaaggguccaagcccucuaacaagcaccuuuccaccaaagaaccaggcugauucagaaugagucaaggcugacccaguucacugucccugacccaagucaucccaaagacagagauaggacaagacauacuggacaggugggugugccuugguuccuuuaccaauccagacaccaaaacucagugguaggguacacgugggcuccagugccuaccaucaagcugcagggaaccuggcaggcaggaaccucuuucaugggccaccaugaggcuugugaaagaaagcaaguuugagguaagagggcaggaggagaccuugugaucgguauagucgaggaacaagaccaggggcucacacacagagaggccaaggcuggccuuggugucuugggaugagggauaccccagcaagaaaguggcagggagaaggggaccucaucagcacggaaauauaguucagaucccaaacaagccaggcgcuaauuagccugauccucuccugcagccuuggugcugcaaguauuuuuaguugcuuuuaccaaacaaauguauuuaauuaacagagagacccaugggggcuuucaagaugggacucauggggcgcgucugccuagcucagcugggcccaggcacagucuccuggcacaggaccugcagcuugcuucuacccacugugcagcuaaggcacagcuaccuccagcuucuaacccaucuggccuaccucucuacuucuggguacaaggcuggagugagcuuggccuccuuuguaccccacaguaagggggcagagcagaccugggggcagcaagggcagcaaaaaccagcacccugccauaggcuagcucugucaggagcugggcgaggggccagccaggguggggccugugucucugggccaagagacugcuagcugggagagagggggagggucacauuccugagagccugggccaccccccacauccgcucagcugccgcuccaccaagacaggcuuaagucaaaccagacccggaagagcuggguaaguggggagguccugggaggccugaaggggcuggacuaauaguugcccaaacuuuauuccuccggccucuggacggacaagcaggaacagcuagcugagacagaaggggcccacagcagcccaauaccccaggggcuggcaaggacacuaaccuuaaccuaaaccuaucuagcccagcuaugccagagcaggggagggagucagguccuggaugacugcuagagcagaucauagcaggcuggcuuacacugcuguauuaaguggggagcaugcagccagagacaaggcuggacucacaccaccuaggccaaaauuggcuuagauguaucuguuuuccuacuccugaaaugggaaugaaucaugcuuccaccuccccccacggugacagagacagaaaagcuugccugagacaggugccaggaaacaagccuguucagugggcaggggaccgagaacucuagaccaaugucuuacaagccuccaagaccacagccaugacucuacucccccacacccuaggcuucacccacauccacaucccagaaagaucccauccucgucacuccugggugguagccuugcauacagggugcccuggacagagaccaggggaguuuccuccugccacaaugaccauguaacccccagcccuaucuugccugccaccacccuucccagacuggguagacacacuagcuccagguaugcaggaaaaggacaggccagagcagagagcagaguccauaaggaaaggaucacaggccauccaggcucaggaggcccugcccccagccugccagcuuaauugacugggacagguggucucaacagcugcaguugggggcuugugaguucagcuguccauccaccugcccagcaaugguccacaugcacaaccagguccuagggacacagcccaguagaggcuaacuccagggagggaccacuggcagagcguggauaccauuccucagcuaggggaauugugggcaucagggagguuauagacaugaguguguugcaguacucugcauugagccaagccaugcucaggccugacaggaccuuugugcacaucagugucacagugucucuggguacauaugugaugauggaguuuauguuuugaauaugaaaugccugccauaggcucauguguuuaaauacuucauucccagcugcugccacuguagagagagguugcagaaucuuucagaugugggagucucguuaaaaagugcaucacuugggguggacccugagguuuacagucuggcuccacuugccuuucugcugccaugaccuccccuacuauaauggacucuaucccacggcgagcaaaaauaaaccccuuuccuuuuaaauugcuuuugucaggguagguauuuuaucacagauuccgaaaaaguaaauacaagacaccugugacaacaucugugugauggagucucuaggugcauguaugaugggggucccugugugaacauguaugugauggagucccuagguguauauauaacagggucaguucccuggguguauagcaugugauguaguuccuagugcacuccuaauggggucucugugcacauguggguaaugagguucuuuugcauacauaugaugggaucucuguguauacacauggaacagguuccuauauguauacauauagugucccuaugaucauaugugcaauggauguauccaugacaaguuuuugugcacacaccaguugauggggcuccuguguacacacuugggacaagggccauagaccucacaugugaugaugggauuacugugcacauaugugauagggccucaaugugcauaugugugaacggggucucaguguauacaugugauaggacccuguguguacauaugugugaugauguggccucugcauacccauguauaauggggcauauguauguacauacaugugcuagucucugaauaugugauguuccuuuguauacacaugaugagugugugagcacauggacauguguaguaaagccugugaacacgugaugggcucuccauucguacguauauaauggguuccuauauacauguauagauaguccccaggacaaugcaucacacaguccuuaagggcauauguaugaaggggaaacuauacacauguaggauaugauccaugugcacacauguaugaugagguccccauguacauguguuugauaggaccuaugcaagcacauguaguggagacccuauauacacacauaugaugaagucucuguauauaccuguuugauggaguugccagaugauaaaauucccccaggauauaugugugugaugugacccugucuauacauguauguaauggagccccccaagcauauguaacagggucucuguauaaauacaugugugaaggggguccccauuguauauaccuacguaauggugguuacuguggauauaugcauuugaugggguccccaggugcaaacaugaggggaacaccugacuggaaugaugguccccaagucaugcuguaucccaccaagcuagagucacuaaaguacagccagcuucaucagaccacacagacaguaaacuguaucucagagagccugugagaagaaccaaguucuagguaccugauuguaacugggaacacagucugcccuggaacauuggggagcuggccaggagggcaucccaggagggcaagagcaagagcuuuagaaggcagaguaggcacagggccagggcaauaacagcagggcagcacugacauggcagcagagcccacgugccaagggcuuagcccacagcuguccacucuagggccaccuaccuggagacagcugcucuggcagucccuugcaaagcagcugggcaacuggugaacaugggaaggcauggacuggggcauccuggguauccuuaccaucuccagcuguugccuucuuguuucucauucuuuuccccagacaccagaauccucuauaacugaacagcacaaugccucuagaagcugugguggaaccaccuagccuccuuggacacagccccaagcugcaccaacacuuacccuaucuuggugacauagucuuuuccauccugccugugcuucuuaagccucaggucucuauccuaucugccaagauggaccugaaaucugagcugacccaagagagaagccaggucagacucugaucucuccaauggacaggagcacccugcccauggaucccaggaacugcaggagaggccauacagagggaaccuggucaggcuggagaggaggcugucacccguggggaaggccaaagccuccaggcuugccagccugccugcuaggcuccaaucaccucuaaggcccuggccaacugcugcagggcgggugggcaggcagcugacagccuggccaggucagcuguccguccagcccugagccaacaauggggccauuauccagaccgagggcaggcggguugcugaagaggaugucugggcuauccaggcuguaugccaaggccggcacgcgcccuagcugcccggaggcagggggcugcccaguuuugcccaaccuaagagaggaggucccuugcuccgcuugccccaagauagcagauugggcugacccuacaaacuacuuagcccuggccucccuguuugugagaguguacugggugaucucacucuccaggacagggucuagaggagagaagagaucaggggcagcagccagugagcauaguaguuucugcagauaaaacugccaagccugucuucuguaggagguugucauagaaggggcuacauaaggcagccuccauucccauaaaggcccuuccucuaacccccgaucaccaccacccucaaagaccaggcaguuugacaguauaagaguagcuggcacuuagcuguccauaccuggaugacaaaacaugguuugcaggugcccaauagcuauaauugggucagguauaggcagggguuccagggguuacuucuuucaccucuaacucugucacacauaaaagaggcuagagcucuaggcaaaggacaguuggggcugugaggaccagcuagcuguagcccgcuccagcacugaccuuccccacacaguggaucacucaggccaauacucaccucuugggacugagaauucagaggcuagcaguucuacaggagggagcaucugauuggagguuacuuggagacucucugcuauggccccacuguuucccacucauagaacauguuuccuaggacagcccugggcuacacuacuguggccuccucugccauggauggaaccuaacugcucccagaggaagagcugcccaggguggguacuaggaguaaaacacauuaagagugacuuccaugugcaucuggguagccuguuggccacuaggagcuaauaugccaucagccuggggcuaguagcuagauagcacugaucaggucugugucuugacucagccccugauggcaggucuccuuuagaaccagcaagaaggaagcagugcucccaggagacacagaugucugcucagcacuacgagaguacaugggugccacaggggcacaucuacuccacagaaggcagacagccugggccccuccauuuccuacuuacaauuagcagggagagaaaacagaaaugggucccaccuagugcuuggaacaagacauuaguugagaaguugaauggaaagaccaagaucaaagcccugcaacucuucccgacacugucagaaccuaugccccaaaggcuagguccuuggagcaaugcugcaugaaacacugcauggcaagcagaggguugcaugcuugaccuguauguggcccacaguguggaacucacagacccagagcaggccacagcuuggcacuguggucaggaugagccugguggcagcugagcaaaagacacaaaggaaaugcacaugacucagcccauucccagaaccuuagccacaaagggucagccagggcaucccuggaguaggcagagccugggaggggcucuggagauggugauguuggugguguguccuccagugagccuucaccaugggcuccauuaugggugccucugaggacacagggucucuagcagggcugggugcagaggaaaaaagggcaagcuggaggcauccaaggucaagggccuguguuggcaggcagggcugcuuguccccaggcagccaggcugcagcagcacagacucugauagcagcagagacagcuguaaaugaaggccacuggcacauuggaagugcagaguaagccaguuggaggcuucacucgugcuccaggcuuuagaugugcugagcagagcugugcucaccccucagaacaucaucuggagacacugugauuaauacccugggagcauacacccuugggaggccagauaucucugccuggacagauggggcagcacaggcugaagaguaaggccuucaaggcuugugaacauggucuggcaggacaaugggcaccgcagccacaccuguuccaaagggucacagcagcaagagggcaagagagaauggugguccugggucauaacuggaagaccacuaccccauccuaccccgaccccagucccaucuuccacccucuccaagccucuggccaacucacagggaggcuugggcucaugcaaguccaggaaaggaaagaggcucaggggaggcuggcugaucaagguagaccuccucaaugguugggccccaucaggccccugaguagaugagugcagccucaggugccgccugagguccuuccuuuccucagcccugucaugccuuuucucagcuguacaaugccacagcauggcucucuggccccaaacuagugcuucauaugcacauuaggugguuuccagagguuuccagaaacaagggguuaauugccaacauugaacacucucucauacauuaaaaaaccccacagauaaucuagauuauccugaaaaaaaaaaaagaaacaauaagcaaacaagcaaaaaugcccuagcaaaagaggcuauauucuaccuggcacacuuaccaggggaccugcuggaccucagcccuggaguguaaguggacagggucacuguccuggggucccuuccuucccugaaguauaaguggacagggucacuguccuggggccccuuccuucccuggagcaaguacugggcaggaguccagagcccauuuuuguagagcuaccugggccaucuuacaggaccaaacaaggccugcaacugcaaacucaggccagaaauggcucuuuggaggcuguagggggagcuacucacagggcugggucucuggaggcccaggaggaugcugggaagggcauuccagagagaaggccucuauuugggggagggucauguuggcaggcagggcucuggagaagaagggggagguaggggcaccccagccagccuugagcagcugaaguuggcaggucuuaaauuaaucgcuacaauuuuacacaacaacacguuuggcagggccuggccuagggccaggcaagucucuggagcucccuagaugcuuuuuaaagcccuggaagucccaggccugggaaagaugggaggggccugcccagccugccugcccuaggucaggcaguggccugggguccccagaguacagguuccaacaagcagugcugagagcuggggaggaggugggguggcgagcaccccugcaugcaguuagucagucagcagagccaggcccagaagccucaggggugggaggagccuggauaaaaacaagagggcucaggaggccacuccaaagcccagaugcaggagguggccugcagcccacaagcagcggacuaguacuggcuugaauggaggaccacagaaaguugcccaucugucagggccaugaccuggggaaauacgagcugugggaaucuuguugccuggugguagauuaagccccaggcccagcagugggagcuucaggcauuuccaagccuggccagcagguagaggggauuccacccuacucccagagacaaucuaagguacuacauggaggccaucauagcagccuguaaugcaguccuggggaccaguaacagaaaggacagcaagggaagaggcucccccagucacugaagcacagccugggccucagagcccugcuagguuccaguucuccuccaaggacccucuaaagaggggagggagggaggaagcaagggcccuggagucauguguuaugacugcucugugccucaguuucucaaucugugaaacagaugcugggauuguugugaggcuucuggugagucaaucacaagaacacugggcauaugcucacagcaaaggagcuugucaggcccuggagaaguacugaacagagggcuuagagaggcucacacagccagagagaacgagcugacaaaacuucagaaacaccucauuugcacaacacuggcaacaaaagaugauggauaagacaggaacaccaguugaacuguuugaugagaucccacaacugggacagguggaucggugagaagguucagauggcaggggccccaggacacaauuauauccaugcccuggguggcacagcacguacccagcucaaccacagagcuccaaacaaaaugucaguccaacugucuacccucccucacacacaucugauuccuuaccccagaaaggccgcauccacucaagagcugcacuugguccagaugcagccagagaugcaaggagccugucacaggcaaggugcuggugggcacaaacagaggcccuuggccugaggaggccacuggcuagggcaaagggucacucagaccacuuccucagcuggacugucuaguggcuguccauacacaaucucaaggcagcagaggggacuccacuccuaucugcccacccaccagcaugaguaugggcaagaugggaguaggagagaggacugggagagggcugggaacucaaccuccuccacagggucacccacaacgcagccucugcucauggaccgucuccaagguuccacccgccaggacuccguuuccucucugugggagcacugccaauccagacuccggggaacagguaugcucugagcucaccagucaaagccuggaaccaaaggggccccuggggcccaggaggcagccaggcgagacaggacuggagagacccguucuccuagcuucacuugggccuaucugccacccccauaguccacaggacaacaaaagggggcacucccaacccggaagcccaucucuagcugggagauagguauuagagaaccccaagacaaagucucuagguuucccacacccuaccuuccauaaucccucucaacacacaucuaacugacuucacucagcggcuccccaggcucaugggccuccuugaggcacaccaguuacagaagaggcuauacuggagcuccagggcacaccuauaccaccuaggagucacaacaaacaagucagggcuccaagugcaguggaggcaugguaugagcugcucaaccuccacugaucaggugccuggcucuacaacauuugaguccacaggauuccuuguuuacugagccccucaauuaccagcucaggccccagggccucaagaccaccaacagcacccuagccuaggauggugaccagagaacaggcaagguugggaugugauucccacagcugagaagaggccagggcuuccuggccuucccugggcccagucucacccacgggcucaugagcaggcaggccagagggaggagggcugugucagcaagagaucucagcuguuauuucaucuccugacccuccugguccuuuggguacccaggcaacucuaccuuccaguguuacuggaggcuucuuccacccagguggggccccaccuacugcccuuccagugacaggcugauccacagccucuggaagcccucuccguccuaaaaaggaagagucuagagaccagacaggccaguacauagagccagggucaccccaaggccugagccgggcccucugucacucaagucaccagcucccugggcacccaggaaggcauggugugauaggggagggcucuccccuugcccugcccuuggccucggcauugcuuugcugcauggugggugggaguggggcuggcugaggcauaaugcugcuucagcagacaccagaucucccagggcugaaagaagggccgaauggggagggggguugcauaguccugcccaguccaacaucgacaccagcuccccacccccagcaucuagacacacccaagccucuaggacccaggcuucuuucugaacaguggcccugaaacccugugcagcagaacaaagccaaucacaggaaagggggaagccccgacuccucacaagccccaucuacccauggguccucagacaaacaaaggacuggggaaaacuucccaugggaagcccagaaagaagggagccuuucagaggcacccagacaucugaguccuucaaggucacuggacaugcacccacccaccucaugcagacccagucucccugucagagaaaaccugguuucucuuucuuggauggaaccugaacacacacaaacacaccauccagggguggcccuuccaagcccacacaggccugaccuugcggaugcggccgcugcgagugccagcaaaaaccacggugcggccuugguagucauaggcagccacagcagucaggccaucuuccuugucgacaaaaaggggugugcccucgauggugaccgugccacccaguggcugguugaaauccugcccgcagaagucgucaucaaucugcaggggcuguaagcagugguaagguuaaguacuuagcagcuucaaggaccuucgccuacaacagggacaaggcuggggaaggcaggccugggcugggggcugggggcuuuaugacacccagaccuaaauaaggccuacaaaauucuggagaagaaacagagucuguggcagcccagguccaaugaaugcccaaagugggagaaaggcccagagagggugacuugaaggaagggcaagugagccacaggacccacaacuaggccagccccucaagaaguugucauguuggacaaagaaagaaauggccucgagcugggaggcagccaauggaagucuuccuucugcagaucuuacauuuguaccuugcaaaacaaaagcuguguuuaaggcaggagggaguggguacaagcagaaggcacagagaagagagaggaacuugcugugcgugcaggaggcgaucaauaccucaagguuccggagauggcuuugaguggaggcaccaggagggggcggggggaggcaggacagcaguuuggggagaaggaagaggacagcugguccuccucuggggacugagguuuauugggguagaggcuacaaacauggaugcagagggaggccagucuggccgggaaucccuggaaauaaucaaggaguaaugggcaggucugagaccaggggcagggaaucaagggacacguggggacacaaugccuuuccugagaagccaagagaagagcgguggcuucaccucccgcugcacucagagccuagucacacucacaucacuccuauaggagccaggcacuccugcugcucuacucuauucugaggagcagccuguggcuccaauucugagauagaaaaccugcugucucccgagggaauagcuggcuugggggcagggagcacuggcugcagaguauccagcacaggguagcugggccgccccugucagggggugcacucagcacucacugggcacaguggggguccugccgggaggauuaacuccacagaagcaguuccugggcuccuugugaugagcuccaauaucauucuaccucuaacuggcugugugagcuugggcaaaccaaucuaucccucugauccucuauaaccucauuuguaaaaggggaacaaacuaaaacuggucaccaccacucagugucccaagggguuuggagcuguguggacaggugccaccagccacuuccuaagguacaaggugauggcaugguuagaagcagacuuuaggcccaauaugccagguucagguccugccucacaagguuggggggaaccagggaggggaaaaaguagaaagcagauccaacaaagagcagggccaccaaggugcaggugaaaugugaccccaggaaggguggcgggagcccccacccacacuccccuacuccugcucaccgaguugaugcagcccagcuccuuguugagcagccaaggcagggagagcuuuccuucuccacgguagcaggauuggaugcgcuccuugauuuucuccuugauggcccucagugugaacaggcacagcgccgacuccuuggguggcuucacgcgguucuucuggcccugugcgaacacagugaacaacaccuccucauccucagccaggcccagcuguuuggccagggccugucccggccggcucagguaggcguccugcaccagccgauacuccacgccagccugcucgcagccaauggggaacuccacguaagaguagaacuuggggucauucacgcacagccgcacaaucuuggaggugaagaagugcucgccagcggcgucgggcgagguaagcugcgugucuagcugcagggugagguaguauacgaacugcucgcugcggaaacuguacacauaguagaugucaaaggcugggaacuuggacaaugugucugaagggaucuugagcugagaugacacaaacucauccugguacacaaagccaaacaugucagcaucuuccucguuggccaugagccggcgacuggacagaguggggaaguauucugauuugccaucgaugggugugcccacgaagagcuuggccuggcccuggccggguggcccagcaaugagcacucccgccaugcugccagccucucgaacacuggacagguaguguuccuugcgguggugcggcucgcccagcuugaagagaucguccaaccucaggaacuggcagaugcccugugaggcacugccacaggccaacaggcgguuggcugcauaguccagcaguagaagcuuguugacguugucugugcugcccagaccaugugggcaggacuguacacugggggguggguagcauuucucauugucuucuacagggccugucacaugggcccgaagcaggguuagguuccccgacagcuuguaaauacgguucacagcgccaacauauaccucuccugucuguucgugaaccaccaggugagugaggccccagucacuggccacaaaggugcggaaggcagguuguggacccaaaccagcugggggcgagcugauggcuauccacacaccccucagcagcagcaagagcagcagcagcaguguccgagagcucagagguggcaguggcauggugggcuggggccucaagccaaaguauucagguccuauaggggcgagcaucaugggauuggguuucuuggcccugggaagcacagggaaaagagggugugaguguggugcugcccacauaugcacagggcauccacgcacggccuccucauucucugagcuauucaccuguguguuugccgccgugcuaugcagaugccuccaaaaagacccucuaccacaacccacacagauuagagcaaagaagguacuuucauguccugagacacagaggcagcaagagugagccaagugucacaggcaugcagcaguagcacaggauaccugccuagcagcagggugcucagcuacagcccgugcuuugccacccuuggcaagacaagaaugggcccaggaacacagcaacuuccaagggucugggguauauaugacccugacccagagccugcccauccccuaauaaggaucaaaauccuucaaaauccucaaucucaaaugggugacauguuuccugcaucaaugucccaccaaaacugggcagaaauaggcuguaauuacacauaugcucuccccacagagugccaguugcuucgaugcaccauuuggcuuaggguagccauguuccacacuauuacauacccuccaauguguggacugcucccgagacucuaaccagcccccagcgcagcauccacacccacaagggccagagagugucccccccgccccccccacgcaauaguucuaagcuugggucaggcuagucugggcuacuuucuaugggaucuugacccuggcauugcucccuggcugaccuuggcccgaugucuuacaaacuccaaggccagcacuuuaaggacagaucuagaggcagcagcucccacuagaauccccacauccccaugcagaggacacuccccaugaugccuccucccagguacuccacccucacacuggacucuaagcaaagaagacuuccagagagauucaggguuuccuaaauuccagcccucagcccacgccugguuccuccaccauguccacccacggccaugauacaguuugggccacuuuuuaggccugcacugccucccaaacuuuagcaugacaccucaaauccagcuguauacccacugucccuggaaggugucaccuuccaggacggaguaguguuuguuaaauguaacugcccuaauggagacaauccuuuuuccucaguuucccuagcugccaaaggaaugacaacacuuguuucaaacuggaugaaacaguuugaagaucauguacugauugacaggugcuugcaggcgccacacucuugaggacagaagggccacagagccugcccugugggcuuguggccgggggucuuaccccacuccuuggcugauaucugaccauggaaguguuuaguguggugagugggcagucggccaguauacacagcuucuuuauacucccacacaugcccucccccacagccccacucacagcugggaacaccgaggcuuaaagauggugccuucuguaaguccagguggggaauuagccagaggcaggaagacagucacaggugcucagcccuuacuccucuggucagagucuagagcgcaaggcaccuugcucugcucugcccccacaccugcucagguaacccugagaugcaucuucugaucugcuugcacaggcaguagcuggcagcacgcaggugccugucuuaaucuguggcauaggucuggcuaguggcucuggcuuacuuauugcucaaauguucucccaaaagaucauaagcugggugcaaauaggucacacucucucuccagagccaccgggcccaggcagguucagcaaacacugugauugagugagaaaguaaguaaagacacuaggaguggccaggccugggcaaagcuauccucaacauacaugcagauagggaaacuaagguucagggcagcaaagaguguuggccuaaaucccagggcaaaugcagggugguacuuccuugcaggaacucuccuagcagacugucagcugcuuuauacccccagaccagcagccaagaggagccuccacaggcagccagaaggggagcacaccaucggccucccacccucaaaaccaaagcagacuagagagcagguugcuugcagacaaaacgggccugggcugagcacugagucuaugugaacucuaaagaaaacaugaaucacucaccguuuaucaguucaaagcaggccugcaauuaccaggggcugggcucuccccuccuccgggauaauuauacacgucuuaaugcaauuacgggcccuacuuuuuauauuaaacaggagggaccuggcugaagaagccaccauccaaaccccagccuggcccugggcccacucccccgccucccaacagaagcugcugggaagggauuggcccggggguacagggcugccguccaggaaagaaggggaucccaagccuacaccuaccauggcacaaagacuagcaaagacgccugggcuacguuccccagauacaaagacucaggauccagacagauccaaggucacacagccagcccugacagaaaggaagcagagcugcuguggagacccuggcagcacagggucccgcagaaaacaauguuccccugagaagcauggucugauacugccugcugagcuaggcuaggggaggggaacagacaaacucuggguucugcgagcugccuggccacuguagccuacagaaacucccagguggugccuuuccaccugcucuacaacaaccagguccacuggaugcugguggggugggggucggcauggaccugcuggacacgcagaugggagcacuacaaacggccauagcucccugauccggacggacaagugagaagucaaacaggagggccaugguggugcugggugugugcagcagggaccaggagagagaagcugggcuugcagaugcggcggggacucugccaggggccacgcuggagcaggccuccaguggacugcagagagcugguacucugcucucucccaacucugaguaacacuaugguucuugcucagaaacaaagcccucaaaacccucacaggaggacagcuugcucccugugcccugcugcucuggagccuuaugguuguggacaggccggucuuacugacaucucaccuagugguuccccaucagcggcaagagaaggaucucccugccuugucacccugccccacccugugggaggucauaggaguuggucuccaacggucuacucucuacauggaggcccuggagucgugcucuccagaaagggugcaagcuucuagucuccccuggggucccacacucccgguccaggugcuccaagagauguggcuuuguccaccacaucuugucugguuccaaacccaagaacacauuccucagccaacacugaccacacaccccaagccuccacccaugcuguccucugugccuuuagacaccuucggugggcuccaagcugccaccuccccucugccugacagccuagcccugaagcagagucccuguuuugcaccucugccuagggcacuggcugagugcuuccccgacccagcagacucuuggccagccuaaugcagcacuaccuccuccugcucacccccaacaagcaauggagcuggaaaacugggggugcucuaggagggcuggagaagcacaggauagcaccacccugaugggacugaagacccgcagcaccugcuggaagagguagguagcaccaggagccagagccagagguaggagccuggcagaggggcagaggcucaguucguucccauccccccccaacacaccccuuucuuucaaggggcguggccccagcaccccaccgaugagacugagagggcuccggccaccuaguagccucucugaagcccucuuguauccuuccagggcagcaccugggaucucugcaggcagagggggccucccaggaaucuacacucgcccuucccuacagcagccagagucagcccaucaccgccgccguccucgccguacaccaggccugggaccguccaggaagcaagaggggaauccuccggggaaggaaugacccguggaggcccugcgcagggggaggccgaggaggcccgagccggcguccucuccgguggcaccgcaccgccccuugcagccggguggagggccugcgggccugggcuggcugcggcgcccacucgcgcgccggagccggagggggcggggguccccacgaagccuugcaacuuccaccccacugccucaggccggcccgaggcgcagccagggaccugccccgaaucccgcggcccugcccgggccugcccagcgcggcgcucgccugcggcccacguccccacccgcggcccgguccgacccggcgcaacacgggccgacaugggcacccgcagggcccuucccgcggggccacugcaaacuuucucuccugccuggaggaagggaccgcgacugcggccacagacauugcgcccccccggaucguagggccccggacgugcugcgacccgccgggacgcggcagcccauagcggagaccgcgcccggacacacgcgggcgcccggccggaaccgcaggacacgccagccgcggacacgcgcgccgcaguccccgcgcacaccccccuggccgccgccagcgccccccggccacucgggaccccgggccgcgacgagccucccgccgcccgcggggaaaguugcgccccgacucacccgccaaccccgggcgcgucccgccgcuggccaucguugcgccccgccgcucgccccucugcggggccgcccacgccgcgcaggccgcccaggccgaggccgccgcgcccgggcuccgcuccgcugcguggcugcgucgccgcugcccagcaugaauggggcgcugagcuccgcgcggcugcggaccggccucgcucucgccgccccgcggagcg

SEQ ID NO: 3210 - RNA, 1071 nt, Mus musculus
augaaugacaauuccgacggcagcacauuggcucuucuuaaggaucuugcucaucagugaagauucaaauuuaucauccucuuacccauggaccucaaaaaguuaacuauauguuuuucauugcucauaaacacaaaagggcugacaguggcauagaugugaaucauaaagaguucgauagaguaagauguuggaucauucaggagcauaguucuuaagcaggagacaauguugucauagauggucaucagcacaaagaaggucaugagcaucaggauggucuggguagcacuuugcucuggggauuuuuuuagggaaagucugguuuccugaagaugcugggucuguuuccugugcaugcauaaaagggccacuauguaccaaguugagaggaacaugagacuaauaagaaaguauucccugauggcuagcagcguagaauuuaugcuuuccacgagguaacucaaggguagaauagagcaggacugaguaacauaaguaaggucauuuguggucaaauuagggguggcaaugauugauaccaagaguugacugcuaauuaacauauagaggacacucaggaaaagaauagcacauaagaugugaugaagagauauaugcuugaacuuugauaaacaggagcuucugggacuaagaaugauggccuggaggacacucaacaugcugguggugcaaagggagagaccccucaaaacucuguacagguacacaaggaauuuacauaugaugucaucccagccccuccgagagauaaaaaugucuguggcuaugaaugcugcgaccagaagcaucaguagguggauuagggacaagagaccaaugggcaggucagugagucugggccugugcccacgaaugaacuugaggaugugguagagaagaaggaagcuguuuccugugaugccaaugccaauuucagagaaaaauguguucccaauguuagaauuaguauguagucugcuguucuuauucauuguaugugagaacagugaacaaggagaaaagaacagaaucuuacucaucccuccuuggcaacucuguuccccucac

SEQ ID NO: 3211 - RNA, 1071 nt, Mus musculus
gugaggggaacagaguugccaaggagggaugaguaagauucuguucuuuucuccuuguucacuguucucacauacaaugaauaagaacagcagacuacauacuaauucuaacauugggaacacauuuuucucugaaauuggcauuggcaucacaggaaacagcuuccuucuucucuaccacauccucaaguucauucgugggcacaggcccagacucacugaccugcccauuggucucuugucccuaauccaccuacugaugcuucuggucgcagcauucauagccacagacauuuuuaucucucggaggggcugggaugacaucauauguaaauuccuuguguaccuguacagaguuuugaggggucucucccuuugcaccaccagcauguugaguguccuccaggccaucauucuuagucccagaagcuccuguuuaucaaaguucaagcauauaucucuucaucacaucuuaugugcuauucuuuuccugaguguccucuauauguuaauuagcagucaacucuugguaucaaucauugccaccccuaauuugaccacaaaugaccuuacuuauguuacucaguccugcucuauucuacccuugaguuaccucguggaaagcauaaauucuacgcugcuagccaucagggaauacuuucuuauuagucucauguuccucucaacuugguacauaguggcccuuuuaugcaugcacaggaaacagacccagcaucuucaggaaaccagacuuucccuaaaaaaauccccagagcaaagugcuacccagaccauccugaugcucaugaccuucuuugugcugaugaccaucuaugacaacauugucuccugcuuaagaacuaugcuccugaaugauccaacaucuuacucuaucgaacucuuuaugauucacaucuaugccacugucagcccuuuuguguuuaugagcaaugaaaaacauauaguuaacuuuuugagguccauggguaagaggaugauaaauuugaaucuucacugaugagcaagauccuuaagaagagccaaugugcugccgucggaauugucauucau

SEQ ID NO: 3212 - RNA, 932 nt, Mus musculus
aucaaauauuuacuauucugccacacaaugaccagaaaaacuuaauuauaugcuuuucagugcaaauaaauacaaaagggcugacugugacauagcuaugggacacaauaauuuggacacagacaaauauugagucauccuugaacuucauccuugaguagaagauaacagagucuaaaauguagaaaaccacaaagaagcucaugagcagcaugaugguccugguggcccuuugcucuggggaugcuuuuaaagaaaggcuguugcugugaaggugcugggccugcuucuugugacuccauaggagagcuaccauguacccacuggacaggaccaugagaccaaugagaaaggcuucccugauggccaucuucguggaaaacaugcuuuuuauggaguaacucauggguaaaauugagcaggacugagaaacauacagaaaauucucugaagucaaauucagagaagcaguaaucgauaagaguucacugcuaagagacauauagagaacacagaggaaaagaaaggcaccugagaugugauggggagauuuauguuuaaacuuuguuaaacaggaguuucuuggacuaagggugaugguccaaaggacauucagcaggcagguagcacaaaguguggggccccucaaaacaaugugcaaauacauaagaaaugugcaugugguagaaucccaucuccccccaggcauaaacauauccacagcuaugagucccauaguuacaagcagcauuagguggguuagggagaagaaagcaauguagagaucaaugggcuuaggccugcuuucaccaaggaacaugcagaggugggaaauaaaaaggauacuguuagcugagaucccaacacucacuucagagaacaauaugacuuucauguuugugucggugcagaauauguuggcuuuauucauu

SEQ ID NO: 3213 - RNA, 935 nt, Mus musculus
uucacauauuuauuauccacucacacauggaccuaaagaaguuaacuaaauguuuuucagugcucauaaauacaaaagggcuaacuguggcauaaaugugcaucacaaagauauauauagaauaacauguugaaucauccaagaacauagcucuugaggaggagacaaugcugucgaagauggacaucagcacaaagaaggucaugagcaucaggauggucuggguggcccuuugcucugcggaugcuuugagggaaagacugguacccugaagauucugggccuguuuccugugcaugcacaagagggccaccauguaugaaguugagaggaccaugagaccaauaagaaagacuucccugaggaccagcaguguagaauacaugcuuugcaugagguaacucaaggguagaagagagcaggacugagaaacauaaagaaaguuauucauggucaaauugaggguggcagugauggauauaaagaggugacugcuaauugacauauacaggacacucaggaaaauaauggcacaggagauguuaugagaagauuugcgcuugaacuuagcuaaacaguagcuucugggacugaggauuauggccuggaggacacucaacaugcuggugguacaaagggagagaccccucaaacuucuguacagguagacaagaaauuuacauaugaugucauuccauccccuccaagaaauaaaaaugucuguggcuaugaccgcugcaaccaguagcaucaguagguggauuagggacaagagaccaaugggcaggucagugagucugggccugugcccacgaaagaacuugaugauauggaagagaagaaggaaacuguugccugagaucccaaugccaauuucagagaaaaagguguuccuuauguuagaaugaguguguagucugcuguucucauucauc

SEQ ID NO: 3214 - RNA, 935 nt, Mus musculus
aucaaauauuuacuauucugccaaaaauugacucccaaaacuuaauuauauguuuuucaguacaaauaaacacaaaagggcugacuguggcauagcuaugggacauaauaauauggacaaaguagaauacugagcaauccuugaacuucagccuugauuggaagacaacucuuuccaaaauguagagaaccacaaagaggcucgugagcagcaugaugguccugguggcccuuugcucuggggaugccuuugaagaaaggcuggugcugcgaagaugcugggccugcuucuugugccuccauaggagagcuaccauguacccacuggacagggccaugagacugauaagaaagguuucccugauggccauaagaguggaaaaccugcuuucucuggaguaacucauggguagaagugagcaggacugaguaacauacauaaaaucuucugaggucaaguuggggguaacaauaauugauacuaagacaugacugcuaaaagacauauagaggacauagaagaaaagaaaggcaccugagaugugauggggagauuuauguuuaaacuuuguuaaacaggagcuucuagaacuaagugugauaguccaaaggacauucagcagacagguagcagaaagggcgaggccucucagaagccugugcaaauagauaagggauuggcaugugguagaauuccaucucccccaaggcauaaacauguccacagcuaugagucccauaguuauaaguagcauuaguugggucagggagagaaaagcaauguagagaucaauggguuuaggcuuguucucaccaaggagcuugcagaggcgggcaaaaaagaggauaguguuagcugagaucccaacacucacuucagagaacaagaugauuuucauguuauugucaguguggaguaaguuugcuuuacucauu

SEQ ID NO: 3215 - RNA, 950 nt, Mus musculus
cuuaccuauuccugagcaauaugaugguuaccauccuuccaaauguggaucugaaaauguugaugauauauuuuucaguacugaggaucaaaaaaggacugacuguggcauagccaugggcugugaaaauguggacacaauaaaaaaucugaccaucaucgauacuucuuauguaggagacaaugcuguccaagguguacaucagcacaaagaagcucaugaggcacagaaugguccucauggcucuuuuuucugcagaugguuugagggaaaagcuggugauauggagaaauugggauugcuuuuuaugucugccuaggaaagucaccauguauccacuggagaggagcaugagaccuacaaagaugacaucccuggaggucaacaguauaaaaacugugagauggaaagaguaacucaugggugccagagagcacgauguagugauauauguaaagcuaggugaggucaaauuagacuuugcaguuauauauguugcaaggggacugcuaaugaauguauagaagacacucaggaaaagaagacaaccuagcauguaguguggagauuuacgcuugaacuuuucuaagcaggaguuucugggauugagagugacagccuggaggaugcugagcaggcugguggcacaaagagagagacuccuacaaaaccuguacaaggauauaacacauuugcauguggugucaccccaucucccccauggcauaaagaugucuguagcuacuaaacucauggcuaucagcaucaccagguggauuagggacaagagaccaaugggcaggucaauaugucuggaccucugcccacgaauguacuugaagauguggaagagaagaaggaagcuguugccugagaucccaaugccaacuccagaauaaauagcauuucuuaucucgguguuaugggacagucuauucauuuuauucauu

SEQ ID NO: 3216 - RNA, 3114 nt, Mus musculus
uccuuuauugugguucauuuuuuuuccugcuuauuuuccaaagauauagagagaacauuaggaguuugauggggugggaaguggggaaauuaugggaacagauggugcagaaacuauggucagaauauaauauaugaaaaauuauuuucaauaaaaacauaaaauauaggagaaaaaacccacagacaugaacagcaccauacaauuaaauaaacaaaaccaaagcucugagcuuguuagcagggaauagggaguuagggaagagaucauggggaaagagauaaacuucuaacacaguggcuggauuauaaagagagaaagcacuccuacuugggaacugagauuaucuuucagagaggaccacucuggccaaggagauggaguaaugagagagggaaggugggaacugagaaagaaaaaagggguuucuaaagagcgcaaguccaggggccugagaaaagaucaucccagaguccauuagucagucuaacugcucuggagacccugcccuucucaacagggaguauucugcucuuugcuuucagccccagugaacaccucuucaaaauuucuaaguaucugguuuauuucacugagcaucugcuuuauuucaucuaucuauaucugucugucugucuguccauccguccauccauccauccauccauccauccauauauuuaucuauuauuugccccagggaagaaccuggacuccuggguaccugcucuauggcaccaacgaccucauuaaaacuggauuugagaugcccuuugaaguaauccacugcucgguuuaccuggggacccccucucuaguaucccacagucuucucucagaugcuucucaaagucuccugagagacaagaguccaccaguuucuggccagaacacaggugacauacuagcagccaaaauuaugggaguggagauggggaagaggucuaggaauuuaccuaacagcugcucauuuaaagguagugcugagaaguccugaagccuccuucccgacuagggaccaaagacaaacaacucuugcuuuuaacccacuucaaaaaccaaaacaaaucaaaagccccuacccaggcaucugcuagaguggagaagugaucuucagaguggaaggggugugcaugucaucccuggcuuggaggggaucucccuccagagagacagguguuugaagugcuaccugacuucuucacucaccauaccugcuuguauuuguuuuuaacucacuggcucauuugccauguaucugauauuuuuucuaaaauucuacaaaaauucaaagaaaguaagcaauaccuaaacaaaugggaaacugugaauagcagagcugcucaaauguuuuccauauucauucuauccagauaugcuauauaggaggcagccucagucaggcuggugauucuggacuucccuggcagugcuuaacuggaauccuuguugacuuccaagaaccuuugugcaucuauguggcuugggaguucaucagugggccacuuagcaaauaauagucauuuaacacugaauaggaaaguacacucuuaugcauguucuuugggauaggaauggccugaaucuggccuuggcuacacacauaggcuuuuugcuuuccuuccccacccccuuagauaaaggccaucagaaggccaguuguuuccugugagcuggggguagguauuggaucaagcaauuggaucaaaccuccagucaacuuguucuggaauccagagcacugugcccucuccagccuccuuacuccucaguagaaagaccagacagacuagccucucacucagguauuuaucuagaugacagguuuguccucagucuacaccccgaugcuucaccugugagaucauguaugucaggcaguguggggucgaaggagcauggcaggcucugugucuugcuguguggagcauugagaagcaggagaaagguucccccuccccauuuuccucccauucauggccugagccccaugaucaggaaucacauccaaggccauccugcaauagggucccugagaagucaguccugcuggagucaggccuucugauaugccucugauuauaacaaccaugcauggccucucuggucacugguaagcugacugugggguccuagucaccuuugguggaagguucuuaucacacuacuguccccaaggucuuucuuagaauaguaucucuuccaggcaguucaccggggggucugggcccuuccccuucuacuuucagaaaguucauagcaagaaguggcuucauaaauuugagaguucucauacuaaugaauuaaaagugcaccugaaagcucuagaacaaaaggaaacaaacacacucaagagggguagauggcaggaaauaaucaaacucaggguugaaaucaaucaauuagaaacagagcaauacaaaaaaaaaucaacgaagcuaagagcuggcuauuuuuagaaaauuaacaagauagacaaaacuuuagccaaauuaaaaggcacagaggaaguacccaaauuaacaaaaccagaaaugaaaagagagauauaauaaaagaaacugaggaaauuaaaaaaaaagcauuagguuuuacuucaaaaaccuguauuaaaaaaaaucuaaaugaaauggcugauuuucaccuagacagauacaacuuaccacagaucagguaaacuaucuaaacagucccauaacccuucagaaaauagaaacauucauuaaaagucuuccaaccaucaaaagcauaggccagaugguuuuagcacagaauucuaccagacauuuaaauaagaguuaaugcuaauauucuuaaaacuauuccacaaaauaaaaaacaggaccauugccaaacucauucuaugaggucacaguaacccugauaaacuuaaaacacucaaagacucaacaaagaaagaaugucagagcaauuucccuuauaaacauugauacaaaaauacucaauaaaauacucacacacugaauccaaaaacacaucaaagacauuauccaccauuguugcguccaacucgaccagcaaggaaaaugcaaccaccaguucuucuuaaagcaguugacucaggcagcuuuucucuucaaauuccccgccucu

SEQ ID NO: 3217 - RNA, 4233 nt, Mus musculus
augggauuugaaccugcaaaguuuauuggugcuguauggucuuugcaugugggggauggaccacuccugguuuuuuaguggucuacaaggcugcucccuuuacaaaugucucugaggcagcugucuggagcagagagaaugaggcuaagaaaggagccuugaaaagcaggcauucuagggaaugcucucagguggcuuugaaaucccacuggugaggggcugguugucaggggucugcagaggaggcagccugggaagaucuuguguggggaaacggagcugcaguaauuuaaguucccagagguuacacagugggggauguggggguggugaguagaagcugaauggccaugcgacuugcggagcgccgagccuagagaagacauauagaaccacaccugacccagggaacccugcagguugcaaccagccaaagcagacagggccauaucugugaagacucuugacagaucuaucuccagcuaggccugucccagcccuguaaacagccucuguaaccaauggcugccaacucagaggcccaggaaguggcuucacacacuauuccugccaccugcucuuccagccuuagaaaccuaagcugaacacagcagauuccuauuacuucuugggccuccacggcagagcuuaggguauaucuuaauucuguucauccucuaggugaguuaugucaguugauuggggcagcuaagucaugcuaauucuucuucugugguuaccacccaccugaggcuagccccuagcuccccaccagaaacuguccucaaucugaggcuggccucucgcaccugagacuggcuccucuuaccugagaccaccuucacacauucacuagguggguccuugcucucuucccccuauggcaccugcaagugaagucccuuacauuugggcuucuccuucaaggucccuguaccucuuucaccuuacuccuucuccuuucucugugcccuggacuccacaauuggccuucuuggauggacuuccagcaagaagcaggcaaagauuuagagcuagaggaccucauggggcuggggcuccucccacuuguccccugcucaucuguucuaaagugguaggcugcccagcccccacauuccucuccuagcucccaagcccuggcuguuccuccagcuuggggaagaaccaauuucccacgugccucgcuucaaugcugcccagggguucucuuaggcuggucucacugugaaccauagcaucauaugcucccuaaaacaucugucacugugugguuuucuccuugagucucuguacuuccugcccaugguaggucauaguauacccuaccuaaaaggguaggucauacccuuuugccugggaucuuggccacacccuacuagggcuugguccagacaugguucagaguacaggggggugggggucagccccaacaccuucccucacucuaacauggcuagauuggauuucuacauccuauccuggaucuaagcugcuuccauuuugcagcuuagauucaaaugcaguguauguccaaauggagacagaggucuagagacuuagcagcucuuugaccacagccucagcagcaaaucccccauggguuaggagguuugguuuagaugucagagaauucuugcucugaauucccagauaagggaagggaagagaccagagacuaaggcuagggugugugugugugugugugugugugugugugugugugugugugugcuuucauucauguugccucuuugggugugcuguggaguaaagguacagacuggcgacuggccagagcugauacacagggacugaacaauaacuguggguucugaggcauugagguggggcuggagugccagggcacccuuugccaccuggcccugaaagucccccaggauggaacagcuuguccaccaugcccgugugguaggugcacuguagccgggugcaaucucuuguucccugugccucuguuccauccuaagauggaacauuguagucacaugucugaugaugaugaggaccuuccugaaagcgacugagguuuccccucaggguggggugaugucgacaagacacauuuguuuguguaugaccaccgaaggcagccaaguacaggaacuuacccugggauggggauggaccguguuggcaccagauucuucuguaagggcaguuuguccuucagugaguugcucuuggccuuacaagauggugggcaugaugugcuaggcuccgucaaaugagguaaccuagaagggggcuugagugguuaagugccuauaacugccagucaccuacagggguucacaccuagaucucucuguuuggccccauacucagugcauuacaggaaauguacuuuucaccuggacugggacaguaggugaagaaggaagagcuagauuguuggccacaguacaggguuccucaggugccccauggacuagagucacuccuccuagccacagcucuucagaacacucuguguucuggggaucugggagcaauauggggcuugcaacagggcucagcccuaagugucuaggcgucuuguaccuguaaggaaacuucuugacaaaucucucauaagucuugauuuccuucuucuuaugccggcagggcuucuuguggccuuuugaguccaucacagagggaguuaggcuguguccugcacagagggggcugccagagcagaagcaggaguaggaagucgugagcuugcuuaacucuccccacugaugaauauuguuauuagcccaguuuucaugggaagagggaaagagcuccaaaaggaaaacugcuuuguuugcaucuaccugacaaaaugguaaacuagucuuccagaauacuacaaucuggagugacaaggauguggcagagccccuucuggcugucugccuuccaguuuugugauggcccugucaucuggcugauugcagcugaccauugugacucaugacaccauuccaggcaucucuacugccaccuugcagcagcaacuaacuucacuaacuggccuggggcuguuccuucagggccaugcagguugcuggagcuuaccagauagccuagucuaaaucuccagugugacagugauuaggacuugguuuacaaagcccaggaacagcucuuucagaggaaguugcaagagaaaaagcugcuguagccccacagcugucacacucagaagccucagucagaugggagacccaggcccaagguguucugggagcaagcaaaccagcagaggcacauaguaugcacacucuuaagugacuacacuaggguugauccuggccaugauccugagugccaggcaccaagggaaccauaauuccauggcucuggaccaacagggcccauaggcccauucugaggucagaagccucugaggucacaaucaguggcagggugguugcugauaugucucacagaagcugagggcaggucuaccagcacagccugggagaucugcagagggcuuaccuugauaaggagagagaauagaaacagaggagccaggcaaugagauggguugagaggucugaggauguggccagugcugucaggagaugccaaagaguaggcaaguggguuguuucaggugaccaaaccaggguuguacaggagacugaauccucagcagacagcucaaauccuuaagccuagauuuaggcuuucuuucuucucuccucugggccagaagagucccuaccccaguuuccuagacaagugacucaaagugaacagcagggaagccaggugaaggcacugagaguuugaacaaaaguugcugguucuucacugggaccaccuuggaguggcugggguugacaaaagacuggacucgaaguuggaagagccagaugagaacacauuucuuacagcugggugguucagacucucccagaaggcucacaugcugcaagugcuguccccagcuggcagauacaauaauugagaggugauuagaugguaagggcucugaaauaaucagagggucaacccacuaaugaauucaugauuuuauggugcugugaaggauaguggagauagaugauggggcuuauuggaggaaguagguacuuaccacuguaaguuguucuggauaguccacaucaauaacaacccuaagaaguugguacccugagugggaugugaccauguguuuuggggaguacuguggaaggccuuuggaaccuuggacuagaacaccauugagua

SEQ ID NO: 3218 - RNA, 34001 nt, Mus musculus
cacggcuccugcgcacgcgcagcucgagaugcgacucugggcuguagucuaagcucagcuuugacagaggcucccggggggcggacccuaggugucgcgcgcaugccuggcagggcugggcagcucuucuccgguggcugcgguucggacgccucagcugggccuaagauggaccucccggcggugcuggccgccccggccacgcgcggagaccaacauggcgguggcccgagccgacuucgccgcggcgcggggccgucccucggugccggucccgggcgccgucgccugcugcugcugaggggcccggaagauggcgggcccgggccgcguccagaggaggccccggggcccagcccgccgcccccggaggacggcggcgacuccuucgugguacugcuggaagugccgcgcgcggccgacacccauggucaggaggaggccgagcccgauucgggcgcgagccccacggaacaggucccggccgccgcccccggcgcagcucuggcaggcacggucaccauccacaaccaggaccuccuggugcgcuucgaccgcggcgucuucacgcuggcugcggcgcccgcgccagccgccccgagccugcaucccgcgaccaccccgggccuggagcccucgagcgcugcugcgucccgccgcgggccgguggccgcuagcgcuggcuccccggccuaccgcuguccggagccgcagugcgcgcugagcuucgccaagaagcaccaguugaaggugcaccugcugacgcacggcagccuccagggccggcggcccuucaagugcccgcuggauggcugcggcugggccuucaccaccuccuacaagcucaaacggcaccugcagucgcaugacaagcugcgucccuuuagcugcccggugggcggcugcggcaagaaguucaccaccgucuacaaccucaaggcgcacaugaagggccacgagcaggagagcuuguucaagugcgaggugugcgccgagcgcuuccccacacacgccaagcucaacucccaccagcgcagccacuucgagcccgagcggccuuacaagugugauuuccccgguaagcuggagacgcggaccugccggggcgggcgggacccggcggggucuggacccaagggccaaacugucgcuuguuugggcaggguuugcggaggucgggguggaggcguuacgcgcccugaucuaaaugagaauaaggcaaaaacacucccguguuuguuuugaagucccuuucagguacuuagauaugaagcucuggguuccuacagccaaguggcaugcacaaucgcagcuauccguggggaggguacaaaccuuuguuaagaugcuuacauuggaagugaccucuucucagaguugagucaggacuuuauuuuucucagucuacucguucaacaauaccagaggagucagagguccaagauacauaaaucgaaauaugccaccuuaaaauacugagggaaugagcacacauuggugcuucucuggucccucuccagccucucuggaagccccauugauuagaggacacagagcucccaaggacgccucgaacauuggaucagaccccuguccuuuccaauauuaugaauagagugaugcuccuucaucaggagccggugugugacacagcuguuuuugugucuuuuauacugauuuuugacagacuaaucaguuucuggaaucaugucuguucuuuuuacuuuuagccagcaucuagcuugcacauuaacauuuauauacacucugcacuaguaaugugcauuguagauuauucucauaugaagauuauuauuauauguaggguauagcaccugaaaaggauaucuuguguguuguauggggcugggaggaagaaccagacuuaacuuguacaagcaacagauucuacuguuguauucuagcgugcacaucauaucugauagagucugauguagaaaucaucaggcugaugauugaaaacaugcagucauuuccuaauccgagaaugaugauggcugcucucacccuagcaaagguagcaccauucucuaucauacugggaaggacagggguccacucacuuaaaagcaugaggugccccugagggucuugugcuggcagaucacuuaggcuuccauagaagcugggagaaggagcaggggaacaccaccuuuucguguccagucaaggagagguuguuuugacaacaugagcuaggaaguggcagugggaaugguguggggcuucaggaaaagaucacagagucagggugaaagagcuugccuauugauaggggguggugaggacuguugcuaaggcagagaaugcuaauguuuggauuaaccuaaucacauauacccuaaauagcaaagcagacagcuugaggcuaaggaagaggauuuuuggauggagcagaaauucccugggcuguuacuuguauguagggcuguauagugauuguauuuuagagauggggcugugagaacagaggugaagcuggcaaccugaauaaauggguaaaagauaaagaggaaccagaugguaagaugcggggugucaguugcagaagcuggagggaauugaaaaguguggaggaugcagauucccacucuagugggacagaaaaucugagcuaguaggaugguugcagcccugcaaagcuguguccgacuaaaucuugaugguuaguguuuaguuuguccugcucauuucuuugguuucagacagcguugccaacugaguuuguaaaagacaaaccuaguuuuugcagaguugucuacaaaaguggccagcaaaugcuauguuuggaagacaaccucuuacucuuacaucacacugcaacaggugaccugaguguugcauaucacaugugcgacaggaccuucugugccuucuagaaagcuaagcauugcuggaccuagcuuugcagaccugguuucugaggcauggcuuuccuugucuguucauugugaacugccacuaucaauugugugagcugcacugugugauuuuuguccugagagcugagcuugugcuuucuucauucaggcugugagaagacguucaucacagugagugcccuguuuucccauaaucgagcccacuucagggagcaagagcucuuuuccugcuccuuuccugggugcaauaaacaauaugacaaagccugccgacugaaaauucacuugcgaagucacacagguaugagcugcagugugcaccucauguagacacaugcuuugugguggcugucgugcucauggcuaugcugugucauguuuuucuuuuacaaggugaaagaccauuuauuugugacucagacaguuguggcuggaccuucaccaguauguccaaacuucuaagacacaaaagguaaacgaaccauacauuuuggcauuuagguucuaaaagcacaugaacuaugugucucagaccauucuuagugaauuacauacagauuucaggcaguuuaaaaugcagcucagugucagugcuuuagaaaaucagaaaacuaagaaaaacucuuaagucucuucacuugacaacaguuaucuccuguguaaguuugauuugcuuuacuuaacauccugucaauacaauuucauuuuuuuuccuuuuaaauguuguagaaauacuuuucuucaugaucuuguaaacuuucagcagugauacugacaacuaggggucuguguacacgugacguucaucgauauguugucucauuccaucuuggucacagcuccgauacugguauuauacagauucagagaggguggguggccuguguauguuuucaugacuggggucugagaugcucagagugaaggcauuacuuagaaaaagacaguguuugcaaguuuacuuaacaaggaucuuuccuacugcugcugagcucugugugugucuucuggucaucuguggcuuggaaagaacauuggucauagagacuucaaagaguucauauugcuucauucucuccuuuggggcucagcgcuuguuagauuguuguagcacuaauuauuccauuccuggcucuggggccaccuaccuaucaaaauagaauuucugauuaugggcagcuaaacaaacccugugugaacauucugaaauguauugaccauuugaauggagggauacacuguuucaggucuaaagucucaugccugugagucugugaguaaugauugcuccuucauuuuuuuauuuuuuuguuucaggaaacaugaugaugaccggagguucacuugcccuguugaagguuguggcaagucauucacuagagcagagcaucugaagggccacaguaucacccaccugggaacaaagccauucgaaugcccuguggaagguagcauuuaaaacguugcuuuagcuguagacaaagugccacaccagcacuccucuuaagcuguaaguuugaguugcagaagcacuaagguaguugccaguuucagcccuguauuuauuugguugguuaagaguaggugcacacugucuucggggaguguacuagaagaagcauucagucuguggcuauaguuccacuaccuguuaaacucggugauuaugaggagcaggggaagugagaagaagaguacaccaucguguguggucuggcauguagcuuggccucacuaaaugacaaauagcuagcuuauugcaccuggacagaaauaaagcuugucugauuuuuuuaauaaggguauacaugaggcuuugucuugguuaggguuuccucaaacaccucgaccagaagcaccuuggagagcaucucagcuuacacuucuaugugacagaccaucaucagagagucagggcaggcacucaaggaagggaccuagaggcaggagcucgugcuaaggccauaagagagugaugcuuacuggcuuacuuagccugcuuuuguagagcacccaggaccauaggccgguaugugguauuaccuuacccacaugaauuugacugugccacaucaaucaucaaucaaggaaaugccucaaaaacauucccacagaccaauguuuggaggcauuuuucucaauugaaauucucucuuucaagaaaaaaaaaaucuagcuugugucaaguugacauaaaacuagccagcacaggcuuuuuucuuugaaauguuuaaaaguuuaauuuauuuguauggcccauuuauaccaacccugcucuaguugaagguccacuaagggaagagcaauccagcaugagucuguugaacccuaaauuuagggccucagcugaaucuguagacuuuaguuaucuuagcuggagaaggauaagaaagaccaacaccaguuuuuacaacagacugaacauagugcagaugguguuaucaagcuuucccuccugucaccgugccaguugugaguaugacagauaaacaagaacauuccggcugcucugggugccagggguucauccauacugcucuuagggggcggggcgugaauguccugaucaguuuaaggaggaaagcuagccagacauuaaauaauggcuguuagaagcagaaagaccaaagggagaauccacagggcaauaguagcucauguuggagacaaggccaagucuggucuuuggaggggcacuguaaucacccugauaagacaguugcuccugagcuaggggcugacaacaaaaaggaagagaaucccaucaacagcagaauagagucacagcuggcugugguuuggaccugggucagggaggagagguaguaguugagaucugauguagggauuggagaagagaagaguuuggucauaugguacauaaaaugauaaaauguuagcuugaccagagcuacucagaaagcagacugugugucugcugcuggccuaaagagcaagccggacuaugucugaagcaaguagcaugcaggcccucauuuaagcccugcaaggggauggaauucucaagcaauucaaaaugugaauucuggauucaaguccugaaucugccuuuugcauggcucagaggaguccugggauaaacagaacugugccucuuuucuucauccaugaaguaaacuaaaccucaugggguuuuugcaggaauucagcuaauugaaacuuuuaaagcuuguaaaaagcauuaguauuuaucaguuccgauaguuguagugauuacuguuagguggaguuuuguuuuguuuucuguuuuuaagcccuagugagccgugauggagagccacagguggugguauaacagugaaaaggcugcccugguaggaauacugaaaacaggauacugagccagaaggauguguguggaaggccagcuaugaaugcugaggcccacuaguaucuguuggugagcaaguuuugguaggccaacucaggcagaacuagugagcaggaggcaggugcugcucauuugacaguucuucugggauugauugggcaauucacuguuaacgauggagcauugaaguaaguucucaaggagcuuugagccucagcagagagaugugugacagggcuuagucaaggccucugcauaaugcaguggcgccugaugcagagacuccagaacuccugcauacuggacuaaaugaagcuaggcucauuuagguggaaguguugagaguggugucaggaacauguucagggugguaggcagugccagugccaaggaccugagagugggcuauuuaagagaauguggggccaugugaggaagggccucgacugucucugugcaguuugggacuucauuucauucucacauagaacuucaaaauguguuucuagacaagcucuaaggcuguuccuuauccugcccccaugcaucucauuuuacagacaaggaaaagcuacucugcagggucagaagcuugucuggggucaugggacaaauaaggguugcaacgccaacagccuuagcugagcaguucccugugcccuaacacccaucagcuuuaaggccugccuccaucacucacugaggcaggucacccacugccccuugcucuggcaucucucucugucuucucagaagcuguuuguacaguauuauuucagcuuugaucuuuuucuuacuuacuaccuaugugcucauaagccucugaacucaagaauucuaccuccccuuccugggucucuagaggacagagcaccaacaugacaggcugucauggaugagggaaaggcaauuguaaacaugugcugccuccagcacuugaauccagaucugaugugugagugaauuaaguauauaagcugggggaugccggaucuggcuccucuucuaccugugaccuagaaacauuugcucaguuucugugaugcacagaggugaaaugggcagguuuguauuuggucauguagugagauaguuccagccccuaggacuguaggauuucucucucuuucuuucuuucuuucuuucuuucuuucuuucuuucuuuuuuaacagcuuaauaaaggugauucauacacaguuuugcaacugaacuuuggagguuuuuaagcuguuuccacuuaacucugagcaguggguagaagggacagagugcgcuugcuugugucacgugucacacuaacucacggucuacauguuccuuuaucauuuuuccuuuaucccuugugccaagguauuugaucuguauuaagguucucuagaggaacagaacuguuaaaaugaaucuauauaaaaaggggguuuauuaaaguggcuuacggguuguggucuagauaguccaacaguggcuaucucucaaaggaaaauacaagaauccaaaaggcuggaugucucagcauacauuggaauuuugaagaaguagacucuaaauuuaguggaggaauaccuuggcagcaggauagauaaacuugccauugagaauggggacaagcaggcaaaacccaaaagcuuuaaucuuucauguccuuuuauauaggcuaccaccagaagguguggcccaaauuuagggugaaucuuccgaccucaagugauccaaucaagaaaaaaucucuuacagguguuuaguuaauuccaaauguaguucaguugacaaccaagauuagauuagccauggcaaauucacuccuugucaacuugacacaauaauaucucauuaugucauguuuuauuuccaaaugaaaccaauaaccagguaauaauuacuccuaacaugauauaacuauccuucaacugcaaaugcauuauauaucuuagaauguguggcaguaucccuuaagggacaguccuuuaguaucucaucacuuagauauucuaaccacugauaucucuauugguguuacauaacaugauaaaucuaguaaagaaaacacaaauacccuuacaaacacauucuuaacaaaaaaugugacagaaguacaugucaguuaucauccugaguuuugcaacuggucacauggccuuaguugguguuugugacucgcuuccucuguuacccagucuguauuuccucacccucagcaagcaccucagcaggacuuaggugcuuguuuuuauguccuguuuuuuuuuuuuuuuuuuuuuucauaagaagugacccauaccuucauucuugaagguucugaacccuuugucauccuaaauggauuggguuauaguuucgcauugacuuaauuucugucuuagaguuacuauugcugugcuaaaaaaucauaaccaaagcaccuugaggauaaaaagaguuuuuuuuuuuuuuggcuuacauauccugaaucacguucuauugaaggaagucaaagcaggagcucaaaucaagagggaaccuggaaaaaggagcugauaaagaguccguggaagaguguuguuucuuacuggcuuauuucucauggcuugcucagccugcucucuuauacccccaggaccaccaccaagagugauaccaccuacagugggcugggccuucccacaucaaucacuaauuaaggaaaugcacuacaggcuugccugauuuuauggagccauuuucucaugagguucucccucucagauuacucuagcuuguaucaaggugacauagaacuggucaguacaugauucuuaauuacuguuguagagggaauuguauguggcacagugcgucacagcgcauauuucacaugugcagaaaguuggucagcagauaacuuuguggaguugguuccuuccaccauuaugugaguuuuggaaaucaaacucagaucaccagacuugggugguaaauaccuuccuucugaauugucuuaucaguccagugucauuucugauguaguuaggaaguauccgugaucauccucagguguaacuggauccccucuguguuccagggugcugugccagguucucagcucgcagcagucuguacauucauucuaagaaacaucugcaggacguggguacuccgaaaagccgcugcccaguguccagcugcaaccgacucuucaccuccaagcauagcaugaaggcacacguggugcggcagcacagccggcgccaaggucugugacuguggcccugcgggcugcacagaaguauaugccugaguaugagagaagugggauuguuccccucccucucaccucucagucacgugcaaaccaugaagaugggucacuguuuccacacagccgugagaccuuggugcucuccucuccugcugcucucaucuuaccacagccccuuugaaacuaguuuccccuugccugugaagugcuucccuucaagugugccaucuuguuucaggccucccuuucacaugugcgucugucugcagcugggcccuuggcucuguaugcucugcauccucugcgucugucuugccguuugcuaugucugucauuccugauuacuggagcuugucuuuuccuccugguauuaggagacaguggguccugcacagaggacuguguccuacagauggacaggaaacucuccaagcucaggguggaauugugucucaggaaugggcugggguaugagagaagcaccaugauaguggucaauaggaccugacuuucagcaucugugguacagcacuuagaagccugcccuucuacgucuuaucuacagauauggacagaauaucaagaauaugggggggggggggggcggagagcccggcaguggcagcguacgccuuuaaucccagcacuugggaggcagaggcaggcggauuucugaguucaaggccagccuggucuacagaguuccaggacagccagggcuauacagagaaacucugccucaaaacaaaaaaaacaaaaaaaaacaaaaagaaaagaaaagaaugaaugaaugaaugaauauaggagaggcagcaguggcugccucucuaguccauucacagaggcugucucucugguuacuccugcuccugguaagguagcuugaugguggucaugcauguuucuaaccaauuccccucacuguaaccugugaagcagggaauaccauuuagcuuuuucccaacugggauccugagcaggagcagauuguagaguccuuuuuccuugagcuuugaaaacaaggaaggugaugauguuaugagucauucuccguuagugucugaugcagggcucugagcagcugaagcuggugaagguuuguguucuuaaucugguuucuucucuugggagaggugguugcuaaucuguccuuuggaucucaggcacuguaaccucaugcuacucucaacaguugcuacucugcacuguaaaagcaguugcccuccugcuagucuguagauuccuuaaggacaacagaguguguuuccuaaaauucaugucggaggaugucacucaaccacugucccccucuccagcucugagcucaaacugcaucucucuuucccuaagcugcuaauucagguuacuucacaggaguuugccguaaacucuggauggaugagaggcccuuuuagcaggcuauguuuaugguauaauugacugauuaauguaucauucauucugcccguugugcucaguagaggaccaggcacucaaugugccugacgacugcuagcuuguauuucaguucauggucuucccaccaugcugcaggaaaacuugccaagguugagaccaaaaggaagcacuaaagccagggucuuuacugggaucuguuugccucccaaagccacaauccuagccaucagcacuacaugcuuauguucagucagugguuuuucuccuguguauccguucauaccaauucucuaguugacaauuguggaauuaauaaaauauuagguggaagauuuuugaguaaguugacaucuuucuuccaccaaaaccacucuccacaagaacagaaucaucaagaggcuuguuuguuugcuuauuuuucauuugagaaaguaacagguuuccugugaaacaggagucuagaaagaaucacucccaucuccucagaauguuguauugaugcugggauacuuuugaagacacuuugugacugugacaacuaaagauuccgucuuugguuuuuauucuuaugucuaaacuagaugucuuuuuaagcuugaguuuaaaaugcaauacgcagccugauggugguagcauauaccuuuaaacccggcccuugggaggcagagacaggcagaucucugugaggccagccuaaucuauagagugaguuccaggacagccagggcuacacagagaaaccuugucucagaagaaacaaaacaaaacaacaaauaagccuuauuuacucugaucuggccuucaugcuuauaaaguaugcauuugugguuagcauguaguuggugugggagaaacagaaaggaguaccccuucccucugcuucaggcacuggggcaguucagaagugucagugagggauguaagaggaccugaugucugagcuucaugcaucugccuaaaccuggagcuuucaaccuaguccagacagccaguuuuacuccuugacuaacuacagaugacucaaacuaauccagguugaggaugacaguagauguggagcugggcacaguuugacaagaccugagaugacugaauaauaauuguaaaaauaccccagagccagugucagucuuagagcugacuuacagaggcuuuguucuauggaugcauugaaaccuugguuagcugcugcagcauaggaggagggcaggcuuuggagcacaaagacagccugaggacaugaaauauuagcucuguucuucuuguugagucagcucuuccuuuggugucugcuguucacugugugccagcaguaagucugucuuuacccugaugacaaggucuagugaacaguagucaguauugcuucaggggcagcugcuagcauuucaagcagaaagaagauuucuuaauccggcaacauaguaacugaaauauccauugcuuucacagaucuuguaccucagcuggaagcuccgagcucucucacacccagcagugaacugaguagcccaggccaaagugagcucaccaacauagaucucgcagcacuuuucucugacacaccugcuaauagcagcaguucaacagcugggucggaugaagcacugaacucugggauccucaccauugaugucacuucugugagcucuucucugggagggaaucucccuacuaacaauaacuccuuaggaccaauggauccacucguucuaguggcccacggugauaugccuccaaguuuggacaguccucuuguucuugggacaucggccacgguucuccaaccaggcagcuucagugcagaugauucacaggccaugagcacaggagcaguaggcugccugguggcucugccugugaggaacuugaaucaagacucuccagcuuugacccccagcaauaacuugacagcaccugguaccacaccaacuucuucagacaccacccaagaaacuggcagugugccagaucugcugguuccaauaaagguggaacaagacuugucuccugucccagaugugguccaggggcagaaagaaagccaugggccaucccaaucugugcuguccagcucuacagagaggccaggggcucagaaggacucagagcucagugcuggcacaggcagucucuacuugguaugaagcacucuauuccaucaccaccacuagcucacuucccuaaugcacuuuggaucguguuggggaugaauccugucuaugcagacgguucuuucuggugugcagaaggacagauggagccugggcaauagucuggaagccugacuuugacuuugagucuggaauugacauucuuacagcuuuaagcaaaucgcuuaacuuaucugagcccuagauccucacuuauuucuaaaauaagggguuuuggcuacaugcauucuaagauuucuuuugaguucugugauuuuauacaguuuucaugagaaaacuugaggcauuucuuacuauugaaauauucaccuuugugcuuuucacguagugacaaguccuagaagagcaauguugacuucaaucgucuuaacaguucagugggaacuugaaagcuacgucaggauauuuuuauuagaauaacagugauuccugagccuucauucuugaaggauuauaacaauacucuaauuuugaggcuggacaguuauuguauucuauauuuauaucaauuauaccuuuaauauaaucuaauuuaaaguaauuuaaagauuccuagagagagucugacuuuccucagucuacaauggaaaugaucauauagguuucuuuagaaugcugguugaauuuuguuuugacauuuaucauguuaagaaucauguaucuuaccuuacuauagccuaaaauacugcugugaacuggaaucaaguguaagaguaccuagcaaccaaccuacuggagccgacuugcauuuaucucagugugagagcugcacagucugucuguccauugcuggagucuggcuggugguggcagagcuacacuugcaggcaucugcuuaggcugucaccgcaguugcuaagagcaacaggugacuagacagggacuggagguaaccacaggucagagcaugugggaagccugucccugccacuccaugccucccugugucucaggaaagauggaauggaagagcuagcagaaccuggguggagguggaagagccagcagaaguuaggcuugccccuuuuuuguucucuugcuagcuguguguggcauugggcucccugcuucucugagugggaugguguugugaauggauuucaguaugcugugagccagagaggacugguuuccuuugcuccauguaguuuuaagaaugaaauuuuccuuacugaguguucacacauuuuuaaauuuccuauuugaauacuguuuucucuggcaccuccauaaguuugcugaauucaguaauacuuuuuguauuggcagaugacaguguggcacuugcugccaacacugcccagggcugcugagacauaacccuggcaucaagaagaugugguguuuuagggagcagggcaguguacagcucuuagcagucucucucuacaauaucuuagugcauauagaccuuggaggaguauacuucacuuauucagaugaugaagcugugugcguuuuccuuugcuaacaauugagcacgugguuucccgagagccuuugcuggugacugaauccuggagcucugauacauugccaggcaggcuuaguccccuugcuacccuuccucugcuguuuagaucaagcaacugacacacuuuucuuuggucccaggaaagugggggcucagcaagaacugauuaccgagccauucaacuagucaagaaaaaaaagcagaaaggaacugggagcgaugaaggugaggccgagugugcugcagugcuggugggcaaggggcucaggucucuugugucacagucacaggcagagaaagcacacagaacaguuguuucuguguucuuugucuucuauguucaaaauacccuuuuaucaauuccuuagcuuaacaugaacuuagaaaacagguagcaaccaaaucaccagcaugucugaacaugcccaacaggucugagaggcccucgggaaaucaaggguccaaacagggucaguucuggaaggcuacugagugaaugagcccagaaggcucggugucaggaaagcagacggguggcuggauaccuaguuaggccuugccuugugguggaagcccuugccuaguagggccauuaucucgaggauagcugugugaaggcggccugugugcagcagucuuugguugaaucagccugaaucuauaugagcagcagcucacuugaaugaaaagacaaagcaagacagaaccauguggagcaguuaagucuauagccucgucugcugucccuucugcacauggcaugaaggugcagguacugagaggaaacuggugaguccugucuaaugucagcaaagcucuucacuauucucaggcgucauucaucuuuacauuuacuuaaauuuacuuuggugcaguuuuaugucuuuccguucuuaauguuguagcuacauauuuaaaauaacaguuuucuucaagcagguguuuccauguaugccucucagugucucuuguaacuuaggacaguucugugauuuaggaauccaaguguaaaacuugcagggaaaauaaaaggagauguagaugucuguagaaaaaauguacuacaugcaagccaacuucaugaagaaagccagcugucucaauugagcccaguuaaaauugugguauuggaggaaaaggagugcuucagcgauuggguacagcguuuauugcacucaccaccuuggggcaguacuuacagagauaguugugcaguuaucauuugcaguaugacauuuuaaaaauuaaaaacacuuuaaaaguuaggcacauauuuaaccucuuuuaaaacugacagcuuuuccuguugguaaauguugagauuuugaguuguucaaaaccccauauaugcugcugacacuguuagcaaagaguccacaggggagucagaggcugcucuuggcugcugcccuucuaguuuagagccauaacaugcgcucccuacacacacacauucucucucucucucucucucucucucucucucucucucucucucucucucucucucucucuccuucucccucccucccucccgcccucucccuucugucucucucucucccacucuuucccacguuugguggaguauugcacagguugguuucgucuguuccaugugcucagguaccuuuacgguuugccucacuggggugguugaguacuuccuucaugguugugugcuccccuaaauuagcuacaucuugaggcuugaucugauugauucuuuuggggagaggagaguuaguaaacucuuuuggguucuuugcagggguccccugaacugauugcuagcagccauugaugacuagcacagagccauuagaugcuuagggucuucagagaaggugauaauaguucuaccuuccccuuaguagcuaggaccccucucuaaaggcuucucaggccuucacucugagguacaauugauaggagaaagucggggugcuuaagacugcaucggguuccuaugaguaguuucuggcaaccugugacaauuauagcauuucauguacacauuuuaaauguuuuagagacuuugaagggaaauauaaucauggcuucugcaagguguauagauuucauggguaagaaagaaaaugucucugccagggugaaggauuacuuucugcacuuaccugucuuuauugaaaaacacucuuggaaccaacccuaugaccagccaggagagguuccauguagagucucugccuuuaaauagcccuuggaaccaaccauguuucuccuaacaugugcaguaccuucagacuuacagacucucucuaccuuggguagcugugagccaugaauauugcuacccuuguguccacaacucugacguguuaccuagccauucuuucgagcagccuacucauagccuuggugagccuguuacugacagcuucugcugacacaguaaugggaaguuuacucucaccaggacucucucagacuggguucaaccaggcucccaucuggguucuguugucaggucuuccaaccaaguagggccucagccuucccuugccuaucacguugcuuucgaagaauacaguuacucucucugcagacucucuccauguguauuucuugaauccuccuuuugauuagacugaggcucgugucuguucccgguaaugugccuucuuugugcauugugcuagguacagguguauugucauggauuguuaucaaaggugcuacuggccagcuuucugccuucuauaagcauccuauuuuucuuuguaguuguaaauauuuaacuugauguagauauuuuacaauugugugcccucaaguauaacuucagucauucucacagcccauugaaagcucuuguacuaggucaguguuauacaguuaaaggacaaagucagaccagguagugaggucaggguagacuuuuuccagcauuggugaccaggagagcucaucugaaacauacuaucugcaguaauuauuggaacucaauuaugugagauaggacugacagugugugacccaggacuacacuguacaucacaauguuagcauuggcucucugaaguggcuuaaaguacccagggaaacaagaacauucuuuuuuuuucuuuuuuuuuuugucuguuauauauauauauauuuuaaagauuuauuuauuauuauauguaaguacacugucuucagaugcaccacaagagggcaucagaucucauuacggaugguugugagccaccacgugguugcugggauuugaacucaggaccuuuggaagagcagucggugcucuuacccacugagccaucucuccagcccuaauuguauuuuuauauauggguucuugacuuguauguaugcucaugugccaugccugugccuggugcccucagaggcuaaaagauggcauccgguccccuagagcuggagcugcaggugauuaugagcuacuauguggauacuggaaugaaagucugguucucugcaagaacagcuagugcuuuuaacuacagagcuaucugaccauccacaaagcaagaacaugcugacaagcaggacauucuaggauucccugggucauccucuaaagaguucagugaagcuaauuguuuaccacagauacccugucucauguuuuccacagauuuaacacuagacagugagcguugacucugauaauugacccugguguucugcagggugauuuguauuuccuguagguguuuauaaguuagggcucuacagacaguacauguucuucccucucuuagguguacuccauuauucucagcauagacucagaggccuggucuuaggcuauucucaguacugggucauagcaugacuagcauugauguuguugaugcucugauucuguacuccucuauacugucguuuaaguauuuucuuuauuuucuggccugaccaggcucaacuuguccuguacuuguccuggccugcagucagcuacuucuacagagaacccuggcuccuuuacuggagauuguuauuuacaaccagguuguggguccaagacuauguuggugagauguauauacuagguucucaguggccagugcuagaaaauauuuguaaauaccauuuuaaucauucugaacuauauuuucuauacagaauguuauggcuuuuggaagguauauaaacaguauuuuacauuccuuguuauuauauugauacuuaccagugaaacauuccuauguguggaaucagacuaaauggcuucacaccaaguugggcuguugggcugugcugcuauuugacaccaaaucugagggggaaauuuuagguuucugggaugucugcauuuugacauugugauuggagauuaugcacuguaauucugagcacagaagucccaguguaacuacaccuuuguggagucuaagcuuuaucaaacagaaagacagcacuuaaauguggggccuacacugugugugcauucuuagaaaauguguagucuaaaauccaaagcugcucccaguaugcugcuguugagaguaaauacacaagaguacugcuggccucuucaguucaggcagugagcugcuccuaacagaauugcaaauauuggaauuuuuucuuaaugugagaauagcauaucguuggagaggggaggucuuuacuagagcuugaacuuagguccuuacacauacugaguagguucuugaccaguuagcagugguagggcagggaaaugaaagccaacaugaugcucauuaaaaggaacaauaaauagcaagacacaugugaccaaaaccugaggguaucugugucacuguaaaaauauaaacagcucuuaagugcauugccaggagacaagacugaauagaucuaagcaaagcauacccuuagggaaauguacgggaagacacaggaaggcgagcagucucagacauaguccccaaagcaggacugauauguacuaagagggcauagugcaaggggaagaguggagacagcaaagcucuuccucuuagguugguguccauguguggcccacagcagagcugaaccacauuuauucugaaaacucagcaucccaaccagcacaaagugaaacauagaaaccuaggggagaggaugaauaaaggccuagcauuagugaaagugacucacuuagcuugguugcagacagcaggaacaaugaaacugugaaaaauguuuuucauggguuuagugaaguuaauuuacuaaauucuaguccauauccaguguuuguaggaauuauauaagaaaugagggaugagaaaaauuacagcuaacaucuuuauagggaaaacguuuuggcauuauaccauuuguauaaauuacaaaguaaaauucacuuggaaaccaaaauaaagcccauugaauaauugguugccuaauuacaacagaaaaugauaaucacagaguuucuaguuggagcucuugaacaguagaagcacuuggcuugguucucuuguggaaauuaaugagacagugaccauaggccacuuagaguauaagcugauuaugacuauugcugugugaaccaggguuguggcugaaagauggguacagcuaugugcacaagcugccuccucuuaagaaaaggaagaacaagguggaaaauaagcccguaacaaccagucgugaguaaccaccugcucagguuggaacuuuuggcuugggcagaacaaaacauauucuuaaugugcacagcucucuaggccauugguuuccauuucugcugaggcucuugaaccaaggaaaaacagcagaagaacagaaauaaacacauaucacacacacugugugauacauuauaguucuugcaacagcaugucauucugaaagacaaaugugaacauugucaccccagaguagccauugaagcuuccuaaaacauaauagauacaaaguucuaagcagcauccucagcaucuuguauuuacuuuauucagaccaaacagggcuugaaaacuaccuaauggucagucuguuagugagucagucauaaucagaguccagugaagaacauaguuguuuucucaacagagggguuuugugcaaagaccagaggaaggaacaucagcugugcuauacuuaacacucucuuauucccucucacugacccuagagcuagcccucugucuucuagguagcaccagcaaucuugcuucucugccguccccuccugccuuuucuaggguuaugggcaugcucaaccaugccccagcauguugauuuuggcucuggagauggcaaauucagacccaagugcuuuauaacgagcacucuuagccacugagccaucucuccaacccucaauauaucuuaagcuggauuucuuuaaaaauuaaugggcaucacugguagaauagauauuucauaaugauuucuguugagugugauguaauucaccugucauugcacuacucaagaagugggaucagggcuucaaaguuguccucaggcaccuggugaguuuagauuagcagccagcacccacugagugcugugcuccaagggcauucugcagauauguccaggacccuuggagucucuguauuccuguucucuccacagguguccauguccuucuagagggcuuugccuuggaaauaaaccagaacuagaaccaaggcagacucuuuggaggcaaugcgaucauuuacagaugacuucacuguucguuggaaaacccaagagauucagcuaaaaaguuaguaaacguuaagagauugaguauccaguuuuaaaagagaugucugcugucugcauacagggcagcagugggcaaugaggaaaugugguugcagguuacaguagccccacgggaggaaauuucacaagcagggagaagacaauagaacuuagcugaaaggcagaguuggguugcucccugcugguauggcuucucucauacaccaaggaaaggucaccagcagauacccagucuacugagugggauggaagugcaugauaagcaaagacugggaaaaccaaaugaugaaauuaaugaagauagaaccugaagggaucuuccuuuucuuaaaaagaggcugcuugugcacacaucuguacccaucuuucagccacagcccugguucauacacagcaauagucauaaucagcuuauacuccccaugugcccugugcaguccucagucaagaagauggguaucaggaaagauaagaccugggaaugaaaaggugccacaggaaugaaaacagguagcagacagccuagggagguccugaggcuacagugugguuggcuuguccagagagaguguaaugaggcagagggaaggcugaagcaccaaggugacccagcuguucaggccuuguaagccauggucaaacucuggucuucacagaggggaaaacggggacaugauaucuugaaaggucauuccaccuacucuuuugaagauaacugacagguggcaugcaugggaggaagcaagaauggcuaggaucucuggccauccugcugaugucagaguggcuagggucagugguggcuaaacaguaggagggauuuggggccugucuugaaauaggagcccccagaacugaguguuaggaaaaagcauuacagacuugacacuucccacagaguggagacacuguuuuaaaaacuugaaaguuuaagaaggcucaagggcagaaacaaacaccaggugagaaugaucaagagagcaaaggaaauaccuagaggcuauacuguagaugcccgggccugucauaucuaccacagcagcccagaaggaaaagagugcugguguaucaugggcagaaucacaaaccagaacauaggacacaucuagagccugggccacccuuucauguggcagaggugacuguguacuucuaacaacuaaaugcugcucuuuguggaucacaagugguuuagggguuuugaaaagcuauaacaacagccaguacuuacuguacuaccugcuguaacacaaggacucauuuggucucccacaaguuaccuuggcagggacgcugcucuccauauuacacaugugcugaggaaaggcaaggggcguaaggaacagagguggggggagcacaucuugucaccaaacuugaccagaaaccacaucuaaugagaacgcugaugguuggggggcagaggaacaccacuaugagcaaguguucagaagaccgccagggcagccagggaggcccucuuggagauggucugguaugucuacaggcucacuggguggugauuccaagaagaaaagaaaacaaagcuggguagugaccacacuugcagcuacaucuuaucaucugccuuguggaaauggaacuccauguaaagggaccguuugccaccuacuguucuaucagagcuguugacaagagaauguuuauagcucaaaugucugucgacaaagcugcaugcuuuguacaugguuuugguaagucagucuauaagaaacgguggauguguggguagacauauuuguguauauacuugcauagaaacagaagugguaaguugcccaugcuggauagucucuuuuucuggguguaaauauugugaauauuuuauuguggucauuucuacuuuuugcauuugagcauuugagaauacaucaguuuuauacaucaauuuuauaacuuuaaaaucuaaaacugccacauuaagugagcaguagaguagccagccauuccuccugggugguuugugaggccuuaggcucucuggucucacuaguacauggagauguaugauuccccucucaggggcaggagcgagaggccagggugggcaugugcuuuccauuccauagcuuuagcccugagaugaccuacuggucccagcaaagucuagccuguagccagagagcuauguggcugugccaugcacauguaguugaaaugcccuggcgaguuaccagccaaguugagccuugagucaguaaucucaucuucauaaguuucucacuuucaaacaaauaucuccaagcauguguuucauagguuuccucccuucuuccuuuagcugccaucaugaaugaaaggggccuccuuaaggagagguagggcaucagcccgugauugcuacacuucucuuucuaggacagaauuuaguaucauucauacaguuaucugaaaauuuaaguccaaagcacugggugcauuuggauugcgugggaugucguuugaccacgggaguuuagucucaucuuaugagccccauacacaccuagaacguacgggcuuaugaaggagguagcuuuugggguccaaagcagaguguagacucuacacugucaccacauguucuucccauucgccaaggugccucuguuccagcuguaccuagucccuucuguguguccaaggguggugaagcuccuucaggcaguggcccuugagggcuguugaaugccugcucucuacaguguccuggcugugauggacuugggcagguucuuucagucuccugagcacagcucugguuuuggcaggugauauagugaggcagaaaagacaguagcacugaacucugccacagcccuagaggugagcccauauucccaaccuuaggacucucuuuuagucuugucauuuucauuucuauuccuguucaugcauuucucaguuacaagguugcuucccugcugggacagucugugccucaaguuugacugugcucuguaagacuacuuuguucuugucuccccuccuugcuccugaugauugaggauggaagcagcccuugguggcugguucccaacuuuaacauaaaaacaccauuaacuuugccacacacauuaucagggagaugauuaauagggccaaaagagugaccuugccaauucuucauagauccaaaggcagaugugauuaggguguaccaucugauaucucaugguccccuucugcuuaaggagcccaggccuccuaugauggguauggcaugucuacaggacuucuuguaaaacaauugagcacagacugaaaggugcuagaagagguguaaauuuauauucuguucacugcccauuuccucuucauuuuacauuuuugcuggagcaaaauaaggcucuggguacaugguguaacagcuggugaccuccaggacaaagugcucuccugugcucaugccuggcuuuguaaucaugaccuuuggccuuuauagccuucgaaacugcuacccaugcuccccuaguagccccuggaaccugauccugaggcucagguggguggggaacuaagcaggccgcugcuguauggcagagcugucucccuugccuguuucucugugcacugucccucuucuagacucuggugacaacguuuuuccuggucccuucucuuugguagggguagucccuugcugcugagaucacuccggauguuugcuucacagugacuagugccguuguguucaaguggcagccugcaaugccaaccucagcugcagucagcuucuucaagucucugucuuugccugccuuguugucucaucaccacugcuggggcagcagaggggggugcauugaaaaaagaucucauuauguagcccaggcuggccucaaacuauacugucucuuaaaugcuaggucuuuagguaugaagcacuaccagcuaccacugcauuuuuuuuaaccacugcauuuuuuauauucaauuauuuauuuacauuucaaauguuaucucccuucccaguucccccucccagaguucuucacaccguuccccccuucccuuugccucugagaggaugcucacccacccacccaccccccuuacuaguaucuaccuucccuagagcaugaagucuuuacaggauuagguacauccucucccauugaggccaaagaugcauuugugccaggguucaugggccugcccauauaugcucucuggcugguagcuuagucucugggagcucugauuaguugauuuaguuaauacuauuguucuuccuaugggguugccauccccuucacucuuucaauccuuccccuaacucuuccauccaaccucaguccaaugguugaguguaaguaucugucuuagucagcugcugguagagccucucagaggauagccaugcuaggcuccugucugcaagcacaacauggccucaguaguagugucaggguuugguaccugugcauggguuggaucccaaguugggccagucacuggauagccuuuuuuuuuuucauuuuaaugcuagguuugcaagccagccauggggagcucuaggggaagugucacuguaucacaugaugaagaugcaggaaauacuugcuaaaugaguauaauggcacaucacuagccauuucaaaguuauauuugguacacaaauaaaauauuuaucguauuaaaguccaaaagaggugucauaucuaaggucuuuuauguaccugguaugguucugacccuugugucuuuuacccagcccuaguccucucuuaaaacucccaauguauaguucccuuuuucuggauaaggaucuuagaacuuggagcaguaauagcuaauagggaucaacaccaggacuagaacucaagaccccaggauucccugaaccuauauauaggucacauucuaugucagcccucccucaggugaaguggauuaugggaaauggauaaggcacaccuagagcuucaaguggcuccugguuaguuaggcauucugucagcauaauuggccaugucaaagaucagaaaaccaugguaucucuacagaaaagcaguugguaacauucagucuuacaggccuuaaucaacugagaacugaagagguaccccuaaauaauaguggccuucacuauuuuuauuaaagagcugccaagaacaguccccucaaaaucuaggaaagauaucaaaccuguaucauggguguauuugacucuugcagaggucaaaaggcuggugaaaaggggcguggugagugcuuguccuugauuugcuagucaaacuuggaaagcucaaagucuaaugaggccuguuggaaccaugaggccuaguggcaccaucaggagucaguagauggcucuugguugguugguugguugguugguugguugguugguuuguuugugggauuuuugauguuuugauagucaggaagaagauggaggaagaugguaauaauaguaacaagcacaucaccccgggcuugcuaguaacaaggccagguaggguaaggcuugccagagaaacacugcagaaaacacucaagacauauugucauauuuugcucaguuccuuuaaaaauccaccuaccagcuuugacuucacugggaaggauaaacaacgaagccaugcggguaggcaaagaauaagcccgaguaccugcuucacagggcgguggccagcauggcugggcuuggccgcucuagaaacauggcacagccuuacacucguaauccugcagcuugcacaguagcuagaaaacagcauauacuagauagacaccauuucagucgugucugcucuugaaacuaaaaagcuaucuuaacccucuuacuguacaaaguaauauuuuugauguguguuaguguuuguuguaauuacaaaagcuaaaggcagccuuuuaucagaauaagcaccccuaacugcucugacuugaugccugcccucgcugccuggccuuccuggcuguuacuucuucaacacugagugaguucuuucaggaacuaagggugguggugaaaguauauuuaagacucauggguauuuuauuuuuaaaauuucaauuaacagagaucuaugcugaccauguuuauccuuuccauaagugaucauuaaauacaggcaggggagaaaaguacagggagaaaaagucauucccagucauuuugaaauguauuuucaauacaguuuggcuuuuuaauaggacugucaauacuugugccaggcauuccuguaaucccaguacucaggaagcugaggcaggagaaucacaaguucaagaccaauaaugaggaaggcccucuauaugguuauaagaaguugccauucuugagggagcucccuugcaucugaugauacaucugccaucgugggauuugguuugcaugacuaguuauuacuaguuauugcaauggugacucaauuuuaacuuguagacuaaaaaugucaaaauacaaaauuuuagcuauguucuuuuguuuuguuuuguuuuguuuuuguuuuuuggagacaggguuucucuguagcccuggcuguccuggaacucacgcuguagaccaggcuggccucaaacucagaaauucaccugccucugccucccgagugcugggauuaaaggcgugugccaccacgcccggcuucuguucauauuuuuaugucaaggaagcaugcuugguuaauaggaaacuuaaaagcauaagaguucacacauguauaguuccggagggauaguguucaggaagcagcaggaagcuucuugcuaugucuggcccugggcccugucuugcaguagcccagccccaacccugcucugcugagaacaaagcaguuaggcaggaaaauuguguacagaccaucagggacuuugaacagagagcccagcagguaagcugaaacuggaguggauccaccucucucugcaaugagggagcucagucucuguuccugacaugggcccuccucaccuuguccauagccugguuaauauuugcacuucaagaaagaguuccuccugcuaaccagagagcacauauguaacaauugugcagcuggguccuuaugugggacuccuaaagccagagcaagggcugucucugacggcccuaucuugccugccuuugaaucccuuccccuaucugggcugccuugucuagccucaauagaagaagaugaugggccuaguuuuacugcaacuggauaugccaaggcugguugauuccuucagaggcuuccccuuuucugaaaaggggaggagggguagggggaagaagagguaagagggagugacuaggaggagggaggggaaguaaauaaaauaaaauaauaaaauaaaaugaaaagaguucuucgauccccacccugagagaaagcaggcuguagguggggagaggcagaaagaagcccugugccugugucaaacaugaccagagcacacuuggauuucacccucacaaggucaugguaaccuucaaaagugaggucagcagguccauagcagcuaugggcauugcagagggcacguaguuaauccugcugcaacuagaaggcuggucuguguggcaaagccagcuacuguguucucucuccuuccaggagcuguggggauuuagggaggagauaggacuuggcccucacaagagcaccuugagucagguucugucaggcacaaggauuuacaauggguuuuguaaguuuucugcuaaagucucagguuugucuguuuuaccucuuucuuuuuuuuucccccucuuucuugccucaugauaauuucuaagauugauuggcugcuuauuuauuuguuuguuuauuuuauuuauuuauuuuauaugaguacgcuguagcuguacagaugguugugaaccaccaugugguugcuggagauuugaacucaggaccuuuggaagagcagucagugcucuuaaccgcugaaccaucucuccagucccucaugaaaauuucuuuggaacaauuuucaagucagggaagcugugugggaugaugggagccaugaagguucuuccucuccucgccagucagggcugagcccagugaagcauguguuagaugugcuguuuuuaucugcuuuguuuuaggagccucugacucugcucacaggaaaguaaaagguggcacgaucaacccuccucauguccacucaggccagcacaguuguuucuguggaacucucaugguacccaguggaggucugacagugccagccccugcagcugggcugcaguguguccagaucccuguucugcagguaggaaccagccauauggaugcugaggucuacaggggcaggauaguggagggguggccucugcccucucaguaaacugccccaaguccuguguccugucccagccaucuuaauaaccccagccucucucuucuucccagccugucucacuucaucugugcaagcccuugccuuuguuaggacugacguaucagguuuguggcacuguguuaccccgugucuaguucccucaaccugguccaucuuccccaccucccuuggaggugcacauggcggcaugugccucuguccugcaaaggccugccugggaccuccuuugugcaggucagaggcaucuaagaugcccaagguggccauguggaagccucauacugcuguguucacacuguucaccuccccagagccuccuuuaagcucuccuuugacuguuuaggccaugcuacugggcagcacucuacacaccacagugcaggcucucaugugaaaauuccagggccucuuugauuuuucugcuuccuuucucacugaucacuaaagaaggcuuagccaccucuuuggaggcucugcagaccugcaucugacagcccaucugugggaacucacugccaggucacuuagcagccccauacauaccuguacucccaggcuucccucugaggagguagauagaguaggagaaggaagaaguuuggaugcugagaaaucuggauaauucuggccuggucacaccuacauauuguacaccacuuggagguauagaugaaacuucagaaggccaaugcaaaccuagaugucggagacuuaaggguagagcuuuuccaguuucuucagagagcuuagagacaggcaagauccaucugggagagaaccaugaaggaaagaggugggacugggaguagaaggcugugaagggcuugcaggguucaaauaaugggggacagauggcaaaggguaaccuguggagcaggguguaaaaggguucuagagaaaaaaaagaugcagaugagaguuuugaggguagaaacucgggcuuguguauggaaaggagcugaaaaucauguuccucccuccuaguuugacccagugggggaacaacauguuacuguggaagagagaaaggauucuguagagauuggcacaguaaaaggagugggaggccuguccugaaggagcacaacacagugugcaagucagcauacagagaucaccccaagacuaagggacuauagugugaagagaccauaggaaagaugccaccacaggcagaaagagcaugcaccuggguaugacuauuucaccugucccuugacgacuaguguugucuugggcaaguggccuuauccccagcuucacuucuguugucaugagguggaacaguaguacucagaaggcccuuaaggcaguggaaggauggggugccagagcaaagggugcucaguuuggggguaauacgagcuguaacugaguacacacuugagaaagcaaaaccagucuuuccugauuggcuaaugggggccugcuagucuccucaucuccagaugcugucugcuuugagaucucuguuuggcccgaggguaagccgggaacagagauaaggguaagcccccacccccaugagcuugaagcacucaggcaucuguguggaauuuaggacauuguagaaggaaaggagcuguugggaccaggcacguuuuuugaguauugaaauaauaaacauaggggaggcagacaacagaagauuccagacucaacugaaccuuggacuaggcucaaagugagugagauggaggggccauugcuccugcuuccugcuuaccaguguguaauaauucuugauguugucuccccaggaugaccccucaggugaaggaggcuuaccacugggccucagcccacagcgcucugccuuccaccccuacuucaccguggaucugccugucuacguccuccaggucuggaugucuacaguucuugcucuucucguagaacucaucccagguuucccaugucaggagguuguagcaugguuuagaagcugccacagaccugcccuggaggcccauuggguugauggucacucuagccacuuuguaauuuuuuuaaaagguagucagggucacagcuucaaauaaggcuugcuugacacuacagugucuucuuguggaccagauaaaacauaguaugccugggacuacugcacucucugguucuaaauucuccacgaaugagcuacaccuacauaaguucaguagcuaagugagggaguagguaaacagagaguagguagucaccaaugcagaucuaggugggaaugaaagucauuuuucagacugcagccuaccucagggaugucuguaccacuguuuuaagcccucagaggacuuccuaaagaaaggaaaucugaaccagaugucauagacauaguugcacccauuaacccagaucaaggcuggagaacugugaauuugaggccacuuuggccacauagcaaggaccugucucuaaaaacugaaaggaaaagggagaaaaaaauauaggguggcgggaagagagcaagaggcugugagggaggcagggaagauacagacuaccagugaccugcaaccugcgcacugcggacuggauuccagcaggagagugauggcuaugcagccguggccaucucccugggcagccugcccacugcaugcuggguacaagaaagaaugagccauuuuuuuaacagaagaguacauggguguuugaauauauauggagccaucaguaggccuuuagaaaaguaucugggaaaaauaucacuguuuuaguucuuuuuauuucuuuacuucuuuuucuuccuuccuuucuuucuuccuuccuuccuuucuuccuuuuuuuaagauggagucccccuuuguagccuacacuggcuggccuggaacucacagagaucugccugacucugccuuccuuguacugggaucaaaagcuuaugccaccauuaucugucacauuguucuuugaagaacauaaggugugggccacaucucugcugagccuuccucuucucuucuugcccuacccucuacuucucugcuugguuuuacaggaggugcuuccagcaccuggagguuuugcuggacuggagacugcacagguaccaggaaguacuaucaaccugcgggaccuugagugacagcagucuugagccaaugaagacugaauuccaggcugugcuucaagaccucagcugcugugggugggcagagacucauuucacuuccucagcacuccagccugauucuuugagacuuugggguacacauauugaaaguacuuugauucuguuccagcaagagccaguuugggcuauacucuuugaaacugccuccacagguugcccucugugauaggcacccugcccaugccguguguguguguguguguguguguguguguguguguacacgugcgugcacgcacgcacaugcauuccagcccuucccagguccccuugggucugacguggguagcaccuuuuacauuaaaagauccuugcaggaaguggguagagcauggcucccuccucagguacuucucuauacugaguuguaguguauuaggauuugucugacacauucugagagcuuauauaacagcuucucaccugugggaaugguuuugguggguguauugcuuucucuacacuguaugcuguagugaagccaaagucagguugagcucuggcaaaacaucuagucugaaaggugauuggcuggccugccgccugccaguagccugcuaauagaaccucuuccuaaauugacagugugcucauaguuugugaaugaagaguucgggcuuuuaaagucaucuuucuaaauucuguuucuggaauucaugguaaguaguaacuugucagcagucucuacaguggaguucugaaugcuuuauguuauguguagggcuggaacaauaggcuuguuuuaugauugagguuggagauaagcauauuauguggccuuguguguuuucacagaaugauuuggucuuccccguggagacgguugguugccuugcacauauuuguuagucaagacuggauacagggucacucagcaaugcuuugggcuuuugaugugugugcuuauucagauacuguuuugauucugucccaucugaguugcuuuguuucuuggauuuggggagagcucugaaacugggcaugaguuuucucuggaugcuaccugggugcugcucccuacaaaaggauuauaaauccuacuugagaagacuccuuuccacaugucucuccugcaucacaggccaaaguuuagggguugaacuugccuagcuguaaucagcgcccccauagacacucaguaggcagccugguaccacugucgccugccuccagagcccaccccacagagaaguugcuccagcagcucccacagccuccagcgugugucugcaagugacaggaugggcuguugugcucugagcucuggagcuuccugcugccauaggcccaguccuuagugcaaaugaauaaaaguguucgaauguuaugugcaaaag

SEQ ID NO: 3219 - RNA, 3266 nt, Mus musculus
aucaggggugacucuuuuuggccauuuuuacuggaagggagaggaugaggugcuugggucuauagugcagugguuagaaccagaaugaacagagugccgugugagccaggcccuggccagggcaggaaagagacagucagggacuuacaccucugacaugcguugggccacugucucccuacaggcuucuucuuucagccaaccguuuucacagacguggaggaccacauguacaucgcuaaggaggaguccuucgggcccaucaugaucaucucucgguuugcugauggguauguuauccaccaugacucuccaggcuuuuccucuguguacauggagccuugacaugagcuguaagagauggcccaugaggaggagacugagucagcagagaaccugugcaccaugccugggcugccugccucuuaaaacacaaaagagguucuggcuucccuuugccucuccuucccugggccagaauggccuccaggcccagaugagcaaaagccaauauccucucauguuccugcuucccuuggucugcccugcaucucucuggcauuacgugcagccugccagguccaguccucaugguguccuaugaguuguaaauugacccuacccauguggccuggagcagcuugggucuugcucacgaaugagcuucaggucagcuagauggagugaguuugucuccgcuccaugccacaucuguauuuuccugguacaaaggaggaagcugcgcucaccuggacuccaggaaccuccauggcagccuugggcagcucaggucacuggccuggagcuuaggucacacagcaaccaacuggagguagcaagaauccuugggagcuagcuucagagcacacuccucagcccagcagucauugaggccaucggguuaaagagaaggaaggguccacucacaguagaggaacuacagaucuuugggcacauuugaccuuucauaccuuuuuuuuuuuuuuuuuggcuaauuuuuuuuuaggcauacugacaccuuccucuuccccuuuuccaaccaauggucacuguaugacuacaaucagcaugcugacuguaguagacagacuucacugucuuugccaaacuggcacaaccguagcucuuuggucugaugccugcugaaugcucaguccacuucugcccuaagcugcuuuucuggacucugucccugcaugagggcgcaugcccagaucugcucugugaagugccucucacucuggcuucuguucuacugccugcuucuucuccuccaggcuugcucuggccucugcacaguuuuuugguuuuggggguuuuguuuguuuguuuguuuuguuuuuguuuuguuuuguuuuauguuuuuuuuucuuuagaaucucaugggugggaaucaagggagcuaggaacauuguggaggcagauucugaucuugccuugucuccaguccaaaaauggacgcucugagcaucucucagggaguucuuggauuucccccacagggacguggaugcagugcuaucucgggccaaugcuacagaauuuggccuggccucuggugucuucacucgggauaucaacaaggcccuguaugucagugacaaacugcaggcgggcacuguguuugucaacacauacaacaagaccgauguggccgcaccuuuuggaggauucaagcagucuggauuuggcaaagaccuggguaacgaaacccugucugugggacugcuuuccagcaaacaccugucaaaggccaccaagggccaggucuuguccccaauacuggggugucacacugaucaacacagcugguggcuggucaguucuagcugggagggaacacucuugggacugauguacuugcugagacagcaguggaaaggauauguauguauaacauauucuagucacaggaggacaggaggauaaguucuuggcugccaauagccaguagggcauccauaccaccuccucuaccaucaauguagcagggaagauucuagaaugguugccccagaucauucuccugccugcacuggugcccgagcccacagcuuacuacagggauggccuggguugggugcaugauuuccucagggcuugguuucucaucuguagagagccaggcuacucacagguguguuccccggagggguccccugcacacccauaaggugucccaacagugggugcuaucuugcaggagaggcggcccugaaugaguaccugcggaucaagacugugacuuuugaguacugaagccaagacugugauacuucuccuguacccuguugaccucagggagugcugacccugucuggugacuuagcacccuccuguccccagcacugcuccuuucagcugcuggagcucuuggccuggaccccugcuggugacaggacacccucugaacaaucagaaguggcuccaaguggagugagcagucaugucccccaugaauaaaaauugugagcagaggucgccuacacuuugugucacugcucugucuauggaugccucguauggaaccagaggcaguggucaccaugaguccugagcauguagcaucacuuggccuucagagaacgagaccccuuagugggacacaggaggaaaugcacaucacacaccuccaaaagcagaauggguacaagaggcuguggaagagggugcgccccagaaacaggaaaugagacuuggggagugagccuugggccaucaagcaccccagucuccucugccaggacccggguucucacucaguggacuuggacagccacaaugguagccuggggucuacagcagggacuccacccagccugacauuucccuggacagcacucccaucuucuaccaucugcauuucuuuuuaucuuacaccaccccagccuggagcacagccccugcaaggcuucugacuccuaugcacucacccgugggugcccaaggcccucuccucuguaccuucuucauucuggaggucccacauaccacaucucaacagauuugcuauugccuugguuuacccaacauucucuucuuggcaugccaaccacuaccaccuuucuuuggcucugccucucuugguccaaaauucuuuaaaggccuuucuguucuucucuaacuccccuggccaggcaggcagugaccuggaucagucgcaaagauuucaggccuauguaguaucccggacuuccuccgcaucccugcccuucucuuaaguggggcacaugccucagaguaacauuuucgucagugagaagcca

SEQ ID NO: 3220 - RNA, 3266 nt, Mus musculus
uggcuucucacugacgaaaauguuacucugaggcaugugccccacuuaagagaagggcagggaugcggaggaaguccgggauacuacauaggccugaaaucuuugcgacugauccaggucacugccugccuggccaggggaguuagagaagaacagaaaggccuuuaaagaauuuuggaccaagagaggcagagccaaagaaaggugguagugguuggcaugccaagaagagaauguuggguaaaccaaggcaauagcaaaucuguugagaugugguaugugggaccuccagaaugaagaagguacagaggagagggccuugggcacccacgggugagugcauaggagucagaagccuugcaggggcugugcuccaggcuggggugguguaagauaaaaagaaaugcagaugguagaagaugggagugcuguccagggaaaugucaggcuggguggagucccugcuguagaccccaggcuaccauuguggcuguccaaguccacugagugagaacccggguccuggcagaggagacuggggugcuugauggcccaaggcucacuccccaagucucauuuccuguuucuggggcgcacccucuuccacagccucuuguacccauucugcuuuuggaggugugugaugugcauuuccuccugugucccacuaaggggucucguucucugaaggccaagugaugcuacaugcucaggacucauggugaccacugccucugguuccauacgaggcauccauagacagagcagugacacaaaguguaggcgaccucugcucacaauuuuuauucaugggggacaugacugcucacuccacuuggagccacuucugauuguucagaggguguccugucaccagcagggguccaggccaagagcuccagcagcugaaaggagcagugcuggggacaggagggugcuaagucaccagacagggucagcacucccugaggucaacaggguacaggagaaguaucacagucuuggcuucaguacucaaaagucacagucuugauccgcagguacucauucagggccgccucuccugcaagauagcacccacuguugggacaccuuaugggugugcaggggaccccuccggggaacacaccugugaguagccuggcucucuacagaugagaaaccaagcccugaggaaaucaugcacccaacccaggccaucccuguaguaagcugugggcucgggcaccagugcaggcaggagaaugaucuggggcaaccauucuagaaucuucccugcuacauugaugguagaggaggugguauggaugcccuacuggcuauuggcagccaagaacuuauccuccuguccuccugugacuagaauauguuauacauacauauccuuuccacugcugucucagcaaguacaucagucccaagaguguucccucccagcuagaacugaccagccaccagcuguguugaucagugugacaccccaguauuggggacaagaccuggcccuugguggccuuugacagguguuugcuggaaagcagucccacagacaggguuucguuacccaggucuuugccaaauccagacugcuugaauccuccaaaaggugcggccacaucggucuuguuguauguguugacaaacacagugcccgccugcaguuugucacugacauacagggccuuguugauaucccgagugaagacaccagaggccaggccaaauucuguagcauuggcccgagauagcacugcauccacgucccugugggggaaauccaagaacucccugagagaugcucagagcguccauuuuuggacuggagacaaggcaagaucagaaucugccuccacaauguuccuagcucccuugauucccacccaugagauucuaaagaaaaaaaaacauaaaacaaaacaaaacaaaaacaaaacaaacaaacaaacaaaacccccaaaaccaaaaaacugugcagaggccagagcaagccuggaggagaagaagcaggcaguagaacagaagccagagugagaggcacuucacagagcagaucugggcaugcgcccucaugcagggacagaguccagaaaagcagcuuagggcagaaguggacugagcauucagcaggcaucagaccaaagagcuacgguugugccaguuuggcaaagacagugaagucugucuacuacagucagcaugcugauuguagucauacagugaccauugguuggaaaaggggaagaggaaggugucaguaugccuaaaaaaaaauuagccaaaaaaaaaaaaaaaaagguaugaaaggucaaaugugcccaaagaucuguaguuccucuacugugaguggacccuuccuucucuuuaacccgauggccucaaugacugcugggcugaggagugugcucugaagcuagcucccaaggauucuugcuaccuccaguugguugcugugugaccuaagcuccaggccagugaccugagcugcccaaggcugccauggagguuccuggaguccaggugagcgcagcuuccuccuuuguaccaggaaaauacagauguggcauggagcggagacaaacucacuccaucuagcugaccugaagcucauucgugagcaagacccaagcugcuccaggccacauggguagggucaauuuacaacucauaggacaccaugaggacuggaccuggcaggcugcacguaaugccagagagaugcagggcagaccaagggaagcaggaacaugagaggauauuggcuuuugcucaucugggccuggaggccauucuggcccagggaaggagaggcaaagggaagccagaaccucuuuuguguuuuaagaggcaggcagcccaggcauggugcacagguucucugcugacucagucuccuccucaugggccaucucuuacagcucaugucaaggcuccauguacacagaggaaaagccuggagagucaugguggauaacauacccaucagcaaaccgagagaugaucaugaugggcccgaaggacuccuccuuagcgauguacaugugguccuccacgucugugaaaacgguuggcugaaagaagaagccuguagggagacaguggcccaacgcaugucagagguguaagucccugacugucucuuuccugcccuggccagggccuggcucacacggcacucuguucauucugguucuaaccacugcacuauagacccaagcaccucauccucucccuuccaguaaaaauggccaaaaagagucaccccugau

SEQ ID NO: 3221 - RNA, 4939 nt, Mus musculus
accacaacagcgcacacggaggccccggcugcagcacucgaccucaguccugcgcaagcaggcugaggaggaggccaucaagcgcucucggucacucucugagagcuaugagcucucuucagaucugcaagacaagcagguagguggcaggggucccugcccacuauccauggucucccaaauggcaugaggcuucagcugccugauguucuuggugauggguuccagauaccagcuggugugcacaucugaggaagaggggaucccugccuccacuucguucagagccuuucccagcccaacucugcugaaaugugggaagggauuuacacugauggucaggggcacugacauccuuucuggggacuuauauagagcccucuucaaauuuugccuuuguaggucucaauaucccucacugcaggauauggggccuguguuggguaacugagugucauggcccaguaggaccuccacgaaguggaggcagguugccaagguagccauggagguucuuaggguccaagaaaggccugaggaaggggggcuacuuguuauauuccccuguggcuauggugccacaguaucucugcuuuagaagaugucugcauugaaugcugcagcucuuccucaggccucagacccaaggaucagguggccuaacccacuuuugggauuguugugagcagagcaaaucuucauggugcagguacccaguagugaauuggcugcuguuugauugugucucugagcaaugccagguuucaggagaucccugaacugcaggaauguguaggaacaaacagaacaccuggucaguauuccauagcccugagccuuguucuuuugagcagguuccaugccucccaugcagucccaugggcuaacaccgggaccccuucccaccacccacaggugcugugcucucccuccuucccauguuugcuggccacuuuguuccauuuguucuccaagggccucuauucuugaagucacagaggucuaagcuuaugcagccccaucuuccucagugcacgaugcccucagguggaucuucucucuuggcagacaucccucgaucuugaucucucauaccuguggugauaccccuguuccccucugcucacaugcuuuauccuccucccaggccagcuaccuucauaguugagauucacaaggagacuggcugguagcagauauucccugacagcuguggcccuagauuacuuugcuaggccuccguugagugucucagcucugccuagauucagaauggucccugaagaguuuguuauagaaguccuccacacaggaccaugaaauagaauuggacaggauugagauggcauccagacuguagcaaugccacagauaaugcagcuauucaccuucaucccacccauagcugaauuucccccuugugccaaaucauaggauggggacagccugcaaaugaggcugcaguaccugagcaacauuccuggacaguggauggacaagcaagucagcaguuaagacauuuucauugcaggaagugacacagacccuggggguuacaauucuagaggaaguaguagagggacucugaguguuggcugugucagaugaagguagcuggccugaaaacugagcauuuggauaagagcuaacaguaugugucaagguucugggacaagaacuaccuuggugugucauucuuggugugucuuugugugugagauacaaaaaaagauggcagggaagaguuggaagaggcaaaaggcauuaacaucagcagccaugccauuuuccauguuguacugagcauccuggcaagcaaagugaaagaaggaggggaugacacgagaguugugaggggaagguggagucacugaaaacucagaugcauucuccuuaacccaaccgucuguccuuguccuucccuguuccugagagcaggaggccagccuagggauuagggaaugaccaucucaggucucugagugguggcaguugugcuuuguggaaggcaaguccucuggauucucauguauacuucuuugagacaauccucagcaaguaagcccauagaggugagcccuggcacaggaccagccucucuggcacugacugugaugccuggcuacuggcuuuucuccugccaucugagaacagggauaguggaaucccucaguaagguaagaacugugugagugugugguccagucccccauaucccaugggguagcaaguguuacuugcuuuucccuccucucggucccuuaagggcuauagacagggccucaugucacuuccagaccagaaggcagaauagcuauggugaguucaagaguaagaaagagugggacugggucaacaaauccccacuuuuaggagagacagagaggagcuuucuuuggugacucauuccagagcccacuucugcccuccuaaaugagccaucauucaacacaauacacacaaacuuggggaacuugagaagcagaugguugccuaauccccaagguccagacaucagggaaggcuauggaguaagcuuuggugacucuggugucuuugaagcccuuggcagggauuccaggccaaggccuucuugggcagggauugagagaaggaagaggguuucccaggaucgacugaggguuuucugacccugagcucuaugaccacucagccaguaguaguuuuguuuguugauaugguaguacagccgucucugagggagaaacccuggagccccuucucugcucaacugggccugguguccugagaauucucuaguucagcuuccuggaggcccugagauggguugcagagaguccucucccagauguggaccacagcccuggguuugcuuuaugucucuagugcaucugucuaauucacacauucucugccucuccaaggcagggaccuuguauguugcccuuuugcauugcaugaugaggugauugcccacagugccagacagguggaaucaggguuucaccuccuccuggggaccugaauccucuccccauccccgaauaaauaaagccaugccccaacagcuagagacugcagcuagauugcugauuccuacagacaggcuguagcugaaggaguguguuuccuguucacccaggaucaggacucaggauuagcucuuaggcugggacuucaggaggcuguggguuacucuugagagaugcugagcugaggugccugagagcuugcccaacaucccucccacuucacgagcugugcacccaucugcacucagggcuguagggcaaaggagagccagaccugucuucccccuaucaaucagccaucuauguagcaaggauagagaccucacaacuacaaccuaggaauggggcugaggucuuuagccagaugcccauggccugugccaagcacuuggcucaucacugugaacuuaccaaagcacuagaaaggguccuacugcugcccugcaucacagauaaggaaauggggagcuucaugguuccaagacucauccagagcugaugggagacagagccagggucaagccaagacccuggcaagguucuaacugcucauacuucaggcucuacaggugacaucuguagaugcaucuugaccuccagggcccacagcuucuaugaccagaaguguugggauguucagcaucugugcaccgccaccuuuacccaaucuugucuuauccuggcacuuaucccauuugacacugaaaauccucagcagccccaagcugcuguuuuaaaccacuugggaauaugguaagaacaucccagguuauaucccuauggagcauagaagagcauagcugucuaucuuugugucaucacacagggcucacauucuccucuucuuaccucacuagguggaaaugcuagaacgcaaguaugggggacgccucgugacccgccaugcagcccgcaccauccagacggcguuccgccaauaccagaugaacaagaacuuugagcgccugcgcagcuccaugucggagaaccgcaugucacgucgcauugugcuguccaacaugaggaugcaguucuccuuugagggccccgagaaggugcacagcuccuacuuugagggaaagcaggucucugugacuaaugauggcucccagcugggggcccuggugccaucagaauguggagaccuuagugacccagcccucaagucuccagcccccuccagugacuuugcagaugccaucacggaacuggaggaugccuucuccaggcaggugaaaucccuggcugaauccaucgaugaugcccucaauugccgcagccuacacagugaggagguaccagccucagacacggcccgggcucgggacacugagcccaaaccaggucuacauggcauggaccaccgcaaacuggaugagaugacagccucguauagugaugugacccucuacauugaugaggaagagcugucaccaccgcuuccacucucacaggcuggcgaucggcccuccagcacagagucggaccugcggcugaggucugggggugcagcccaggacuacugggccuuggcccacaaagaggacaaggcugacacggacacaagcugccgaagcacaccaucacuggagcggccagagccacggcugcggguggagcaccugccccugcuuaccauugagccacccagugauagcuccguggaacucagugaccgcucagaucgcagcucacucaagaggcagagugccuaugagcgcagccucggugggcagcagggcagccccaagcauggcccccacgguggcccccccaaaggccuccccagggaggaaccugaauugcggccucggccccccagaccucuugagagucaccuagccaucaaugguucagccaaccggcagagcaaaucugagucugacuacucagauggggacaaugacagcaucaacagcaccucc

SEQ ID NO: 3222 - RNA, 103913 nt, Mus musculus
uacgggcuccggggcugaaaaagcucgcaggauucggcgcgcucuaggggcucagcaccaggcgcgugcucuccgcuuucccgccggucccgcccaucacugcgcucgccccgccccacgcggccaccugcuacccagcgcgcgccgguggagggcgcgggagcgcgcgcccgggcgcuagcgaggccgggaggauggcgcgggccucacuagugcagccggcgcucugggcgcugcuguugcugcagguagugggucccgccgcggccgccaagcuuaacauucccaaggugcugcugcccuucacgcgggccacgcgcgugaacuucacucuggaagcuucugagggcugcuaccgcuggugaggcgcgcgggcccggcgggaggcggcaggugcgcgcgggagggggcuugggccgcaggugcguggcgugcucgcuccagccggccccgcgugaccccgcggcgcgcgcgcucucucucugcgcauggcgccugggccacucgcgucugggcugcgcgggaagaggaggcugugaucgcgggccauggagggcagcgccgcacguggccucgguccccagcugucagggcccugaggagcuccagcuugagcagccacgcucuggagucugugggagacgggggaggugggacucaccccuggcgccugacuggugugagaagagugucuguagagaccugggcaaggagucugugggagacacaccacacccguuaagccacuuagggagagucauuaaaucuuggaugaaaggaccauuuuccagcucagaagugggaggcaaaggaauuagaugcugguggaguagggucugccuugaugaccuggcuuccagcaggguguugcgguccagccuuuggcuaggcagaugaagggagaacuucucguugcugggugcaggcugaguagggugugaucaggucacacccuugacccacacccucacuagugcgacauagucccuuccuucucucaggcuacauuuugcugccagccuccuuaagaauguguuuaggucauugguucucaaccuguggguuaaaacccaguuuggggccuccugucagauauucacauuaugauuccaacaguagcaacauuacaguuaugaaguaacaacaaaauaauuuuaugguuuuaguacaguucaacaacagaggaauuguaguaaaggcuuacagcauuaggaagguugagaaccacugaucuaggcuaaggcuuaacuagcuagguguguguguguuaauguucuauaugaugcccagagcucagagccacauucugcuauauguaguucucaaauuuaauuuguuuuaaaagucugccucauaggggguggcacuguaccucuauaauuacuucacuagggaggcugaggcaguagugccgcuuugaggucagucuggagugucuuuagguuggccucuggaguaugaagaggcagagucuuuccauugcaguuuggaguaaaugcuuuacccaaggggaaguguuuauucuucucuggggcuuuguuuugagugaggaggucagcuguuaauacucuggagggauacaugcucacuccauuguugaaguugucugcuugauagaugggccagagagaggaagcugacuauuuaaaacagcuggcuccaagggaaucaaucuccuggcguguauuugugugcugcuuccuaggaaguucuguauguuucuuccuagaauaacauuuucugucuuuacuuccucucuaacugcacuuuccugagaguugcugaugggucuuggcagauuuuuauauucucaguaggaggacugggaaagacauucaaaagcucagauaccucagacgcaugccaaguacccucuggauuguuuagugucugguggcuuucauccuaaggugugguugaaaagugucuucuuugaagguguuugguugcaguuucccccuuacucaaccggaagcuggucugucagucaagcauagaucagaaauguuauucugaauacagucacucguugcuuuaguuuugagaauccuggaggcuuugagaguuggcagauagcuaagacucacaccugcagucaucucucccuggaggagauggccucuuuauccaggaguacuucaagucucugagaugaaaaacaaagacaauuuaaccccugccaggcccuggggguguugcucauccuuggaauucagugcugagcuccagguucucugaagugacugcaugucugagccuguagcuuuaaguuaccuuuccuaguuccugaauuguagcauccaguaacugggaggucaucuggucgguguugcugcguuugagggaaugcagagagggaagagguggcagcucacucacaguguggugauggugauggugcugaaggccuuccagcccaucauccaucagugggaccuggggccacagccuuggcaaacuugccaggcucauuugucuuuccaguuaaacccagacagcuuugcugcagaccaaguuaugauuuagcguaagcuacuuugcauggaaaauuauuuuauugguuccuuuaaaagguauccuuguauauacaaaugauauccacaaaaaacuugaauugagaggaaaaaagaaauuucacccuugucuuucaacuuugcuccaaacucaggcacauuguggucuccuuucaguucugugguucauuaagaagguggucuguugggaagugggguagauaaggcaggagagagaagugaggaugagacccagguaaagucuggagacccucugguguuggucuauacuugaggcaaaccuugugcauccgcgccugugcgugugugguauaacuucucagcucacugaaugaaugaaucaaucuuaucugagguaguagagaaaccugcccgauagauuugccuagugugguccugaaucuucuuagcuaagagauaagugaguuaggacagaaagauggggagaguuguugggaaguggcaagggaagaaagcacuuuacccuagaaucuguuugaaaccucugcuuggcugagaguaagaauucacuacaguugacuuaacauuucucucucuguccccaucugucucuauccauccaaugaaccaggcugacagccugacuuuauauguuacugucugucugauuaacuaggcguaaggccugaauguaaaugacuuuggguagggccucauuaccacccacccccauucucaaauuucaaacaaaacuguuuuucuguaaagacucuuaucaccccuuuguucccuugagcuagagguuuaccuaucaauugcaauucuguugcaugaccuucagcaaucuucucugaucucauaggaaccauuugaagaugguggcaucaagaccuacuaaaauaggacacauaugaacacacacacacacacacacacgaaagauuguuuaguuuuuuucuuuuuuuuuuuuuucuuuacgauuuauuuauuuuaugugugugugccuggugccuaaggaggccagaauagaguguuggauccccuggaacugggguuacagaugguuauaagugauaaguggucgaauuggugcuggaaaccaaacccucauccucugcaagagcaacaagagcaacaaguguucuauaucacugagccauuucuccagccagacaaagaaaggugacugucucuugaugaguuggcacacacaguuauuuguguccaccaugccuuauuugugacacuguguuuguuuguguguacauuuuguuuuuucucuuuaggcauuucucacuuuacccuugugcucaagccuguauuauaauaucugggggcuggagggaugacccuuugguuaagagaacucacuuuuccagaggaccuggguuuaacuccuagcaccuauguggaggcucauagcuauguaacucuaguucuaggggaucuggugccuucuucuggccucugaggccacuguacacacauagggcacacacauauauaugcagacaaaacacccuuacccauauagaauaaauuagaaaaggaaaaaaaauuuuuuuuuucaagacaggguuucucuguguagcucuggcuguccuggaacucacucuguagaccaggcuggcuucgaacucagaaauccgccugccuuggccucccgagugcugggauuaaagugcgacaccacugcaccgcuagaaaaaauuuuuaaagauuuuuaaaaauccauaauaaacccugagcuggcuaguguuuaugggaacuugacacaaacuagagucauuuuggaagagggaaccucagguaagaaaauacccccaccagauugugaggaagucuguggugcacuuucuuaacugaugcuugauguagggaggacccaguucacuguuggcuguggagcccaugaacugguagcccuucaauacaagcaagcuaagcaagccaugaggagcaagucaguaagcaguaccccuccauggccucugcaucagcuccugccuccaaguuccugcccugacuucugucagugauggguugugaccuuagaauuauaagcugaaagaaaccuuuuccuccccaaguuagcaauagaaaucggaagauaaaccccaacuccucuucauagacuggcuggucccgaaguucuuuuauguauugaagccgugaaucucuauuuuugcuaauucaggucccuaaaagucuaggggaacuccucgggcugcugagagugacaguagagagcuguaccuccugccucuguuccccaaacugcuagcaauaaggauucccagagcagucagagagucacuuuaacaaagagcggacagguaauggugacauccacaugcacuggacugugccagaaggagcggcagugaaggagugggugaugcccugcuuccuggaauucaggguuggacuuugggagcauuugcacauggccuguggaagaaauggacaacaaucccagacauguauucugggauacguuucccuggaagccagcugggccuugaguucaaacggagagaacagcaagggcugggcugagcauguugggagaggaggugcacuuggugcgguuaggguguuggggaaacacaaggacaaagugaaaguaauucaacguucacuugaaucccaaugaagccugguaacacauucaccagaaauaucccugucucuuauccccaauguagguggugaugucucaccucaucggugagagcugaccucauaauuuggcccaaaagggaagggguggggaauguucaggaauuuggauccuuguccggcugagcaucuuugauuuaaaaaaacaaaagcaaaacugguucucaccagguuaucagaaggugaggguccagagcucagcaggcagaggucacgugagaccuugguuagggucaggucaagcauugagauuugcuuuucugagaaccaugcccacuuggccuccagagcugccugcugcagagguuucugaugggugucucugcuugcucaccuuacaggaccggugugaggaagguucuggaaacugucagcauguuggcuugagccgaccuggagcccugggugguuuucuucuacuuccuuugugggguuccucuauucugccugaccccgagguggcuucuacccauagacucaugagagauggccccugcagauagguaaacuggguugaccagcaguccagccuucccauccaucuccuuugucucucuuaccccucucccucaccccuuguauuuucccguuauuuucugaccugaccucccugagucucuguuccucuuacuccugcccagguccuggcuuauauucugaaaaggggacagcucucuuaaaggccguggcacccagagaguuggaacauucuguaugccagugggucucaugcagccauggugaggagaaagugucacccuuucgagcgcagucuccccuauuauuuauuuauuuacuggugcuggaagagaacucaggaccuggcaggaucuggggaagcacuguucuacaaaaacauaaacccgccaucucagaauucacucuugauuguugagaccuuauuuacuuuauaauauaugcuuaugagucuuuaccuguguguauuugccuagugucuguagaggucagaaaagggugucgaguccccuggagcuagaccuaagagcagucgugagccacggugugcgugcucagaacugagccuggguccucugcaagcgcucacuggcugagcugucucuucagccccucuccuauuuuaaaacaagaacuguguaacccagaacguugccuccuaaccguuugcucaguucagggcaucagcgcacccugacauccaucucagaacucugccuucuaaaacugaaaccccuuagccguuaaacacuaacuccccacuuccuccuacacugccccugacaaccgcccuccagcuuucuucucuuucuuucuuuuuaaaaauauuaaccaaaaguuuuacuuccuaagugacuguccccuucauagccuccuccuuucuaaguguuuggcugcuuccgagagcuucugugagaagcacugaccccagguucagagggguuuuuuuuuuguuguuuuuuuuuuuuugcgucugguuuccuggcaagcccaacagagugucugugugcccugguguauaagguuuccuuuccaguaaaggugaauuaauuuaaagaaaaaaaaauuggaagauacuucagcaguuaagaguacugacugcucuuccagaggacuagguguuaauuuuaagcacccauuaugguggcucacagucccccccccccgcuucccccccacaacccccacccccacccccauuccaugcucagacauacaagcagucaagauacgcacagaaaauaaagaauagaaagauaaaaaugguguuggaugugacuguugcugaaucagguggugaggucccuaagguggguguguuggguguccaaugcuauuagaaagugacuaagauaaggaauguaauggggaaaccagucuacaaucguuuggaccuguggugaggcaggacaucauggugggaguggguggugggccaaggucaguucacuucuuguagaagcaaaaugggagggagaaaggggcuggggccccuauauaucagucaauagugugcucuaaugcccugacuuccagaggacuagggguaacuucuucaggguucuuguaucuuucagugacuaaguguucaggauaaggccuucuggagacauuuaagggccaaaccacagcugugggaaaggucaugagaaagcccuggaguccaggcagcugcucuuggugguuagaaacugcaggaccugcuaaagcccaguaggaaccagaaugguaaagcuaguuugucuucuaaucccuuuaaauauuaaucuucacuuaauccuaaggagcuauuuuuuuauaaucccuaaaaccugcucuaccuagagggaugguuauagccacuuaaguugaggugccugagaccuggagccucccagcagagugucucuggggugugaaguggaauugggcucuucagcuggugccuggcuugcuuggccccucccucaacaaguuuaaaagaauaaaucagucaacuuuaagaaauauauuuaaaaggguacauuuagucacaugcucacugaugccaucuucugcagguuccgggaaguccuuagcauaguuuuuuaauguuguacccacuacagaguagcaggauuaugucauugcuuccuggucuaagcuguguugaagccauuguuuucuaggcauauggugacauguggcaguuuccugaucugucaccugggguucuaauaugacuauuggggacacagcuguacucaucacacuuuacuauuuaacacagaacagaauuaucguauaacaaugaacauuacugugguguguuuauuacaguacugggucuguaggaaacauuacugugaaccauaaagagcucagccuggaguauucaccuccccagccuugagaugcugugugugacaggaaaugcaagccaaaauguuugcaaaacaaugaagggauguauguaauuuuggcaagauuuguuuccgguuucuauguuggaguuagaaaugaaugcauggucacuaggauaugcuccuuguucuuagguuuuggcugugguguuccuuggcucacucuuaggguagcaagauacuauggcaaccaacccucacccccacccccacccucauuccagucuguguggacauaagccacaacaccuguucuaauuggaucugccugaggcacauaugacaguccaagcccaucucugugaccugggugcacaaggcuuuuguuggccaguaguguguuugucaguguccucaguguucucuggagucuccuagacugagagaggauaaaggcucugucucuuccggcugcuguuacaaacccauagaugaaaaaaagugccuugaaauaaugagaaugucuucccuuagugcuggaggaagucacagauguugucugaguggcuguguugugaggcugugucccacuugcauacuaacaguuucguguuguguucuugggugugucuguggugguggugguggugguggugguggugguggugguggaccaggcagcucugagaggccucuuuaaguggcacugagcccuuucucaaggcucugugcccauagccuaaucacuccccaguacugcugucuggggagcuaggauuucaaugugggagcuggagggacauauugacaucauccuaggcaggcccacccaggggaguuaggugcuguuacagaaagagguagauggaggucgagggcauccccuuccugagugacaagucagaugugagugccuuuucuaugccugucuacuggauuguugguggggagaggaugccuuugaagcuguugucaccaggagacuuuggaaggaacauggcaggagccugugagaagguggccuggcugugugacaggcacugaacccaguaucugcagaugugagcucucacuugaccaacguugggacugauucugaauacacuuggaaagcugugcagcacccaaggcuuucugguucacuccauagaguuauuccaauuugcuuuauacuuaaaaacuuugguguuaagaaaauuucucacuugaguguccugugaauccuugaggaggcagacagauuguagugcuuagaccccaaauaggaaagggcagcagacauucccuaacucgguucaggaguguacaguauaccagcugcccacagacccuaacacaaaaccccucaccacagugugagagagaguuaaauccagagaaaugucagggagcaagagggugaaacccaggaaugcaaaguuggcuugauacuaaaacaaaacaaaaccucaguguaauguuagcagcaaaaggaaggaggacacuaauugucacugauggcagaccuagcuuuugucaagaguacagaauuccucagccacaccucauccauccagcuagccuacuggaaguuacaggcuuccccuuccugguccauguuccccccagcccuaaguccuccuuucucccuucugcguuuccugcucaccuccuuauggaagcaggagcuacacaaaggcagaggcucaugugugugcugaacucuucucaacaucauaggugauccagcaaaacucacaugauuuggaucuucagugucccucagggcccgugugcuucaggcguagggucagcagaaccuuuagaagguggggcuuagagaaaagaaauugucuuuggaaauguguccuugaaggguuggucggucucuaguuacacugucuccucuugugagcagcuucuccguuuccacacucugaugccaagagaaccaacuaauacuaggcuggaacuccugaaaccauaggccgaaguaccuccccuccuuauauguugcuuuuuaaaauagggauuugucauuguuuuaaaggcugacuacuccucauggacucagagaauggcugagcauuaaagauuccaggaggaccagugucacagggggaacugagaggaaggagguguugcccucugccuuagcugugagagcgggagggaugggcuccuaacaaggacaugugaugugcaaaggcauuugcaaagggauaaagaugggagaguugugggagagaggggcuuauaagcugagaucugacuucagaugguugaggcuccugccugaaccugccuguggaucugggggugucagugucugugucugcucuguuggggaggccuggaggaggaggcagaaccagaaucaagguucagggaagcauacugaccugcaauuccuuucucuuaagguuaagaguccuauaaacauugaagugagguagucucuacugaccuuguccuguucccagcccccaacuagguucuuccuccccuucugagaaucaguggauagauagcuagugugcaaaccagagguacuguaucaucaguucaggaccgauagccuuagacaggguaaaacaacuuaaaacauagugccauaggggauuugaaugaaaugugugugccucagucaacguaccauugcucugaagagacaccaccaccaugauaucuauuucuuauaaggaaagcauuuaauugggucuugcuuacgguuucagaggucuaauccauuaccaccacaguggauagcacauaggcagauauggagcuggaccuggagcugagaauucuacauccaagucuacaggcagaaggaagagagagcuaaugggccuggcuugcacuuuugagaccucaaagcccaccuccagugacacacuuccuccaacaacaccacgucuaauccaacaaggccacaccuucuaauccuaaauagugccacucccugauggccaaacauuuaaauauaugagccucugggggcugucuuauuccagccacuacaggguguaaacauguuagcuuugggaugccagccacuggcuuugagaagugcugcaacucaaagcucaaaggucuuuggaugacagucaguauuggucccuaucagggcaggucugcaggucuggugucacagcucucacagacuucuagaguaguagagaguagagucuuuguagaggugggcaguuuugaugucuacagacuggauguagaguuccuguaccugcaguugcccugucaaagcccagaacuuggcuugagugagcccccugcuggagguaggaaucucaagugcuggggcuccagucucuaucaaguuaucaaguucaucuccagcagauccugaagguacucagcucuuccuggguugacucuguauaucuauagaggacaugcuggagcaggauggucucugauuggccgaauguagacacacaaauggggugagcauagagcuaaucacagaagagcugucagaccuggugggagaggggaggauccuugugccuccaaaagaugguuggaaagcucuguguuggagcuccauguaccccaacagcaguaggccugcuggccuguguucaggauccccccucagcuggguaagagcuuugcgucuuguucugucugaucuucccuaguccuuugcagcuagacuuuguuccuauuaaaugaggagauggugguucauauggcaggugaguggcaguucccuguagcaccuuuaccuuucugcagauaucaacagugagacaggccauacugccugauccucagccccgcuguuuauugugcugaccuaagguucccaggaaacacaggugugucauuuucagacuaugagacuuuccauauguuccuugaggcuaagcacacugcugucugcugucuacugguucugaacaauuggggaggugcccugaggauagcaguugauuuaaccugggcaugggggugcacugagcagaaagccaugugaacugguuuccauuucuucuguagaacaugaaacaugacaccacccacgugggcagaccugguggacuuuuucuuugccuucucaaguuugacagguuucuccugauugguucuuuuuuuauaacucauuugcauacacagucaauuagaguccacuaggcuuucuguaacuaggagacaagccauguuuuccccagucuugcuuccagccuggucuuaguuguuucugcuaucuucagaggaagaagccuaaauaccucagaguccaguucccagccauaggcaggcuuccagcuggauuaagucuucucuagacagucagacagucagacugucagacagaaggcagacagacagacagacagaugaacuugcucccacuguuucugccuuagccuuugagacaugucuauagcugcaagccagggaaccaacucuagccuucagagccugccagagaugggagaacuguuguaccugccucucuugucagugacccacucucucugccaggaacuugguaccccaaagccuuacccacccagugggagcuuuugagcuacagcacuugcugacggguaccccagcacacagggcugccauauuucuaacuuguugguuagcauccugggccaccaauggucucaguuucugauuuccuguuugaggaucuguguucccauucaacuuuuuacuccugugugaugagugcuaucuuugucugcccacccuguuauuggugaggaggcaagaacccaagauaagagaauugacucucaguaacaucuuacauuaugauuagaacuuucaguagaggaaaugccccuucuugauaggaaauaaggaaagagaggcccaagucucaauacccuuuucaagagcucacccuagcgaccuaaugcucucccacuagagauuguacauccucccaguagcacugaaugccuaugaccaagccuguagcauaugggccuuugggggacauccagcacacaaucuauagcuaucacauagacaaugucacugcccggaaaaaccuguacuccucacacucaucccuaauuuccagcccuaauaaguuuguccagauauuuuaauuauaaaccauaugccuagauugggcagaucuaguacuauacuaacuuauucuccagcuauaaaaccccuugcuauuugcaguuucuucuagccacgugguucuggucuauuaggacuuccuccuccucuuccucuucuuccuccuucauccucuguucucuccuucucccucuaccugcuacccccucuugagccuccaguuucaccuuuccccaccacugcccaucccaggucuuuuacugaccaauuaaaauggggagaagacucacauggcaucuucugaguagugagggucugcuccuugggaacagccccuccugaggaaccaguauuaacauuagaauacaaacacugcagcagggcgugccuuuaaucccagcacucaggaggcagaggcagguggauuucugaguucaaggccagccuggucuacaaagugaguuccaggacagccagggcuauacagagaaacccugucuugaaaaacaacaacaacaacaaaaaaaauacaaacagcaucagagcaacccaccacaucacucuuccccuacacugucucuucuaaugguuccucaagucauagcugcguuacuaggacauucacagcagaacgugacuacccaugacauccuagacuguuugggcuuuaccagaguuuccaggaagguccucuuccaauuuacugauccaagcuaguguccuacagggcaguuauuuguccuguuuccauagucuccuuugauggauguuaauuuucuagccacacacucucucucucucuguagcucuuuuucugucucucugugugucucaugugugugugugugugugugugugugugugugugugugugugaagcuuaaccuugaaaaauaucuucaacuacuacugaauaaaguccaucucuugcauaaagagugagagacuccuccucaacuuuguucuucccccuuggcuucugaagugcuguauccucagagggaugccucgagccaagcacacaugccucucccugagaauuccaucucuccucacugguggcugagguugguuuaguauuucagacuuccugcagcagcuuaguugguaccuauguugugucucaguguucucaguugugaugggagauguugcuugugaccaccuggcuucuagcaagacauuagccaugaggcuggaagucuggagaugucuguucaggugugcuaugugccacuauuuugugucgaacagcauacuauguaaccuagguugcccucaaacuugcuauguagcugaggaagaccuugaauugcagaugauccugaguuuugagauuauuggcaagggccacccaccauggcuggcuuuuagcugugacugacucuagcaugucugugcuguguuggagacugggcuaggugaggcugaggcacuuugcucaauggcuguccuacccugggcacugggcacucggcauagauaacucucagugugugugacaggcaggacaagucucugccaucacccugccaucuugguggcauucauucagaggccacuugggacuugcaguaacagugaauacccacuuagcaucugguaggugcugacuuuuguccucaguucuccuugacugaguugcugggacuguugcugugcuguguuauggagcugaggcagugacaccugauggcuuccccagcauguuuccagcuguccaacuuaccuguugcugggcuuaucugccucuccccuuccugugguugugagaccagucugagugcauagggaccgguuaucacuauacuuuguggucuccaggugcuguagaagccauauggggaugaaggauaacaucugggugagugcucuugaguccagccuggaucagauccaguauuuguuccucaugcauaaauccucuuccugcugaugaaaaauugcaucaguaacucacagguugaaaauauuacauagaaaauuccagaaauaaacuauucaaucaauagguuuuuaaauaacuuugauuacggucuuguuauaacuuguauuuuauuauauuaccacucuuaauuucuuucugggccuaaugaguaaacuaaaauucacuguagguguguguggaggcauagauagaggcugcaauaguuucagggguccucuggagucuugggcuugcucccugaggugaggaggccuuguguagucccauggagaaaucuuggaaggugacuguugaauacagaggcuguguccagaugcucagugucuggcuugauuugccuggggggcggggacggggacggggcggggggggggggggagggggagcacuguguaccgugacucaagcccuuggguugcagagcucuggugcuggaaggcuugguuuggcuucuuuccuucuuuuguuuucuuuuggguugauguaugaggucccucaccucuguucuguguuucaguccaacaggcucccagguagaagccucuucucuucucugcaguauggcuccagggaaugaccuuuccucucuuuacugcaggucauccacccggccagagguagccagcauagagccguugggcuccagugaacagcagugcucccagaaggcaguggugcaggcccgcuugacccagccagcccgccugaccagcaucaucuuugcagaagacaucaguaaggguuuuaugggggauccuuggugggguugugagacaggcucccuugagacaucuaccuggggucuaggaagcguccuuucuggucuuuccucacugagacugacuuucuaaacucauaaauuaguauuuguuaccuuagaugcucuuaacuggugucaaaucaaaaugaaaaaaaucugaccuacuauaggaaaccaugucuuuuuguucccuguauuugauucauuauauuguagauguggaguacaguuuuccucaggauccaugguagauugguuccagggucuccugggaugcuguacuccugggaccagccccucaaguggucuggugcagugcuugcuuagaacuguuuccuguauuccucaaucaucucagacaacacgcaaugcuucauguguugcaaagcgcugcagaucagcagaccgugugaccuaagggguaauggcaggaugugagugcccaguacagaggauguuuccugagugugugcuugccagagugugcguuugugauuccccagauacagaagcccgacugaaccuggagagcaugugaccuucuguuaggcucccugcacugugauguggugguuuccauuuuacuguguuuauuauuaguauuuuucagcagugcagagguugaacccagggccuuauguguguaaggaaguccuggaucacugagcuacaugcucagccucugcuaggaauuauuacuuuaaaaauacuuuaucuuauuuauguguacaugucuguucuguguguaugccauggaggccagaagaggucguguggucccaggagcuggacuuacaaguaguugugagacagcucauacccaagucuucucuucaaccccauauuuuaaaugcugaacacuaugccuuuucuuuuuuuuuaagauggggaucuuacuguaguccuggcuguccuggaauuccuuguguagauuaguacaccaggcuggcuuugaacuuauagagauccacccaucucugcuucccaagugcuaggaucaaagacguguauccagccugcugagcacuauuuuuaacaggaggcgaucucacagacauucccucauguuaaacaguuagagugcucgguuucaguucaguguuaggaaugcuaguuuuaugcacacacagcuugggcuuauuuauuuccuaccuaccacagaagcccaguuuugcugggucacaacauauacauuuuauugcuuuuuaaauuguauuuuaauuauauguaugacguguguuuguguguggguguaugcauaggagugcuggaacucguggacgugagaggcuucggaucccccuggagcuggaguugcaggugguugggggacaucugauaugguuguguccuuaggaagaauaggcugugcuacaaauggcucaggccucuauccagcccauaguuuuuguuuugagguagguccagucugccccugaacuacuagacccuagcaguccuaccgccucagucuccugaguagcugggaccauagguauauacccaauaccuuauugagcacagcaauauaagaauuuuuaaggcuuuugauacaugggcuaacacagaacaaguguuucuaucuagugccuggagaauggucagaauaacuaguauuauacaaugguuauccucacucuagaggguucgccagguaauguuguuaucugucuuauuugugaggaaguagaaagucuguguauaggcuggagagauuaaucgguaaagagcacuggcggcuugcucuuccagagguccugaguucaauucccagcaaccauaugguggcucacaaccaucuguaaugguauccgauacccuuuucuggugugucugaagacagcuacaguguacucauaaaugaaauaaauagaucuuuaaaaaaaaaaaaaggucugugcaucuauccaugcacuccccuugugauauacuggguagucuuauagaagguugauguaaguaaaacagggaggccagggaauggcugcacaaacccagagacuuggguuccaucccuagaacucaaguaaaggaggacggagagagcuggcuccacagaacuguccccugcuguccccuguguccacaugugugcugugcuaagcagccuccccacccaucauccacacagucauaaguaaauaaaaauuuucagaaaagccgaacaaacaccaagagaacaaguacgaggggcaagcauuagugugaguccugaucuuggugcacaagcagagagagagaggcacagucagcuauuguguuugccacuucccuuugugguugcagccuaaggacugcugcacuuuccuggaggaauuuuuccucacacagcuuuaaauguggguucacaaagaaacgaugagaaagccagucuuccugucuggguagcuaugcuagcuaccagaauauacuguuugcuccuggggugaauugggcuccuguugugguguguuggguucucaguuacuguagucaaugccacuggagguaggauggcgaguggacaccauucucagugcuguucuucuuugucccugcagcuacagggcaggugcugcgcugugacgccaucguugaucucauccacggcauucagauugucucuaccacccgugagcucuaucuugaggacucuccacuggagcugaagauccaggcucuggacucagaaggugacugcacccgcugcucuucggcaggcucccaucuuggccauaguucgguugcugugucuucucaugacuagcugcuguuccagccagaaagggagagucgccaucaggggaucaguggaggggguagaaguuaucucugaggugacuguguccccugguggcauaaaaccucaccccaccucauguucacaggcuugacagcccggccgguauguacaggucuuagcugccucugggaguauguauagugcccaugcaaaguuagaugucuccaggagcugacaucuggucaguggaauuggaagagcugccccacagagguaaugaccauacugggcaguaggaacccuucuuucucccugcucuguuucuaggcugguuuugauuuccuaaacacuccagaccucuaacagguguauagaugagggcaucugugggcugcuggcucagugcauugggagucacuucuugacuggcacggauagugacuggcucuggggugguguucuuguguguggccuuaucuggugguaggcagacugucugggauggaggcugacuuuuuggaagcagcaagaggaguuuguuguucagcuuguuauaguugugaccaacaccugagaucaacaaguuaagaacgagacauucuuauuucgauguguauuuuuagagguuccagcccaggucuuuaggcccauggcuuggcagaacaucauggugggcacuuuugucacaggagacugcucaccuucuagcagccaggaaaccaagagguggaagcagugggcuccagaugauccccuucaaucccuugucccuguugauguaacuucucccgacuaagccagcucagucaguugacagguucccuagggagggagggaggauuaaaagggaaaagagacaauuggauaacacuguaccaugaccccagccaguucugaggcugaaguagguuuauuuuuuuuuuccagccugcuuuuauaucauucuagguacauacaaaggauacggacaguucuaagucauaagcaaaguaguuaaguaauaaauaaagcauagauuacuguauucaggguauuaacaagacccaucaagauacagagaacacacauuccucaguuguauccaucuugagccuacuucugaguccuagcccaaagucauauucgugccugaggccuacuucuguauccuggcccagugucaaauaccugccagguuucuagaagcggcuccaaaagcccuccacauucucucuauugggccccaauugcugaaaaguauaccacuucccaggagaacagcaccauggcuguuaacugagccuucagugcauacaugccccagaaccuugggguguaggaauacacccugugaauaaacaaggugugugcaugggauaaacggcccgagucagaaaauacagaaucugcaauguguucagucuugggcguuuugagacacuuggaagagucuauguacacacccccagaucugaaaacuacaagagcagaaucaccuccagucccaaacgucuucaggucaugacuguuuauaaagcaugggggacaguagagcuggggagaagacccugaggacagcugagugggugcgcagggugaguagugaggguuuuggguuuaccagccauggguguacacugggguggguggggcagguguguaguugccuuguagcugagccagagucugagcuguaaucuggcucugggaguccugcuuuggaucagaaguaggccaucuuguucugugaugggcugcauagugaaugugaccaagagucucuggguguaugucucugucacgucuuuucacuggggaccuucuuguuccaagaagccacaggugaugcagcaaugaguggaagcguccugauaaacuuuauuuauaaaagcaggagggccacacuuacucuaggaauuauaguuugcuaacccccgcucuguuucugcuugaagguauuuaaagauuuuuuucuucugagauuuauaugcauugauucaccuuguuuuuuucuuuuuguuuuuuguuuuuuuagauuuauuuauuuuaugugcauauaugaguguuugcaugcauguauguacaacacauguguagaguacccacagaguccagaaguggacuucuggucaccugaaacuggaguuacagccuccauguaggggaugggaacaaaacuugcuccucugcaagaacagcgagugcucuuaaccacucagcccuccuuccagaccuaauuuaccuuuuugaaaguggguuuugguuuaauucacaaaauagugccaucaugguugcaucacugucuaauuuuagaaccuucucaccaguguagaaggaaacccaccuguggaugcuuacugccggcugacuaucgcccagcccugaugcccacccuggccacagccagcuuucugucugccuuucuugcucuggacuuuuccugaaaguguggcuauacggcacagccacagucuucugacugucaccuuucacucccacuccacuggugcuuccaguuccuguguuucaauaccaugugacagcggguuguuguucuuauuaucagcagcacuccacuguguggacaaacagcuaugucuccagccuucagcugauggaauuuuggguuuucacuuugcagaauuucuguguaaauguguuucagguucucucgaguaagcacagaugaagagauugcuuagugguuaggaguacuggcuguucuugcagaggaccuagguuugauucccaguacucacauagcagcuuaaaaccaccuguaacaccaaguccagagaaucuaacacccuucuccggccucgucaggacacuagguccacauucacacauauaaaugacucuuuaaggagcagcugagugaugugcuuucugacgggcuuuccccagccagacaugcugaccuuuguugucuguuuugguccaagucucuucagugagugaacuugacccuuguaagcuuugaggacuucacugucugagcuggguuguugugucuucgcuagauuccugguguuacuuaacacuagcucugcaccuuaacagauguccuaugggagccugugggugucagcccccaugcuaggccaugggcaaguuggguaaugcccuuuguacagccaaggaagcugugguaacuucccuggggugacacggcccauaaguugcagaguaugcugcugcugcucugacugcaguacucugacugcuccugcugcaguacuuuuccuggcuguuggcagcucucugcacucugcauagaccaucugccugcuguguucucaaugugauuugccugccugaaacuguccucagagaaugugugcacaagagugauggucccuguaagagcuuguuuagucauaagagggaccaaagcuguucuugcuagauuagccugguuaguauuguuuuguucaauuuauuccugggcaggucagccauuugucugccuauccuucugugucuuaguuaggguuuccauugcugagaagagacaucaugaccaguuggggcuggcuuacagguuuagagguucaguccauuaucaucauggcagaagcauggcaguauacaggcagacauggcacuggagaaggagcugaguguucaucuuaaugaagcuacauccaggagaggacugacuuccaggaaguuaggaggagggucucaaagcccacuaccauagugacauacuuccucuaucaaggccacaccuacuccgaaaggccacacauccuaauagucccacucccuuccuugggccaagcauauucaaaccgccacauucugcauucugaccacauuuauaaugcgauuaagcaaguuguuuguugugacucaggcucugccuuuaucuaacucucuauguagcugaggaugaccuucaacuucagcccugcuuccuuaugccuuuugccucuugccuacagagugauagaauuauaagcauaccugguuuucugugguucugggauuugaaccaagaacuccaacacaugccagucaaguacuguaugagccagaucucugcucccucaugauguaucuugacaugaggucuucacuagaugugaaaccuaaucuugcacauccauccucuuggugucuuagcauucuacuaugaguaauuaccugaggcaaucagcuuuuaaagaagaaagguuuccuuuggcuuaggggucugagguuucaguacaugcuuguuugaccugauugcuuuccaguaucccauggaguagcgugccuccacuaucaauggugcuauagacuagugaccaagucuuugugggagcucaaaaucuaaacuuucacacucugucuuagauguauucuauuuuaggaacugaaaguagacuaggacagacuccuuaaauguccuccucuugcagcccuuuguucccugcagauuucauguggucuccgugucuaagacccuaaaguaggcaucaagucagauuuuuccucagaguaaaccaugcauuuauuuuaaaacaaugcuuuuguauucauauaguuucacuauuuauuagagaugaaagcaaauguguguacugacaagacgggugugcuugcucuccuuuacaagaagaguuaaaucccagcaggggcucugauacugagggacacagacucugcuguacuuuucagagcugaugaauauuuugauuuuugaggucucugugcugagaacgcugcuuuucauaaauacauagugcaagauaggagaaaugcauuucgggauauuucagaauccccaagucaaaauuuacaaacccauuuccuaaguuguuggcugcaacuguuuugggcaagggagagauugaggcaggucuuauaacuuaggcuggccucaaacucacuguggcugaggcugucuuguagcccuguucuuccugccucugcuauacagaugcugggguucugggcaggucccaccgagccuacccuccuggagcagcuuuuaaaauaaaaauuaauaacaauauaaccucaaagauaauuugguaugugcuugaggaguggcaggaaaauacagaaacuucuuguuuuucuuaauuaaacgauuaugauacuuuuaagagcagaaaccuuugugcauaaaguaaacccacugcauuuauaacacaugguggucugaggucugagcaugauggcaugcccaauguaaaaugcucauguuagccaggugugguugcccaaucuuuugaucccauccuuugggaagcagaggcagggggauuucugugaguucaacacuagcuuggucuauacagugagacccuguuucagucaaaacaaacaaaaaaaacccaaaagcucaucaaaguccacauguugcauguucagaaccaagacuguagucaaguuguguggcucaacauguggcguuacacacuugaguuuucacuauuuucugcucgcugcccccagguagaaauguuucacuguuguaucuuuuguagauccugcauucagucagagcugaggauguugcuggcaauuugcuuucaggauucuuucccaucccucaugcaccauguacaucagugaacuguaacugagcaugcuccaggugcucagagacgcccccucccugugcucgugcuggcccaagucucugcugucagaagcccugcauccuccaggccuuccuguucggguguuccuccuccucccuggcuucccagguggaauuuucucuuuucugccuacgucucucaacccucaccggccucaguguucaggacuaguuuuauuuguugagcuuagcucuuggcuuuauucuucuggcugcuucuggacuuuggagcccguaaacauuggacacguauuuguucauuugaguugcauguuuuucuguggcccucuugguauuaggacaggagugguuugucccuuggagucgguguuccugggucuccugguuuguaucucuugguugugaggcuuugagguccagggcucuguggguuguacacagugggugcucauagcuacuucucaaguggaaaagcaaggcuuuguucgggccuggccugcuccccagcccagcaugucacucuuggguaugcuuacgugguauuaguuuccacacugccuucuuggagggcccugggccacagcaggggagccguaauauggcuuccugugguuuauuuugucaggaguaauuaaucuccacccugcccacggcaaagguuuauacagggcagugugcucagaaggagccaggcuuggcuucaugcucaacuccugcucccuggaagaccagagacucugguauggacucugguggaacagugguguguguucuggugacauggaaccuuagcgauucagggugcugaguccuugccacuuucaugcauccuggaaugccuucucugccacccuccccuggcuccugguuuccuggguccuccuguuuccuuuucucauucuuaaccauuuccucccucugccugugggagucuagguagggagaguuggugcauaugcagaguaggccuuccauuuaggaaggagagaugugacuugaguucucuagagcucagcccaggugggaugcaggaugguacagugaccagcagagaaggcaguaauuugccaugucuggccuguuugccgcuccccacccccccaggugcagggcaggguuuucauuuucaggcuccucugagccucuguugucaccuugguuuagcucacacccugagggagcauguccucagcugguuccaugcuugucugcauacacagagagccuagaaaauuccaguuaguuccccauguacauccuucugaauacgugagacuuuaagaagccuuuaguucuucugacucuugagucaucacaucugucaccucuuccucuugugagugucagcaaccauggggcaagaaaaggggcuagcagcugagcccagaagccguaugugcagauacggacauucuaugagacagaccccuuguauagcaucugucuccccgcccuccuuguaaggccuuuaugcucacuggguacagugucuuucuuaagauuuauuuuguauuauguucauguguuuguguagguuugugcaugagagugcaggugcccuuaaaggucaggaccuggaguugcaggugauuuugagcuaccuagugugggugcugcgaaccaaacucaguuccucaguuccuguguaaacacaguaugcauggcuuuaaccacugagcugucucugcagccugcuagagacacuuugugaacugauccuguagauguaugaggugaaguuuuuguuccuauuauaugguagaaagaaggggucugcacugagccaagaggaauccucagaguguucucggauauguaaauagccaccgucagacauggugcuggagaggggcugagagguaggucuacaucuggauuggcaagcaacacgaggagaagugagcugcucagccugacgugagcuucugaaaccucaaaccccacccuuugacacacuuucuccagcaaggccauaccuccagcagugcugcuguccaugagacugaggacauuuucauugagaccaccacacuccccuaccucuagucuccccugagaaguaaaggcaaaggccaccuuucucuggacuuuuugcuaagugugguuugauuuggucuuuggugauuuauuaguguaaucuuuauguguauuaugugccugcauggguauacaugcuacaucaccugcauguagaugcccauagaauucaggggaugucagauacccuggaaucagaguuccaggcaguugugagccaccugacguggaugcugggaaucaaacccgaguuucccaaaauagcagccagcauucuuaaccuccgaggcaucucacuauccucugauuugggcuuugagaucuuggaugaagguggugagauuucagugugggcugauuuuacagauccuacugcuuuaugauuugggucuaaaauaucugucauaggcucauguugaagauugcaguugcaguugcaguugcaggagcaggaguguucagagauguggccuggggaagggcuuuugagagguagugcaaacucaggagauggaccuggcugaggaggcccuugcgagcaugcucucauggaucauaccuugucuccauuuccucccugggucuugauuccaguauggugaaaaucuuugcccugcuucccuuuguggucccugcugccgagauguacuuccauccuccuguaccuugaagggaggcauucucuguucaggagguaucaaggagggggauuaauggcuuaguucucaguggccuccuaaggugucuauaacaacagaggauucaagguuaaguggggagggacaggccuauggucaaaucuuggaucagccuuuuaugguaaguagcaaguaucaccauuccuuugagccuuaguuuuccccuuucugaaauggaggucauggugugcaccuugcauggguguggcacugagcacugucacuguguguaguaaaagcugccaucucccuguucuaggucccuagggaacaaacuuacguguuuuugccucucugaacuuuuguacagggaauaccuucagcaccuuggcaggacuggucuucgacuggacaauugugaaggauacagaggccaauggauucucagacucccacaaugcacuccgguaagaggcucugugacaaggccuaucuugguguauacaagggacauguggguguucauacagggugagcaaguuaaaggguguggcggggggggggggcggcaaguccuggcuaagaggacaggccaguagugaacacaguucucaggauaggcuagauccucagcguaguguacagacagacuuauagagagggggcuucauagcaacuggacucauuacaccccuucccggcugccaucuggccugcccaccucugacauucccacuuuccggcuagggaaacugaggucuggagagagugggcuuguugguaagugguagaguuggcauuugcacucagaucucugucgaucugcuuucuccagcaugggagcugcugagcccgugcugaaucagauguaugucuaacagaaugaaaguuccuucuggguuaggagggaggcuuagcgggcaaaggagcuuaucaagaugacuugaguccccaggccauucgcaugguaggaaaauugacuccugcaaauuguccuuugacuucacuugagcagugacaugaacacacacacacacaccacacacacacacacacacaccacaccagcuggggguugggguaaauaaaugcaaaagauuuuuuuuuuaauuucuuuccugagucaugcuucuuacauugaaagccguggcugaaggcugucuguuggcuggaguggcagcagaggauuucaauuuaaaaccuacagaaaacaccagcguaaugcagaaaauguuucccuaaauuacuugagggccuguugccagcaugauguccugucaccuuugauuauuuuacugugcuuucacuaccauuaggauauuuucuugagucucuacaauaaaguuaucaagaacaggaaauuggggcuggagagauggcucagcagauaagagcauuggcugcucugucaaagaauccagguuugguucccaccauccauguaucucacagcuuucuguagcugcucuguaguucuaauggauccagcacuuucuucugaccuccacaggcacugcaugcacauggugcagauacacaugcaggcaaggcacacacacaaaauaaaaauaaauaaaacgcauauuuuuuaaaucagcaaauuuacucucaugcaugcuaucuucagaccuuacaauagcaacccagggucacacauugcaugcugccacuugucuuuuuuugucugucagccuugguuuuucuuugacuuuuggagacuugacacuuaugagcaugacaguccaguugguauguguaugaaugcuaggccugaggccuaggcaucgugaauacuugcugcacucugucacugaacuacuggaugauaaacuacagcuuagggcggugcugggguauccuggggcaacugcaaguguguccugcugguuguuguucuugugcagagcaggaguccuauugugaauugcagguugaaagagagacaagcaggaaccccauaagcuaaccuuacuugucagccacagaaggcuucaccaugugugauuuacuugcugugcugaucugcauuacugaugcucuuggagcuggguccuugggcuugccuuuuaaugugccucuucccuguggacccagcugauggucucagauuucagugaaugucaucauauauggguauugaugugcccaggcccaagaucaggaaaucguguuuaaguauuaccaagcagaaugauucaugacgucaacaucccuuauucugggguccagcccucaguaguagacccuagaaaugguaaaugccacucuggaaucuggaaaauucuguguuuaggucuugugauguguuccccuuucagcauccucaccuucuuggaaucuacguauaucccaccuuccuacaucucagagauggagaaggcagccaagcagggcgacaccauccuagugucugggaugaagacuggaagcuccaagcucaaggcucgaauucaggaggcugucuauaaggugggccuggguucuacaguaggauaaggaugacaguggauugcacaucuggauuuaguguguuguacuucuauaucuuucuguuugucugauuuguugaaccaugguguaggggcagggcuaaggcuccagaagucagugucucaggggucacagcaucugcuccucaggcuuggaggaguuaccucauuuccaggaaguacuucuuauccugaagcaggcacacaccuaccaucugagacucagcugucucccaugcuguaucucccugugcucuagcgaggccuugagacugccucaguagccaauuacggaugguugcaucuccccgccuaucuccaguuaguaaaaggcuuuuccugucagcuuugcuuggcagcaccagcccagaguccagaucuauuaggcuauuggggugcuaaagcaaauuauggagauugaaaauggccauaaauccaccaagaacagucuagguauauuggcauuucugucaacaaggaucaugucugccauuaguuuucuccaacaaugaaagccacaggcacugaggaaucugacacccagggcacacuggacaggaggcccugcaauccugucucagucucuugaguugcuucccgaagacuaggaggggaagagacuagguagggaguagggacugagaacacacagcacuccacuucucaggucacccuggaccaugagcacuuguggagugagagcuuaagcauccgaagacauugcucugggucaucugguuuccuucugugugguugcugucacuuuaaaucaagcuagagcauguggaagguacugcgaguggucauaugcuuuuggcagugacaguuuugagagcauccuggugccauaccuaugaggucccccuggauucuagggugugggguugcaaacgauguccuguuucuccauaccuuacuuauuccugaaggaauauaccgagaagccaaaaacaaaacaaacaaccacaacaaaaacaaaaucagaguucuggggcuuuagcugucucugagcuguagaccuagcaugggcuaauccuagggucaguccccagcacugcauagaaauagaacaaauggggcuguagagauggcucagaacacucacugcuccugcagagaacccaagucuaauucccaguuccuauaucauuugggucaaaaaauuuggauacaggauaucuaguuuccucucaggccuccauagacacucauacacauaugaaauauauacacagagauacagacauguacauguaauuuaaaagaaaaauauuuaaaauaacaaaacaaaccaaucgcuuagcacuuaagagcacuugcuguucuuccauaggaccuagauuuaguuccccagcacaugcauggcagcuuauaaccaucuguaacuccaguuccagaggagcuaacauccucuucuggccucauuggaaaugaggcauguguguggugcacagacauaugugcaggcuaaacacccauacacauuaaaacacacagagacagacagacagacagacagacagacacacacacacacacacuaccaaccacuacaaccaccaccaccacuguaaaaacaaagaaccuuuuuuuuuuuuuuccccaaaauaggguuucucuguguagcccuagcuguccaggaacucacuuuguagaccagacuggccucgaacucagaaauccgccugccucugccucccaagugcugggauuaaaggugggcaccaccacugccuggcacaaagaaccuuccuuaccuacaauuucucugcccccguuccucacccaacucaaccuccuucuucuuuucucugugcuaagaauguucgcccugcggaagucaggcugcugaucuuggagaacauccuucugaauccagccuaugaugucuaccugcuggugggaaccuccauucacuacaagguucagaagaucaggcagggcaagauuacagguacaguugugacucagaagucauguuagaugcuuucuucuuucuuuaaaaaaaaaaaucuauuuuuuuuauauguaugggugucuugucugaaugugggggugggguggggugggguggggugggcccuaugcacaugcaguacccgaggaggccagaagagggcaguggauccuacuggaacuggaguuagcuacugggaacugaaccuggguccucugugaaaggagccaguguuuuaacaacugagcuaucuuuucaacuggcucccuucuuguuacugugguaaaauacauggcacuauaaaguuuucaugugugcagaccagggaguggcauugcauuccuuuguagcacuuuuuaaccaucguuacauuccaucuccagagcguauccauccuccccagcagagccaauguccucaucacacacaccccaucucucucccuugcacccacggcucacaaacauugucucaugaaguuaacugcuuugcugagcucaguugcaugcaggccugugugcuuguccugugauugggcggccauugacugugcccucaagauuaguugcuaucuacaaugugucagaccacauugucugucuuuggacaguuggcauggcuccaucuuuugucaugaagaaugcugugaacauggaugugcuuacagcuuagucccugcuuucaauucucugcuucacuuagaggaacuucagagguguuggcucacauuggaucagguuguucugcuggccugccucugacugcugagagaaguugagcuuugucucaggugggcuauuccugcccaggcugugaggaagacaugauuggcaggaguggagcuauucugggaauucuguuuuuguuuuuguuuuuuuuuuuuuuuuuuuuaauaaauacauuuuuccuuucuuuuuaaaaauauuuaauuuuaauguaugugaguauacuguugcugucuucagacacaacagaagagggcaucagaucccauuacagaugguugugagccaccaugugguugcuaggaauugaacucaggaccucuggaagaacagucagugcucuuaacugcuuagccaucucuccaucccuauucuggaaauucuaugguuugggguacauguauuuuagaaggugaguauugauggagcuggcucuccuagacauccugucuaguuuauagguguagguguguggugucaaaacauagugaucagaaaucucaagacaacuggguugcauucagaguugguucaucuaaagguuucagccacacauaucuacaggugaccaccagaguggaagggccacugccggugacacugaagaagcauaauagaugcuauuaccuacaagcaacuauguuguccaguuuccuacguugaguucuagguuaggugacaguucauggauggagaccugagagguguugccuccaugagccaccagcaguguaucuggcuggucaacccaagauggggguuacuugauccauuugaaggccccuaccuccugguucugcacccacuucucuugacaacaaagagggagggaagcaggcuuguguuuugugaguguuuguugagugcugaaggaucaagccuucuccuuggcguucugucagggugaggguacuggacaaggaggauguguaggaagcccaucucaggcuugaucccacccuuaucucuagggaagaagcuuagaaggacaaggaugguuccaagacugaggugaggcaguuagaaguggagugcuguggucaccgaugugguauccuaaggaggggguaucuugaaaggccagagaacacaaacaggcuuguauaaaauucugugugauggguggugguagcucaugccuuuaaucccagcacuggaaggcugaggcagguagauaccugugagucuaaggccaguuuggucuacagagcuaguuccaggacagccaggacuauguagagagacccugucucaggaaaaaaaguucugugugaacacagauguuggucagaaaugguguuaccuugaagggugagagccuggagagggugguauuuugagugacuguccucugauaucuggggccauucaccugugccccuugcaaaagaucaccccagcugggcuugcaguucacagcuguacauagagagaggaggagagcccaaugggcuucucacccugguguccuuacgcucccugccaccugacugccuuaaaacugcaugggccuacagggaaagcccaucccuacugggucaggcuuuccaaguucagcuggcucggggaggagugcccacagccauguaggcaaucccucacugucuuagucgggguuucuauuccuguacaaacaucaugaccaagaagcaaguuggggaggaaaggguuuauucagcuuacauuuccacauugcuguucaucaccaaaggaagucaggacuggaacucaagcaggucaugaagcaggagcugaugcagaggccauggagggauguucuuuacuggcuugcuucccccggcuugcucagccugcucucuuauagaacccaaagacuaccagcccagggauggucccacccacaaggggcccuucccccuugaucacuaauugagaaaaugccccacagcuggaucucauggaggcacauccccaacugaagcuccuuucucugugauaacuccagcuugugucaaguugacacacaaaaccaaccaguacaauugaccccuugucaacuugacacacaaacacaucacuaguaagccucaacccauauguucuuauucauccccaagaucuaaguaacuuuaaaaguuccacaaucuuuacauauuaaaaguucagucacuuuaaaauauccauuauguuuuaaaauucaaagucucuuaacugugggcuccacuaaaauacuuucuuccuucaagagggaaaaauaucagggcacagucacaaucaaaagcaaaaauuaaacuccaacuguccaaugucugggauccaacuaacgaucuucugggcuccuccaagggcuugggucacuucuccagcccuguccauuauagcacaaagcuuuucaucuaggcuccagaugccuguacuccacugcugcugcugcuguucuugguggucauucaugguccuggcaucuccaaaacacugcaugacgccuucaguccugggccaucaauugcaacugaggcugcaccuucaccaauggccuuccauggccucucacagugcugagccucagcugcucugcaugaccccuucaugccuucaaaaccaguaccaccugggugacucuuacacauuaccaaguccagccacagcacaagguacaaccuuggcuaucucuggaacacagcuucugugcuuucagaaaacacuucccagaagaugucaccucaaugaugcuggucucuuuuuaaucacaacuaauuucuuagcuccagcuaaccagcaucaauagucccaguaaugcaaaaguuucacuuuaguaguucugguaucuuguuaaucacagcugauucuucagccccagcuaaccagaaccauagaaucuucccaaucaaaauagcaauggcccugaaaagagucuuuaauuuucccucugaaauuucacaagccagaccuccaucuucugcacuguucucaacauuaucuuccaagcuccuacacaacaucucacagagcucuuaacgaauggaucuucaagcccaacguuccaaaguccuuccacaguccucucccaaacauggucagguugucacaggaauaccucacuaugcugguaccaauuugucuuaguuaggguuacuauuccuguacaaacaucaugaccaagaaacaaguuggggaggaaaggguuuauucagcuuacauuucuacauugcuguucaucaccaaaggaagucaggacuggaacucaagcaggucaugaagcaggagcugaugcagaggccauggagggauguucuuuacuggcuugcuucccccggcuugcucagccugcucucuuauagaacccaaagacuaccagcccagggauggucccacccacaaggggcccuucccccuugaucacuaauugaaaaaaaugccuuacaauuggaucucauggaggcauuuccucaacugaagcuccuuucccugugauaacuccagcugugucaaguugacacacaaaaccagccaguacacucaccuaucaucuguaaggaaguccauagacucuugugaggagagguggcuauugguaauguuucccccugagaagggauuuuagcaacagguggacauugccaacagugucucacuaggaucuagcaccucugaagcucugaccaagguucuuagagugcuuccuuuuaggacucaagagcccugagaggugaacuucaugaagacacucugaguaggcagggacacaggaaaaccugaaggucacggagcuauagaguucaacugaguaucuuuuuacugcugucuccucaaaagaaagucagaaaaccagaaggguaguggcugggcuuucucucagcaacaagauggagauggucuacuacacaggguccaugagagaugaaacugcucagcucgggagaggagggggagccagcauggauaggagauucaggguugguauuuuaagaaacuuauccuaaaucagcacccaacuucacccuucucugcuuccugacugcuaugugugugaccaaacaccuuacacuuccacugucaugccucuuaugugagcccaaaagucuucccuuccucaaggccuuuugcuaaguagcuaacauagcaguuuaugacccagagaauuacaaagguccggaaaccuuggagguuuggugacuuuguuaccuuagaaguuaaggaaugagagagcccaugagagauaauccuagagccagacagaggaaaguccccugcucaucaguuggguccaugccugggugauaggugauaguguugcccaggcuuauagagacuuccagaugggugcuggggcaacagccugcugacauuguuuuaccaggagcaaagcccacagcuggaaacuccauuuucuuuguguguguguguguguguguguguguguguguguguguguguuuaauucuagcacugucuuuuuggguguuauucgucaugugcagucauaggaacauccuuuaacuuccaaagcuggauuuaacuauuuuguuugaaaauuaauauccaacuuacauuaacugacauuuucuuccccaaauuuaugaagucuacaaauugggaauuucacggaaauuuucacauuaaagaaaucuguggcugagcuugguagugagugucucugaucaggcccucagggauggggcaggcaggucaugaauauagaugaaccugggguagaauacagguucaaagacagcuggacuauagaucaaggccuuuucucaaauagaaaagugugaagauuuguugaaagugaucaaagagacacugcuucugagucaggaauucuaaacuuacaggcauuucccugguugagggcuuuggcuugagucuguuggcaaagccuguugacuggaugacccuugccugcaucugugugcuccacguguguuccuguugccugcagagggcagaagaggacauuagauccuuuggaacugccauucuggauaguuguaagccucccuguagaugcuuggggagaaauccaacaaguguucuuagccauugagccagcucucuugccccagaaccuucuaacugguguguguguguguguguguguguguguguguguguguguguguguguguguuuaguguauggauguuucugugcauguuuauguaccacucugugccuggugccuauagaggccagaagagggugucagaacccauggaacugggguuacagaccauugugagcuaccaugugggugcugagaauugaaacuagguccuuuggaggaguggccaguguucuuagccacugagccaucucuccagcccuaaucuguuugaaucuucuaauacaaaaacaaauaucaaaaacaacaaaaccagaaacaccaucuuagccagcagagcaccucugagcuucauccuagcucaacucauucuuuagauuuuaauguacucuuuccacaagggcugugauggcgguggcugguacugcugguggugguggugguggcagacuccugugagcccuguuucucuaugccugccucuguguucagcacauuuaugggauuucugauacuagaagagacugagguucuguugaacauucugacauucuuuucucauaguuccaugcugaugcuggcuccugucaugucacuuacaauaggaaguuuucuuguauuuuaggaucuggugucuugcucuauugcccauguuggccuugauccugagucccauugaaugucagccaucucuuugauguauuacucuuagugacugcagugugucaaaaaugucucuucucaucgugccgccuggucuccacugggccacucacuuagguucuggagucuucugcugugcacuguaacccaaauccguacacuagcuuggaggugcucucagguuuguccaugcagagcccaggaacaccaggcugcugcaguucuccagcaucacacccuguagaggauccucaaaaacaguagucauggucugccacuccucaggggacaucuauggcuuugucauuguccuggcuaguguuuuugucaacuugacagacgcuuagagccaucugggaagagagacaaugccaccagacuggucuguaggcaagucuauagagcauuuucuugauuaaugauuauuugggaaggcccagcccuguggacagagcuauuccugagcaggugguccugggugguauaaaaaggcaggcugcgcaagccaugagaagcaagccagcaggcagcauuucuccaugcuuucuguucaguuccagccuccauguuccugccuugaguuccugccaugacuuucuuauaauggacuguaagcuauaaguuagcagacuggagaaauggcuuaguaguuaaaggcacugacugcuuuuucagaggacccagguuugauuuccaguuaccuauaugguggcucacgaccaucuguaacuccauuuccaggcaaucugacuaccucuucuggccuucauggacaccaggcacugcacuagugcacugauacacaugcagacacaacacccagacacauaaauuaaaagaaaaguuuaaagcuguaaguugaaauaaacccuuuccucuccuaguugcuuuuggucaugguguuuaucacagcaauagaaacccuagcuaaaacaguccucaauugaccuuuucuaucccaaaacgcaagaaugggcacacagaaaggaaguggaucugaaaaaguccaaacccaauagugccaacacuuaguccuguaguuuagcuccagcaucccauacauguggugaugguguggcugagcuccaguggauuugggcagccuugugccuguggcuuuccuauuuguaucccauguugccugucucuagggcuggcucuacuuguuaggguuaggacaugcuugggggcagggugcuggucugcuccuaacuagcuauaaaacuguauuguagucuauguucuauguuagaggaaauacucagagcugcuccuugaugugacacauucuagagauccaagagcaccagcugugucucagcucugccuuuuguuugcagcucccuuggcugcuuuuccucagggcagguggauccugauguggcaucaugugcagcaggagguaagagaggaagccgaguucacgagccaggccugcucuuuuauaacaacccgcaguuucuaguacuggaguucuagaccugcuuucauuccuuucagggccgugcccuagugaccuaaccacuuuccccuaggccacauugcuuuguuuuuaauuucucaaucuuuucaaaaauuacguuuuuaaaauucuguaucucuuugugaauaugugcaugggggugcaggcgccugcaguggcuuaggcaucaguuccucugagcuggaguugugaguugccuaaaugugugcugaauauugaacucagguccucugcacucuuauucccuaagccaccucuccagcccccaaucaucagucuucccgugcucucugucgcgguacgugagcauggggguaugugagcauggggguaugccugccacuggucugagagcagccucaggccagcugacauggaagccucuggggauucuccugucuuccaucaugccauaggaaugcugggauugcaaacacaugcuacugcuuuguguuggugcuggguuuugaacacccuuuggacaccuuugaacauccucauccuuacccagcaagugcuuuacacacugacccauccgugacauguuuucuagcauaugaaguuuagguucuuaaagcaguggaagucauagcagaccaugagcuagcuucucaccugacuugcucagcccucucuaaaguggggaugccaguaguccuuguuccuaggguuguugagagaugagaugagggaaauuggucaugagaugccuaagcaagaccagagcucuuucaccgcagagucuggugucgcuuuuccuuucugggaaauugaacuccuauccagcaggugucuucaaacaaaaguacuguguucucugcccagagagugaagaugguggguuucccagaaccugugauuuccugggaauuguucugugaccugggcucuuguugggaaagucauuuuuacacaaauuuagaccgaggggggagcacagagaguggucaggauuagaaucauucuuugcgaugguaagcugagcauccaaaaacccauagaagaccaucagguccaacuuuuuugguaauacagugagaaccccacugggcccagauguagagaagagcuugcucacuucgggggggagggggauggucagguguucaccacugcuagcauucuucaagcugcugucuugacagcaggucccaagagucagggcuggagacggccgucuuggugugcagcauuucacacuuucaucuuaccugcuuuucucaucucuuucucauacagaacucucaaugccuucugaucaauaugagcugcagcuccagaacagcaucccagauccucagggagaccccgcccguccuguggccauccugacacaggacacaucaagagucacugccaugcagaugggacagagcaaccugguccugggccacaggaauauccuccgcucuggcaccgugucgugcugacugcuuugaagccaaguuguuuuucucccuuaaagccagccaggacuaaaaauagcacuguuuccccaucugucugaaaaucagaaagagccuaaauagcaacccgcugaguggaauugcucaccucuguagaugacucacagagacucccagagccaggagucuggcggaggcauacgucacuccaggccucuggaagcuucccaggaaccacagucccuccccucagagggggccuggcagaagcugugugaguacugugcgaacacuggcacauagguuguugaaaacccaagauggauuguaugcccuggggucccuggugucccuugcagagacucggcuuuguagggcagaugguacaguaagggucuugacucaccaacaucuucgcucuaagauguagaucuucggccuaaucuagggguuccucacccacuucuuaguucauaugguaucugugugaugcucaaaccgugugcaucaggcagaaagcccuggcugcuuuacccuuuguaucuuauguuuuauaccuuaauuaagaauucagguauccguaugcaaggagcuucuaggcuccccaacagcaccaucuaugugguugaagccggauaccuagguaagucuggcccccugggguuuccuacacauugauugccugugauuccaucauuugagagaucaaagaguaaaagcaagaccugagauucagcucagcaguauaugucuuagcucauaugagaauagucaaucccuuggaccugucagcaaaagcaaacccaccuaacugcagagguacaguagcucucacacugaccacauccuccgccaugcucacggccaucaguccucagcccuggcagcaugcagaccugagugcugcucugcaccugucaagguuggggacccugugccuagcuggucaucuuuagguugaugugagaguuggcaguaccuuggcagggaagaaggaggcaucagagagaggagggaaccaccuguagcaguaaaugacccugaagcccagguggaucugggagcugcaaugauagccagcgcggagaccuuuggggcaugugugucaugggagucaccaugguaguguuuucuuuagucugaggcagcucaccuaaggagcucacagccagaguucagucuggagagcaguggccagaugggcagcaguacccuuaauuaagauccucuugucagggagcuugugaaccucugguggugcagcacccagcuaacaggcaccaacccccguaugccucaaggacccuuugugucucggcagcauccuuugccugauuggccuggggugagacuuagcuccacaguagagguugguacaaacagguggcaacagugugguaggagcaaacaccagggcagaggaaagacuucgggagguucaugggaggcaggugcugugucagacugauuuucuguggugggaagggcaccuggcagaguuaacagcuuaguuggagcuauggagaugagaaagcaaacaaccuugugggaauagaaguagcuaguguugcauugugugugggggaugugggguggaggagacaaagggcuagcuaggugcucucagagcccagacccagauacaucuuauccagagcucucgggagcuuuagccuaggauccaaaaccuguucuagcuucagacuuagaccugucaucccugagaguuuagaccuucuguggguacaggugagacacaguaucaccacagguaacuuguguuucagccuuagagucuacacugccauggucuugaguggacuuguauggccuugggauagacucauauuggccaauggguagaccagcugaggacucagagucuaaaugagcuauggccucagacuagauccacuggagccucagaccuacugggaagucagaauucugguugucacagccucagagcuuaaaccugcugagggucagauucuggguauguucaguguuggacccaggaaccaggaagaccggcugugguuucucuagguugggaauaaugguagccaucagguucuguacuggugagcauucugggcccuuuacagggguggguguguaauucuuagccucagguucucucucagcccugcugcccuuguaucaugaggguugaacccuacuuccuguucuagguuucacagucuacccuggugacagaugggugcuugagacuggacaucuguaugcaauuaccaucgaaguauuugauagguccagcaacaaggucuacccaucugacgugagugcccucugggauucugauggggaggccaugggguucccacauaggcagaccaaagcuuccugugauauuccuagggcuguggagaaaugucaucgggucccuggagcacuucaagacguugauaggcuaugaguuggcauuauccccucaugcaagguuggggguagauagauaccucaggcagcagggccuguggauaguguugguggggguugaggggaggcucugcacauuggccuccugcuccuuacauggagucccugaggcuaagaguccauuuagcuuuggagagggucagguguccaggugcacuugccaccucccaagaagcucucaagcgaucaaggcuaacuauguuuagcuuuuuggcucuggaaaggcauggcagaugaguuggagagugguggccauucuucugucccuugggagaauguccuagcacccucacauagaucacacagucacuugcugugguguuagagauuuuagaagcaagccagguucuuuuuuuuuuuuuuucuuuuguagaggucuuucuguccccuguuuaagcagugacuaagccagucacuauguuugaagccggauuucagagacucaguuuucuuuuuauauucucugguuccuucuugcaacuccaggacaugggagagugagcguagucugucagcugcccugagggucacacacucagcuagaacuguggugcugggucuugggggcccgccugugcuccaugcggagggggucagaacacugggacuucauuccuuuugccugcuuugagaggcuuucaggccacagaggcugucagccuggccucccugccaccuuggaacuuuuccagucuuuugauaucacacucaucuuuuagaagcucccauuaucuaccuugcuugccuuuccagaacauccgaauugaagcugugcuuccugcugaguuuuuugagguucugucgucuucccagaaugggucuuaucaucacaucagggcuauccagaguggccagacggccaucagugcaacccucaccucugugguggaccaggugagcugaucucagcccuuuuucauguccuagcugggcccccaugaccuaacucugagggcggaaaugucaauuggcagguacuuugccccacgacccaccuggugccacugcucugauaccugaggaaacugucuuaggguuuuuauugcugugaaaagacaccaugaccacggcaacucuuauaaaggaaagaauuuaacugugcuggcucacauaucagagauuuacuccauuauugucauagugggaaucauggugacaugcaggcacacacagugcuagagaaggaacugugaguucuacaucuguauccucaggcagcaggaagagagagugacagugggccuggcuucaguauugaaaccuaauagcccaucccuagugacacacuuccuccaacaaagccacacccacuccaacaaggccacagcuccuaauagugccacucccuaugagccuaugggggccacuuuuauucaaaccaccccagaaacuuucccaccuggggcuugagcucuguccaggugcccuuuggcuguccagagacuguguugucacagacuucuuuuuccaccacccugcaccuauuucuauaaaaacgguguguaccuuucaagaucacauacagaaucuguuuggggauagcauggcagcaggcccacuggcacuuaaucgguuuugccugcucgauuccuccagcuuugguuuugucuuguacugaaaagccucaucagcccuaguagggagcaguauuuuaccaguuggcacauugucaaggguguuucuccugccucauacaagcccuccagaccugugagaggcagcauguggagagacaggaaggaccuacgcccuagacagugguuccucuagcuaagacagcaggugucuccaucaccugcacugcugcucuggguuuuggauaagauguuccaggccucaguuucuuuaucuguaaaguaggaacaguggcauccauccugugagggauacccaaggaaucaaguaaguagaauuuacaugaugggccauuaaagaucuagaauaagccuccccacuaagccugcugucuuccauauucuuaggagcacaaagcuaccuuuuauggccugguaugcccuuccucagggaagaaaagugucuuagugauaggaaaauaccuagugauaaugugguugccguggugacagcaacaaucucauccuuguaggacggagggguccaugugcuucagguaccuguguggaaccagcaagaaguggacauucauauccccaucacacucuaucccagcauccugacauuuccauggcaaccaaagacaggcgccuaucaguauaccauaaagguaggugagaugcugccuuuggauguuuucuuugggguguuuccuugggauguuggcaguuuguuugcuugugugaauucuuuuuuauguguuuauugagacaggaucuaaacuauguaguucuaacuagguugguuuagaacgaacucuccugcuaaguaagccuuuggcggauuuucuugauugaugauugagucccugggcaggugguccugggaagcauaggaaaaccacugaguggggcacagugaugaaccuuaaauaccagcgcucaggaggcagaggcaggcauaucucugagaauucauggccagucuggacuacauaggaaguuccaaggcagccaggccuacauagauucugucuccaaacaaacaaacaaacaaagauacagaaagaaagggagagggagagggaaagagaaagaaaagcgagcagggugagcacuugagucagcagcagugucauggcuuccgcuucagcuccugccuccagaguccugcuugccugaguucucucugacuccucucaucuuaugcuguaccuggaagcauaagaugaaauaaaucuuuucuuccucauguugcuuuuggugcuggugucuuucacauccacagaaaguaaacaaagacagcuaaaacacagaaauagaaaauaggucugaguucugcuuagcagucguucuucuaaaagauuauuauuuuuaaaaguaauaugaauauaaucauaggcaaaccugaauucaaguggaaauaccaccuucccuacuacaugcuuaucauuagugccucgugaugcuuccaaucccugguccucagggacugcacucagcuagggcuuaagcucccgcuagucagccuggucccgucgcucgcuccugugguccgccugaagacaugaugacagcuguccugugugcacuggcacuuguacacuaaaauaugccacuuuacaggauaggauguucuucacucagaguuucagguugaucccugaucuagauagggccugucaaucacuucuccaaagaugguuaggagcaagcagagcugugugcuggaugugcuugugugcccagagcagaauucugcuguaggauccaugacuagggagguuucugcccaggucugagcucgggucauagcugcgaauuuguauaucagucuccagguccccagaauagaucuagaauggagauggacagagaaagugggggaaauguuggccugugcgacauuuuuccaugggcaggacuuucacuguguguacagguaugauuuugaauguaugauuauguguguacaugguaugcuaauguguauauuuaagagugagcccaugagugcguguggugaauuuauggugacaauauaggugagugugaaugaauguaggugucagaugugacugaguguaaggagacauucgaauagugagugugaacaggugugugaauaugugagugagagagagugcacacuuggcccagcccuguacauccccaggcagggaguggcaggggccugacagaucccaugaucauuuccuuccuaggcccaugggggcagugggaacuucagcuggucuucgucaagcuccaugguugccacagucaccgucaagggggucaugaccacaaguggugacacuggccucagugugauccgggcgcacgauguucagaauccucuccauuuuggcgagaugaagguaagauaguggcaggacauccuguggagaggcucaggacagguuccagcugccccucucaccugcccucaggccaugcucagggguuuuauuccucugcccagugguugugcuauguggaggguugaugggcccaucccagcucugaucuccaggaaucaggccccauaauaaggauggacagaauacugcacaccaaacagcggcuggcagagccugaaaaauccacagcaauagccaggggacaugaguaaccacagaacaacagugggaaguuucccacacagaagucaggacucugaauuagaagggccgucaaggcuggacugagggcuuccuggcuccucuucucuugcucuguuaaggugcaaguucagguguccuguuacugguauuugauccugacugacuaagagccccaggugcugucagguaggguugcucacuacaucugugcuccccuucuuaccccgagucucaugcuguguccagucccagccuccucuuacauuaaagggguguggguuuucagugggauccacacacguauguuaaacauagguuuaugcucaguuacaggugaaccuaucaggccugacagaggaagugcaacuacccacuguugggaucaguugugaguccuuugccucaaccccuuccuuccucuguaacugacaccaaaggcagugcucagcaggcagcaugugccacaguuagcacuaacugcauggcuacacgggauaugaugggcaguucucuccuucucuagguguaugugauugagcccagcagcauggaguuugccccgugccagguggaggcucgagugggucacacccuggagcugccccugacaaucaguggcuucaugcccggugggggcagugagguggucacccugagcgacugcucccauuucgaccuggugguggagguggagaaccaggguguguuccagccauugccagguaaaccaguagcagaauuggggcccaggugcuauggguuaucuauggacaccagaggggccacaacaugaagaauggccuuucccuguguucuuguccuuccugaauccugccugauguguugccuuugucacuccgucucuacguucuuuuuuucuucaaugucugcaaagugucucuuccaugccugaguggagucuccugcacacauuuguauuucaguucaugaaaugcagcaggugcccacacuauaauacauacaugggguuuugauuaguucaaucauaaugccugugacaggcccaggccaccccugaguacauuuuuuucucagccuccugcuuggggauaguauuauuaguagugacugugacaguaucaguuugcauguguugagcaggcacuuugccuggaugaccuuaucuagaucaugcaccuauaacaagaggagcugcugguggaccaggcauccagugacgacacuggggcagcuuaguuguuuauggccacauguggccuguacagggauggagcacagaccugcagcuccaguuucuaugaguuguggccucccagaaguguggcuccagggaggguaaggauuuucagcuuacaaaauccacaagacacuugggaguaggcugugggcaagaacaaagauaacauucagugagugacugugcccaugccaugacccaaggugugcaguucaggcagggauugucucauggugagccuagaaugccaggaccuaucccaucauagaggucucaagccuagaggccuggagccauuggagguguuugagcagagagggaucugagucucuagugccacagaugcuuuccagguggcuguguguacccugugguuguaaugacauccagagcuacacagaagaagaggauaucucuugaaagugcccaacuaaagccacuagcugguagacucagaaaauguaauguuuccacacguuagcuauuguggguggcagaaguggcauucuaaaggagagggaccaccagcagucagagauggacugucccauguacugaucccacuguagggugcuacucagucuuugagggaaacccagggccuguaauucaacauucacagugcuguuaggcuucuucacuuacuggcaugauguucaaucucucugagacuuguuuucucuaugggucaugggaaauggguacaagagccccugccuccugagagggcuacauguggacaucccucugaacauacggaggguuuuucaaggaguccagguucugaagacagcagccaaaacaaauccuguguagucaaaauuucccuuagaaagugcuggaaucucucucagugagcaggguguuagauggaaaucucugggacucagcaggcuugggcaauggaugucuuauaugugugagagccaccuuagggcacacaugaccuguggaacagauauggcuaucaggauaaguuaggugagucaacuucuccaagccaggguacacagcaggacucugaggaagggacuguaucagguucccuauugggcaaaaauaacuauggucuggggcaggucauuucuuagaaagguuuaagaucuagaauacguagagaacuucuguguaucaacaauaaaacagagaaaugacucaauaaugcauaaaugacuugagcagauauuucugaauguuacaugucguaggcaccuuguaggaaaagaugcccacccucaucuaucaccacagaaauucagagcaaaaccaccuggaaagggcuggagagguggcucaguaguuaagagcccauguugcucuuccagaggaccaagguuaauuucccaguacccacauuaggcaccucacagcugccugugacuccaguucugggaauccaacacccucuucuggccuccccgggcaucacaugcaugcacucacauuacacacucauaguuaaaaauaaauuucaaagacgaguacacccauuggggcaacuacuguuacagcaacagaaagcauuaggauguguggaaacuggaauccaugcuccgcuggaggauguuaaagacagccacugugggaaacaguaugcuggguucucagaaccuuaaacagaagcaguaugacucagaaggucccauuucuaggcauagaccuaaggguauugaaagugcgaauguaaagacgucuuugucagccuagagcagcauuuuucacaugugcagggagcucaguagaggacugggcaggaggcauguucagcucuaggaaggaaggucuguuguggugccucacugagaagucuugaggacuuugugcagagugaacuaagccagucacauguggauacgugcuaugugguucuacuuaggugagcugcuuauaggaggcaagcucauagagacagggaauaauggcugucguuaacacuagacauuucaguuuugcaagucaacgggcuugaguggcagcugguggugggaucugaacaacccuguggccuguugcugaggugggauuguuguuguuguuguuguuguuguuguuguuguuaauaaccaggucccacugaccggccuagaaaucacuguaaagcggguuggccucugcugccucugccucuauaguacagggauuaaaagccugugccaccacaacugcccccucuccacuuuugagaugagaaguuuauauguugcgugcuucaccauaauucagauuugcuaguuagguuuucuguugcuguauuaaacaccaugaccaaaggcagcuuggaggauggaaaagccuuaucuggcuuacaguuuacacuccaucacugagggaagccaagggagaaaccugaaggcagaagcugaagcagaggucaugcugcuuacuggcuagcucagccugcuuccuuaaacagucauagaccacuugcucagagaugguaccacucacagugggccaggcccucuuacaccaauaauuaacugaggaaaugccccacaggcguccucagcuugcguacaggcagaccugaugcaggcaguuccuuaccuggguuucccucuccccagaggaacucauuuguaucaaguuggcaaacacaaauagcgcaacauuaauacauuucuugcaaaccuaauuaaauuuuuguuggaaagggguagcacagaugaaaaauagcugcuagcaggguaaauugggaaagauuucacugcacccaugcauaccugcacacauguauauuugucacuggucccauuccucuggccucagguagaagaaaugcuggaguccacuuugguguuguguagcacaggccaaacuggaagcaucuauaauguucauaguggcauguggaagccaugcugugcauucacccucacagcagagcagcauucagaaauguggauaaaggcugcccgaccaugaagacucugaggacuucggggaggcaggcggaccagcacagcuccccaucccucuuuauuuaaggcuguucugauggaaauggggaggaguuggagaccaaaggggccucuagggaagucugggcugcugguaagcucucucuggauucuggacauuguguguugagcacaugggggagaugggaagccauugccaguuguauuuguaccagaucuguguguaauauacaugaaucagguuuugcuuuuguuuaauuguguuuuguggugcuggggauggaaccuagagcucuuuuugugcuaggcaaccauuuuaccacugagcuacaacucuagucucaaguuguauaugaagaccagaaugaaaaggggcccuuaguuugccaugucuuccucuugaagaacaaguuuauguuaacauaugauuuucuuuaugcagggaggcugccgccaggaccugagcacugcaguggggucaaagugaaagcugaugcccagggaucuaccacccuccucgugagcuacacacacggccauguacacuuggaugcaaagaucacucuugcugccuaccugccccucaaggugaguugucccuguccuuugucaucugccccgucugucccccaccuucucuuuaguguuccuggagguuagaugauggucuuucuccacagauccugugguuuuuuuucuuucuuuuuucccuaaauuggcaguaagcuauggucauaugggaagaaggaaccccaguugagaauauguccccaucagauugauuuguauacaagucaauggaguguuuugaguaaugauuauuauggauaguccuggguuauauaaaaagcagggugaacaaaccaaagaaaguugcucccuggucucuguuucagcuccugacuacagguuacugccuugagcuccuacccugacuucccuuccucauggacugugauugggauguguaaaccaaauaaauccauuccuccccacguugcuuuuggucaugguauuuaucacagcaauaggaagcaaacuagaauagucaccaagugcugucauugguaccugugggcaggcuacgaguuccuuagcaccacaaccaccauaguccauaagaagcucucugucaaaagcucugugaguucucccuuugcuuaguggagacuuugagggcugugugaucucacuggcuaauucacaguuugcuucaguuaguguugagaaucuguagagugcugggcacuguucuuugccaaauauaacacggaccuagagacuugugcugggugccucugcacacaggugaggaagauaaagccaggugugguuguguacagcuguaaguccagcacucaggugccugaggcaggaggaucuuaaguuccaggccagucuaggccuggacucagugaugagaccugucucaaaaaagaaaacaaaacaacccugaaacacaaaaggaaaucgaagagagcuugggagcaagacauugagcuggcccugagcaagcuggccagggacaccugaacccugugcaucgccugucugcagcuuuguuuccugugaaagcgaucuuccacuacacacacacacacacacacacacacacacagcauucacacacacgcacacacacacacacacacacacagagcauuccacaccagagagcaagccuugagcaugcugggcaagcacuugaccacaucucaaaccuuuuaauuuuuauuuugagauaguuuugcuauguaacccaggcaggccuuaaacugcuuccuaaguagugggaguuacagaccucugccuucacauuggcuaguuuuuguuuuuuaaagcgcaguguguauguguguguuggggugggggcuggagagacgguucaguggcuaaagcaggagcuggagaaaugcucagucauuaaaucacuggaugcucuuccuguucaacucccaacguccacauaguggcucacaacuaccuggaacuccagucucagggaaucagagcccucuuuguccucugugaaugcaugugguacauagauauacacccagguaaacuacucauagaauauaauaauaagaaggaggaggagaaggagaaagaggagaaggagaagaaguaaacuacucauagaauauaauaauaauaauaaucauaaguagaaguaguaguaguggcaguaugguaggauuaauguauauguucagucuuaugcccuacauucagcacuugguaaguaaguacuguguugggaccugugcgaagugcaucaugccuucccagaaccuucuuugugaauauuaauguguugcuggcucuuaccucugagaaaugagcaugaaaagcauguuuuuguucaugaaguccuuucucucccauguagucuguguuaggauagauccuagguaggaauuucuaggguuuuauuuuaucuuauuuugaaacaaggucucuaugugacuccaacuagcuuagaacuugcuauguagcccaagcugggcuugaacuuguagaaacccaccccugccccugccucuugaaugcugcaauuaaacugggcaccaccaugcccugcacucuaguguacuccccgcuccaaugaggacuuaauucuucccaaagccccuaacucauggccacucugugccugauacccaugugaagacugaauuucaaagaggacacaggcuuugccuggcagucccccaagcaggguggggaccuuacuucucuaugccuagcauugccuggccaccuccucccagagcaaugcuaagcuuuccccuucuuucuucaggcuguggaucccucuucuguugcuguggugacccuaggcuccucaaaggaaaugcuguuugaaggaggccccaggccauggguccuggaaccuuccaaauucuuucggaaugucacuucugaagacacaggcagcaucagccugucucucuuggguccuccagccucccggaauuaccagcagcaccggguccucaugaccugccaggccuugggugagcaggugaguagacagucacucucagugccaccuugccuacugggagagacagaaaauuuacucaguccucagagagcuaugagaauguuguuccucuuguauccaagaacaugggaguccaaggcucagugagguggccugccaacugaauagaauguggcuguuggaauccccaguacacaucagcuuucuuaaagccaccagaaaagucagaguggccuccucuuucccagggcuauaguauccccccaucuacugcuguagggguagagguuugagaucaggagucacaaaaccccauguuucagggucgggcagcuuucaaaaaguuugugacccuggaccuggguuuagcacacauacuucuucuuucaggauuuggggguaugugccaaugccugaugugugaacuuuugguuguuuugagauaggguuucccuaugcagcugaggguggcuugaauggaaugcacuuuauuauuauguagcauagguugaccuugaacucacuuugccucagcuuuccaagugcugagauuacaggcauaaguuauuaugcccaguuucagaauuugguuugguuuugguuuagugcugaaaaccaaaaaauauuggaagauuaagaggacugaaccaagcgugucguauccuggguucccgcagagccugcauggcugggcauaguacccuauuccucaggccuggccacgucugugugugggccuugcacucuucuggcuucugauggaucuguuucugagaguccccauacgggaacagagagcaggcagaaccaugaacugaaaagugagagugaaaagaaugcagagucgggcuggugagauggcucaguggguaagagcacccgacugcucuuccaaagguccagaguucaaaucccagcaaccacaugguggcucucaaccauccguaaugagaucugaugcccucuucuggugugucugaagacagcuacaguguacuuacauauaauaaauaaauaaaucuuuuaaaaaaaaaaaaaaaaaaaaaagaaugcagaguccauugaagaugcacauguacaccuugacagagcccccugacaucagcaauccaaagcaggcugcugugucaaaggagugccuggagaaagcccucacuagaggugcuaguagaaguauaggacaguauuaagaacaagaaaagcugaggcugaagaaaugacucagcgguuauuuaagacuaagaguagcaacgaauuaucuuggcuugucugagucauuggaguuccugccuuggccuguagaaguuauaggucaggucuccucuaaggccuacacucucugggcuuccucacuugugguaucaugggcagaaagucaggaggugccuuccuccuccugccucagagcagacuguucuguccucaaguugugugucacugaggaggcuggggaugcuagcucccucaggugcagcuguuagcuguauugcauauaaaaccagaggcugcacuugacuucaguggccccagucuaaccacaagcaggccuuucugacagcuccugcucuguccugugcacuguugcauaguuggccucucuccucuagcucggaggagcaagugggccuggaguuaggugguuccaccuguggcucuggccucuccacugggcuuuguccuguacauccccuuuucugacccauuccuucacaguuaaggucucuuaaccuucagggugcagauuccuccaucugugucucgccuugaugggugugaaguuagcacagauuccucuuucaaauguccaggaccagcuucagcuauggaguuuuccugauguccuggggaaucaugaggcaucuccuaaacugccucuucucugagauguuuguagaugguaccugggguauaggcaucgucacuguccuacggacguuaagucucaguucagagaggagggacuacgcucaggugucugacugcuccucuuguuccuuuaggucauugcuuuguccguggggaaccggcccagccucucuaaccccuucccugcuguggagcccacuguggugaaguccaucugugccccaccauccaggcucacucucaugccugucuaugcccucccgcagcuggaccuauccugcccauugcugcagcagaauaagcagguggugaguauggccacucuuggggagggaggagacauugccugguggaucgacaagagaaccuuagcucccugcacccaugcauggucuugacuguucugagagcugggacucuauaugcaggcaccugaaucuuaacagccagagcugugugggguguuuccauuugcaccuugcaugagggaauccagggccugcaaaggugggagacauuccaaaguccaguugcauagcuguucccagcuuacagcgagacauacauacuuagcuucugguuuucuguuauaggggugggaagguggcaggcacuuguuagaagccaauuuggaguuuuggucuuuucccaggcuaguacuaaacaguucaucuucccuuaauugugugcccaguggagccagucacagccucagucagcuucagcaccauaggggaaacugaugcucuguggagcucugcuguccauaacucaugggcauucacucagucccaugucuuuguguacugucagcugaugucaguggcugucaugucagagcacauguaggucaggcuggcugaggggguggggcacaacaguccaugguguguuaacucaagauggugucauuggggugugaccucauccuaaguccaggagcuucuguaguagccaagcaagacacaaccccucaggcccagacucgcuguugcccucugcugggcaccugaggagcuguagagcccuuguggagcauccugugguuucagcuguucgugagggguguugucuuuguguguggucagaaugggacugggggcugugaggagagaggacaucagcauuguauugucacagggcagggcauuccaaaguaagugucaggaggggaagaaagugccuggggccuucaaccagcggugguggggguaacaccuacagguuggcuuucccagaagcaggucagucaacagguucaguccucagcucuggagucucauagcccccggcccugagugcauccagcucagggaugugggagaaaguagccucggcccugcauggaggaaggaagucaugguuuccucgucccuccagcacauacucugguaucccuccuguguacaugguggcuaaggccaguucugugggcuuggaaccuucaccucauagccucaucucccccaucaccaugaccaucucugaggugggcagaguugaaaaugcggaaccagcuuuauccgucuccaaacccagcagcugcuccuccuagggucuguguuuucccaaagucaucucagaguagggcuugaucaccucugugcauccaggccucccacacaucugaaugaaccuucugaugcugaguauguccauagccuuuccagcuguggggcgggugcugugagccgggucccuggugggugaaagacagcucugccuuugauccucaccgucugguggaagcuugguuaggagagcuguacagcuguacagccugggccuugaggaccagccuucaucucuccugguggggucaagcacaccuguuuccccuacugcucugguguggaucugugaggcgguuuugccuucucuggcccuuguucacccuggagcugagaauuaauacuccaccgacccccacguaucuccuucacuugcuucacuugugccaguaaggaugguuuacaguaagagguacaucaaggagugggaagugggguggggguggggguuacagacucagaaccugcagguggcuuaagccccagugucugcugcagaaucaaugaccgucucuuuuguuuuguuuuguuuuugaccuuggauuggggugcucagagaaagacuucuauaucucaacuugaagacuuguugagaugaaauccucaagccuuuuuagcuuuuuguuaaaccacauuauugcauaguuacagcauacacaguguguguguguguguguguguacauauauaaaaucugugagcuaucaaaucagucugggcaacccuuccuuucaaaugauauuuccauuguguugggaagcuucagacugcucccuuuggcguucuucauguaaucgauuauucugguauuuaguugccccccugugcugcagaaccccagagcauacugcuccccauguucagcgcuacaucccauccuucucccccccccccccccguaucccccccaagccuccagugacucccgccugcucuacucugcuucugugagaucauuuuagcuaccacgcaugugugagggcccacaucaccugucugugugugugucucucucucucugccugguuugucugcaagcuuuaccuuuuaguucacaucuguuuuguguaauuguccuugguagagggaacagcauugugcuaaguuuggauucucaagaaacaucugucugcugggcucccagccagaggcagggagcaaaagucagugaagaaguuucaccaugauuccaacaggagagauaguuggcuuguguucaagcccccaccugcugugggaaccaaugauugauggugacagaggccagugauggguuaugugacuagauguagagucaagagaguagccaugauacauucuguguuuucugcuuaaaccugcuuguggcuuacaguugggcucaguggcaacaccaagucccuucuguggccuguggaaucuugggacccuggucccuagcuguucuuaccccugacucuaugccuuucaugcuugaauacguugucauuuccccuaccagucaguccuagggacuuggauaggcugagcccuggggcuuguagcucccccuuucuuggccccaugccuuccucacuguaccugcccuugccccuuauuucuuuauccagauucuucuuugccuuuggcuucaauuaaaggcauaccugccucugcauaccugaccccuccucccaguccucucacuccccgguuccuauagugaccuauuacuguagaauuugcuugccuaguucagucucugccagucaccagaacagagccuggcuccugccaaaagcucagcaagcaacuguggguaagugagcgccaaaccaggagcacauugccccugagucccucugagaggcacccucguguagacuuagggacacuaagacagcaagagcauggggaauggaugcuagccgggagagcaucgaccuucauguugagcagucugcgcugcuaagcugcagcaggacaaaaaccagaucacauacagaugugucuucccugacuuuaagcaugggugaggagcccagcaagggguuucuggucucucugcagccagacuggguuaguccagggcugccuuggacugaaaggugauggcgugacucuggagcuugacucagaauggacugcauguuguuggugucagcaagaaguaaugggccuuggacacagaacugccgugcgauccaucagucccuauauucccaagccaugagccggccauucaggcguggccccugcgauuuauggucccauuaggggaccuugaagaagauauauccccaaggugcaucuaggugcaguaucaauuuaguuuuauagcucuccaaaugcagaagccaccuaggacauguuugcaggguaaauuauuggcaaggugaaauaccaguauggagucaaccagcgggaaugauugacuguagucagaccagggcagguccaggucuugcaggcaggucauucaguguuccuuuuacaaucuugggugcugcuguguaccuggggacugauuaguccgggauuggguugagcuggugccuaaggagcaagcagugucacagaaguccuuggagcaucuggccugcuguguucugcucuaagccugugagagugugagcaaguucuggaaagagucugagcuacagcauuucauuuuguaaagugggaaagcucuagucagccugcaggcaugcuugcauagagcugaugucuuucccagaaaagcacugauuuucuaccagaagcugggaggaagggugagaugucuggggaaagagcucugcagucccugcccacacucacagcuccccaguuuguguccugcccaguuaaaacccuugguguacccaguuggagagccaaguugcugauaugaaagagugguucuuaaauugcagcaugcuuagucaugucuggaaccaggagagauacaagaaauuggagagggauccuggagguagaggcaggaagcuuggugcaacaucaaucaggguggccaugucacauuaacagcccccaaccccacagcuacauaucucaacugugcaauguaagcucagcucuugccugcauagugcaagagucucaagauguccaccaguaagagccauuguacagaaaguuugugcuuaggccucagaggguccccuggaauuaccacaaaucacuugucacaucucacuagacuuagugaguuaccccuaaggugacaggauaguccuuccuucugggcugugccugaauggauuauaucagcuguaagcuaugcuagagcccaccccaucacagugugaauugugaauuugucucucuaaaaccacaguacaggauucauauuuaaaauaaaguccugggucaguaguuaugagugcuggguucaguucucagcacccacaugauggcucauaaccauccugcccucuucuguccucuacaggcaugaggcuuacauauguauauguagggaaaacauucaaacacauaaaucaaucaaucuaaaaaaaaacaauaugaaaaagucccagccgauagguuuugcuuccuacccugaccgaagcagacaaagauggaggccuuucugccuuccugcgcaggaagagcuggagccaagggucaauccagauuuagggagauacuccugccucuccugggcugccucuccuuggcguguacccugugucuguuuguuagggaaaaggggaguccuuaucaccccuggagaaaaaggagccaaucugggcagaacuuugggcaccugaaugauggcauuccugaauguugguuauagcucaucucugccccuucaccagccacagggaaacucccagcuucauggcaugccuguggcaggcaguagugccagaguccuggauguggccccggcaucugaucauuguuucuuuuagguuccaguauccagucaccguaauccccuguuagaccugggugccuaugaccaacagggccggcgauucgauaacuucagcucucugagcauccagugggaguccucccggccauugcuggccagcauugagcuugaccagcccaugcagcugguaucccaggaugaugggaauggccaaaagaaacuacauggugagccaggucuuuagcuagagggccuggagcuggaagagaugugggaagcccuagacacacaggaaggauccugcacuaaguucaugccucggaccucaggcgucauucagaacugaaccauggaacacagagagaguucagaucccuaucccucccuuuuugagacagagucucacuguagcacuggcuggcccagaacucacuauguagaccagacuagccucaagacauugagauccaccugcuucugccucuugagugcugagaugaaagacaugccaugacaguuggcugcugauuuuuuuuuuuugagauaagaucuccuuuuuaugcaaucaagcuagccucaaacagaucuuuuugucucuugagugcugagaucucacacaugggucaguauacccaguuucacuauuucuuuaaucccauuuaggcaugugggguaggaaccaggggcucaggacccagagcagccagaucuccugucucagacccccuggccaagccguggcaguaacaaacuuccucagccgcccaauguugaacuuguccuuucaacuuaucucagcaacuguucuggaccuguuaauccuuacaggacuaaaagccucagcaaacucaguuaccuguuucaaaacuugaaacugaaucagcagcaggaugagguagccccaagguaaccaaggggccugugacugauauuuguuuccugucugugcccucagguuugcagacagucucgguucacgaggcaucaggaaccacagccaucucugccacagcgacuggcuaccagcagucccaccugagcgaagccagagugaagcaaccgguaucuuccagaggacacagugggugggaccaugggcaaggccaggacggauccugguuuuguguagauucugucuggagaucacuaccugcuugauuuuuccuugcuucccagcaucucuugauggcuucaggcuaaggugcugcuuggaagggguugggggagagggauccaguggguacauuugaggaauuagaaggcuucuccaaggauggaccuguguggaugauaccuacccugucagacuaccccauaagcugcuacugaaaugguggagacaguagauacuuguggacagggaaaguggggggcuuguguccuugagagccaggaugcuaagacaaucaggaugcuaauuccucugggagaaaucaguuccccuuuggauguuuugauguucacuuaucccugucccaaaugucuucuccccauuucguucuuuuguagaacuuguuagcuuuugagaggccucacuggggcuccucucuggagccucacaccccacagauggccuuuuaagaacuucacuuaugcuuccaaccucucugggggccagggguucucucugccucccugguguccccuggauacuaacaccgcuugaagcuuccauuccuggaaugaggccucuaccuggagcaucuagcucgacucuuuucagagggaacugguaguguccauggucuuacggaucugacaguguuggccuuucucuuucagcaugacccucuaguaccugugucagccuccauugaacuuauucucguagaggaugugagggucaguccagaagaaaugaccauuuauaaccauccugguguccaggugugacccuuugcccaccaccccucaagugaggaacugugcacucuuugcuacccagccugaccccucucacccccacaucucccugcagguggaacucuacaucacagaaggcucuggauacuucuuccucaacacaagcacccaggacaucaucaagguggccuaccaggacacccggggcguagcucugguaagccuaggcauggagaccccagcugucugcucaggcucacauuauuccaggccucccugguacugagcagagccuugagcuucugagcagcucugaaguucucugguucccaugcuaccucugugcuuucucuucugcaucugcaauuacccgcacuguuaauuaccuaauucuucccuuucaaucaaucuuacgauucaucuuuuaauuauucuuuuauuacauaaguggcuuugugguaacccuaagacacuugcauuucaaagcuucuccugugcucucuucacuccacuaccucuccacaguucccacuucacccucuccuacucaaggaccugauuggaccucuggcauggaggaggaauggagcgcccugucuccucaugccccgagcugcucuuucuuucacaucgucauguaguccaaaguuaccuuacuuguacuuuuggcccuuuuguuagcgcaggauuagagcucucuagauccucuuuuuuuuccagugguuuaguuuuauuuuuugugcaugaguacucgacugcaugcguguauguguaccaguguaucaaguacauugcaguguccucagaggccagaagagggugacagaucaccuagaccuggaguucuagcagguuaugaaaggccauguggauguugggaacugaacccagcuccucuggaauggcugccagccaaugcuuuuagucacugagcuaucucuccagccccuaaauguucuuuucuuaauagagccaaagaaagaaaauaaagaacuguccuaauugucuacacaugugucuuaugggguauuuauguagcccuuaaaugaaaaguuacucuugaaguccagaaugauaccugcacacagugucaacacuugccuaaucgggcaucgccacugggcagcucugagcucaaacucugcuuccucuguugaaaguguacuugccucauuccuagagucaaggcucccccucacucugaggagguccaagaugacaggguaguggaguggagggcgcguggcuucaauccauaaaaucugguuggcaggcuggcugugacuccccaggcccuuuacuuuuggccuugccuuguuccugcagcugagcccugaaaggcuagccgcaguaaggagguacuuguguuccagagagggcucugacccagacaaugaccgaggccuagcaccuccuuucagaaaugcuggagcauguuguccgccccuacuccgucugucaugugcugguguugguggauucaacuccccacauuucuguugcuccugauuuuucucuacacuagcucucuuagccuauagaucacagaguuaaugacacuaagcuggacagaggaaccaacugggugugaggaaugugacuggaaguauuggacuugagggcuaacuguggugcugaguaucaggagcugguggggacagagguaaaccggaggguaugggauuuaggggaugggggacgaguggcagugugugccucuguugaugccuuugaugcuggcucuugucuccucagcuucaugugucguguggagguucuuaguauguuacagaugugaacagccacccuccaccaucaugcuuagaguguuuuccugccugggaaggaaaccgaauagcuaccuguuaccuuugagcucuuccagacucaucccuugucccagcuuuuaccuaauuuauuacuuaucucuauagauuuucccauucugcacaguuccuugugaggcagauuuguguucccugaggaguaaagccauccaccgucuuugugccuuuuucugucuucuucaaauucuugugucuuuuuggauaaaugucuauuuagaaccuuugaugguuauucuuuuuauuaaguuguagaauauauuauauucuagauauaauucauucaugagaugugauaugcacauauuuuucauuuaaggcuuaucuuuuuuacuuucuuuguagcauacuuucaagcuuauguuuuuaauuuugguuaaaauaaaaagauaaaaauuuauauuuuuuauuuuuuuuaauuuuugauuuucuuuuaaaguaacauuuauuuacacaucuacuguguuggaggugaggggaacaugcaagccacagcauguguguggaugucagagggcaacuuuggcaguugguucucucuuuccaccuuguggguucuggggauugaacucuggguaggagccuuggcgaugagcagcccugcuggucugugcuucugccuuuccugacccccugagggucuauggccaauggcacuccugaugguuugcucugucugcuuuuaaguucugucuacacugaguuaacugugguguuggugggauccgggucuucuguuacgagugacucuucagcuguccuggcagccuuuguucuuuuccuucugcacuggaugauucuggcauccuugucaaaacccagcagagauaugagcucaguucugaggccaccagcucugcgugaguucugugcgacccacaugucuuugcuuccgucgcaccaccguguagacauugcugcuucauagcaaguuuuacaucgugugagucuucuggcucuuucuucaagucuguuuugacuguuuugcaucccuuacaauucgauauaaauucucaagucagcuugucaacuuauauaugaagccagcuagaauugugccaggacuuaggucggcccuuuaacaguauacaaccucuguccaugagugugagguauuacccugucaccucggccuccuuugauaucuuuugguggugggucuaguugggaguguuaaguuuuauacuagcuuuguuaacuuuauuucuaaguauuuguuauuuuucauguuaauaauucuaaauagaauugugucuuaaauuuuauuuuucuaacauuuggcuuucugcauauuagucucauauucuguaaccuugcugaauucuuaggaaguuuuaguggauucccuaggggguguguguguacaaucaugucaugugugaauauagguaauuugacuccuucccuuugaauuuggaaguuuugaucucuuuuucuugccuuauugucuuggcuacagucucuaguacaguguugaauaaaaguaagagaauagccaucauuaucuugcucuagauuguggggagaaagcuugcacccuuccaucacuaaacaugauguugucauuuuacagaugccugaaaugggauaguaguguccacggggcuuuuaggcaaggcugaaaguauuuuuaaauauguuugugaagauaaagacagcuagcauuccucaccccacccucauccuaccuugccucuguuagcuuagaugcagaugggccucuggguauucacacacucaguaccuccaagguuucuucugauucccagagcuuccagcagaaaaugaauggguaucuccaugaugcugcuugcucuaccucugcucagaacuuuuaucuuaccugugagagaagggugaggguauugggcaauaauacuguucccuugaccagaucguaaaucucugcuuccacccuguaaaggaguguggucauacuguaggacucuggucacagacaugugagguugucaugggucuuucugcugucagacugguugacacuggauuuagagcagaugcccacuacauccccuuucucgcccaugauuggugagucagagaucagcucauguacacaggugcucauaggcacauagguggugguagugcagaccuaagcgaauucuggcuuuucggugaccaacaagcugaggaacccaaggaugugcuuaugagcaagcuauguguggugcugccuuguuccaguuaauaaauggccaucucugcaucuuguuuagauuuaaugaagaggcagcaucagaaaagccaggugagaggagacaaguggcucaggggaauacuaugguugcaccucacuccauauuccuaccuguguucuaacugggcucugugcaagguugacuuacauaugauacugauaaggucagcaaacucuguguccaccuucggggagcauccagugcagcugauuuggagccugugggagucagucauagcagcugugagaggggcguguauauacaugcugcugguugagaggggcguguauauacaugcugcugguugagaggggcguguauauacaugcugcugguugagaggggcguguauauacaugcugcugguugagaggggcguguauauacaugcugcugguugagaggggcguguauauacaugcugcugguugagaggaugcuccuuuccccaggcucucuaaugugacaaugcacuggcucugcuuauggccuggggaccuuucguuuuucugucccucuuuccuauaugcuuauguguuaggccuuuguuuugaaaucuuuuguuuccauuuuuaaaagauuauuuuuaaauuuagcauuugaguguuuugccugcaugugugugugcagcaaaugcauucagugccugcaaaagucagaggagcacaucggagccccuggagguagaguuacagaugguuuaagccaccauaugaguggugagacuagaacccagguccucaggaagagcaaccagugcuccuagccacugauccaucucuaacuuuuuaauuuuuuucaaauauuuauuuauuuuaugaaugugaguguacugucuuuagacacaccagaagagggcaucagaucccauacagaugguugugagccaccaugugguugcugggaauugaacucaggaccucuggaagagcagucaguacucuuaaccacugcaccaucuuuccagccccugacuuuuucauuuuuaugauccuggggucucccuaaauuuucugguugaccuugaacuccuggcuccaaugcuccuccuaccucagccuccugagcagcgggaacuguggcugugauacucauacuuuugccaagcguuuucauuuguucgccucuauaaaagaaggaauaauuguacaccccucugugugagugugccuugucaaagcuugacacuaggaggaaaagcuuuaguugaaauucauccgcacaucuggaaacauaccuuaucuuuguguccuagagauuaaaaauaacuuccugcuaucaagaagaagggaauuugaaaucgggagaugugugucaguugccguagcaaccaacaacaguuccucuuagauaacccuucuugaguaagcugagggugaaccuauggccagaagaaagaccuuucaucccggagcaagugcucuuccgagacugguuuuggcuuggcucuguguauaggcagugagcagaagcuggaaccuuuguuugaaagacuaagcccuacaguuuccccuagaaucuucuugagacacugccauucugggguuaccucuguguggguaucuguacccaucuucacagggucccagugggcuacagccauucugucccauggccagucuggcucccugggaagcagcaccuuggaggcaggccuucugaguguggcuuccaucccagcaggcucuauggaagaaacacugaccuugggucucugcuuucuccuccaacuacuucaaggggaaaucugguccuguuuccuucuucucuggaaccugcaggaucuuucaggguguugauaggcugugacgggugcucccagcuuccuucagagggcugucucugaaggacacauuugcacauuucuuuggcauuuugcagcugcuaauuagcagcauccucauuucucuucuucacagacaagaaagcccacagccguucucacguagcuccuagacaaugcuucguucuucucuauugauaggcaguggagacgccacaguggcuccuguauguauggaguuggcuuuccagugucuuuggaagagaugugaguguguaauucacacagcaggcuaugguggaaguuuucaugcccacacaaugaaccccaggcugagcagggcugauuaguuuugcucacacagcccccagaacccucugccagggaccuuuauuuuauuuuuggcagguuugcacaaaggaguguuuaccugauuuaaacuuaaaacuucuuccgucucaaccauuccucauauuucaugaguccuccgagcacagccugucacugagaacuuggugugcccugaguacuugacacuucuuuuugcuguguucauuugagaaagcuuuagugcauaauaugaugguaacaaggaauaaggcucgcaggcucugcucuggagagccauauuuaucacaggcucugcucuggagagcccuuucuuuaucuccuuaguacugcaggauguggucagccaugaugcccuaggacauaugcagaagcauacuggugaugaauugguaggagguaauggcuguaggguuugaacucaaguguccacaucgucuguggggcugguuuguagaugguauggugccuacuccauacucucaccuuugggaaacuugcagagcugaccacagcaugauguuuuauccaggcugacuccuggauaccuguggucuucaugugagcgcuggucaucucuguagacugcugggugagagagacugaagauccaggucccaguccucuuguguggucgcuuggccuacuucacagcaucagaagagggagaagcuaauggucccucccagugauggucagaaaucuugcugaggucuuuauucaucugaaaaugucaccugccacaacaacuuugaagugugaacgggccccaggaaggcggggcuggugagcucaugggccaugcagcgucuuaaugagcaauaaugcauucaucaucuccagauugaugacaggacuuccccuugggcucaguacuugaugacauucucaguggcauugucaacacuuagaaaugagaagaacucuuuccagacacccccacugccucuucucaguguucuugaacguccaucaggaagcauguggugacagacucuugagaaguaugagccaccuacagucuagugaggagugguccagggucccuguguggccaccagcuguugguuggcucucugugucucucugugcuauuucuuugucuucagcaugaccucacgugucagauucaaagcuuuguuaccaggcaaaacugugaagugaguccgggagcugagcaggcuagaccccgccgccuccccacauucagccuggcacuguccucuccgucugucauccggaaggugacagaauguccauucucugggaagccaaguggaagaggaauugauuuccccacugccauuuuaugccuuuguuuaaaaugugcaaagugaauuuuuuuucuuuuuugaaggacauagggaaaaacaaaaaugaaaaagcccacccacgucugcguugcccacgugagucugucggcagcgugugcaccauguaauuuccucagguuguaaaggacacgccagcuccugacagcagcagcuccugcaugagcagcagcccagggcucaggucauguucucagaggugcuccuuccuccaugccgguuugcaugagcuuucuuuaggggaaauguaaugacagcaaagccagaugacugguagcuucuccacccauacuuaauguggcuagcagcaacagcucaaaucccacagccaucauuuuggaauguaaguaugauucccacccugggaaucuuuguuaaucuacuuuaagccaucauauuaaauaagccaggcauacuucaucugcuuagaugugcccuggagcgcaguuacaccugcauguagcagcuuggcccagcuuuccaauuuugucuacaccugguuaccugugggcuuaggccuuucuuagcuuagccuuuccuuacuggccucucuccucuguuccugcucuggaagcugcuggcccugcuucucugugaaggaggcagugccccugaauggggcacuaagcuacuugggucggaucccuagcuccccuucaggcuguuuccacccaucuuugaggcaugguuuguucuucuguaccuugaaguugcuggaccagaauccauagggucuguguucucugcagaggucuucagaacuucccauugcuaaccaaguugguucacgcaaagcugcgaaucuauguccaaucaagguguagagguuuugugcaggcugcuagccagacaccaggcucugugugaagucuucuggaagauacaggucagcauagaggggaaaggcaagaugaaaaauuccacagugaugagaggaugucagcccaguggagggaaggucauaccuauccagugaggaaagugaggcuugaaauuggagcaacaauugagggcugggguaagaggcagaaaguugguuguuucccuuugguagagaaccuaucugccacucucccccccacccccccccacacacaaauucuugguauuggaacucgugaugagcuucuuacugaaugcauuuauagccugagccccucugugacagaauguaaucggcagucagucacugcccccaccccccucccugccccugccugcucagcugaaacacaugccugggggacaugugacagguuccuguuuaaugucagacgucuccuugaggagccacugcagcugaaccagugcuuggagcugcgguugcuucuggaaaaucuccacagcauggggcugcaugggugaggaaggcugagggagcuaguagaacugaggcaguggaaagacuaggaaguccaagcuuguguuuguuauucaccuagaacuucuuaguugguuaugacuccaagcagagcuggguugcagagauggguaggucacccagcagugggcaaccuggguggucucuucucagguccauugugcugugaguucagagaugaauucccuuuggcagcagcugcccccaguucuaccagcuccugacaugcaccuucaucugggggcaugcugcuguuauuagagccagcugaccaggccauccuggguuugaagcuuccgcuuccagguuaccauguguguguucucacaauugcaagugaggcugcaccuucaccaauggccuuccaugaccucucacagugccgagccucagcugcucugcgugaccccuucaugccuucaaaaccagaaccaccugggugacucuuacacauuaccaaguccagccacagcacaaaguacaaccuuggcuaucucuggaacacagccucugugcucucagaaaacacuucccagaagaugucaccucaaugaugcuucggucaagucccccucgccccuauuuguauaaaaugcauaaaguugaggugaaugcuacauggaguccccccaggaguaauacccucugcagugcaugccccggcugcuggggugccugaggaaaggugccagaggccuucuguguucacuucuuugaagcacugaccagguaguuacugcuaaugacucuuugaacagagaugggaccugcagccuugugacccuguccgccucugcuuugcaggugcacccucugcucccaggcucaucaacugucaugguccaugacuugugccuggccuucccagcccccgcaaaggccaucauucacgucuccgacauccaggagcucuauguucgagugguggacaaggucaguagccacuucugcaugccacccucucugcugaugcacauaaagcagggacaguguauccugggaggugcuuccuuauacccuucgcuuuucuuccugaguccugccccaccucugaccacuccaagcugccaccucugacuccugugcuucuuacggacagugugagcugacaucccuacuauauuucuucauuccauuugucaucaguaaagcuugacaguaaauccugcaggguugacugaauuagccuugacuugggaaugcauguccucugccucacauagguuauccaccagccugccacacaccuugcugagcuuggaguuuugacccggaauggggagcgggggaaagauucuugggaauuucagagacaaaugaguaaaacucaguacugccaagugcuccuguguugugaauaagcaacagacagaccuagguuuuccuuuugugugaaugggaaucucauuuagagcugagguggcugaagcuagguuucagagcuuacuacccagucccuguuuccugugcugaugaaaaggguagugguugagacuucauagcuaaaagcauuauuagcucaaaagcuaagagucuguuacccagccucaaauauuccugaguguuuucuuagagagacaggcuggcuguguaucucaagcugaacuuuaacccacucuccugccucagccucuccugaugcuugcuaccacagccaacuucccucuagcaucccucuagcuuccuaauggaugcauuaggaaaugugccugcugauacguuguauagguucagacacugagcuccucuguuccccugugauucuaaacuguguccugucucccuaauucaauugauugcccacggguagugaguggaguacaugccuugugcuauggccaagucucccacccccugggcccuguauacuuacuguaaacucguaauuuuucacucauugauuagccaaacccagacaucauucugggugccuuguacccaguuccuaaguucugauuuagagguuggugaugcugucucugaaagccuugggugcuacgugguggaggaaugaucacugagagacuaccugagccugugccuuagguggagaucgggaaggcugucaaagccuacguccguguguuggacuucuacaagaagccuuuccuggccaaguacuucaccuuuauggaccugaagcugcaagcagccucccagauaaucacgcuggugugaguccucacaggagucaggaggaagggugucuuggggguggagcugauuuccauuguagucucucaacagcucuuccuuggaggagauauguaaugcgucuuuuugucucaggacucuggaugaagcucuagacaacuacacggccacauuccucgugcaugguguggccauuggccagaccagccugucugcaagcgugacggacaaaucugggcagagagucagcuccaccccacaacaaaucgagguaguucugcuccuuuugcccugugugggcugcaucuugguuggacaugucuuucuggugacaggcuaggauuucaaccacaaggagaagccacauugaaaucugugacuucguauguucucugagcaaaaggcauagucaccagcucucaaguauguagauugcagcaguuagaugcagaaccagaaggagcuugagauguugacuuccuucugaggcacagggguccagguaguucagagaaaugcuugugcuuugucccauggcaaagggacaagcagaaauucuuucagaagccauaaacugcuuuuaacuuguguacugcuaacuccuacaguccugagccuuagccuagguccaggagggccaugagcaccuaccagggcugugcagacagaaggggucagaaaggagcuuccuggggcaggucuuucaggagcuccagggccccuacaccaucuuggugugaugcagucuauucugcauccagguuuucacgggcaccccacuguaggaagaagucagggcagccugggucaggccaccuuacccaagaauccccagauauccacuagcagcagcaacaguaccaucuccagcagguuuccgccacacagggguggcaggcuucauugaucugccuuuagaauggggcagaggcgguuugugccuccagauggaagugugccuuccuccuacugguggugaggaauucguuucugccuauaaauagcucaacccaaccaagacuaauucucagcacagagcagucuccacgcucuccucggagcacuucuuacaugcuugacaaguaggaacuugugggggcuguggggcaaggaugcuacagaaaugggguguccaccuuggguacugacuguuccugagcccuuccucuuacaggaaaaugauacaacuguugaaguagagcccuguuccaagacaguuugcuuuuaguagugcuagaggcagcucuccaaagagggaguaguuaggauucuggagaugagagccagucacaacuucaaaagucacccucaauuaccagagagcuugucaggccucaaaucacagaaauccaccucuggcucccauaggucuuagauagaucagaccagagaaucccugacaaguccccaaaagaaguacuagugcugcuagcuggggcccacaucgaguccugcacugagagauucauagguuucucaagcacugugugguaccucggccccuacugguuacccucagcugagggauguucauaccccaugaucagugcaugucauguacagccagugccaacuugcagaugccagucccuucugucucugucuccacauccaggucuuccccccauucagauugauacccaggaaggugacacugaucauuggagccaugaugcaggugggagccacugugggucuacacaggccuuccuucagugucagcaucucacccuugagggauggugaggacucuccagcauggcaggugcugaugagagccacuguuucucacuucucagaucaccucugaggggggcccccagccucaguccaacauccucuucuccaucaacaaugagaguguggcagcagugagcagcucugggcuggugcgugggcucauggucggcaauggcucugugcugggagucgugcaggcgguggaugcagagacuggcaaggucaucaucgucucccagguaucucacgugccacugaugaguagcucuugguguggucagauuucugcucgguuuggucucugccuucuugaggacaccuaaaccuaagauggcucuucuacagacuaagucuccuaggcucuaauagcuucucucugggauaagaucucuacuaucccuagaccuacagguucucugguacaugaggagguauaugcugcagaacacugaucucagaacuuggcguuccucgguuuauguuuugcuaccuucugccuuugcagaugaauugugugacaaaccugcuaguggcccguggcuguugugauucugagccuuggcccaggacucacugaggucagagcucugaguccuuuugugcacugucugcaguggcuccugagcaugugguaacaggauggaagaggccaguccugaugagaugcucugugugugacccuauaugccuggauucacagcagugugcuaaaagcaugcuguaugguugccaauaauucuagaccuggauuuaucguucaguguucugcucgucucuuccuuaaccacuggcccaauggcucuggcugccuaggcucuuugguggacuuuuuuuuuuuuuuugaccagcagagaagcuggaagccccaguggaagcaguugucuuccccuggaggcucucccugacccacaccagugauauugcugacaagaggugacagucaguuuucaaagccugacagcgucccuuucaggaacgcaguggggggaucauuucugcuccccagaaagccugaugauaaaaucagaagagcaucuggauucccugccaccuccacccccuuugccacaguggcucacacacaggcauccuggaagacuccugugauuccacucauagaagaggucaugugugcacugacagguaguucauucaagccucagucaccccaucccuccaggaggcccccugugggcaaccugugccacucucuacacugggagcaacuaagcacaugccuggaggccugaugaauggccauccccaugggccugguaguccugguucccugaggcugacuuugauccgacauugaguucauugauuggcucccuuuucuugccguuucaguaucugccuccaagaauccaaguuaaaccacaaagucuuucugaauggcagaggcagccgucccaguucuguguaucgauuuuuguggagauggcaaggaagcacuaagcauuuaaaaccgucccaguggugcccaggguucacacgggcaucccagagagugaaaugaaagacuccagcauguccugcucuguuucuucuguacagaagacuggcuucugaagcaggcucuuuuuuaucuccucuggucaggcagaaggcacagcccuggcccuccccauauccuucuuucuacucuugcccuaggucucccagcuguaccuccucucuggucucaccuugcuaggcccucuccuucaccugucucccaucaugguccuuggcaggaugugggcguugugucuccagcuauucugagaaggcucagccuguaguuuccacauccacacugggcauaugauucuaucagaugcugcuggcuccaucugucuaauccugagcacagcagcaucuuaaggccaaggggugauucagaaacagcuggaacugagcagugagaaagaucagggacaagaaggacuuacuggaccccuccuaugaagcaagcacuuacuugccuaaauaauggcacuaggcgaugucuuuucuauugcuaugacaaaaacaccuuaaccgaggcaaccuuuaaaagaaaacauuuaguugggagcuugcuuaguuuccaaguauguguccauguccaucaugacagggagcauggcagcaggcagacagguauggggcuggaauagcugagagcuuacagcuuagccauaaccacgagaccacgaggaagagacuagaaaugccaugggccuuugaaaccucaaaguccaccuguagugacaacaaggucauaccuacuaguccuucccaaacaguuucuccaacuggggaccaaacccugaaauaugggaguuuauggaagccauucucauuuaaaccaccacagcagagaaggaauauggacuuuacacaugcagugucuaaaaggcuauacaccuuauuagcccaaggcccccauuaguuagcagcaucugaagaagccagugcaggaggaguuagucuuuggucaaauuaguugauacauggaauuaaggauaaaggaaggguaaggccuguuggcuaucagauguccugguuccucuauucaucccuguauccuggugagucagagaggcagauaggcugaguacuggaguugggaauaucugacaccuguccugagagguccacacagccuagagaagagcaaaucggguucuugcuaccagccuguggugcugauugcagcaucuggauuaaacaggauagagcugcagggccaggaccagacugggacucccaggguguagggagaaaaaaggcuggucccauggagugagccauccccaaagcaagaccuccucaggcagauacucauucagcagcuaggcugacaccuggcuaugacaccagaucaugggucugugguaccugcucugucauguauguuccacacacuugucccauugggugauugcaguaguacucgaggugggguuggcucacaucacaaauuagcagaagggucauucugucuaaggucacacagcuggaugugguucuggugccuuguagcuaggcaggugccuucuuccccuggaggguucuuaacaccccagauggccugaaccucugcucucuucuaggaucuugucgaaguagaggugcuacagcuccaggcagugaggauccgugccccaaucacacggaugaggaccgggacccaggugaggugggagccugauaguucaguauaacucugagcccaggcucuugacaggccacugcuggaacaucaugucaugugagggaaccaccucuacccuucaugcauggagcauguugauguguggagaggugcucagacacauacagcacgguguuacacucaccgccggacucuaaguuugugauuucuucacugaucccuaugaguuccugagguugcugccuuucuguggcuaggcugacacccggucugacacacuagaucaugggucugugguacuagcucugccauguaugcuccacacacuugucccuuugggugauugcaguaguacuugaaguagaguuggcucacaucacagaugagcagaauggugcuauucuacccaaggucacacagcuggaugugguucuguggucucuuagggaauguagucuccugaacaauggagugacauucucuuccauccucugugcuuagaguuaugccugggugacuuacaacaccuaauaugcuguaagugcuucuguguggcugucagaccauauugcguagggaauaaagaugagacaaaguccaagagugucccugacagacucagucuuuucugcacuguuuuggugcaugacuuaggaaccuggggucauagagguccagugguaagugaugggcuagucuggcuuggcguccuuuccuuacuguuagccacaucacccucgucagcagcaggcacucagcaaacaggugguaguguucaccucacuguauccauucccaagagcagucucccugcugaagcaggagagaggccugaaggcauggggcagcugugugguauuguaagguaaauuugggcaucuuagagcucuagggcccauuucagaaaggaaccuuacauacacagccuuuucccacaguagcauggagugaggauuaaucuggacuauguguguuguuugcauugugucaaacuuccugauccucugcccuggccuugucggguuaagaaaaaggagagcacaguucccacugcacaagggaggcaggaaagcuuuggggccaguggggauggagaugucagggagugggguacccagugcugcuggaaccagcaauuacagggccuggcuucccacagaugccugucuuugucaccggaaucaccagcaaccagagcccuuucuccuuuggcaaugcugugccaggccugaccuuccacuggucugucaccaaaagggauguccuggaccuucgagggcggcaccaugagguaaccacccagaaaucccaacccccugucugaaucagcauccuugcugggugaggguccuaccacauugcugcacaggagucuacacauugcuguuuggagauguaucugucccuguucuguuuccacaacaaaauaccagaagugggauacuuuauggagaaaaggaguuuauuuaguugucagcuuggggaguuucacagugugguaccaguacuaacaguguccugaugagggguugugggucacaucacagcaaggcagucauggcacauggcaguugguaugagauguguagagagagauggaaugaugaaccagaaagccagggcuugaagagagaagagucuaugccucguguguguguguguguguguguguguauguguguguguguguguguguguguguguauacuuaccuacaucugaacacacuguuagggauuaaagucuaugaugaccccuuuugaggacagugcccccaacagcagucaccuuguucccuuccacauggucuccaucaccucuugugcccaaauuuacaauagaagaacccuaggggacaaaccauagucagguggcugcuaacagaaggcaacacgaugaacaaccuugcaggaaagucacuggacuuccagaaaguucugggacagagcauguaacuuugcucuagcuuuuugucacgaugccagaaaguccugggucuuugcucugauauagcucagggcaaacuccugucuaucagcccuccaggaucccagucaccccuaagaccuuggagcuggacaggaaaagacuuggaauuaaagcccauggacagcaaaggacuugccuaagacuugcccagcuagggagaacugaauagaguaccagcuccuauggcucuaggcucuaggcacaggauccucgguuacaguguccugagggagguugccauagaaggccauucuggucuuugccacaaugguggagcugacagcaggagaaggccaaagccauggaagaauucccuaacuccccagguuuauacaccauagggcccauacuuguuagggccuuggccccaguuccaagauauugcccagauuguuugcauaagacaccagcagugugauuauccagauacuauguaucaguggcucugcaagaaacccugcauggcccagcaugcuuuggagugacuacugacacauccguggacacagagugcuuggggacaugcugcucuaaagacaguggcucgugugugaacacagagcuuucuaaacacucccaaaugcugaaaugcagcugguggugcuggaaggacacuguuucacucuggguuugcccucugacccuggcaguaagacaguggcuuugaaaaaugucagauuccuuucugggaccagugucuccaucuaucaccuucugaggaugcugggguccuaggccucuguccuggaaacacauuugaugucuuucccagguaucuauccggcucccgccucaguauaauuuugccaugaauguguauggccgagugaaaggucggacuggacuucggguuguagucaaagcucuggaccccacagcuggccagcugcauggucucggcaaggagcucucagaugagauccaaauucagguaaggggcuggggucaagagccacaugaagggagagagcacugguggccugaguccuaggaugggggcuuugugccaccacagccacgagggccucauagacugcugaggaauuugaggcauacauccucagucuccauuauucaucagggcaggaggcagguggagagaggagaggagaguauacagaaggugccagggaaggcagagauaagccugacuacagcuccaaggggagagggcuuggcugguaaauaaccugugcaguggccuggagaugccagaaaugcagcucacucuuaggucugggagcauccugauauugggacaggagcccaucaugucugaaguuuaauccugcgcauuuauuuaacaaucacuucuagacuuccuaauagaggcaggcuugcuuuucucugcuucuguaauugacaccuccaacgaggaguccaacagggaggccacuuguggaugaaccagaggcccaaggaacaaaggaucaaggccacacagggcuggaggaauuguguucuguccuguagcaagggagggccuauggccccaccgagaacaacucagucuggcuccgagauuccccuguuagagccuguugucuucguguucuuuucuuuucuuuucuuuucuuuucuuuucuuuucuuuucuuuucuuuucuuuucuuuccuuuccuuuccuuuccuuuucuucucuucuucuccuccuccuccucuuccucuaccuccuccuccuccuccucuuccuccuccuccuccuccuccuccuccuccuccuccuucuucuucuucuucuucuucuucuucucucucucucucucucucucucucucucucucucucucucucucucucucucucucccuuccuccuucuggaugaguguaucucuagguccucuaaaacaugggaguuaggcuagagaaauaguuguugguaaaguucuuacugugcaugaggaucagaguuugguccuuagaauccauaaaaaagccaggugugggccuagagaggcggcucagagauuaagagcgcuuguugcuuuuacagaagacccagguucaggucccaguacccacauggugauuuauaaccauugccagggaucugaugcccucuucugaccuuuguggguaccagguacacauuuagugcacauacauacauugcaggcagaacacuauauacauuuaaggggggggggggggaaagcauggggagguaaagacaggggaauucuuaggacuugcuggccagccagugucaucuaaucugcaagccccaggccaguaagagucugucguuaaaaauaagauugacaguacauaagacauaacaccugaggauaaccucuaaccucugcaccaacacauacaugagccuacacacaagcauccucauaggcucgugugcacaugcgugccugcaugcacacaugugcacgugcgcacacauagacacacaccucugauagaggaguugauaacuugccucuggagaggguguuucgauucaagggcaucuugcugcugaucugggauucuguaaccccugacaccuuguaagcuacaaagaaaaacugaagguauccccugaguaccaggagaaagaacaaaagguucacacccccuccuggagaagaaaugagcuuuucuccuuccucucuuccccucccccucacgcaugcuaagcuuggggacaaagaagcugauuuucaaagaaauaacuauucucuucuauugccucugcucucacaugugcgugcacuaacggaagcagagaccugcgcucacacucacacagggacacauagacaagugucuacacaaaggcacuugcaaguaacagacaagugaguuuagagguuuacccacucagauacagacagacacaguuacaaagaacacaugacuuacacgcaggacuuaacaguuuugagucugagugggucuguguccauuucccuccucgacagccacuggggcuauaguaagccagaccaggagauuggggaccaucccacaaguguguuuuguuguuguuguuguugccaguaugguuuugcuacacggcagaaacagcagauaaaugaagcccagcuucccuguacuugaagccccacucucuaguucaccacagugccccaccacucccuggugccugccccacagaugcuguuucccaaggugcuggucuguuggccuucucacaguugaugauaaagugaguuuaccuccaucuaaaaagaagaugcgcuuuaagggaauaggaguaagucugcuuguggaugaacccacugugcagccagggccuccagucagucaguggggccacuccgugcucaggagcaccugucuguguggagauagccucugauucugccccaagugccccugacaccaaagcccccugggucuuucugaggcuguuuuucagcucucccuuugggaugaggccuuuugccucagguccagucucuagagacaggagguuccagaacccacacagggaucugcuguagagaucacagaggugcuggaggaacaacuugaacuguuuccuccucagagagcugcccaucugcucaggaucuguacugucuagaugcuuauaccccuugggaggcccauaugaucccaucagaagcugagaguugagugcagugucagaaugugugggcccuugaaucaggcuggaagcaaucuaaaaucuaacagcuccaggagacuuuaaacagcaggacuggggugguaaugggcuauauggagaaaggaucaaauuccccucaaggccucagaauaucucuugagugaaaggaucauauuuggccuggccuugucauacccuaaaggccugcccucucuaucacaccccaggccaccuggaagauacuaagagcaacuucacaucucuucucagcccucacugagggagagcagaugcucagauuggaugugggucugguugggguaggaaauauggcucacucuuuuccagguauuugaaaaacugcggcugcugaacccugaaauagaagcagaacaaauacuaaugucacccaacucauuuauaaagcugcagacaaacagguuugugacucagcuccuguuuucugugaggacacucucgucccauccgacaagccauuugucacaguugucaggugcccugggugcaugcaggggaucuuucaggguggugugcuugaauuagguggcuucugcaucccccccucugcucuucccagggacaugcuugauucugccauagccuuucaggaucccucuucuguucccuguagccaaaaaccauuuuaugagcacugucgaauucagucuuuaaaagggaccaaaguaccaacuuagaaguguuaaauuuuucaaaugcuccuguguuugcaagacucgccacuugaaguagagcccaugaauuagcaauagcaguggcacuggggaacaggauagaaugcagagcuugggccccaucacagccuaccaaaggaaaagcugcacuuaaguucccaggaggugagggcacaugcccgugcuggugacuuguuuuaaaggcuggcuacaaacagggcucauccuuagauucaccagggacaccuuucauaacauggcuuacacuucaguagcaguuggugagugggggacucugggccacacaaccauguugccugaggcacucaggguucauucagccagaaauaacucaggagcagaugcggugcuaggcuguaugaccacagaggugaaggacacacagugccuucaggggcagcagaaggauggaaagaaagugaugugugacuuucagguggagcccagagaaggauuucucuguagagauuuagaggaggggucacagguggagaugccugacuuaagggcaucuuaaaggaugaauaagacuucuuuagaguacaaggagggagcugguagaagaauguucaggcagaggcuguaccauuugcuuaaacucaucuagagaagaucaguggugcaagcacagcugcagaguuugcagggagugggaacuagaggucucuccuugguugccauguugaggagugcaugaaaugcugugagccuuuccuuuagcaguccuugcaaauagagguccauacagcucaaagcccccacacuguuccccacccaagcugccucauuucaagaagagaaaaugacuugccauagaaacgaucuguuuuacaaagugugauugaugaaacucuagucucaugguuucccauccugaugacugacccuuggcuauaugcuguucucaaaguugugaguuuuccgaguuagacuucugugggugauugauaggaccacgagguccugucugguaagucacagaugugaaaucuucauauuaacuugcugggccucccugugccauagcuucuccaugcaucauaaaaacagaucaucuuucuuuccaaagggauggugcagccauucugagcuaccguguccuugaugggccugagaaggcucccauuguucacacugaugagaagggguuucuggugucgggcucuggaauuggaguguccacccucgaagugauugcacaggagccuuucggcaccaaccagacuauccuugucgcuguaaagguaagauugccuuucacacugucuguaaaagcucagacgugacacucucucagguguaaaagugauucacccuccagcugaggaauucuacuuaggaauuuauccaagaacacuugcaggcaaaagcccuggcuagauugcgagccacuggguccaaauguccagugauugauucugccuagauuguuucagagaaggggaaacugaggcacugugacauccacaaaaggcucagaguccuagagaacaagcaugaugauggucucucuucuuccugaccacaggcauucccaccacccacugcugcucaggucagcacagaaccuggguauagucaguucuuucuggcauaacguauacucaguaccagacaugcaaauaauuguaucaacucugaggacauaguggcucauuuugaaucagagaaacugacucaggugucacucaaggcuacacaguagcucuacacuguguucugugccuacuggggacagagaccuccucgggcacccugucacauuguuaccaccuucuggauccuagaggacaaagcucacucagucacuggacgcuuugauucagggcuggacuguagcuuguuuuauuuagugggccaagcaaaugcagcccacuuacuuuuugaguggcagaaaguacgagguguucaucauaucccagcccugcaacaguuaaccuggcuugugggcuuuggauuuugauggccucguggaggcuucuugucuagagucaggaugauuguuuaccugccguuuauggggccuggauucagagguggcucuaagugucccacuguugacuuccaucagcaccccugauguagggguguaggcgcguggcaccucuucuccauccagugggcauugcuucuacuucacgugcccugaggaccuucucccacaacucugaacauggcagccauggcacagagggcauucuggcccugugaaccauuaccuaaguuuucaguccuggauccugccucaacugagucucuuggaggcugacuagcuguauggggugauagaaaccguguugcuaggugggaacucuaaaaagcaaagucuuucuuccucacacucagaagucagcccgccuacuaagugucccuaaaauagggacccacuugggcagguaccaccacacccaaaugcuguccuccaggucucuccuguuucauaccugaggaucuccaugagcccaguccugcacacucagcacaaggaggcgcugacagcucugccucuggggaugaccgugaccuucauuguccacuuccacgacagcucuggagacaucuuccaugcucauaauucaguccucaauuuugccacuaacagguaggacauaggcauuucuuguuucccaagaagcugggcuuguuguaucuggguuucauauauagguucagaugggugaugaaagaaaggcaaaugcuauggaaggacaauggaagggauggcaugccacaccacacaggccaggccuggaagcagcaaguccagucaagaggcagagggagugaggggaagaaaggcccaggccuuugucuguauguggcaggaacguguuacuugaugucgcucccuaaugggcaggaagcagagcacaccuacagagagacuggagguuuuguggaaggcucuccuugugaccaggaaaggaacgcgcagggaaauguagcgucugcagaacaaggaacauggcccacacugcauggacacaugagagagaagccacacacugaacaucuguguuacaucuuucugguuccucccuuagcucuguuacagaggcccagagcagucaagccauuugcccugagcuaccagcuaggaaguaagguuugaauuuagccagcuccaagcaugauuuucuuaggcugacuuaaucccugaugcagccucgauccuggugugagaagggagagggugacaggagggcccagucuucaguguagccugccaaauguuugagucugcuggauagcaguggcucucugugcacaucuccccucugacaucagcauccucuggguaguuagagauacauuucuauagaggucagcacuccaugauuuuaaaggucgguggccgcugcccuagggcauugcagagguaugagggagacacuuuggcugaggcuggggcuucuugaacuauccagauguuaguuaccauuccaacuuggcucagaacccugaagaacagggauaaggacauucauggcaggagccugagcaggaaaccuaauccugugauuuugacaagguagcucaucuccccaaggcacucccaccucucacacaaagaauauaccuaacccauccauggaaaguucucaugagggucucuguauaacuucagggcacuacucauaguaccaucugucugccuugggggaaguagagcccaggucuggccaccguuagccauaccauagaagucacucaggccuagcauggccagaaguaccuguucauagcaaccauuuuggagucagcauggaggaggucugaauggagucagacaacaugacccucacuccuaccugcucuaugcuccccucuggcaucccucacaaugagggucucgcagguguguuaggagugccuucccacuaccagccuuguuugaucccuacaacaguugcaccauauccguccuugcuccugcuugacaggaccagacagacagcacagcagugcuugggccagccacauggugaaaggcagccugcaccuuuuuggcauguccucugugggucauuuucuuccuugggccucugcuucccucuugagugugagcaagaugauguuggcagauccgugcugagugcugaggguugugucucaagaagugucaagucuguguuccuagacagacagacagacagacagaugguacuaugaguaguucccugcaguuauacagagacccucgugagaacuccccauggauggguuagccacaucugggaccacaguuagccucaauguugcucaguaggugauagggcugcauacuuuuucuguuuccccucugccuucuuuacugagcuucagcccgccuuuccccugucccuagagaugacuucgugcagaucggcaagggugccaccaacaacaccugcaucauccgcacagucagugugggcuugacgcugcuccaugugugggauguggagcaccucggccucuccgacuucguaccacuaccuguccuacaggccaucaccccagaguugucuggagccgugguggugggugacauccucugucuggcuaguguucuuacuagccugggagguaagagggaagugacugguucaugcuaggauauggcacugccgaagaugcuuggugccacaucguaggaguuguacagguggcucggaggauacugcccaagggccacauucacucugccacuuggcaaugccuguucauuuguaguuagguagcaguggagaugguauuggcagugcagcugucuacauccacucucuagugguuugcagcaaaagucuguccuccccugcuuuggaauaauacugcccaguaggauugucuggucuuguggaagaguccuaugcauauacuuuaucacccaguugccucugcaagcacaugcuuaccauguggcugaugcagcgagggaacgaaccuguaaucagauagauuauguggcuaguggaacauacguacaugucucugggacaccugagcagaaaaugaauucccacaucccuguaaguuauacacagauauuugcuuuuuuuccugauugguccccuugcuuuagucucuuuaauuuacuuccaaaggaaauuaaguaguagccagguuugguacuuacaccugcaaucccaacacugaggaggcugagacuggacgcuugacaugagucugagaucagucugaucaguacagugaguuccgggguagucuagcaugcaaugagaccuugucuuaaaaagaggaaagaaagaggagauagggcaagggaggaagauagaaauaaaacuguuuuugaauuauauuauuuauugggaacaaaguggcugugugaaacugagccuuuuuaaagaggcauuuaaaguauguuauauauuauaaaaauguuauuaaguaaauuuuaucuguuuaauccagauagcaauuuuaugaauaaucaguucaucugggcuggaugauuguuguuguuguuguuguuguuaugguuuauuuuuauuuuauguguaugaaugucuugccuguugcugggaauugaacuuggguccucugcaaagcagagcagaaagcauucuuaaccacugaacaaucucuccagccuaugauuucuuauuuuuauuaucaacacaucgccagugaggucucgucucuguuuuuaaagaggaagugacagugcuggguagugagaugggcccagagauauggccccagcccacccaggacaaagaauugggaaagggucuugugaaaacagauuccagaugggaagguacagggggagcuggggccuccugaacaggugcagagggagaguggcaggcggccagagcugggaaggugggaggaccacuuuauaggucuauguggauuccucccugaagcugaggaaucccucacagacagaggggaguggggagcuagguuugggcuaugcguccaaacaaaauggaugauaucuggguuuauucucccaggugucucagggacauggagcuccucagccagccauguccucuacguugacccuaagacaggcguggcuauagcccgagaugcagggucugugacuguuuacuacgagaucgcugggcagcugaagaccuucaaggagguaggucuuggacugagagcagccagaagcaauuauggccaaugaacccuguuagaggcaguaagagcaucggugugugucuguaacuagacuuggagauccauguuugcacuugggaggcugaggcagaagauuauuuugaguuugagaccauccuggcuuacauagcaagacugacucaaaacucaagcaagcaaacacacacacacagcccaccauugcauccccagcacaucguaguguguaugccccuagauaccagaaccugagcaugaccagaucucuuuacacaaaggcgugagaccucagcaccuccugccuauuuuuauuuuauuuuuauuuuguuuuuauuuuauuuuuauuuuguuugguuucauggucuguuuggacacagggucuuacuguguagcccaggguguccuugaacugaaucucccgugcaucccugguguuugucacccccuguaugcuugaaaucaccucugacuuacaguagcuaauucaugcuauguccugugagugguuguuagccugugagguuuaggaagugccugucucugcucagaacaaaugcacuuucccucugacuauuuuugaucuguuguugguugaauccaaagcugccaaagcagcagguacaaaagccuggcuguaccucugauuccuuuuucuuuaagaaacaaauaaccaggucuccugccagagcuugucugcagcugucaagaucuaggagaaucagccacccacuaagugugagaugggaaccaguucccuguccaucccaagcauccuucucacguccaaaccagcaucgggggagagaucuggucgauugauucuacccauccaccgacacccacaccugucuggcagccagcaugauccugcagccauuggggugggcauuuccuucagggaguucaggcauggggugggcaacccagugauuuggcaucaccuggcaaaguauaacuucccccccagcaagucaccuuugagucuuuaugaaagcgaacaaaacccuuucucuccagccgagaacaagccaaugacccuagucuggcugaguuccaaaccugucucauuuuuagagccagcgugugcuuuaucgaauccagcaguuuaaccuaauaguuuacauauuuagugcugugguucaggcgaguggcugcagauagaggcacucugauuaauaaagcucugcuccacagaagaggccccuaagaauggucaugagaggaaccagcagucaccaagguauaugggauuugagagaggacccugggugagcuggaucauaggauaugugugggaggaaccuauggccuggcuuuauaggcaggucaugagguuccgggcuaggccaggaagcugggugcagugguuuaaggguggcuuuaacugggcauaucccugcagugucacuucuugagagucugagauuguagcagcauaaggauuuuagggcaaccuagacucugugcccaagggauacaccacacugugauguagcauacuuagcuaacagggagggaguagguugguuggcacuuaguaucuguucuggcugguuugugugucaacucaauacaucagagagaaaggagccucacuugaggaaauaccuccaugagaucaagcuguaaggcauuuucucaauuagugaucaaugggaggguccagcccacuuuggguggugccaucccugggcuggugguccuggguucuauaagaaagcaggcugaguaagccauguuaagcaagccaguaaggagcaccccuccauagcuucugcaucggcuccuaccgccagguuccagcccugcuuugaguucauguccugacuuccuccaaugaugaauugugaucuggaaguauaagccaaauaaauccuuuccuccccgacuugcuuuuuggucaugguguuucaucucaguaauagaaacccugacuaagacagucucacaaguguuuacuccucuguguuugcugcuaauguucccauuggagagcagggugguagcuugcuuaugucagacuacauaaacuuugguuuuaaaucagaaugaugcagaucagaggcacauagugguggaguugcugcaggauguccugcugguagacuggauggggugguguggaggagggcgugggguaacguuccuggaucuguccccacugaccugguaugugaugguucuuuauucugaguagggaauagaaguaaggguguaugcuggaggaagacagcgaguggaugagggaguguuugaaaugggugucacuucuccgacugaggugggaagggcacaguugggugcuaaguuugcagccccugugccccuuccugaagacuggggcugcacagggcugucuagcacagggauggugcuauaccugaaugugggauacaccugaauaugggaugaucauaacaggaguaggccagacagagaaggagaaacugagaagacccaucaugaacagaaaaaaaaaaaaaaagaaaaauggaaggcagggcuacggauggcaguggugggcacuucuguuggucccuugggcagcagcuacuccuggaaggaagcaguacagugaugacuggaaguacugguaaggccagagggaccaaggccccccuaaaugguggggcugugagcugccccaccagggaagggagccuuuccugcugccaugacuuuacugcacaaaagggacccacaagaagagccuccaaaguacuugcccccaucagaaagggugaucaacaugcuagccaaagaggggcaugggccugugguucuuacagagaaagauagagggacaucccaguggaggaaagucugcacaggggauagaguaugcacaagggguaccaggugggguacaauaccaggugggguacauccuagcaggcuggccucugggguacccuuauucuguacacauuugggucugauugauccauucugaauaaggaucuucuguccuugugacaggauuaguuaaccagaucugugagcagaggaaagaugauggcaggaguauguggccugcccuggaccacuaaguggguucagcccgcuguuagcccuggccuugcuguugauccaguucugccagguacccugucucuaccuccugccuuggcuuugauaucagaucuagcuuugcucucauagggugggagaauugggguggccuguuagggcucugacagguaacccugccacacuccgaccaggauuuaagcugugagcucauuagauuguguugccugggguguaggugauacaagcugcaagaaaggucaugaaaucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaaucccuaauaaaaaauggaaaaaaaaaaaaaaaaaaaaagaaagagaaaagggaagucagauuuaacuagucacauuauauuauauauaauauauucuauuucaauaaauaaaaaggcucaagcuaaaaaaaaaaaaaaaaaaaaaaaaaaagaaaggucaugaaaaaugcccaacacaagccagcaugcacucgucgcucaacacaacugacuuguuucccuagauaguggucggcaccccucagaagauuguggcccgucgccuccacucugcccagaccaguauccaggaagccacagccuccaaagugacugucagcgugggagacaggagcucuaaccuacuugguacaggaugagcaggccaugggcauuugggcuuaccuugccagacuuggggagcggggaguagccucugugcccuuuagguaugguuuuaucuguuuggguuuuguuguuguuuugugguguuggggauugagcucagggccauaacacaccacaagcacaugcuauaccacugagcaauacccccagaccucuuuuucuuauucagacucaccucuaacuccagagagagccuucagcccccgcucauccacucuuugcagcucuuaagaaacacgaggccuccauaagccaaagcgugaaaggugccuucauaaaagcacagcucuaagaaacugccugggcugagucagagcugugauugcagcccuagggcaugagcagagcaagccacaguccacugcagcugaugguagaaacuaaugacaucgcaggcugguggcugguuuugauuuuuauaauuaccucucccuagucaugcauagaacauuccaucucacucuucgccugugacagcccuggacagcaagugccagaaauaaauaugucgauacagauuuuuuuuaaccacuuaacggaugaauuaaguuccacuauucucauugugauuaaugggguacauuuacuacaucauggaaaugcuguuuuccuccuuuagugcaagugggaaaauagucuacuguugccagaacuaugugcagcguguuuauggagagccucuguccccccagugugcagaagcaaauggccaauggccauuucuccuugcugauuacaaccaggccacacaucaguagauuuccugucaccgugcccucugugcaggcucagcgcucaugcuggaauccccaucuccagugacccuggcacucagaguugcucauccucugggucaggauccuuauguuuaaugaaagacauaguaccuucagcgagccucauugacugcugagcucccugggaacaggauuggauacuggugcuaugcacaccugucccgcucuguagggccuugcucccucauuuuaguuggugauggcugugguagccuugugcuuggcccaagcccuucucaucucaucacugccccuaacccugugccuuuaggugagugcuccccugcccagcgagaggccauugaagccuugcaccccgagucccucaucagcugccaacuccaguucaagcaagaugucuuugacuucccugcuugugaugucuucaccguggaaccaggauuugaugcugcucuggguaaaguugcaaagaauuuaaaaugcagugaaugccagcuggauaucugggguugguccuaaguguauacuacacaauggccauauguccagauaggcagagguuguugggaguccagccuggcguuguuaggcuauaaucucuguuacuacucuaugccugccaaggaggagucgccuuugacaucaccuacacucugcagagcucagcuccaaacccagacuggagucuuuuucuauaaucccaucacucagcuuugaauagaggcuuauacccuucuaaacccuccuuucuagacugaggaugcccuguccuucacugccugcauagagcaagugagaggugacuggcaucauaugaaauagucgugagcaauauucaggcaugcuaagacacagccacuccaaagcucaggacaccagagugguugggcugacgaccagcacuuuaggcuggcaagccugccuggccccacugcauggcauggaaugcugcuggcugagagggugcagggguaugguugauggaugauugguauccuggccucaccagcaucuagcacagaggagguccuuguugaacaaggaaguuuacucaucuagguacuucuaguuaugugucguugauggagucuagcccauguguccagauucuagguugcccaacugccugaggcccugcuccuuaauaccuggcucaucugcccugggccaggcacuaaggacaggacaggacuagacagaggcugucaacacaaccuucugcugcaccuggaacaagggcaucuuggagucagcucuaucuugaccuguagcccaggguuggaucauguaucuauguaccauuaucugcccuugcucuggaccagguugccuggggcuugagcugcagagccggcccaaacaugaugccugucucaagagugcuauucagugcaaaccucaucaucagaaaauucugagaaagugagaggaccauugguuacagagaagguguccaggcuggcccagggcucugaaggggguauuccuagaaggacuccuggaggacguagcuuauuagcugucucucaagugugucuuggaguuccccugucauagcagggccaaggugaggaucugugcacacauaggagaacaagccuucucuccacaggccaguaccucugcucgguuacuaugcgcaggcugacagauaagcaacugaagcacuugaacaugaagaagacaucacuggcagucacugccuccauccccagcaguuauaccucuguagagaaggugggagcugagguccccuucaguccagggcucuaugccaaccaggcagaaauccuuuugagcaaccacuauaccagcuccgaggucaaagucuuuggugcuguggagagucuggaaaacuuggagguaagcugcugugggggcuuugguucaggccagagcugguucagauuaggauuuagaguugugaggcuaggguuuggggcuaggguuagggcucagacgaggguuggcuucaggcuuaaaguuagaaauauuuuuaguugccugguuuacagacuaagcuuaguguuaaagguugggcuuaacaauguaagauauuagaggcuaggauuaguggcuaugguuaguggcuaggauuaguagguaagguuagugauuaggguuagaaugcgcuuuguacaguuagugcaggaguuagugcauucugauucaggguacccuguuccauguuggaauaggccacugcuguacaugcuuuacgguuacugccgcuuccuccuccuccccuccucuuccuucucuucuuccuccucccuuccucuucuuccuccuccccuccuccuccuccucuuccuccuccucuuccuccucuucuuccuccucuucuuccuucucuuccuccuccucucccucuuccuccuccuccccuccucuuccuucucuuccuccuccuccccuccucuuccucuucuuccuucucuucuuccucuucuuccuucucuuccuccucuuccuucucuuccuccucucccucuuccuccuccuccccuucuuccucuuccuccccucuuucucuucuccauccccccuuccuccucuucaucuucuuccucuuccuccucuuugucuucuucuuccccuuuucuucuggcugauaaugacuggccucugaggcuucaguccagaaagccuacaaggagagcucugaugugugguuggaggaacccuguagccugcuucucuugucuugugagcagugguuaacugcucacaagggaugaagaagaaguauauaguugcuguggcaaccugaugggcuagagaugcugcuuugugggaacuugguuuuaggcgcuacuuuggguaggcuaacauuuuuaugcucaacuagaauucaguaauauugaucaugcccucucuagcagauucugaaugugggccaugcuucgggguaucagggcccaccugguccugggagagaaguccagcauaugugguuagaaggguguguccagagaugagcuggacacugcggucccacagugugcacucccugcagagcaugccuccucagcacugccuucuucccaggugaaaucuggauccccggcagugcuagccuucgugaaagagaagucauuugggcuacccagcuucaucacguacacagugggugucuuggaucccacagcuggcagccagggcccucuguccacugcccugaccuucuccagcccugccacuaaccaggccaucaccauuccagucaccguggccuuuguguuggaucgucgugggccuggucccugugagucauagaugagauaucaacugacccagaucugggcagggaaagcuggggcagggggccuuggguaucggugggcaccuacagcgugaaaguuggacaagucagaaacaaaaaaugucucucaaaguggcagucucuuucugucaccagugccauaauacuucccuugucacaauauccucagcaaagaccugugcucaaaauccugccauggcuccgucucucaaguguaaagcccacguccccccacagugaccgcugagacccauauggucucuccugcccauucauaacucgccuccuccugugcuuccugauccagcaccaaucuguuucuugccuguuucuggaacaugagaccccagucugagucauuggcaucacuguuuacucugcauacaaugucauuucccauugaccuauguccucaacugucucagacugcccgucgagcauuaccucuugguuaacacaggauuagacucuccuccucccaacccacccuccagauauguguuggccuauggagaaguaacauuauucaugacugggacuccugcccgacugccccaggaaguccagugugaggacaguucuuugcucagggcccuccugaugccaggagcuacucacuuccuacccagcuauguacagacuuguccugcuucagcugccuguggucaugcagaggaugcagggcauggagugagggcccugcagucuggugucucucuaccaggaaguacuuggggacaaguagagaguguaauaacacuguuacauaggcagcagggaucugggauucaggccacuccacagagguggauagcuuuggggcagaagugcugcccaccuacacccuggggcucuuaggaaggagucagaucaggagcuccuauccugugagccucuggcccaccaaucgcucaagcuuuaaagcucacagggcaucuuccagaacugccucucuuucuuuggagcaaccuagcugccuccuugacagaaaggacaccaaaaccugaugugccaagcugguaccuaaggauacuuucuggaaaggacagagauggccagaggagacagaaggagaugcugcccuugucuagacaccucacaucuaagacagacucgccccugcaucccaggcaguaggacaugguggaccaugcagaugucuaguggcacaggcccucaggggacccagcuauggcucuggcauuuugaugucugucuuuguccuguugcagauggagccagccuccugucacacuuccuggacuccuaucaagucauguucuucaccuuuuuugcucugcuggcugggacagcagucaccauuauaggugaggccaaccucauaccccuuucuccaccccgcacccucucacccuacucacucucaccagccucuauucuugcagccuaccauacagucugugcaccccgggaacuugcuucaccccuggcccucacgccccgugccagcccucagcacagcccccacugugaguaccucggccacaggcauagccuagagcgccuccacuagagucaucuccuggggaagggugggauccaggccccgaacccuagauuucacagcuugugucagagcaaaagagacaguuagagcugagccccagggacagaugugccaggggacaagagugucacacagacucagauauuagucuugacuccucagaggcauccauccccagcaggcugugggaugggaggaguugguagagacaguguugucugagcaggggaauuccagaaaagacaggcagggcuaccacugagaggucagguugggaugggaggauggagacucuacacuguccucaugagagauacucccacagagaaagauaggaaagcccacuccuuucaguaaucuauuugucugugaugaccuaaggucuuagucacccucuacaguuccugggguaccuuucucuaagagucuucuggaauugugcagugcccaguagcccuuugucuccugacucccauuuggcuuguguaagaggcccuugagcuaguguuugcucaucuuaguguuagaggacagcuuuauggccagaagugcacgcacacccacacacacacacacacacacacacacacacacacacacacacacacacacgcacgcacgcacgcacgcacgcacacacgcacacgcacacgcacgcacacacacccuguuaucaaagccucuuccuguugucucuggucuucaaggcaggacuccugaguauccuagcaugcugggugguagcuguccucauggcuuuggcuugaugcacagcuauucugcuacaguccuuucugacucuuccucccaguguuuguugaaguuaccauagggucuuagugacaaaguuccuuucacuugccuccagguccuuguuacaauagcauugugcucaagagucugguucuuccauccucuuggcuccguggagagauaacaggaugugucaugugacccaccccagacuacugacugagcucaggaaggucagaggucauguuccaggcuaaguggauauaaauauuuaugaacccuacacaucccaguaaaucucauccacacccuccacaggauuagcccagucuagcucauaagguauucauuggagacagaaggcugcuggguacagaagcacagguugggcaguguacuuucccgugccuccccugccccugucaguuucugcuguccuagguauaagccccuggcaugccaugggcacacacugaggaguauaguggggauauuggcuauuuauuccuucaugcucacgucccuuuccuccccagaucuugccucaucuccggcugcuuucaacacacugccuucuggucgcaaagccagcccucccucggggcucuggagcccagccuaugccucucacuaggcaaugugcagggcugguauuacuacacagcugaacugacaccuggacagaagggucacugucauuuucacaccggggugaaaccacgccugggcccuaggccauccucacugcccuggccgugcugaaucacugccugauucacacaagcaagggauuuuaauuuguuugcuuuuaaaucucuuucccagucuugagggucagggcuuccugguucccuccuucucauguggugugcaggguuugggggugcugcuuaaucuuguauuuguucugcucgaggaagcucgcuucccuguucauggcuuuugaguauuggaagcuguuucuacaucaucuacagauaaugucacuguagugaucucagggaaaggauuuucucaugacuccugggguuuuuguggugcuuggaauagaacccaggguuucauaccugcuuggcaauugcuuguccauuggcacaugugcacaccagcccuuuauuguggguuuuuuuuguuauuguuguuguuguuuuuuguuuuuuguuuuuuuuuucaugaaaacucacucuucuccuuauccuacugcugcuaggaaaugugggggacaagcagauguggauguccccuaggggacaccaugcccagagcccugugcugacugagccuucuuacugugauaguuacugagccucagcagaguggcccucccuucagagccccgggaggacuucggucuuguuucagcagaagggcuucugucaccaggguuggaguaccucucgcucucccugaggcagcuugggaauagccacagcaucaucggcccugcccugcagccacuggcagggaucuucugaucucuggguuuguucugagaugcugcugugacuuguggagcagagagacccagggucaucugcucaucugccuuggaggacacagaaugcaguaccucaguggaucugagccacccuauuggcccuccucucccccuccucugccaccagcacucgccucgcuagcccaggagcgaagaggaugccuugggaauacgacgcaucuucacguccaagcucagggucauggccucuguuucagguccaggugcuguggugcugucagaaugagccagagacucaccuccaaguggacguguaugggcaccacgucaccaagaguuguuugccuuugaaggucaugugugauccuuugaggcugagccauaggauggacuuucuggacgugaggauagagucuuugugcccagccagccacucaaucucccccgagagcuguuaauggagucuucccugcauuuguuuaauaaaguucuguguaguuucuuaagg

SEQ ID NO: 3223 - RNA, 546 nt, Mus musculus
agcucguugagauagcgccucgugugcaccaccagcagguccuccuccgaggccucccgagccuccaccagcaugccaucggacagcagcuucucuucuggaaccacagaacaagacccugcuuccuuuccaguucucaagggcccagccccuaggccugcccuugggcugcaggcuagccucuggcagccccucagcacacagugaacuuguggguaugcugagaauggcugucucccuaggccaguguggccagcgguuaggcccucucuguccaaggggguugaaccugaaacacacagcagucuccauauuuucugugcugcugacagccaccagaugaacucagguacaacuggaugacuuccagaagcaaacagcacaaagaacagcaauguucucaagguagaaaaagcucuucagagcaacucucccuccacagguggcucaggaugguguggccuuucucggccugaaccaaaggagagcaguggcucacaggcagcagaagccagaacugaacaacugcuguuuucagagccuugu

SEQ ID NO: 3224 - RNA, 60362 nt, Mus musculus
ugaucuagacaguggagaacuaagaugggagcaugcccaugccuaguuucugcagaccugucccugggcagcuuugagccuggguaccucuggcuaucacagggugcuggguccaggaggagaagcuaaaggguggcgcaguacugagacaucugagucucaauauagccaaagcauggugagagggaguggaaagagggacucagagacccggacaggagagcgccggcuccugggcuccuauuugggcuuguugagcacuggguugggcgaagucuuagcaaaaucgaggccccgcccugaggcgggaccuguggggcggggucucaaggccuggcuagucccgcucuucuccaaccccgagccgcgcgccacccggacucuggauucaccgacggcgggugcgcggacagacugacggcggcgcagcucaacacagagcaccggguaaguacagagccuucgaucuccaccccgcgcuuccucuaggucagucacguucucuugaucgcuggcucgucucucuggcucuccagacaccagacuaguccuucagggucucccagggucacucccccagcugccccccauccccggcgggaaagauugggccucucggucugguaccaccccacccucagucacaaacugccacacaugcacucacacuagcagaaguuacugcaagcucugcagaggcacaggccaccccaacacccagcccagaaucucucgugcaggggcugugcacguucacuucucccacaucccucugcacgugagugcuuucacacacacuugcauguuuuaggcauccuucagacaugcauauguguccguguuaggcacgugugcguucgacauccauagaaaguuugguucagugccgguugguucaaugcuucgcuuaucuccauccgcuauuccacacacaucucccacacgggccuguguuggacacagagggccccacacucagguucacagacagagucauggucccuagcaucugcgguuccccugcugagugggagccucagccuagagagaaggagguggcugcugguguuagucuuggcucacucuuggaguggccuagggggcccaggaggggcuaagucuucaggggugggcuuggcuccucaccaccucuuguuuccccgcccccccucuccuaggcaagaguccauccuuucuuccucagccagccugagaucgugcccaucugcuucacggugauggccacuuggaccaguccgaaguuggucugagccagcagguguucuaugacuggccagagagacaaaaaggaauuugugguguguggguccuuguugcucagaggaugcugaaccugacccucuccaggagagcuugggugacguggguggguggcagcagagggcucccugggcuuggcauugaguggagcuaauacauauuugugauggaaugaucggagcucucgccucaccuuccagaggugccaaguaugugugugugugugugugugugugcaggacccccaagaggaaaggcaggaugggagauguugccaaggguggguaccucuugucuucccgcccaccccuucauguaguauguagaaagcaucugacuggaggugcagacccgccagccccggcugugacuagcucugcauguuuugcuuggcucucaguaugcuauuauuguuuuuaaaaauuuaauuagcugccagcauuuacuaacuggcagcuuucacagaaaaguccggauuuccgucuuuucuugaaaaaaaaaaaaaaaaaaaagcaagcucuggugguuaggauucauaugcuuuuguggagugcuucaaccagugcugcuggcugccuucccuuagggaugggccaggggcaccuuugguugcagucucuaccagaucuuucuucugggcuccugucuggccuuuggagaccuguucugguuguagccuuuuaaauccauugcuaucucaagggugagcccaggcuaggcucugccaugccuuaaguaagccuccuaccauucaggauguuggucaccacaaaggugggaguguccaggaucagguuuacaggggauucuaaugauaguauagacauuuugugcuggucugugggggugauggccugguguccccauaggaggaaggucagagcuccugguggaccugagauagaccucgcauagaauuuuccuucuuguuauucugagagcuccucuguaaagucacacugguucuccugacuggaaaagggaggcucagaaagaauucaacaagcaaaggaacauuuucauacccuggaacaaagcucucuguucuuccaggcucucuguccuuccagcauugaaucccgagaaagggagaccuggaugucagugacucuggaguuuccugagucucguccauagaggacacacaguaggugcucaauaaaugcuccuggcaugacuaaggcaaagagauugcuccuugggaucaugguagagcagaaccuggggcucaggcguaagauuacacacagccuggcccuuugaugucugaugggagugacagcccucuuugcugugacuccuguggcccucaaguggagaucacaaagucgggguaaaucuauggcaucacucaggcgugaccucuuggacaucuucuggccuugugccuuaaauuuggaagcuaggcugugaauaauuguuuuuuucuuauuucccuagcuggccuuggcaaaggagaugccacacagagagggacucaggauaccacacaagccaaguucauguuccugcaggcagcugcuugaugggugguucagggucugguggccacuguguuauucuaagcugaaauuucugugaucuucuacacucaucuuccgcauguggcggaucguagguaugcuaagcaccccugugacauguggcugccugucuacagcucaggggacaugaggagggugcagccacacuggcuucuccuuggugcuucuuggagauuuuuugcuagggagguagucuagaggugaggcccugcucuacucccaaccccauuuccuggaccucagucuuuucuucugcacaguagagacuucuggcacuuuccagugcucaugagcuuacagugaggaggcagagauggggaugacugucuagcauuuuguucuggccggguacagaugcucaugggagcugggggugggugaagcagaugcugugcauguuguuaugcagcugauuuucuaacuggaggaggcaggauggggugggguggagugggauccagaugggaacauauuguggaaagagguauauggccaggaguguguguguguguguguguguguguguguguguguguguguguguguauguguauguguuugguuguuuugaaauggagucuugcuaugcagagggcuggucuagaccuuauccugguagccuaggcuuagggaugagguuaagggucucuuugaggagggauuucuaaacugagauaugaaugacaaugacaaugacagcaaguucaaggagccuaggaugagauucuccuuggugcuugugugugagcaaaagggguggugguggagcuuuugugggaaggggacaguagggacagagaaggugcaggguauacagcagggagucugaaauuuccuggaaguuuuuaguuugcuuuaucuugcuucuucagacaggauccugcuauguagcucuggcuggccucaacucauuaugucaaccagauugaccucugaccccuagagaucucccuuccucugccuccuuagugucccaaauuaaaggagagucccuagaagguuugaaccaggaauccccaagauacagguucauguaaagauguucuggacaugugcagguucaggagguuucauggcucugcagaaugguaccaugugaccacugagcccucuuuagagacaggccuggggucgggguaggccccaucuugagaaaauacaugcgaauggggagcuaggccuggaaggggucacuaagcuuccugugacaugugcuggucaaacagaggccagcauagucuuuuguggcauauuauguagcuguaaaaauguuaggguguaugcuauguggaaagaucuagaaggucugcuggaagaaggaaaggaggagcugucacuugguguagccgugcugccuuuugucagaucggaacacacauucacaugggcuacaugagcaguggucacuaccccagaggaaaggugaccugcgcccaccugggaggggcagcagaggggaggugagacuucccacuguaugcuuuguuacaguguuguaggcucagaacaugcaggagaggcuaguugguauuaucaguagcagagccuaugggucgagugaauaaggcccugaaagccaccccuagugacacaggaaauagaccuccaaacauugcacaaagcugaaagccaccagcgagcggguguacacuugugaaguguugggugacaagugagggucgccauucacaucccugcguccgugaccuccaugaauagacggacuucucccuggcacgaccugugaaaguuuccacagugauuacaucguauggugccaaagucucgauuugcaaagucuagccagugagcaaaaggaaauuaccuccucuuccccucccccuuuccucuugccuccuuuccuggggugugcacucccguuuaaucccugcggguugucuggaaagggcauuugguuggaagcccucacuugguccuaggcauaucgcccagcccaggggggguggcucagaccccacucuuguauggggagagacuggugcagaaaaaaaaaaauucccuuuggccuccuaugaagugcacaacucugcugcccaaauacuguauugcccucaugcagcagguacuuccugagcauccacugugugugcagugugcuucugagugcugagggaaacccagggacccaggccauuucuuucugaaucacagagcuugaucuggugggagacacagaugggaggcagauuaguacacaugucccugugagcagauggggggugguaaggauaccuaggacagagacucaacauuagggaccccacccuggguacugcugccaggagacagaaggccugucaagagcaaguggccagaauuggcuacagggugguagcugcccaccucacugaagguaauagaaguggacaguauggagaugggcggggcugaccacuggagguucaaaauccccaugguugugaaggggagagcaagcuggaggcaacaucuggguuaucuccuccccucaucagguuaucuccuagccucuacuacaguuguagccagggugcauacugaugggguaaauggagacugugggaugacggccucaaugggagcagugaaaacugguuggccacacuuagggaugguugagagucuagugggcgaauguccagggaggugcuugcuggaguuggggcucauguguuagcucucaugugugcuaaagcagguacaccaagugaggaagacaagaucuguuuuguggcagucugggggcugggggcugcagcacacucaaccugggugcacagccaaucaggagaagagugcagagaguucagaggucucagaggcugacccaugaggcagacacauccagacgagccucagggagcuggagagcuuccuggacaggggugcaaccaccauuccaaugggaagaaagaaugagagagauggggcccugagaaagucuggcuucucuuggugagugguuugaucaugagaagggagguagacagaacccuggagacagagaacucccaauguuggccaaagguccagugacaggcauuugagaauacauugaacauagagggacaaggccagaaugcugaggugacaaagcagguagaccaaggcucugagaggacaugacuguuggcagucacacuagagaggaggaaugggccggagccagcucuguucucccccauguccucaguggugggugcugccggucuccuuuuggcucgucuuuucccagggucccuugagggucaggcugugcgucauuuacagccauugucuucgaaguugcuguaaccuggaaaccguacagaaaugccucugcaugcaggcugauuguugcagagaaagugcaggucuaggggaagguugcuuccuuccucggggugggagcugacuguauugucccuggccaggguccccacccacgucuuccagcuggcaaggaaauggugccacccaccgguacugggcagaggccaaggggauggugggagccucgggggugggggugggggcugggguacugaguaccaugugcugcauccacaggaggaggcaggccugaucccccaaggucucucaucucauugggccuccgccagcucaugucugaggugaggauaaugcuuuuggcucugcugaccuuuggguucauggauggugugcauguagaaagaggcucugaagugugaggagggccaggcagugugugggauguguggaaaaggcuggcuacuugccuuuggccuuagucacagggugucucucccagcuucagagucuccaucuggggaauggguugagugacagccuccucccagaggcugguggagauggaaggauggucauaagcugcaugccccgcccccaacacacucuagacagguggacagcaccaccgaaugguggcuucuuucuuguuaccauucacuccucugggugcugaggugucauuccucaaguugauguuuggucucaugguccuuggugcccccagaguucauuguccccuaccugugacccccagugaaugcccagcccugacuuuuauccaagggagcacuuaggaaaucuagaaacuucuggcuuuagaguccucucauccuaaaagcacaucagaaaaacauugcaguauggaacccuugggagcccugagcacccucccugcuauuucccuuggucugaccuaaguugugagaacugauccuaaggucagugagaugagccagggagguggggguguggaugaaauagaagagggagagggagagggggagagggagggggggaaagagaaagaacaguguggagcauguggaaaggggaagcccuccugagaaccaaggaucggggcauugagacagguggucuuaacacauagaauaucuuguaaacacaaucuaccaauacccuccagucccugacauccacacacacauaugcacauaagaaaacacacagaaccacacacccacagucacauguacccauagacaaacacucccuauuauuuuauuuauguaugucccugcacgcauacaugugaguucaguugccuguggagugagucacuggguucuucagccuccacacuaccuccuaauccucacagggccacagagagguugcauggcagaauauuucuggguucugagccaccugcuuucaguugccuugcaaccauggguuugauuuugagcuccauuuucaggagcacccaguuucguccugaugggucucugcauuggcauugcauuggcagugguggccuguuggcaggguuggggguaggguaggguuucucagaucuuuagccugaugguuggaccaggacugugucuagaucuugcuggguuuugcacaccaccugcuucucuggcaaucuugagaaauauccaaaauccaggucugugucaauaauugucacuuggcaaagacucuugggaguuguagagaaaccagcagccaucucucuuggcuggcaucucuguacagcuguguuggcagcugaggaagauggaugcagagagccugucagucacugaaaggacccagaaggcuguauggucuggggaggggggaguggcuaugcucagcagccagggcuggagagcuggcacuuacucagaaaaagugggaaauggccaggugaaugggagcccaucacauguguggcuacauaugcauacaugacccuggaauuaaucuucauguuuaccccaaaaaggcuucaagaaaaaaaaaaguuaagacaacucagagagagccagggcaggugagagccugacccagcccccgaggggcucucccuccccuacaaaugugugaguagcuugucacauagugggcucuugcuggaccugcaauuuguggauaugggaggcucuggcucugcagccugggcugugagagacuaugugucuguaucauuggcggccaugcuggcuccaaccccauccuugaaaagccaucucauucucuaggaagagaggggcuggcccuucucagaggcuuggauuccacagaguuggauuuuauugcuucuauuucagcaucuagggauguuuguguugaauuuucuuucagcucuugccuggcaguacggagccgugcugacuuccagccuuguguggcuucuggcaucugaggccuuagcggggagugggcagugaggucuucucuuguacugucugugucugcuuuagauuucaggauuuuccugguuuuauaaugggaggagggggaggcacauuccaucuucaaggccuggagcaauuuuuaaagcaaucuuuuaauaggauggaaauuuugaggggcccucucugugcugucucacacuggccucugucaaaaggcuuuccaguucgggacgaugguguucuccugcgcagggcugggggcugagcucagagagccagagccuuucaccugcagacacacagcaggggaacuuccugugcugggaccuccacaaggccugucugacucuggggccugagcucuggugcuuguccccagggcagggagcugucugaggugcuggccagugguggugccucaggcuguguuggggaaguaaagaacuuugacucuggacuucccuuggucuguaaaaucaauggacaagccuggcucuuuacucccauguguacagcuacuguucacuggccugggacucuauucaucccuugcugguggcccuggccaccacccaccuccauccuccauccucucacauccacccaacugccacccacaaacguacugagcuacccacaaaucuaccuuccugucaaucuguccuccacucaucagcagcccaccuaccuggcucacuagaauccauuuucuuauccacuuuucugggggauaaguucauguguccauuuauuaacucaccuuuucacccaucuaucuuucuucugauccucucagcuaacuagccacucacuuauuuacugacacagucaacuccguacuaaaccaucugucgacccaccuacucacuucucuaccugcccacucauccacuuauccauuuacccacucacccaguaacccucccauauaucccacacacaccuaauucacccauccacuaccuauauauccucuuguucauccacuuacgcuuucauccaucuagccaccucccagcuucucucucacuuucccauccaugcauccaugcauccauccacuauuaucuacuaccccccccccuccuuuagccacuuccuaacccuuugggcuuggcuuuaagcaugggauaggacuaggggcugcaacuucagaggagaagcaucucagguugggguaauaagaggauugucugugaacaaagaaaaaccuucugguuuguuaggaauugguucuuuggaggacuccagagggaggagguagcuugggagagauggguggcuuggagagugacuuuuggacuuuuucauuucaacugggaggccaggcacaagucccuauuuccacagaauaagccuguaugucuauuaagacuugcgagcuagugaaaguccggucagaguuagcuugggcuagcucacugcaagguuugucuuuucaauuaacuuuagguguagcuagugcagcugcuagacagcuguggccaugcaccaccuaccucucucuccaucccucucccuccuuucuuccagcugaacuggcuccaauauccucagugucccucugaggacaggaugacuucagagauucuugaugucucauacaaggcgauagacacagguuguucuccacuguauccccugagcuggguccuguaggcucugacugacuuggugucuaccacuggccacuguggugugggaagugagaaaugcugaguugcaugcagugggccucagaggguaaucuaggggcuguucuuacagaggggugugcuggauagucacauccauccuuugugccccacagagcuucaguguuuacagagggcacugagcgggaucaguggagacagcccaggcaggcgggaccuggagcuagcuacagggaggucaagggugcacaguuguaggcuggauggagccccagguaggaaugcugagaucagucuuggcccaggccagcuccuuucacugcuccacccugggacugcuuccacucuguaggcuuuaguaacaggggaaggcacggauggagcacccccgagccaaaagcaacauuuucuuuucuugaaagcuaaugaagaguucugggcguuaagcuguguaauuuuucaccugcuugucuugguuaugagauuagcgguucauaccuaggaauccaagggucagcccucacccgacacuuggcagaauaaaauucuuuucuuucuuagggaggagugggaagggagggugaagccuggcuguuccauugagaguuuguuuuuccaacauucucaugagcucacuccuuugaaggaaagcccaggggcuggagggugggugacgagcugccuggcacccugaaucucacaucgggccaagcgagcuuauucaguuuuugucuuuuucauuuuuaaaaaauauuuaauuuauuauuauguagcccaggcuggcccagcauuucuuccuaccucagcaucucaaguagcuuggaccauacacaugugccaccaugccugacucuggggcaugacuuaauccacaauuugcauuuggacccagcauuucccuucucuucccagggaauuggggguugggugucccauagccuuucacucaccaucuucagcuuccacaguacuuccuggccuaccccuuugcucaaguucugugcccuagaggaccccagacccuucccuaggucccugcugacuccuuccaagcacagccaggcuuggucugugaccagucacaccauccuguguugugacacugggucacaggaagggaagaaaguagagauucagguagaagggagaccugaugacaguuggcaguuguguguggcucgugucucuugccaucuguccauuccccagcucccugcccccuuuuguuacauuuuucugaacuacuuguuuguuuguuuguuuguuuuguaaagcaucuuaaggaggaaaagcacgcauacagaaugugcuucagcauugggguaggcaggagaacagacccuugguugacaccaccuuuguaaaucaagaggcugucccuggaaggcauuguggcucugugggcccuucuuccagaagacuuggcaacagggaggcaugguauccuauaaauagggguguccagccuuuugccauuguugccuacaguugugugggcuacauucagagaucugcuggaaccauccggccugcaggcuggagguuggauaugcccacuuggcaacuggguuuuucuagauuuccugcuuucuaggacuggauuguccucggaccuucgaaggggaugugugcagcuuuucuuugaaucccaagcaugcuguuacugaccuguguaacuaaggucguucacaccgcuucucccuuccccccaugacccccuccuuucuuguugcccacuucccaucuucugcugucucacuugcaaccacccacagugaggcaaacuguuucaugcccuggggccuuugcacaugcauuucuucugcccauugccauuccuagacauuuggguggcugcacauuuugggaggggacuggaucucaguugaaauguaaccuccucagccuccucuguccucuuuuaucaagggugugucuaguucucugucacaaugccccaauugucuuacugauuucuuuccugcuuuuuuucuacauuagguuauugguuccauaaaagucagagucagucuccuucucucccucucccucucucccuuucuccuucucuaucuaucuaucuaucuaucuaucuaucuaucuaucuaucuaucuaucucaugcacauucuuucuauguuuguuugcuuauguucugguuguuauuguugguaguagucuaacuauguagcccaggcuggccuugaauucaugaucuugugucacaguuuccaaagugcugggaugacaguuaugcccagagggaggacuucuuuuguucuuguucacugucccaucuugguaucuggcacagggcugaugggggugagguggagagaggugcuugcugaacugaaggacucgggcuccuaucgccauugaggucugagcucauaucccuuuaucacccuuucugauugugggucucaucagcgaauguagugaaaugagcuaaacacgcccaggcccucgcagaauggugucuggcacugugaguaugaaccugacuagccuugaagcucagacuaaugaacuugugccaagaacaagcuuauuuucucagugaacuaaugacuuccucuuaucagaggaggagugccgggucacccucuaauuucccuuuuggcacuggcugccaggaagcuuacuacuaaagucgggcuucaggagcagugguugcuuccuuucaggucuucucuguccccucucugugacuuagucacccucuuuuggcuuuuggcuuuagagugcaugugguuuuuuguucuuuuuucuuuuuuuguaauuauacauacaauuuuuaucauuuuuggguguguggcucagugucacuaagagcagcuacaguguugugcagcucccaccauuucugucucuagacucuuuaauccugaaaaaaaaaaaacucuggccauccaaugccagcucccuccguguguccuggcacccgccauccccauucugucugaguccaauugcuccguguagcuuuguaaguagacucuuuagugaguguccauuuugaccagcuugucacuggacaucauguccucaagggccaucuacgugggggccugugccagaauguccuugcugaggcuggugguauuccauugucaggauaaguggcuugucuuuacuggccucucugccagugggcagcaugcaguggugagugugggcauuugggauuaauuuuaaaagacauggucuuaucuuucuggaccuuagaugaacccaagauaaucugugcauuuaaaguagguucuggacaauuuuagaaccaagucauugucaguguuuguguguguguguguguguguguguguguguguguauguauguaugugucugugugugcauuuauuugugugugugucugaauguaugugugccuguguguguucuaugugucuuuauaugugugggucuguaugugugucuaugugugcauuuuuauaucucugugugcaucucucucugugucugacuguguguuugacuguauguguguauauguucugugugucuuuuuaugucuuuguaugugugggucugugcaggguauguguuugcuuuguuucuuucugugucuguguauaugcuagacacagcucugcauggcuccaguuuccucccaccuguugucucccaguugucaaguguuggccacuaaugacucacaccuguaccugcuccagcugcuugcucuuggcugccagauccuccucaucuuggcacagcucucccuggucuuucguagggagagggcugagcucuggggcccuuacccugcaagauccauugacaguauagugcuacacugaggcugggacccuggguccccaggagcuauggccugcugaagcaugcagugcauacacacccauauuccagacuugaggccaauggggauuugggacccccucaccauugaggucuugaggaacuguaggcugaugauuggaucugaagaggcugacagauugagggugacuagaggcuggacacgguggccaccaaguagaggguacagaaggcaaaguagaggaagaauaacccugaaguuuaaggucaucauggucuauacagugaguuucaggcuauccaggacuacauggcagacugugucgcaaacaaaagagaagcccaagucuuuguggagucaagauugggagcucucagaucucacagagagcuggugaggcuaaguucugccagagcagcagugacaguguggacaguuuggugucauaauacaaggucccaugggugggacugugcacaaaugggcuggcugcugguuugcuguccucuggcuggaugugaggaugggucuggcggucucuggggugguccucuggucaggucaaacugauuccucuuguucugaauagccaacaagaagggcuugcauguuuauuuaccagcugucaauccagcuguuugcaagccccaggguuuucuguagcugcuugucauugaagggagauucccuccaaaugcuugagaaguuuuaaggcauaugaugccaggcugagguuuucauccagagcugcucauccaguauaggcuaccaguuaaagcaagauuucagacacacagcgaaugaauaugugucuaaauaucgcaggggcucacuuacgcuaagcuagugcucauugcuguucugaaaucccagcaggaccgcaugcccugggcuuuuauuuccuaguccuagcaggccucuucuugucagagucagaaguugccagaacuggagaagcaaaggacuggucuuacugucuaacccaagucacaugcagaaugcucucuuguugacaauuuucaacuucuacaguuuaauuaucugcaaccaaccacagcccaaaauaucaaguagaaaaaucucagcagcaaacuucacagauuugaaaugauguggauucuggugcaagugaugacaucuagcgcccuccugccugggaccugagcuacucuguccaguggauccacaccguguucacuacccucucgcuagucacuuaacaggcugugauagagcuugccuuuaaguggucccaugccacuuaaucauaaccccaaaggacagaagcgcugacacaagagcugauagugguaauugauaugccaaagagaaggauggagugcuuguuaaugggaaaggaguaagguuugcaacaaaggaggaagguugcuugcugcugagagugcuuccauuuaaagucacaacaugcagucgcaacaaacauggagauguuugaggucucaugcacccccuggggauccagggaugcauuccuaggcacccucuagggauccaggggugcauucccagaugauagaaguucgaggucucaggcagccccuggggauccagggaugcucuuccagaugauaggggggauugcuggggucugccauagaguggccauugcucuccuugggggcagaucccacuuuuacaauggcagcaacaguaugucuuccuggggacacugugaccuuccaacguccuugccagcucagaguuguacacagugcauagguuaaccuguuaaucacuucacuggaggacuguggucuguagagggucagggaacagugaggacauaaggaggaggugcguucaguuacagagaccagcagaaguccuggagcacugugauugguauggcagaggccugcucuucuugaucaccuugcucacccaggggccugugugagaaggguguggagagagugucuccacugcaugcccuuggagagaaaacuuugcugagugggcuccuuacccauaaggcccugugcaugguaaagucaaggcaugcauuguccaaaaauuuuuuuaaaauguuguguguccaugugguauaugaaugugcacauuuguaaguguggaugugucuggaggucagaggucaguguuggugucuuccucuuucuccacguuacuuuuugagacacaauuucccacugaacuuggagcucacugauuucagcugggauggcuggccagggacccccugucuccucuuccccagugcugggauugcaggcgugugugacugcacccagauucucaggugggaccugggaaccaaacugagguccucgugcucgggaaacaagcaaggcuggcccagcccccagcucccugagcaugugucuuacugccacuggaacacgcuugcuuuguacauguugggcugcugcagugacuauuucuggucuuuuuccuacccuuuccacuuagcuguccacuuugaagguucacuggguccugcuuuccaugccgugggguccaucaaaggauguggcucucaggcugcaggcaggacaaaaauggagcuguggcuaccugggucuggaggacgaggggcagccagguggaaccaaccauagcuaugaaggaggagggagaguugggaagcugaaguuguggcccuggggaaaggagccacgauaucccagagggaaggaggggaaaaaugaggaguagacacgccccagccucucugcuccucccuuugacugaacagaaagcuggagaaccaagaugggguugcagccaaguccagucucucuggcacagaccagcacagcuugagauagacagccagacaguaacucaacucacacagcgguaccuucaucccacagaccagcucagugcucccuggguguggaguguuugccagcugcauauaguggagugugugccauguagugugguagcuucagggcacacgggauggaguuguccucauaugaugcugcucuagcauauguccugucugcacuucaucucuggagggugggacucacagggaaacucugggacaccccagcuagguguggccgagaccuuacucugaaacacugcauccaugcaugguaagagccaacugagaagucuugugaaggccuccggaggccuguggaguucacuggacauuuguggaggcugcuuggaucucccuuccuuccccuuccuccucugacaccuucuggagggguacaggauuuagucaguuggggugaacucucagagcgccaaagauccuucagauucuguacuuggcaugggcacaggcuccuuccuccacuguuaucuuuaugguauguaugcuuccugacuucccaaauccugccuaguccaauccuucacaucccccaguauaugcauggaccuccaucuguugauccuucuaggcuuccagaacucuugcuccauucccugccugaccagauccugucuguccacaaacuccguagacuugaucuucacaggaacagccuuccacccuaccccucaccucccauccccaccccucagucuuguucucuccuguauuccacacuuccugcucuguccagaucuuugcugcccucagcacagagcagccacagguugucaggccccugggcugccagcaccccauaugucacucagcaagaaaaaccuggccuucuuucgccacucucccaugcucaccuguugccaggccccccaaggcucccucucccauccaacuuccucaucugccucccacugcuccugucucuagccugugcacuugcuguccagagccugaagcacuuagccuccagcaagucauccagccucagucagaugccaccucccgaaaccuucagaaaccuucccuggcucacagagguaucaggcuucacaaccagaccuuucccaauuucucuauuuacuguuuuaaagagccaugagugccuggcacaggugggagcaaaccaucuacccucagggccaucagcccuggaaggcugccaggcugcaugucuggcuugcugguggggugcccgagugccaucagcaagccucucaggggaggcagaacacagucccuaauaggggucccaguccguguuucccugggugagaaacagcagagugaguuggacacugugguucccagucuccuguaugcccagacucugggaguugggaauggggguaggggugcucuguggucugagcuacugcucaaggguucugcuuaccaggcaagaaggggauggcugagccugggaugggaguggaaucugguuugguucugaguggaagagagagaagaccuuuuccaggagauuuaggugugacucuuuacaaugaagcccccuccccugcugagaucuuugaugaaggagauggucuucaucaacaguuugcucguccaaacuguuuuaguagauggcagauguaaaugcauacaucuuacuaagguugaaccaggaauuaaauaccuuuugugggaaggaaugcccaggaagggaagcucauuggcuaaacacucaggucuaucuagcuaccucauuggcauggagaacuccagguuuuugugcuccguaaccgauugucauggucuucucaguagggcgucaugguuacguguugcggaucagguaguuuggcagggagcuggcuccuugccugccauucucaauucugagauuccccaggguuugagccugcucaaccuuaccaguucuucugucugguggcacgguccacuugccccacaggaggucagccagguggcccaucuuacuagcugacgcugacaaacccccagucccuggauguguccaucacagaucccugaugccugcagcugguaccuccagcugguagugaccagcuuggcauuauuccauugcugccuucagggcucgggccaugcugacagaccaugcuuacccugcuggucucagagggagcugggcaacucaagcacauccauucuuuggaaagcucagcgcucucuuuacuccucuuucuugccucagaccuuugagaaguuagcaucuucuuaauguuugacgugagagcagggcguggcggugcaggccuguuacuaccccaguacuugggaggcugaggaaggaacauucucucggguucaaggacagcugugaauacaaugugagaucugucucuaaauagaaaagacaucauccuuuauuauuauuauuuuuuaaaaaggauaaauguugagguuuagggaugauacuucguuguauuuucugaaagauaaaaaacagggcugggcuugcucaguuaguaagacuggcaccagcacgugggcucagugcuaugucccuguaacugcagcucuggagagccagacggaaggaguccuggggcucaguggccagcuaggcuaaccuaauugucaagcucucagucagugagggacccugucucaaaagagguagacagugugucugaggauaaaaucugagguuguucuuuguaaucacccacaugugcaacaggcaugcucacacaugcacacgugugcacacauggguguuuccccccccaagaugugugcacacacacacacacacacacacacacacaucagauagguaccaucagaaagcacugguggugugagagcccccauuuggggauugugguguccagagggcugcccugaugcugagucacccgcugccuguggggaccuguaacuuuugcaggagggaggauugguggaaagauggcauaugagugguuguggaggacuuugaggauagcgugaagagagaggcuccugcaagccagauaggccguauguauggaaguggcuccuagagcacucuggugucccagugagucaaggaggcacgauggggagauggauggcugggccucagguugggcaggugggagguguugcguggagcagcagagcagugagagccagucuuggcaauggacaggacagagacagugauucggcacgaggagguggcaggagcgucccagguugaccuugaaaucccagggucucaugggauagaugaucuugagcucugaagucuaagggcugggagugcaguaaacccgagguuggauguuugggccacucugcaaggggucuguuccuacccagcaucccucacuucacccccugacuacagucagugucuggaggaggaaaacuguucuggcggcugugugcggauguggacucacccacccacacacacaucagacagguaccaucagaaagcacugguggugugagagcccccauuugugucuucaguaugugugcaggaugacucaugggugugucugggugacugggcauggagaggccacagugauaggcugagugagugugcacucauguguacucgcuuagcuuuaccugugugugagacugugggcuagaugguucagaagguucaagucacccugagcacacagauuccauuccagaggccacauugcuucaucuccugagugcacacacuccuguuccuauaucuuccccguaugugucugugugagagagagcagggcugagugauguaugaguguggguuaggaaggcaugccuggagguagagauggugugugcuauguguagacauguuggggcauacaccucaucucucucuauguccuuagugugacaggcuuccucucuguucuccuagggacuccugagacaugcugcuccaggaaucugcaggaguguggcuggccuuggcucuggucacagcucugacuccgagcccaagcauggccgucccguggcaggauugcacaggugcugaguguccccugcuggagaacugcaucgaggaggcguuggagccaggagccugcugugcuaccugugugcagcagggcugugccugcgaaggcuaccaguacuacgacugcguacaaggaggguuuguggauggccguguaccagccggccaguccuacuuuguggacuuuggcagcaccgagugcuccugcccacccggugguggcaagaucagcugccaguucaugcugugcccugagcuaccacccaacugcauugaagcuguaguaguagccgacagcugcccgcaguguggccaggugggcuguguccacaguggccguaaguaugcugcuggccauaccguccaccucucauccugccgggcuugccacuguccugacgcugguggugagcucauuugcuaccagcuuccugguugccaugggaacuucucggaugcugaggagggugacucugagaggcaguaugaagaccccuacagcuaugaccaggagguggcagaggcagaagcuacuacggccauugugaacgagguccaggcaggugcagagggccccccagcugcucugggaggagggaaucugccaccguccuccaucagaguaacacccuggccaguugcccuucccagacccacagcagcugcugcccugggucccccagcaccugugcaggccaaagccaggagagugacauuggacacugaagaggaugaggaagaagaagaggaggagacacuagucacugagccaccaacagcaggcaguccuggaaggcuggacagccugcccacaagauccccagccagaccugguuucccuguccaggagaaggaggcugaagcuaaggcagggccugaggaaaaccuuauuccugaugcccaggucacuccucgaagugucaugcaggagggugcugcaccucugccaaggucaggccuggcugcucucaguccaucucuggccacugacagcucuucagaggacccaguaaagcccagcgaucaccccacucuaucuacacugccaccugaccgagcccaggucucccccuccccagagacaccugaagaaauaccccagcauccacaguugcuaccucgauuccgggcagaagaagacauagaccccaacucaguacauucuguccccagaggugaucuugaugguaagauccauuuccuguguuccugaagggccaccgaaccuggaaggaauagucgcugacuauccuagcuagcuccucgcagcuaccaucucucaggccugagacaaagugguccgaguugauaguuucccauggcugcucucuugccagccucaaacagcguggcaugggccaggggaggucucagcagcugcccucucagagaucugagacagggacacagagagguccuuguucuaggagguacagggccucuggugggcucuggcuaaaggcacagaagguuuucuucaucagaauagagcccaauccugccuccuggaguccaagggugucuuaguaguaaucacagggcucugcagaucgccauggccaacugccucugagugccuuccuacagaagcccagcugugggcugguggcagagggggcauguucugcuguggcucuagcucugcugcuccuacuagccugagucuaguuaacucaucaguccucucuucucgaugcuacuacaguggcucacaccuuauacaaaguagaagcuaaggucccuauggugaccacauguccuucucauccacccaguggccccuccccuccccuccuggcucuucaugcucccacagucagcccaggccacuggguucuugggagggcagccucugucccagggcuuuugcacuugcuacagcuuuugccugagaugcucuuggaggugucuggaugccuuguugcuuuguucugugccggguuaccucugugacccuccuuccuuccugcagcuuugaucucucucagucacagcuuacauuacagacaggaugacuuggguccuuguuuauugcuuuucuggaauuuagcaucacacaagccagauuuugugcugagcccaaggguuccagcaccacgugcauacaguuggugcucuauaaauguuggaugcuggauggaacuggugggagacccugucuaccuccucucucccucauucuucucaccaguuggugccuaugauccucauaucaccaguaccucugcuuccagccuacuuuccuuccugggauucccugccugcagccugcuggagaggcauggcuauaggggaggccugggacugccugggaccaggccccagauguucuccacccagcccugagccuggaagugcagggaacagggacggucuaauggagugcaugcaugugcgugugcaugugugugugugugcgcgcaugcgugcucagugccugcagccucuguguuuccagaauagaaacaguccuggcuucucuaacugcuuguguccauuggcucuguagaaccugggaccaguuuugcucacuugagggaucuuugugccuggcuuucucagauguguuugggcuaugguguugaugaaggcugguggaagcuaggucuggaguaccuucaucaacugcagggccauccuagcagggacccagcucaugcaaaggccgggaagacucuagugagcagggccaggcuggcguugcagcgucagcuggagaggguucucagccacugucuucuugcuuagccuuugguugagcucaccauggcuaccauuucauauguugacuccaugaccacggacaaacggcuuggcccuuuauaccucaguuccgccaucugcagacagcguagacgcccugcuuugagucuguuuugaagcugcagggagcucauuuguggccgugguuggcaugagccgagcaaucacugaggauuacgagauaugguacugauuuuauuuccaucuguucuucagccacagcucucgccuuaaucaggcauucguggggcccuuacuauaccaggggcugagcuagagaacaaggcagccucagccauucccuuaggggacuagcagaaaggagugcauuaaacagauaaaggugcagccgacagggcaugcagcuggugagggugggugacagcaggccuuauguggguggggcucuugauggccugccaagcguuugaggaaaguagagucuggaacauaggaucuucaggcugguuucggacgggagucugggggccauggaugggggaggggcuagagagacaguuuugccuuacaugacccucugggcuuacugagaggcaggccggaaaugaccccagcccaguugccauggcagcccugaggccuggagaaggugguuuccauccaucgcccuggcccaacuggggcggggauccugccugggagucagaauuguaccagggauccccacugccucagcugggcugucccugccucugagcauguccagauguggccuaaauggaagccacaugcuugccucuucgagccauggagaagggcucugacgucuguuucugcugucacucagagacuuugggagggugcugucucugaugugcugguauagcagagggagccacugaaacagcaggcgguggcccuggccuugaagagucucucagaaagccaggcaggaaagaaagagucccuuccuugggagucccagacugcagggcaggugucugcucacuggugcucaaguuuaggugccagguucucucugucacagacaccaucuuuugggcacucagugacuauuaagccguuucauccccaccuaagcccagagaguuccagagagcucugccuucuggcccguggacacagugacaggaaauggcagaaucggcgucaucuugaagucugcauugcucuguccugugacccaguuucugagaugcugaauaaaaauugaggagugaaacccauaucuccacccugggggagcucugggugacccgguugcugauccaggcucaguagucacagauguuaaggucucauuucggggagguuggggaugagguggcagugcccugugcccaucuggggcaggguggggagcucugacuccuccuguggauagggagucugucuucuggaggacagagcaacuguguuaguguuguggccacugcaggggguggggggagguaguuccaggcauggggagcgucucuauaaagccucugcggccaguugaaaugaaauuugguuaagaggagcugcugugacugauaggaggaagaacuguuggggaaggggaacuuggggcucugcuaaucucuguccucccuacugccagcucacaggaccuaggcauuggagaagugucagggcugcuggugguggugguauaugugugugugugugugugugugugugugugugugugugugugugugugcuggaagaagccuggggcuucuccagcuucuccagccucuccuguucucagcaaggccuggccuggaguucaccagcugcagugagugugcagagcuucaugucugggcuuuggagacacagaggaccucaugcucugugcuuccaucagcuuuggauacaagacauuugagaaaagaauuggaacuguguggaccauaugguuuaguccuuauacccuaaacaacaaugugacagcuguucacacugcauaguuacacgugacuguagucuagagaugauuuagagcauacaauggccguguagaggccaggcaggcucuuguaugggacuggagcaccugcuauuugaggccucugcuggggcuuccuggguccacugcccuuaggaucccaagggacaacugggcaguaugauccuggugcccuccucugguuugcugaucugccaucuuugcccucauuggucuacuugucagcuucucuacaaaacauccuuguggucaucaugaucugcagauacuggacaugagaugagauucaggaugucagcagauccacuuuugcuuggcacuguugauugauaggcagguauggccacauaccauaggcuagccugugggcaggcaaggagagcccuucccacuggucagacugguugcugcugacccuccaucucagcucugguguugccaauagugguuggcaguuguacucaggccuguuacucugagacucugcuugaagcaugaagagacagcucuggaagacaccaugaggauaucccauccauagagugggaaacugucaucccaggucagggagcuuuccuggaugucauagcagaaaugguggcagguagacccuaccucccugugggaagagugggcucuagaucccauggaggacucacagguagcucaucuggauuuccuaggcucuauccuccccguuagguacugguuacauuuuacaguugucccuagagugaggguuugaacccaaggcuuggguuucuuuaauugguuuguuuuguuuuugagacagacuuucacuucauaacccagucuggcucuaaacuuugccuuucuccugccucaguuuuucaaguucuggggauaauaccuauuaucuuauuuucucucugugguaaacaccuuggagagggaaggcuuuauugggcuuacguuuucugcucacaguacaucauugaggaaagaagucagggcaggagcauaugcagaaaccacaaaggaacacugucuguugacucaaacucagacacaugcucagguagcuuucuuauguaguccagacccaccugccuagggaugguguugcccacagugggcugagcccuuccacaucaucaaucaagauaaucucucucagacauggccucaggccagucucaucagcugaaauuccaucuucccaggugacucuagauuaugauagguugauaguacaaacuacccagcacagauacauuccacuaugccugaaggaucaagaccaugggaaucaaaguucucuaaaguuucugucauuuucauaagugggauguccccauggugucucccagggcugucacuccaccaggaccagguuucucuaaauuugcuguuucuuuaaugucuuucuuuaaaagcagauuuauugagaucauauuuacaaucauaaaguccccugcauuuaaaggcauagugccguggcuuuuaauacuuucccaguuaugcaaaaaucauuuaagucuaauuccaggauauucccaccaugcuagagauaccauguccugcccuaguguucacagccucuggcugcuacucaccucucuuuugcccacuggaaguguggauuccagauggucuagaauacucagaaaccuuccuaccaggguuuccaggccaugugccauccccagggcuguugguggguugccucucuuccucuuucccaagccauagcacugugguucuucugguauucuucauagauguccucucugccuucccuacccggugucgucuccacucuacauggucuuguuucugcucugccuggucuuguuuuugacccccauggacuugucucugcucuguggucuccuaucugcucuauugucuuaccccuguuccccuuugccuugucuguuuacccacauugacuucucugugcuccaugguuucucaugcuugauuggcuugcuccagcccauccuaacacacagcugaggagugcaaggugguccuuauaugcagacucagcaccagcaaugcucuugcuucugaugcuauccauagccagcccugucaggagccuggccaggcccagggacugaaugagagguacuucaaaguccucagcagacccugagggaugagcaguggugggagauugggcaaggagucucccuagaccggagugucagcccucagcccuguggcaggagccucagggguccccaucauauuugcuccccacaacaaaagcauuuuccuugugauccccacaagagcucuuguccucugguccugcugagagucuccccagcuuggaugacccagcucccucucacuguauagccuucagguuaaucacuuggcugcccuguaaaagguacaguggccuuacugccuccuucaucugccucuggaaggcaauauugauuaaaaucugcagggcccuuacccccaugaccauacaaugcuucccagcuugguacugcauuacacuggaaaagaacccaguuugacucucagugagcagauuccagcuccugcuucuccuggauaugugaccucaggcaagggacgcacccucucugagccucaguucuguaucuggaagauguaggaagucugauacaaugagcagcucagaguggcugcccagagcugugugguguguucuuccaugcugucucuacagcaggguugcuagugcucugggagugcaaggagaauggauuugugcuuuuguuggaacagaucugugucuguuucugcugaucagaagccuguuccucuggcuacagagcuaagggcuaggccugcugggguugugccgggguguuuagcugaacacuuccugcccuucccuuguguuugucauuccagcugcuuucagaugugcagcugagugcuccucccugccugacccuuuuuauuuugugcuccaccuccagcugagugcuccucccugccuaucucucacacuguacuccccugacaucacuuuggcaucugugugcagaugccuggcaacaagguggcauuccauuagcaagggcaggcggcuagauuaugugucagauacuggauucaaugguggcuauguauagauauuuucauuuuagaagacauucucagggguuugcuaucuucauacccauuuuauaaguggaugacugagaccuaggaagguuaagggaacuguccaaggucccaaggccaaugaagcagagaaaugugcuggcuacccacuuggccuuuugcccugguauuuccuagcccuguaugccaucuuucugagugcccagcuauacugugcuaacaaauguuccccuguuguccagauggaggcucuggaacuauuacagggcacuggcagcauugggcagggcagggcuggugcauagcuggcaggcuguggccucuuuucuagccucuggccugggcaauauuauagcauggaguccagaauccagaaauccagauucucuggggucuaugugguaaagugugggaagcuaagcacagguuccgacugucugcucaugcuuagggagccacugagcuggggauaggucucugguuugcuuucagccccuauccccuucuucuccacucacuucuccacucacucauggauaugguguugggugccuagggaucuguagggggcagaggugaagucuuacccugcugggauggggucagcugugacucagugcugggggucugcagaccuuagggaggcuccugaccuggaaguaguaggaaugaugugcuggugggagaucagaucucauuguauggaaacuuccgggucuguuguuucuugggcugagaaggcugagcaugauucccuuggguuuucucagaagccugggaucugggauuucaucuggaagcucccaucauguaaauauuggcagcucacucaaacagucuaaagcaccaagaaagcuugcagugggccuagucuugcugcugugaguguugacuuucuuacuccuucccaucccuaggcacacaaccagaacucugaagaggccagggauaaguaaggagcuugcugaaggccagcaagcucugagguguuaccagaaguccugacucuaugaugacccugucuagucccuaugaugacccugucuagucccuaugaugacccugucuagcuaugccaaaaaaaaaaaaaaaaaagccccugugaagcaguuucaugaaggggccugauuugaucugaggggaccaagaggauccugugguauagggauugguggcaguucacuagagcaucagcucuggcuugaggaacagaggcagucgggccccuaugccauggacauuccaggcuuccccccuccaggccacuuuccugcugagcaaugaacagggcugaacaggguggaagguuugcuuggaagaaagaggcgagagcagcaggcuuuggggaggauagucacguaggcacaguuagcaagggauaaggcacccucuugugccauuucccagguaugggcacagcagcacacucccugaucuuuauagccugugguugugugcuggcugcucaaggugugaggugcggacaccuggagagaggccacgugaccaguaggaaucggaagcuggggcacccaacaguuuggaucugaccuauugcccagagccucaaauggagaagcuuagucccaguuuagugcugugagagguggaacuuuuaggaaguggagccuaguggggugucuuuaggucacugggcuugugcccuugaccaugggaugcaagcuuucucucucuuaacccauaguggacagcuagggcuauuuguggggcuauuaucauccagugcagacucauuugauacucauggagacacauggguacacauauacuuacauuuguguuauuuccuggggaggcuaagaccacaacagaaugaaugauuccauccaagucuacuguggguuuaguugggguuaugagaaacaugaacaacuuaacagggggugugucccagcagcaauugcuaacugcugguacauccuugggggaaugggcaaggcucaaccucacuuccacaaaggaauguuaggaggcccacccuucagaauucacugcaugcacggucacugcugcuuugauuucaaggcagcaauaggguugucauagaagacagcaucaugcaacucucucucucucucucucucucucucucucucucucucucucucucacacacacacacacacacacacacacacacagagagagagagagagagagagagagagagagagagagagagagucaccauccuggcuaaguuuaugucaaccugacacaaguuagagccauuagagaggaagaaaucuuaguuggggaaaaugccucccuaagauccagcuguaggguguuuucuuuguuaguuauuguugguggaggguccggcacauuguggguagugccaucccugggcuggugguccuggguucuacaagaaagcaggcuaaacaagccauggaaagcaagcaacacuccuccauguccucuaaaucagcugcugccuccagguuccugcccuguuugaguuucuguucugacuuccuuggaugaugaacagugauguggaaguguaagccaaauaagcccuuuccuccuccccaacuugcuuuuggugcuucauugcagcaauaggaacccugacuaagacacacauuuacggagagucaccgcucgcuaucuucagggaacugauuccaggaacacccccgucucuaucuuggguaccaaaguuggaggaugcuuaugucucuuauguaaaacccaugcauagaaccggugugaauccuacuucaaacaccuggagaucacugguuauuaugagacagggugaauacgauguguuaauagcugcucuacugcacugugugggggaacaagcaaaggaugucugugugccuuugcucaauacagauacaggacuuuuagaaauauuuuuuuaaauugaguugcuugaauccacagcugcagagucaguggauaggaagaccagccuaugacacgugcauucuggaagcaucuccagucuuggaccuguaucuuaaaacucuaaaaaaaaaaaaaaaaaaaaauacuccaucuaacucaguuaauucccuaaggccauauaaugcucugcuuacucuaauuguuccccaggucuucuguaaagcuuguuugguaaaggcuauaucuaaucaagggugauuagccaguguuugcuuuaccuuggugguuauaccccuuggguuuguuuuucugaaacuccccugaauacacacacuacucucgggugucuuuugauguaguguaauugccaaauguccuauccgaacuuaauuugcagacagcagcgcuuugggucucgguggacagcuuagggagacaacaccugugcucuaacccacagauagaaaccaggguucucagguguugccuccagcuugucagcucuuacucucuccuggccccauuaaagccauuguucugacuugacaauacccuugccuauucuugaguuuauuuuguagaauggcaaugauuugugccugucucuuuuggaggaaggaaacacuuuggguccuauccauguucuuguaaggagcaguuaauugcagcccccguugcgauggcaaccggaaugccucaguagcauucugcuguggagugaaucauacuuguugaucugcugugaugcugguggagaguugggggcugugcugcuggcacaugccucugugucuuuggggagcgggaggcgucccugaguauuuacggcaugcuuggguggggaucugcugaccgaagggugcauggcauugauugauguuucucaaugcuuuacgagagcaucuugaaguuuauaugcacugaguuuacacauguguguguggcagguggguucccagcacccucaucucuguuacagccccuuucauccuuggcucugguguagagcagcaucucuucuugcucuuaagucacauuccugagaauggugucagcaaguaccuuuccuuguagcuagcugauccuuuuuguucucguuugccugugaguaugugugguauaccauaggucaggccucugucugaccaucuguaaaagugacagugucgggacccucuauugagagcccuggggaugggaccucaagugcaggcugcaguucagcagucacugcuagacucuggcucagcucagcacacaguaggacugacuagguuuaagugagccuacuggaaggcagacuccuauagcuaaauagacucauauagacucguaugcuaaaacaccuggaaagaacaaggguauggagacauagacauagagaagcaaggccagguggacucagguggacccccaccucagcggcucaucugcccccuccuaugaaccuggggcagaaggcagaguggaggccaggacccuugcuaguuugccuacuuuacaggccucagaaagaugcucacggcuccuggguggccuggaagggcuugcccuggguucugcuguaaaugccuucgauaucccucaaaucuggugggacccacaaugccuugucauccucugggcuuuguucugaggccacaaagcaaacauucuguugagugggccuagcagagaacccccacugcugcccuccugccaggagagaaaaggcucugccgcaguuucaaagccagaauucuucagggcuuucgcggcagggaaaggggacuguccaggggucuugcugucuggccuggauuguuugggacauccauuguucugugaucaaagaaggcuauagucuccggaucucugaaucuauuuacaagggacaggcucuggaaugacuaauaccugccugcaguauacagaaggcuggacuccucccuaagacaccaucuguggcugggucuugggucuccacucagaagccugguguauauccauguaauccuuuuaaagacaaaugucaguuuauauaucuccugaacucugccugaaguaccuucaggagugauuucauuucaggcacacauacgcugccccuggcuccuuaacacccgugugcgauuggcugggagcagcuucacuauuucaucgcggauuguuagguauuucuggaaucuuugcugucacaaauacaucacgcuucugggacccuccugucugggcacaugggugugugugugugucaguauaugagauuccuggcgggggaagcgucagcucacaguucuuuauauuguacugcaaugcauuuuuuuuucaaaaauaacaugaaauuuacagcuauugagucugcagcucaacagcauuaaaugcagucacaguggagggagacuucccaucuuccccagcuccuggugccugcuacacuacuuucugucucugaaucugaguggaaacaggugcuaucagcagucugugucgggcucgcugcucuaucauuucuaaaucuuagaucugucuucauuaugagauuuuucuaguccuguuaccuuauccacucauguuuuugucucuuccuguggccagugucuuuccccaugucaugcuugugggauaugagcaugucgcaugguggcuguggcugucauuggaaagacuuguugaaguauagagaccaugccugguaagacauuucuagcaugggccuuucaguggccuagggccccuggaguaucuauuucuguuuuguuuuuuguuuuuuuucuuauaacaaaaucucugcaaaaugaauuugcacagcuucccuuucaacagcuggcagggcaaguuuuccacuuuaucaaucucucucugucaccuaggggugugagaggugccguuugaccgaguaggucagggguuccauacugucuggcuaucaggacccggaagccugauacucugaagaccauggcagagugguccagagccaggccauguuacugcucggcaggagggucauccuugggaggaauagggagguccagccgacccagaggaagcagaagagcagaugggcaucacucaauggacaguggcccagcccauucuuccacccagggauugauucucuuccugugauggucuauuucauucagaaaggugcaacaccacauugugugcugacggacaaggguggccccuuuacuacauauacaggcaucaugggcuggugugaacuuugaacaaugauggaugcugagauccugaaugauccuccuagaagcagaaucugugauguccuagucagugcugggcccugugcugcccacuagagaccugaggugacucaggcccagucuuggacacaggaccuuccaaggaugguguuggcauaagugugucacauggcagggauaucauugguguguguguguguguguguguguguuguuuaacuagaagcaggagcugaguggucugcccagagguaggugggugcuggccagauggaggggcagggaagucauauuggaugggccucuucaggcuugauagauggacauuccccagguggacagggagaaggaggaugcuucuagcacagaccaucaccaaugaaaguagcaguaagcagaggcccaagugacuagguagaggggcaaaaacuguuuugaagaccuuuauuguuacaccauagagugguaauuuguccuguaauggcuuuuuacgcaauuccaagguuccccaaaaugacucagagcuacuacccacccccccaacaaggccagugcuguaugagaaaggcuaaaugaaguuguaugguagugauaaguagaguuagggugcacagaaguuggggagacccucucuaagaaaaagugaucccugaaaaggagaaaggaguuggcuugguugagaguagagguggggacaggcaggaggagggguggaagauucugggcagacaacauagcaacugcaguagcccuggguaggaaugagccugagacacucaggaaaagggagggggggaagggaggaggggagcagggaagaugggagaggggagagagagagagagagagagagagagagagagcgcugagaagggacaaguggggaaggaggaggcaggagcauuucguggaguugcacaggcacagaggaauccucaucuguuuucuguguguggaacugucaccuggguaccaaccuggaagugacuggaggacauauggagcagaggguccagagguaaggagacagguggguggguugagugugcuucagagguaguggcccugggagguauguccucagaacagccagggagggauuucagugacgcaagaagcagcuuagggauuagaaggagccaaaugccagucuugggaagccagggguagccugaagcaagucugcugcagauggggugcaaauuccuguggccagguuagguagaacuguaggaguggccaaggcaaggugacacagggcacccagagauuggagcauaucacuacagucagauuaugaggaggaugagaggccuugggguucacuccacaggccagaagucagaggucaagaaaucaccagagagaggggcuggggugucuggggucagggagggaugcaagcaggccugcaggagcugccucaggagcaccuugggaguugugagguagagaccucauuucgaccuugccucccauaccuuggauguugaguccacauuagacccagucccccucaugcuccaaguagguugaccuucuagcaggaggucacagcuccagauggcucugaagugagagagcuagggugggagaagccagggaacaguggaaaucuaccaagugcaggcugaaaccuggccugagaucaagagacuagaaaaccccugaguccacaugaaggcggcaccuuggccugcuggaggcucuguuugagugagcucucucagacuggcugcaucaagaugccugugccuggagagggaaagggaagggggaaaucgaggcugugcugucuaauccuccacuuccucuugggcagagggaguaacaacaguuggaguguuuggccuugugccuggguuguuacuggcgcucagcacauuggggcugucauugugaucucuuagggcaucuaucauauauugccucaccaggaccccaggaucuggcgcaaucuuguaaucccauagggcuuucuuagaaaagccuuagggagggaagauuccagacuguagaaggaaggucaaguguuaggguuuagauaugaaaugucccaccaaaggcucauuaugucuuacagccuggguccucagccaguggaccaucucuucaucuuggccacauccacauuauacuccuccuccuucuccucuuccuccuuuuccuccucuuccucuuucuccuccuccucuuccucguucucuucuuccuccucuucuuccucuuccuuuuccuccuucuccuccuccuucuucucuuccuuucucuuccucuucuuccuccucuuccuccuccuucuuuuggugacagguucucuuuauggaucccaggcuuaaauuuguaaucuuccuaccucagcuuccggagugcuuguuuuauagccuccaugccuggcuuguauacuuuuagauagucaauuuuguuaaugggggcagagugggguaauuggaugggguugggguacacaggugccagggagacuuucucugaggagauuugaucccugaaaagugaaaaggaagaagccagccugauugagagccauaauucugccucuuuguuuuuaagucuucauuuugagacaagucccacaagguuguccaugcuggucuugaacuacaauccugcugcauggccuucuuaguaguggauuauagacuguuucuaccaggccuggcuauucaugugaauuugagaaucaccuugacaaaucccauaagcagacugggucuuugauuauaauuguauuaaaguugugucucacauaaaggagaguucacaacuugagugcauugccccucuucucgaguauguguacaugguauguguuucaaauaaagugguuaaaagcacuugcugcuccagcagagaacccagguucauucccagcauccacauagcagcccaaaauuaccaguaacuacaguuccaggggaucugaugccaccuugugggcuucuuggguucugcacucauggugcauauacacacaugcaagcaaaguaacacauaaaauaaaucuaaaaggaaagagaaggaggaggagacagacagacagagucccucuuuuuggucaacaugcuuacugccuguuuauuucuggauuucucuuuuaaaugccauacuuuucuacuaauuuuuuuauuacuguauuaagaaccacuauuugaauacaucaauuuugguuuuggucauuguguuauaaugauuguuaauuaguauuaauuuuuauaauuuagacuucaucauuacaaccaaaucuccgagaaaagcaacuuaagauggcucuaaauggaaucccacaagcccucaaggcucuuuucugucuccugcccuauuuggguuacuuggaccagaagaacccagcucagggcuucuugugucugcaaugguucauuuagagacaugucuuggcagaaacagucuagggguuagggaaggggcuagacaaaucaccugucagcuguuaccuguguaguccaguccugugggcucuggagagagcauccccuacacacacacacacacacacacacacacacacacacacacacacacacacacgcacgcacgcacgcacgcgcacaugcgcgcacacgcgcguucuuggagccagucauuggcugcccauugcucuacccgcccugcaagaggaucaaggcuccucagugcuuccuuacaagggaggggcuggaagugcaggucaggggugggugggguugaggugagagguuccccugcacagagccugcaguauguauuacacuugguggcccugaaacccaaccacagcuccucauugcaacccacaggcuccaccaaggaccuaaucgagaccuguugugcagcgggccagcagugggccaucgacaaugaugagugccaggagauccccgagaauggugcccagagugacaucuguagguaaguggcuuugggugggcagaacugcucuugccuucccuggaccccagaugugugagggugaccaaaagugaauacaaugagccaucuggccaggcggauguggggagacugacugguucugagggucagcugaccacauggaucuguggcuggcuuggugaguaaaugguguacuauuuagagcaaauucaaagugccaucaucaccuuggggauccggggcuccccaccccgaaugccccggagccgaucccuuucuauccuccucugucaccucugcugugacucagacaccugcgcucugcuucccuugccagaauuggucuucuguucucucccuuucucaacuuucauggccuacucauaaaguucagagaggcagugugauucaccuagugcugcacagcucaccaguauggccagaauuagaacucauauuuucuaaugucuacuguguucugucccugcccauucuccuucuucucccuuccccuacccccuucuucuucuucuuccuucuuuucuucuuuuucuucuuccuucuuuucuuuucuccucuuccucuucuuccuucuuucuccuuccaucuccuccucuuccucuuccuuuuccuccuucuccaucuccucuacuuccuccuccuccucuucuccucuuccaguucugagacagggucucacuauauagcccuacugaccugaaacucucuauguagaccaggcuggccucaaagagaucugcccaccuuugccucccacaugcugagguuaaaggcauucaccaccaugccuggucccacucugccuucuuuagagaacuuuaaauucuaaccuugucucuucucuuuccuuuuugccacuucuguuugggguuacugaaugacuagagcauguacacucuucagaccccauaaguuuugagcuuugcagccauuauaaauacuuacaucccucuugagauagagcucaccgccacauggaccacaccacaacuccauuacuggucagcugaucccugcacgugucccucccaaguagugcugaguccugccucucauggcccaugcuuugcuggcucgccagccaccucuuuaacagauuauucauauggagaggaacaggaggugaccagggacccagggacuacucuccccagcagaucuacuccaucuuuccugagguugggucucuauaacuuucugagaacugguaguggaacucugaaugccaacaccuuccuccagaagucaaggacacagcugaggccagugggucccaggcccaaaucaaaccuaugugacuugguggggguugugucugauuugcuaccagcccuggcgccacuugcuguagacugcaggugggggcuucccuucucuacauuccacuccaucucccuccugugagguggggacugucacccuccuugagagggacccauccauuagguacugagguauuccccuguuuuaggauagcccagaggcaaugcugcaucuccuacuugaaagagaagagcuguguggcuggggucaugggagccaaggagggugagaccuguggagcagaggacaaugauaccugcggcgucucacucuacaaggcaagucccacuugccacaaucauggcugagauguuugacaccacauccuggggugggggugggggcagacucacaccugcccagaaaauguuaacagucaugguauuggucaacaaauccacaaauuauguauugaccucaucagagacccaggagacaucuugcucucucugaggcagaguagguugaaugugacaaggaaugguuugucugagguagugaagaggucugugggcaaaggcugugcuggagcacacaacuguucuaggagcagugugguggccagcaauggaaaguccuaggaugcuagcuuucuuugcauguguauacuggaggcuggaggcuggaggcccaggcugcaucaggggcaggggagauagcaggaggaagaggagaagaccugguguuaggagaggagaguauagaguccggcuucugaggugauuuuuaccccaaguccagaccucuucucuuagcuucaguuucuccaugcauaaaacauggacaaggaauccccauccuggcccagugccagcaccuagagcuuguguucgugugguuuuuggcaguggguauugaagcaucaggugaagggugucacucccuguagcuaugccuguggcuggcuuguuugggugggccuguguagcugucguuggcugguggcugcucuggagucagguggcucagcugaacuaucuuuguucccugaaguuucucccacaaugggcuagcugagccugguucagauagggccccaagaaagagauugaaagcauacgugucgcuuaguuuuccucaccugauaacaugcccgagaagaucccuuuugugagugaaagguuuugguuccauuuguucucacuuggcccugcugccuuuaggcuuguggugagguaucaugguguggcauggugugcauaggaaagccaguuucuuauguaagagagaagagaccaguguccccaaguccccuucaagggcaugcccucagugaccuaggaucugccauuagacccacccuggguccuggaguaggcauaugcuaaccucaagcuauagugacacacaagaccuuuagaaggcuaggcucaaaugggcacaugaucacuucugucucacccuagugaccaaagcaagucauugagccagagccgcauggucacucucugagucucugagcuguuuggcuccagaguguggaugccggggaggcuggucagcugggcuuuugcuguaccaguccauugcuacaguuugacagugcaaaccagauuucccccaugucaguuggcugucugaaccgaugggucugcauauccuuagggacccaaccucucuuugucguuuuguugaauggucaguguguaguguuagcuucaggucacuucauaacuugaugugauuccaggagcuccaacacauacacucuaaggaggaugagcagggagagagagacagguacacuuccaaguagauccugucccgaacacuuuaugaagucacccggauugcaagggcccuuaggaaaugcugucuuuguugagcugacaggauuaaagucugcuucugaggguggggcauggugagcgugccuggucuucauuuguaguucuuuccaagggacauuuauucauucauuaaggaaaauuaacauuagucuacccuucuccagacuugggauguaggggugggccaccuuccacccugggagagcacacaggcagacagaggaaccagacaauacuaauucacugcagagucugccccaggcugugcccacagacccugaaugaaucacaggcacauagacugugggaacaggcaugcucugagguccugguugugauggucugucucccucagcaaugcugugacugcuguggccugggacuccgagugcgggcugagggccaguccugugaguccaaccccaaccugggcuaucccugcaaccaugucaugcucuccugcugugaaggugaagagccccucauagugccugagguccgccggccaccagagcccgaggcugcuccucgcagaggugggugcuguucucccagguggaggcaguugaaggaggacagaugggcuccuagggugguugggauggguggcuuugggcuacaguggggacccugguccauuacuguaugugguuugagguuugagcucugcuuuauaaaguucugcggcugcugacuggacucuaacaccguuugugcugcccuggcaaucccacaguucucuguaccauucaccaaucaccagugaccaucugcccuucuacucucccuucaccacccugacugucugaccaucuccacacccuuccacuguuucccuagcugggcaucauguucugcuuauauuauucuucaucugauaucugugcauccggcuauuaucuauuugcuauucuuuccauccauccauccauccauccauccauccauccauccaugcaugcaaacaccuucauccauccacaugccuaucuguuuauaguucugcuucuucauucacccccaauccauccaucacucaccuccacucauccaucacucaucuccccuacuuuauucaccuauuuuucucccauccaccccacacccauccaccagcucauccaagaugcugguugaagaugauaauuuacgaagaacaaguuauuagccagagagcgguuuaagguaguguucaggaguaaacccagcaucagaggucagaacaaagcaugggugggggggggcugggaccagguggaccacacagcugggcagggucuguucaucccuucacuuaaccacccacaguaacauugugucucuucuguguagagcuucugaguggcuuggguaugugagauacaggugcugggagcagacuguuugaaauagccgcaggcacauccuccucuuuucucuucuguugugaacauggucagaagagcaugcagaugacaaugagcugggcuuggcccauggagguacauccuggugggcucagggauuccugagccuuggucuuugaccuugggccuugccucugucugcucacaguuccagguccucaggacagagcugugaucaccaggauaggguuccucagggggagcucaaugcacccaccuucccugugacaugcccuuggauguagcuucaugccagccuucuguucucuuguugcaucuggccaaugcagaacagcucuccccuacuccccugcugcccucuggggaguagaccgugcaccccagagccuggagaccuaaagagacugcugauacagcuaagggugcugcaaucagaugucacauccuuaucuuucucaacucaggcuagcacacuuucuauagcuccaguuuagcacuuuaguaagaacccuaauuaggcacgguucuguccuauugaaggagacuuagaugaugaagacucagacccagcugcuaugggcucacuacuguucauccauacauccaccccacucccacccaccuccccacccauguggccauccauccauuccucccucucucccuccuuuacuucuucauccuuaucaucuuuugagccucuguugcuuuccuggauccugugggcucagccacccauuggccaugcuggcuauguuccaagugcugaccaaccaccccaguuucagagauggagauggcaagccgggaggcccugucacugggcacagaggcugaacugcccaauagccugccgggagaugaccaggaugagugccugaugcucccuggggagcuuugccagcaucuuugcaucaacaccgucggcuccuaccgcugugccugcuucccuggauucgagcugcagggugauggccguaccugccgcccagguaagcuguaggcagcccagggacagacuuguccugccaauggaggauagccuuccuaggcuaccucucuuccugcugccccuguguugaugcuggcagaagccagaggaggcuccuaggcuucagagaccuggaacaggcccagcugugucuccagcaccaggguuuucuccaugccagcuguauggguggaacuguuuucuagucuagauacccccuauuucuuccuuuacucuuuugccuuuuccuaguagcugugagauagcucuugcccaagguguguccauacccugagccucaguauucucccuugugaaugagcaaggggaguggcagugacgucaucagucagugccuggugugguugacugugagugucuaagcccuggcagaagaugugagccugcccccugccacaugcucuaccuguaacagauagaggugccccacaguuggacacugcacgagagucugcaccgaggucugagucugcccagguaucucccaacaccaucccacugccggugccacagcccaacaccugcaaaggugaguggaaagguagcccuucugcagggcugagcugcaagggucugagcugagacauguggugugguaggcucuggggcugggugugugcagguugggccaggcuaucuggugucucugcuuugugaaaggcccugucuguugaugacggaggaggagggggaagaagaggaggaggaagaggaggaagaggagggagaggaagaagaggaagaagaagaggaggaggagggggaggaggaagaagaggaggaggggaggaggaagaagaagaggagggggaggaggaggaggaggaggaggaggaagaggagaaggaggagaaggaggaggaggagacaucaggggauucugggucucuaggugacccuggucaaagaggaucaccugcuaugucucauuccuguaaagccaagucuuuauucagggaugccgggaagacuucccuuccugccuucugcuuuugucccucacuguccuugcugguacucaagggaugguuugacaucugaguggugugugggaggaacccaaaauauugucuccugugccagcugggacuggaggcauuuacuggggacccugugaaaaggcucaggccuggggcucccaucuuuucacaccucugucucccugggccugcaguggaaaccccaacccauaccucagaccugaaggaugagcaguguggccagggcuuaugaauucugacucugagacuuuuuccucagacaaugggcccugccgucaggugugucguguuguuggggacacagcuaugugcuccugcuucccuggcuacgccaucauggcagaugguguguccugugaaggugaguacuuugggguuacccucugaucuuugcagaucugguuggcccauggugagagcuuagggaaggggagaucaggacuucaaaugcacccugaucgugagguucagcuguugugacagagaagcccagcaggacaguguaggcgguucucucuggugucacugaguccuugguauuggcccuccaugcggcuccuaucuggcugcucugcugcugucuaaggaccaaaugccucucagaauugaauguguaccgcaucaccugaaggcccauuggacacagauuccugggaauucugcugacccuccagacaaccucacuaggggucuggauaagcuuugaacuuguguucuaaucaggacucaugccagauauggaccauucucaacucacugcucccugagggcugguguggucuacaaggcuaagcuuacuuugugaucucugaguucauccaugcuccagcccaagguggagaaagagagaagggagcgaugugucacuguguuggaugugucacuguguugguggcagcauccagaagugaccuccucccccacaugccugcagucauggagagggaauugacauugguggcggugagcuuccucugccagucacagugaagaacaucacucuucaugucauugugacuggcagaggaagcucaccgccaccaaugucauguagauaggaccucucaguacacaguauacaacgggaacagugguucugacgccuauugguuggcuuccucagugaguuuuguuugaacuaguuugaggguccuaggaucuuaccccuccugucuuagcagaagcaggauagagagccaagucuaggauauguaugggcucaggcucagaaggcauggucugaauaucugcauagaaugaucaggcuuguccaaaaggaugcccacguucuucucugaagcucacaucccacauacucuagaggcucuguauguaacugacacccuccagugaguccagagaaggugcuaaagcacagagccuggugacaacugauuggccuuucucucugaugauggagacaacagacccaggggauaauguguucuuugagcucugauucuccccagggcucucagcucugaccccucucagggaccugcugcccgaggcccagucuacugccucugccagacacuggcgcacugcagcaggaagaguggaggggaacagggcagaggcugcaaagacacaccugugagggcauguacagcucccacacaggaggaggccugucuccuuuuguucucaggaauaaucacagggauucucugcugggacagccugaggauuuuaaaaauaucuccagauuugaguuucuggagaaacuucauaaagcuucuuuucauggaggcccuucuguauagccuuagccuggcagccucuggagcccuccuccccauccccuucugugaaugauacuggccuggaaccccagagcccuugaaauuucagacccuacuguuguuaucucuuugguugcuguagacuugggcauuauuaccaagcauggguuggggaaaguuugcugccugggguuuacucugggcuggcugcuuauccucucugagucucucuccaucugcccuuacugggcaguaggggcagcucuaacaucuuugaguuuuacaaacucaacuugggucuaagguucagcugcccccugacaggcgcacacagguucuuuaucucucucuccccggaugccccuggcagacacgccucucuaacagccuucuguuuuuccuuccguggcugucauuagaccaagacgaguguuugaugggcacucacgauuguagcuggaaacaguucugugugaacacccugggauccuucuacugugucaaccacacagugcugugugcagagggcuauauccucaacgcacauaggaaguguguggguaagcuagagccccugccugccgccgcccacgucacggcugucugcucugcuccacgccaacccaccacauagugccacaugcuaaagggccuacuacccuuugcaugugagcucccacacagcagccugccgagcucugugucauacccucguguccuggugucuugucccgcuuguucuccauggcuguguucccagauaugcccgugacucagaaagcuaaugggaugucucagggaugggccagagacaggaaggccagauguggacagcagggccauguagcaguguggaagcagggaggccugggugggaggcaggaccccaguggcucuggcucuugucuuuucucaguuauuggaagcuacugacagcgacgaggauucgggugcaugugccgugugcacauagucugggucacacauccuguuaccucggccacuuagcuugcuuguagauuuaucugggaucucccgagaggcaaguagauuguccugguccagcuggcccaguucaacauccauuugcugugugacccugaacaaauguuacuuuccccucugagccuuccuucaauggacaaggaagaugugagcccuguguaaaccugcacguggcugggccucuugucuaucuaugccugaauaggccggggcugggauucuggaguucuguggacaaggaaggacuccauacugucuugugucugaguuaccugguauucucacugaggaaaaaauguaagcccuggcuuccugcaucucagagauaacacugaguagaggagaagucaggcagacuggcugaugcaaugauggggaaacaggcaaagggagacuucacucuugccaacuggcacccagaggaaagaggaauagcuccaccuauucccaaggaugggugggaauuggcgaugggaaaagccacaaaacaggacaguuuugaagacaguugggacagagguguggaggugggaccagggcacacagugcucagggcuugcggccagaguccugucugucuugccugugcuuggggaccauguccagccuggacauguccucuuccuccccugcaccgcugggcagcagugcuggcugacauguuugccucgcugcacccacgguacaacauggcccuccugaugugcuugccagugauggcaguuccuccuggguggacuggguuugugugugugugugugugcgcugggaggcauguggguccccucucaggauguccccccauuugccacucccuggcuuggcagcuaugaccucugcugcaggguucuuagcggcugaaagaugagcccacggaugagaaagccaagauacauuccauucagcaagauuuaugaaccagcucugcauugcuucccucuuuauucugcacaagcuaucagucacucuccucccacuucaagccaacaucacuugggggcucggggguucugcaguugcucugcucaggugcaggaacucagauaggggaggagcaggaccaugcugggaugaguguggcuucacugaaguccauaaccucucugagcccuaguuuccccacuccacaaaagaggcaucugcaucugaaggucaccauggagaccgggugcauuaguccccaggaggaaugcuagcaggguucccugagcuagaagcugaggccuagaagcuggggacagcuugguguggccucugccagggcccccuauaugcuuuacucuuaagaaaguuccacagcuaugcuggcuggacugcagagaguaggaauggcaaagcccugcucugaggacuuugcaacgggaagcaggcagcgagaaaagccuguagcucggagcaagcgcccuagauuccauauuugcuggcugcguaauucaguccaguggcaucccuuuggggugaaagaucuccucaucugugaaauggccaccucuguauuacaagacagugagucuggucaguucuuguagcuuccugaccccuggggaucuuuugugaguagugacucuugucauacaauacucugaggccucuuagcugugggaaacuccuaggguccuaggugcccaucucccugugccuauucagcuguacaucagaugucuuuguggugccugauuguaccucuauggcaaacuugacucaaaacugucccuucccuaucgccauuucugucuauaccaucucugccuggaagggucucuuccccaccccuacuuuccuaccugguccccuaaucauacucauagauucaacucaaauguuacuaccccugagaagcagcuggcauuacaggaccagggaagacagcccucugaucugagccccagggaccccucuuuaucugugucucuacuugccugccuugaccuauccaucagggucagaggcugugcuaacccacuguguggagaauucugguggagaauaagcacuggccaguguagcacuaagcaaguaggcugugccuaaguaccauuacaugccagguacaggccagggcuaaggguccuuccaggcuccauccagccuacucccagcugcuuaucccuagagugucccaaugucuguccguggccucuucuucauguaccuauuccuucaagugaccucagccaccugacuauccccucagcuccuucagugagcccagaguuaggaagacuaacccugugagcccagagguaggucauuagcugccuccuagccccugagaaccccaggaccuucuucagcacaccugccccccccccacaggccacccaucccaggugcuggcaucuauuuagcugcucagcccaaagcuuuucugaucuccugguucucucacuuccccuucugccaucugaggggucuggcugcuucugcucucuuccagcauaccagccaccauccuucuguggauaaaugacaucuccuccuagucugcucaccagcuccaaccagggugccuucauuccuauagcaggaaccacuuuggcucccauccucuccuugguauaaccuugucuguucacauuuucuucucuccccuacagccacaccugccucuugguuaguccugaaccugccugggcuaucaucuaacuguuccuucugccuggacugucagaguggcuccugcugucaccucuucaccuuccuacucagauguccgucuucugacagugcuccucaucccugccuuaaacuugcuugcccugucucugccucagcccaccuuccuccugcugugguccccauaguccccuuugagcaaccucauugcauaugcaagcaucuccaagcaucugcuccaagggcaggcauuucugucuuguucacucacccaucccucuugucaagagcccugcuugacaccuagaggggugugauaaaucuuuguugaaugaagggauacuuggauaaggggacaucagcuucaugcuucucccugcauggugaguaccugaggucagagccuggugcuuccugucucagugccugguugugcuaggccuauaugcuaggcucuaguaccuggagccccugcaggcccugacagcugccucaaucuccacacagacaucaaugagugugugacagaccugcacacgugcacccgggccgagcacugugugaacacgccagguuccuuccaaugcuacaaggcgcucaccugugagccaggcuauguccucacagauggugaaugcacagguaagaaagugcuagacucuccaggaguccaguuuccgugaaacuuugugucucaggacugcagccaagcuuuuggacuugucacgcagacuccacuggagugaguguggcagaaccucacaucugcucucuaggcuaacugucccagggaugucccuaccccugcccugucucacuucccccauuccugcacuugacuuuccuuggggugggggugggguggucucugaggcuaggggugggagcugggacaagggcaacaccugcccuugcccuuucuaccaccugcugaucauugcuaugcuaaucauucuuauggccucaguuuccccauuugcacacugaaguggagccccacagaugauuguucauaucucauucacuggaaaauucuagcuuucuaauaagagggauuuuuuuuucaguaucucacauauuucuuaugcuucuuuuaaugccagacaggguucuggguaccaguagcacuggugugaggugaccuuucugugaccucaugguagaggauguggggaauacagagauggcgaagcagucaugggagguaggaggaugugucuucaaugagcgucuagaaaggcucucaggaaagugacaguguaguugagacauagaaaaaugggaggcuaccuggaaaggggcugugggcauagggaacagcaggcacagaggccuacgaaauggaggaaggcuccuggcaagggccccaggugcgagccucugugcuccagugacaagugugacuuaaccuuaggauacagucucucacacguuucugccugcuccucaccaguguggugugaugggugguagggagucaggcugccuggcauucuguagcaauggaagcuugccugugccucaguuucuccucuuucauaaaguaggccagucacaggauguacucuguguugcugugagaaugggauaaauuuaaucaugucacaugcuuuggauaguggcagggaucauagagaaguguggagcaugugguuaugucacuuuuacuccugggacaugggccuccucagugacuccacucugccaccuuacugggaugcagaccuuugugggauuacaacggugugaagcuucgaaguguggcagggcugcuggcugugagggcagggccuccugccucccaccucuaguugugagagcagggccuccugccuccugccccuaaugcccagccucuguguggcagacguggacgaaugugugacgggcacacacaacugccaggcaggcuucucaugccagaacaccaagggcuccuucuacugccaggcccggcaacgcugcauggauggcuucuugcaggaccccgagggcaacuguguggguaagcaggcuucgggcuguggcuccucagguccugcaggcuuuagaacccuagugggucuagcugguggccccccuucucccagccucacuaucuccauccauugaguggguaugugcagaaugguagcugcucugcucaccuuggagcuguuucucacagggccucaguuuaccuacuugugggaccaaacuaaaagaacacagaucauguguuuugagccagcugacagaaagaacugucuaggauacaauaucgcaggguuccugacugaagugaaauccacaguugcuuucacugucuaaaaccacugugaggcucucuagauuagcuccgugccaugguugagacaugccgugugacagaugccggccucauuguccugagaaggucugagaugucacuuacuccuuccaaacagccagggcauaccaugucccuagagcuucugacuugucuucugcuagaaugcagguggcagaggggacaguggcacagagaggcaaagagcuggcagcauuuccugaguaccaacuaugcuccaggauucuagaugggggcagccauaguguuugcugaacuguuuaguggggagaccaaauaggcagccauguuuacaaaaacaccaggaauucauuuauacuuugauaaaaauaauaauaauaaacaaccaugaccagucuugccuuccccuuggcuuuagcuguuccauuggacagauguguucacacuguagucagcccacuggcuguggcuucuggaggugggauucucacgugccaggguucaggggugguauagucuaggcuuaaaacccagagcugggcacaugaguggaggaggggcaagccgggcuuuccaucaccuugucgcuucugcagacaucaacgaaugcacaucguuacuggagccuugccgcucaggguucagcugcaucaacacagugggcuccuacaccugucagaggaacccacuggucugcggucgcgguuaccaugcuaacgaggagggcucugaauguguggguaagguuggagccuccccaucuacuucucugcccaagaggccccauagaggggcuguccggaccucagggugucuugcuugccugccccacagaugugaaugagugugagacaggugugcaucgcuguggcgagggccaacugugcuauaaccucccuggauccuaccgcugugacugcaagcccggcuuccagagggaugcauucggcaggacuugcauugguaaaagacacuggcgucugggauccacugggaacaaagagccuacccccucuguaccaguugucuggccuggaccuccccagauggcugucuucaagccuccucuccccuuggcuaagacuccuugcuauagcccccuuacugccuugucugccuguguuucugcacccucugggacauucccuccuggcugcccacucugugccugcugcccauugucuccuuugcagaugugaacgaaugcugggucucgccgggccgccugugccagcacacaugugagaacacaccgggcuccuaccgcugcuccugcgcugcuggcuuccuuuuggccgcagauggcaaacauugugaagguacugcucacccugccuucugaccccugccuucugagcccauguaccuagcuccuacuuggacaggcagccucugauuccugcugugaucacagggaguuuguuggcaggacagcacugggcagccaugagcacucaggagcaaggucacuuguuucccacagcugauaccaccaggcaguaaagccuggggcagucuaauuuaucuggcuuuucagaaaccaggaauuucauccuguguguaaaaucagcagcucuguauucauggcugauaguguaagccuuggaguacacagugagauaaaccaaguguggcacagguugugguucaagucugugaugggccuguagcuggggaagugauaucacggaguucccacaguugcuuaguccccuagugcagcuggcucagguccacuggggaagagagccaugagguggcucagugagaagcugaucuucagccaagagaccauggcaucucuggcuccaauuucuuaacaguuuuccucacuccuccaagugggaccaaucugcugagaccucugugagacucccaguccuuugacccuguguguguguguguguauaggggugggguggcuauaacaagacacugggauagucacucauacccacuagugucauuauacugugggcaugccucauaccagauugggugugggcaacccggagcagacagggccucuaccuccccagcauucugccuaggcaugauucuuacguucaccucugugcuucaacuggcugcauguuggagacccggaggugaauugagcauggauucugccagccagaugcacagcacagcacaguagacgagccacauauugacacguggccugucuuuugggaaugggcuucaguucaagaguuagauacggucggcugccguugccuccuuuugcaugccccuuaguucuucugccucagccaccuuugccucauucauguucccuaaaaacacucagcaagcuccgaccucaggaccuuugcacaugcugugcccuacagagccccuguccuagauggccacauggcccugucccuaugauuacauccucccugaucacuuugccuaugacugcagcucacaugagaccucugugagacaccccuuuccauuguucugaugugcuuuccccaugccucugaauguacuuaggcaugcuggccaucuuguuuaccagucccucuccuccccucuucucuccacacgugagcuagcucuuccaggugaagauauugucugccuucuucauggcuguuucuccaaguccaguguaggcccugugcagucuaaugggaaacagcucagucggcagaugcucugaggaagcuaugaacuagcucucccuucuucacccuacaguaguuccugcacccucccccaccucagcaaugucagcucuugguggccuauuuugugccuaggugacucaagaguuccagucauugcguguucccagcagggcaguaccaggcuuugccuugguuuguccuggggccagaaaacuugcccuugcugaguguccugccuggccccaccuuccucaaaggguguccgaaggaaagucucucuaaacaaggauacuggugagccagcccaguccaguauauagucugggaggacucacuaugaugaagacucugucccuguuguguccagccagcagaucacuaccuggguucuagccuggaaaggcauuuuggaaaccuggaagagaagaagggcuaggcugcgagagauaaggaaggaaccaagacaagcucucugcucaagguucaauuuuaaugucagcaaacaugcuuuauaaagaaaaggggaggcccaucccuggccaagcaaaguuccuuugaaauagauaggucagccuuuuagugagaacucucgaagagguguuaacucuacuccggaagauucuuggaagagaacugguuaggccucuggcagguugagccucaggcauguaguggcacaucaaaggagcagcacagcagguggcuccgcucaaacgguggcagauggucacagccagccuugcuaggcugaaaagagguaacauguccccacagaugugaacgagugcgagacucggcgcugcagccaggaaugugccaacaucuauggcuccuaucagugcuacugccgucagggcuaccagcuggcagaggaugggcauaccugcacaggugagccccucccaggacucacaugaagaaggggcaccuuuccccauaugcugggaucccaggggauuuaguguggggucugaguucauaucccagcccacaguuuuccugcugugcgaccuugggucucuccacucugaccucaagguccuucucuguaaaguaugauacccugaucucaacaggaguacaucgcccaagucgggcuggcaccuaaauagcccuuggauggugcugucauuauuaguggugcacaguccugggaauacuguauauagucugggaggacucauucugcuccccaucuccuauguggcuuugagcgaucgacucccaccaccggagccuucuugucuucccuucuuaauggccccugggcuuccuggcugagccuguggaugggugaggcuuaccagcugacccuuuuugacagacaucgaugagugugcacagggcgcgggcauucucuguaccuuccgcugugucaacgugccugggagcuaccagugugcaugcccagagcaaggguauacaaugauggccaacgggagguccugcaagggugagugacagccuccacucccacauacauagucaggcagcucugugucugcaucaggcuucgagcuuagcacuaagcccacguguucagaacaacugugcucagggcagggcaauagucccugugucuaggccugggaugaggaaggugaugggcuuucugccauuuaggccagcauagaaucuuccagguuuggccuugaaucuguaccccacccuggugugaggagacaagggacugucuaugaacauacuggaaggagagccuuagagaucugaacugcuguccucaaaucucugucaaacuguccagggggccuacugggauaggaaaguaugcuguccagacgccaggguauagggaaggaguccuagggaggccaacacuagucuggugcccugugugucuugaagaaaaagugaguugguccugggugggacagguaggcagcucugcauucagguuagugacuguggcugcuggcuguuagcccagcaucccaggcuguggugaagcuugguauguagcgggcaaucaugaacuuuauucugagaagccagcagaacaggaccccugcugcugugugccccagugagaugggcagauggcucuguaagggagugagcugugcucuuaggccacacagcuagcuucccagcacccgggcuuccagugugggugggagugguucaggcuggguuccuaggccaugaggauucucuuaacagcccuccucucccguuccagaccuggaugagugugcacugggcacccacaacugcucugaggcugagaccugccacaauauccaggggaguuuccgcugccugcgcuuugauuguccacccaacuauguccgugucucagaaacgugagugccuuuagcccuggugugauccagggcucuuuacugccacugggacacaggauaagagucagauaagauaaggauaagaguccugccauggucaccuccuaccuuuucccaaaaaguacuaugaaaagauauagagaacuauccaugcuaaaaagagggcugucaccucaaagggagguuugaucuauggucagauaugaaugaccacagcccaggaacauggauacaggcugacucaaauagcauguuugugaaaacaguuuuaugaaguuucuaggguaacaaaacaaaagauuuauaaaugaacacacuuaaaaaaaaacacugguggacacaugcagguuauguaaacuggggaaauuucuuggcuaucguuugguagcauucuuagccuucgggcuaguggaagcuaggagucuauuuguguauucccaaaggauuucccuaaugacacaugcaggucacaccagagauggguacuggguagcuauuaagggagcugaagauagcuuaaaauaaucuuucuacaggaccuguaacauucuaacucuccagagucacaaccaguuaaucagccuuguagacucuuuaacacagacagaguauuugcugggcacucccuaugcgcgcacgcacgcacgcacgcacgcacgcgcacacacacacauacacucacacgcacucacacacuacaugcauuaccuacuguguaacaaacuccccgaauuaccauauaugcuccuuaccuccuggggguuucugggggccagcagacagagcagccucaccagugcaguuucaugggacagcugccaugucugggccuccugagcccaccgugaaacuauuccugucccugcccgaucuucuggcugcuggccugcauuugcaaggucuggccaggcaaacagucaucagguuguagacugaggccauagugucucacccuuggccagcucacuccucagccucuccaagggcugccuaggcuguggccucccucgcgcaggacacaagaugcaugagcugaaguacuuaaagggacuuaacucagaaaugagagcacccugcgcugcaacaggauacagguuggguauggcgggccagcaggcugugcugggcagagggcugugaggaauagggaaggggaagaauggaaggaacaaauauguaugaagagaacugcugacaggccugcugggaccuugugccaggcacgccagccacacccucacaggagaccaucuuacagcugggaauggggccuagauggguaaaguaacuuacuuguggcugcuggauuccucuggguagagcucacauuugcucccugguccacuagugccugagcuagcugcuggggucugucccacaucugggaugggagugagggucccuagucauugaccaagcaucuuucccucacaggaagugcgagcgcaccacaugccaggauaucacggaaugucaaaccucaccagcucgcaucacgcacuaccagcucaauuuccagacaggccuacugguaccugcacauaucuuccgcaucggcccugcucccgccuuugcuggggacaccaucucccugaccaucacgaagggcaaugaggagggcuacuucgucacacgcagacucaaugccuacacuggugugguaucccugcagcggucuguucuggagccgcgggacuuugcccuagauguggagaugaagcuuuggcgccagggcucugucacuaccuuccuggccaagauguacaucuucuucaccacuuuugccccaugaggugacaugucaggcaaucccuccaggugaugccugggcggugggcagcugcgccacuccuaaguggcuuuuugcugugacucuguaacuuaacuuaaucaugcugagcugguuggucuugagucucuacccuagagggagggagaugcaccccagcaggcacugaguacaggccagggucacccgaggcuagauggugaccugcaaacuggaaacagccauagggggcuucugaacuccacuccucaacuauggcuacagcugacauuccauuccuucauccacuguguuccucaauuaaaaaaaaaaaucagcugugcaugguagcacagaccuuuaauccuagcacuggggaggcagagguagguagaucucugaguuccaggccagccuggucuacacugggaguucuaaccagccagagcuacauagagagacccuaucucaacaaggaaaaaacgaaagaaaucucugugaguuccaggccagccuggucuacgcugggaguucuaaccagccagagcuacauagagagauccuaucucaacaaggaaaaaugaaagaaaucauuuuaaaagguuuuuuuuuuugcuguuguuguuuaaugauaagaguagcacauauacauuauuaaaaaugaucaaauagcacagaaagguuauucagucucuuugacuucuuucuuuuguaaaacacugaagauuggcaucaguccuggaaugucacagggucuccaacuaacagaugagcucagagugagagccacagguuucuauuaugucccugccucuucuccugcccgcacuugcuacccgcuacucccuccuucucccagauggguucucgagcugcuuggugggucaccuuggguguggugguggcaggucuggaguggaugugggcagaacugaaaaagacacauuuucuuugauccug

SEQ ID NO: 3225 - RNA, 60362 nt, Mus musculus
caggaucaaagaaaaugugucuuuuucaguucugcccacauccacuccagaccugccaccaccacacccaaggugacccaccaagcagcucgagaacccaucugggagaaggagggaguagcggguagcaagugcgggcaggagaagaggcagggacauaauagaaaccuguggcucucacucugagcucaucuguuaguuggagacccugugacauuccaggacugaugccaaucuucaguguuuuacaaaagaaagaagucaaagagacugaauaaccuuucugugcuauuugaucauuuuuaauaauguauaugugcuacucuuaucauuaaacaacaacagcaaaaaaaaaaaccuuuuaaaaugauuucuuucauuuuuccuuguugagauaggaucucucuauguagcucuggcugguuagaacucccagcguagaccaggcuggccuggaacucacagagauuucuuucguuuuuuccuuguugagauagggucucucuauguagcucuggcugguuagaacucccaguguagaccaggcuggccuggaacucagagaucuaccuaccucugccuccccagugcuaggauuaaaggucugugcuaccaugcacagcugauuuuuuuuuuuaauugaggaacacaguggaugaaggaauggaaugucagcuguagccauaguugaggaguggaguucagaagcccccuauggcuguuuccaguuugcaggucaccaucuagccucgggugacccuggccuguacucagugccugcuggggugcaucucccucccucuaggguagagacucaagaccaaccagcucagcaugauuaaguuaaguuacagagucacagcaaaaagccacuuaggaguggcgcagcugcccaccgcccaggcaucaccuggagggauugccugacaugucaccucauggggcaaaaguggugaagaagauguacaucuuggccaggaagguagugacagagcccuggcgccaaagcuucaucuccacaucuagggcaaagucccgcggcuccagaacagaccgcugcagggauaccacaccaguguaggcauugagucugcgugugacgaaguagcccuccucauugcccuucgugauggucagggagaugguguccccagcaaaggcgggagcagggccgaugcggaagauaugugcagguaccaguaggccugucuggaaauugagcugguagugcgugaugcgagcuggugagguuugacauuccgugauauccuggcauguggugcgcucgcacuuccugugagggaaagaugcuuggucaaugacuagggacccucacucccaucccagaugugggacagaccccagcagcuagcucaggcacuaguggaccagggagcaaaugugagcucuacccagaggaauccagcagccacaaguaaguuacuuuacccaucuaggccccauucccagcuguaagauggucuccugugaggguguggcuggcgugccuggcacaaggucccagcaggccugucagcaguucucuucauacauauuuguuccuuccauucuuccccuucccuauuccucacagcccucugcccagcacagccugcuggcccgccauacccaaccuguauccuguugcagcgcagggugcucucauuucugaguuaagucccuuuaaguacuucagcucaugcaucuuguguccugcgcgagggaggccacagccuaggcagcccuuggagaggcugaggagugagcuggccaagggugagacacuauggccucagucuacaaccugaugacuguuugccuggccagaccuugcaaaugcaggccagcagccagaagaucgggcagggacaggaauaguuucacggugggcucaggaggcccagacauggcagcugucccaugaaacugcacuggugaggcugcucugucugcuggcccccagaaacccccaggagguaaggagcauauaugguaauucggggaguuuguuacacaguagguaaugcauguagugugugagugcgugugaguguaugugugugugugcgcgugcgugcgugcgugcgugcgugcgcgcauagggagugcccagcaaauacucugucuguguuaaagagucuacaaggcugauuaacugguugugacucuggagaguuagaauguuacagguccuguagaaagauuauuuuaagcuaucuucagcucccuuaauagcuacccaguacccaucucuggugugaccugcaugugucauuagggaaauccuuugggaauacacaaauagacuccuagcuuccacuagcccgaaggcuaagaaugcuaccaaacgauagccaagaaauuuccccaguuuacauaaccugcauguguccaccaguguuuuuuuuuaaguguguucauuuauaaaucuuuuguuuuguuacccuagaaacuucauaaaacuguuuucacaaacaugcuauuugagucagccuguauccauguuccugggcuguggucauucauaucugaccauagaucaaaccucccuuugaggugacagcccucuuuuuagcauggauaguucucuauaucuuuucauaguacuuuuugggaaaagguaggaggugaccauggcaggacucuuauccuuaucuuaucugacucuuauccugugucccaguggcaguaaagagcccuggaucacaccagggcuaaaggcacucacguuucugagacacggacauaguuggguggacaaucaaagcgcaggcagcggaaacuccccuggauauuguggcaggucucagccucagagcaguugugggugcccagugcacacucauccaggucuggaacgggagaggagggcuguuaagagaauccucauggccuaggaacccagccugaaccacucccacccacacuggaagcccgggugcugggaagcuagcuguguggccuaagagcacagcucacucccuuacagagccaucugcccaucucacuggggcacacagcagcagggguccuguucugcuggcuucucagaauaaaguucaugauugcccgcuacauaccaagcuucaccacagccugggaugcugggcuaacagccagcagccacagucacuaaccugaaugcagagcugccuaccugucccacccaggaccaacucacuuuuucuucaagacacacagggcaccagacuaguguuggccucccuaggacuccuucccuauacccuggcgucuggacagcauacuuuccuaucccaguaggcccccuggacaguuugacagagauuugaggacagcaguucagaucucuaaggcucuccuuccaguauguucauagacagucccuugucuccucacaccagggugggguacagauucaaggccaaaccuggaagauucuaugcuggccuaaauggcagaaagcccaucaccuuccucaucccaggccuagacacagggacuauugcccugcccugagcacaguuguucugaacacgugggcuuagugcuaagcucgaagccugaugcagacacagagcugccugacuauguaugugggaguggaggcugucacucacccuugcaggaccucccguuggccaucauuguauacccuugcucugggcaugcacacugguagcucccaggcacguugacacagcggaagguacagagaaugcccgcgcccugugcacacucaucgaugucugucaaaaagggucagcugguaagccucacccauccacaggcucagccaggaagcccaggggccauuaagaagggaagacaagaaggcuccgguggugggagucgaucgcucaaagccacauaggagauggggagcagaaugaguccucccagacuauauacaguauucccaggacugugcaccacuaauaaugacagcaccauccaagggcuauuuaggugccagcccgacuugggcgauguacuccuguugagaucaggguaucauacuuuacagagaaggaccuugaggucagaguggagagacccaaggucgcacagcaggaaaacugugggcugggauaugaacucagaccccacacuaaauccccugggaucccagcauauggggaaaggugccccuucuucaugugaguccugggaggggcucaccugugcagguaugcccauccucugccagcugguagcccugacggcaguagcacugauaggagccauagauguuggcacauuccuggcugcagcgccgagucucgcacucguucacaucuguggggacauguuaccucuuuucagccuagcaaggcuggcugugaccaucugccaccguuugagcggagccaccugcugugcugcuccuuugaugugccacuacaugccugaggcucaaccugccagaggccuaaccaguucucuuccaagaaucuuccggaguagaguuaacaccucuucgagaguucucacuaaaaggcugaccuaucuauuucaaaggaacuuugcuuggccagggaugggccuccccuuuucuuuauaaagcauguuugcugacauuaaaauugaaccuugagcagagagcuugucuugguuccuuccuuaucucucgcagccuagcccuucuucucuuccagguuuccaaaaugccuuuccaggcuagaacccagguagugaucugcuggcuggacacaacagggacagagucuucaucauagugaguccucccagacuauauacuggacugggcuggcucaccaguauccuuguuuagagagacuuuccuucggacacccuuugaggaagguggggccaggcaggacacucagcaagggcaaguuuucuggccccaggacaaaccaaggcaaagccugguacugcccugcugggaacacgcaaugacuggaacucuugagucaccuaggcacaaaauaggccaccaagagcugacauugcugaggugggggagggugcaggaacuacuguagggugaagaagggagagcuaguucauagcuuccucagagcaucugccgacugagcuguuucccauuagacugcacagggccuacacuggacuuggagaaacagccaugaagaaggcagacaauaucuucaccuggaagagcuagcucacguguggagagaagaggggaggagagggacugguaaacaagauggccagcaugccuaaguacauucagaggcauggggaaagcacaucagaacaauggaaaggggugucucacagaggucucaugugagcugcagucauaggcaaagugaucagggaggauguaaucauagggacagggccauguggccaucuaggacaggggcucuguagggcacagcaugugcaaagguccugaggucggagcuugcugaguguuuuuagggaacaugaaugaggcaaagguggcugaggcagaagaacuaaggggcaugcaaaaggaggcaacggcagccgaccguaucuaacucuugaacugaagcccauucccaaaagacaggccacgugucaauauguggcucgucuacugugcugugcugugcaucuggcuggcagaauccaugcucaauucaccuccgggucuccaacaugcagccaguugaagcacagaggugaacguaagaaucaugccuaggcagaaugcuggggagguagaggcccugucugcuccggguugcccacacccaaucugguaugaggcaugcccacaguauaaugacacuaguggguaugagugacuaucccagugucuuguuauagccaccccaccccuauacacacacacacacacagggucaaaggacugggagucucacagaggucucagcagauuggucccacuuggaggagugaggaaaacuguuaagaaauuggagccagagaugccauggucucuuggcugaagaucagcuucucacugagccaccucauggcucucuuccccaguggaccugagccagcugcacuaggggacuaagcaacugugggaacuccgugauaucacuuccccagcuacaggcccaucacagacuugaaccacaaccugugccacacuugguuuaucucacuguguacuccaaggcuuacacuaucagccaugaauacagagcugcugauuuuacacacaggaugaaauuccugguuucugaaaagccagauaaauuagacugccccaggcuuuacugccuggugguaucagcugugggaaacaagugaccuugcuccugagugcucauggcugcccagugcuguccugccaacaaacucccugugaucacagcaggaaucagaggcugccuguccaaguaggagcuagguacaugggcucagaaggcaggggucagaaggcagggugagcaguaccuucacaauguuugccaucugcggccaaaaggaagccagcagcgcaggagcagcgguaggagcccgguguguucucacaugugugcuggcacaggcggcccggcgagacccagcauucguucacaucugcaaaggagacaaugggcagcaggcacagagugggcagccaggagggaaugucccagagggugcagaaacacaggcagacaaggcaguaagggggcuauagcaaggagucuuagccaaggggagaggaggcuugaagacagccaucuggggagguccaggccagacaacugguacagaggggguaggcucuuuguucccaguggaucccagacgccagugucuuuuaccaaugcaaguccugccgaaugcaucccucuggaagccgggcuugcagucacagcgguaggauccagggagguuauagcacaguuggcccucgccacagcgaugcacaccugucucacacucauucacaucuguggggcaggcaagcaagacacccugagguccggacagccccucuauggggccucuugggcagagaaguagauggggaggcuccaaccuuacccacacauucagagcccuccucguuagcaugguaaccgcgaccgcagaccaguggguuccucugacagguguaggagcccacuguguugaugcagcugaacccugagcggcaaggcuccaguaacgaugugcauucguugaugucugcagaagcgacaaggugauggaaagcccggcuugccccuccuccacucaugugcccagcucuggguuuuaagccuagacuauaccaccccugaacccuggcacgugagaaucccaccuccagaagccacagccagugggcugacuacagugugaacacaucuguccaauggaacagcuaaagccaaggggaaggcaagacuggucaugguuguuuauuauuauuauuuuuaucaaaguauaaaugaauuccugguguuuuuguaaacauggcugccuauuuggucuccccacuaaacaguucagcaaacacuauggcugcccccaucuagaauccuggagcauaguugguacucaggaaaugcugccagcucuuugccucucugugccacuguccccucugccaccugcauucuagcagaagacaagucagaagcucuagggacaugguaugcccuggcuguuuggaaggaguaagugacaucucagaccuucucaggacaaugaggccggcaucugucacacggcaugucucaaccauggcacggagcuaaucuagagagccucacagugguuuuagacagugaaagcaacuguggauuucacuucagucaggaacccugcgauauuguauccuagacaguucuuucugucagcuggcucaaaacacaugaucuguguucuuuuaguuuggucccacaaguagguaaacugaggcccugugagaaacagcuccaaggugagcagagcagcuaccauucugcacauacccacucaauggauggagauagugaggcugggagaaggggggccaccagcuagacccacuaggguucuaaagccugcaggaccugaggagccacagcccgaagccugcuuacccacacaguugcccucgggguccugcaagaagccauccaugcagcguugccgggccuggcaguagaaggagcccuugguguucuggcaugagaagccugccuggcaguugugugugcccgucacacauucguccacgucugccacacagaggcugggcauuaggggcaggaggcaggaggcccugcucucacaacuagaggugggaggcaggaggcccugcccucacagccagcagcccugccacacuucgaagcuucacaccguuguaaucccacaaaggucugcaucccaguaagguggcagaguggagucacugaggaggcccaugucccaggaguaaaagugacauaaccacaugcuccacacuucucuaugaucccugccacuauccaaagcaugugacaugauuaaauuuaucccauucucacagcaacacagaguacauccugugacuggccuacuuuaugaaagaggagaaacugaggcacaggcaagcuuccauugcuacagaaugccaggcagccugacucccuaccacccaucacaccacacuggugaggagcaggcagaaacgugugagagacuguauccuaagguuaagucacacuugucacuggagcacagaggcucgcaccuggggcccuugccaggagccuuccuccauuucguaggccucugugccugcuguucccuaugcccacagccccuuuccagguagccucccauuuuucuaugucucaacuacacugucacuuuccugagagccuuucuagacgcucauugaagacacauccuccuaccucccaugacugcuucgccaucucuguauuccccacauccucuaccaugaggucacagaaaggucaccucacaccagugcuacugguacccagaacccugucuggcauuaaaagaagcauaagaaauaugugagauacugaaaaaaaaaucccucuuauuagaaagcuagaauuuuccagugaaugagauaugaacaaucaucuguggggcuccacuucagugugcaaauggggaaacugaggccauaagaaugauuagcauagcaaugaucagcaggugguagaaagggcaagggcagguguugcccuugucccagcucccaccccuagccucagagaccaccccacccccaccccaaggaaagucaagugcaggaaugggggaagugagacagggcagggguagggacaucccugggacaguuagccuagagagcagaugugagguucugccacacucacuccaguggagucugcgugacaaguccaaaagcuuggcugcaguccugagacacaaaguuucacggaaacuggacuccuggagagucuagcacuuucuuaccugugcauucaccaucugugaggacauagccuggcucacaggugagcgccuuguagcauuggaaggaaccuggcguguucacacagugcucggcccgggugcacgugugcaggucugucacacacucauugaugucuguguggagauugaggcagcugucagggccugcaggggcuccagguacuagagccuagcauauaggccuagcacaaccaggcacugagacaggaagcaccaggcucugaccucagguacucaccaugcagggagaagcaugaagcugauguccccuuauccaaguaucccuucauucaacaaagauuuaucacaccccucuaggugucaagcagggcucuugacaagagggaugggugagugaacaagacagaaaugccugcccuuggagcagaugcuuggagaugcuugcauaugcaaugagguugcucaaaggggacuauggggaccacagcaggaggaaggugggcugaggcagagacagggcaagcaaguuuaaggcagggaugaggagcacugucagaagacggacaucugaguaggaaggugaagaggugacagcaggagccacucugacaguccaggcagaaggaacaguuagaugauagcccaggcagguucaggacuaaccaagaggcagguguggcuguaggggagagaagaaaaugugaacagacaagguuauaccaaggagaggaugggagccaaagugguuccugcuauaggaaugaaggcacccugguuggagcuggugagcagacuaggaggagaugucauuuauccacagaaggaugguggcugguaugcuggaagagagcagaagcagccagaccccucagauggcagaaggggaagugagagaaccaggagaucagaaaagcuuugggcugagcagcuaaauagaugccagcaccugggauggguggccuguggggggggggcaggugugcugaagaagguccugggguucucaggggcuaggaggcagcuaaugaccuaccucugggcucacaggguuagucuuccuaacucugggcucacugaaggagcugaggggauagucagguggcugaggucacuugaaggaauagguacaugaagaagaggccacggacagacauugggacacucuagggauaagcagcugggaguaggcuggauggagccuggaaggacccuuagcccuggccuguaccuggcauguaaugguacuuaggcacagccuacuugcuuagugcuacacuggccagugcuuauucuccaccagaauucuccacacaguggguuagcacagccucugacccugauggauaggucaaggcaggcaaguagagacacagauaaagaggggucccuggggcucagaucagagggcugucuucccugguccuguaaugccagcugcuucucagggguaguaacauuugaguugaaucuaugaguaugauuaggggaccagguaggaaaguagggguggggaagagacccuuccaggcagagaugguauagacagaaauggcgauagggaagggacaguuuugagucaaguuugccauagagguacaaucaggcaccacaaagacaucugauguacagcugaauaggcacagggagaugggcaccuaggacccuaggaguuucccacagcuaagaggccucagaguauuguaugacaagagucacuacucacaaaagauccccaggggucaggaagcuacaagaacugaccagacucacugucuuguaauacagagguggccauuucacagaugaggagaucuuucaccccaaagggaugccacuggacugaauuacgcagccagcaaauauggaaucuagggcgcuugcuccgagcuacaggcuuuucucgcugccugcuucccguugcaaaguccucagagcagggcuuugccauuccuacucucugcaguccagccagcauagcuguggaacuuucuuaagaguaaagcauauagggggcccuggcagaggccacaccaagcuguccccagcuucuaggccucagcuucuagcucagggaacccugcuagcauuccuccuggggacuaaugcacccggucuccauggugaccuucagaugcagaugccucuuuuguggaguggggaaacuagggcucagagagguuauggacuucagugaagccacacucaucccagcaugguccugcuccuccccuaucugaguuccugcaccugagcagagcaacugcagaacccccgagcccccaagugauguuggcuugaagugggaggagagugacugauagcuugugcagaauaaagagggaagcaaugcagagcugguucauaaaucuugcugaauggaauguaucuuggcuuucucauccgugggcucaucuuucagccgcuaagaacccugcagcagaggucauagcugccaagccagggaguggcaaauggggggacauccugagaggggacccacaugccucccagcgcacacacacacacacacaaacccaguccacccaggaggaacugccaucacuggcaagcacaucaggagggccauguuguaccgugggugcagcgaggcaaacaugucagccagcacugcugcccagcggugcaggggaggaagaggacauguccaggcuggacaugguccccaagcacaggcaagacagacaggacucuggccgcaagcccugagcacugugugcccuggucccaccuccacaccucugucccaacugucuucaaaacuguccuguuuuguggcuuuucccaucgccaauucccacccauccuugggaauagguggagcuauuccucuuuccucugggugccaguuggcaagagugaagucucccuuugccuguuuccccaucauugcaucagccagucugccugacuucuccucuacucaguguuaucucugagaugcaggaagccagggcuuacauuuuuuccucagugagaauaccagguaacucagacacaagacaguauggaguccuuccuuguccacagaacuccagaaucccagccccggccuauucaggcauagauagacaagaggcccagccacgugcagguuuacacagggcucacaucuuccuuguccauugaaggaaggcucagaggggaaaguaacauuuguucagggucacacagcaaauggauguugaacugggccagcuggaccaggacaaucuacuugccucucgggagaucccagauaaaucuacaagcaagcuaaguggccgagguaacaggaugugugacccagacuaugugcacacggcacaugcacccgaauccucgucgcugucaguagcuuccaauaacugagaaaagacaagagccagagccacugggguccugccucccacccaggccucccugcuuccacacugcuacauggcccugcuguccacaucuggccuuccugucucuggcccaucccugagacaucccauuagcuuucugagucacgggcauaucugggaacacagccauggagaacaagcgggacaagacaccaggacacgaggguaugacacagagcucggcaggcugcugugugggagcucacaugcaaaggguaguaggcccuuuagcauguggcacuaugugguggguuggcguggagcagagcagacagccgugacgugggcggcggcaggcaggggcucuagcuuacccacacacuuccuaugugcguugaggauauagcccucugcacacagcacugugugguugacacaguagaaggaucccaggguguucacacagaacuguuuccagcuacaaucgugagugcccaucaaacacucgucuuggucuaaugacagccacggaaggaaaaacagaaggcuguuagagaggcgugucugccaggggcauccggggagagagagauaaagaaccugugugcgccugucagggggcagcugaaccuuagacccaaguugaguuuguaaaacucaaagauguuagagcugccccuacugcccaguaagggcagauggagagagacucagagaggauaagcagccagcccagaguaaaccccaggcagcaaacuuuccccaacccaugcuugguaauaaugcccaagucuacagcaaccaaagagauaacaacaguagggucugaaauuucaagggcucugggguuccaggccaguaucauucacagaaggggauggggaggagggcuccagaggcugccaggcuaaggcuauacagaagggccuccaugaaaagaagcuuuaugaaguuucuccagaaacucaaaucuggagauauuuuuaaaauccucaggcugucccagcagagaaucccugugauuauuccugagaacaaaaggagacaggccuccuccugugugggagcuguacaugcccucacaggugugucuuugcagccucugcccuguuccccuccacucuuccugcugcagugcgccagugucuggcagaggcaguagacugggccucgggcagcaggucccugagaggggucagagcugagagcccuggggagaaucagagcucaaagaacacauuauccccugggucuguugucuccaucaucagagagaaaggccaaucaguugucaccaggcucugugcuuuagcaccuucucuggacucacuggagggugucaguuacauacagagccucuagaguaugugggaugugagcuucagagaagaacgugggcauccuuuuggacaagccugaucauucuaugcagauauucagaccaugccuucugagccugagcccauacauauccuagacuuggcucucuauccugcuucugcuaagacaggagggguaagauccuaggacccucaaacuaguucaaacaaaacucacugaggaagccaaccaauaggcgucagaaccacuguucccguuguauacuguguacugagagguccuaucuacaugacauugguggcggugagcuuccucugccagucacaaugacaugaagagugauguucuucacugugacuggcagaggaagcucaccgccaccaaugucaauucccucuccaugacugcaggcaugugggggaggaggucacuucuggaugcugccaccaacacagugacacauccaacacagugacacaucgcucccuucucucuuucuccaccuugggcuggagcauggaugaacucagagaucacaaaguaagcuuagccuuguagaccacaccagcccucagggagcagugaguugagaaugguccauaucuggcaugaguccugauuagaacacaaguucaaagcuuauccagaccccuagugagguugucuggagggucagcagaauucccaggaaucuguguccaaugggccuucaggugaugcgguacacauucaauucugagaggcauuugguccuuagacagcagcagagcagccagauaggagccgcauggagggccaauaccaaggacucagugacaccagagagaaccgccuacacuguccugcugggcuucucugucacaacagcugaaccucacgaucagggugcauuugaaguccugaucuccccuucccuaagcucucaccaugggccaaccagaucugcaaagaucagaggguaaccccaaaguacucaccuucacaggacacaccaucugccaugauggcguagccagggaagcaggagcacauagcuguguccccaacaacacgacacaccugacggcagggcccauugucugaggaaaaagucucagagucagaauucauaagcccuggccacacugcucauccuucaggucugagguauggguugggguuuccacugcaggcccagggagacagaggugugaaaagaugggagccccaggccugagccuuuucacaggguccccaguaaaugccuccagucccagcuggcacaggagacaauauuuuggguuccucccacacaccacucagaugucaaaccaucccuugaguaccagcaaggacagugagggacaaaagcagaaggcaggaagggaagucuucccggcaucccugaauaaagacuuggcuuuacaggaaugagacauagcaggugauccucuuugaccagggucaccuagagacccagaauccccugaugucuccuccuccuccuucuccuccuucuccucuuccuccuccuccuccuccuccuccucccccuccucuucuucuuccuccuccccuccuccucuucuuccuccucccccuccuccuccucuucuucuuccucuucuuccucucccuccucuuccuccucuuccuccuccucuucuucccccuccuccuccgucaucaacagacagggccuuucacaaagcagagacaccagauagccuggcccaaccugcacacacccagccccagagccuaccacaccacaugucucagcucagacccuugcagcucagcccugcagaagggcuaccuuuccacucaccuuugcagguguugggcuguggcaccggcagugggaugguguugggagauaccugggcagacucagaccucggugcagacucucgugcaguguccaacuguggggcaccucuaucuguuacagguagagcauguggcagggggcaggcucacaucuucugccagggcuuagacacucacagucaaccacaccaggcacugacugaugacgucacugccacuccccuugcucauucacaagggagaauacugaggcucaggguauggacacaccuugggcaagagcuaucucacagcuacuaggaaaaggcaaaagaguaaaggaagaaauaggggguaucuagacuagaaaacaguuccacccauacagcuggcauggagaaaacccuggugcuggagacacagcugggccuguuccaggucucugaagccuaggagccuccucuggcuucugccagcaucaacacaggggcagcaggaagagagguagccuaggaaggcuauccuccauuggcaggacaagucugucccugggcugccuacagcuuaccugggcggcagguacggccaucacccugcagcucgaauccagggaagcaggcacagcgguaggagccgacgguguugaugcaaagaugcuggcaaagcuccccagggagcaucaggcacucauccuggucaucucccggcaggcuauugggcaguucagccucugugcccagugacagggccucccggcuugccaucuccaucucugaaacuggggugguuggucagcacuuggaacauagccagcauggccaauggguggcugagcccacaggauccaggaaagcaacagaggcucaaaagaugauaaggaugaagaaguaaaggagggagagagggaggaauggauggauggccacauggguggggaggugggugggagugggguggauguauggaugaacaguagugagcccauagcagcugggucugagucuucaucaucuaagucuccuucaauaggacagaaccgugccuaauuaggguucuuacuaaagugcuaaacuggagcuauagaaagugugcuagccugaguugagaaagauaaggaugugacaucugauugcagcacccuuagcuguaucagcagucucuuuaggucuccaggcucuggggugcacggucuacuccccagagggcagcaggggaguaggggagagcuguucugcauuggccagaugcaacaagagaacagaaggcuggcaugaagcuacauccaagggcaugucacagggaaggugggugcauugagcucccccugaggaacccuauccuggugaucacagcucuguccugaggaccuggaacugugagcagacagaggcaaggcccaaggucaaagaccaaggcucaggaaucccugagcccaccaggauguaccuccaugggccaagcccagcucauugucaucugcaugcucuucugaccauguucacaacagaagagaaaagaggaggaugugccugcggcuauuucaaacagucugcucccagcaccuguaucucacauacccaagccacucagaagcucuacacagaagagacacaauguuacugugggugguuaagugaagggaugaacagacccugcccagcugugugguccaccuggucccagcccccccccacccaugcuuuguucugaccucugaugcuggguuuacuccugaacacuaccuuaaaccgcucucuggcuaauaacuuguucuucguaaauuaucaucuucaaccagcaucuuggaugagcugguggaugggugugggguggaugggagaaaaauaggugaauaaaguaggggagaugagugauggaugaguggaggugagugauggauggauugggggugaaugaagaagcagaacuauaaacagauaggcauguggauggaugaagguguuugcaugcauggauggauggauggauggauggauggauggauggauggaaagaauagcaaauagauaauagccggaugcacagauaucagaugaagaauaauauaagcagaacaugaugcccagcuagggaaacaguggaaggguguggagauggucagacagucaggguggugaagggagaguagaagggcagauggucacuggugauuggugaaugguacagagaacugugggauugccagggcagcacaaacgguguuagaguccagucagcagccgcagaacuuuauaaagcagagcucaaaccucaaaccacauacaguaauggaccaggguccccacuguagcccaaagccacccaucccaaccacccuaggagcccaucuguccuccuucaacugccuccaccugggagaacagcacccaccucugcgaggagcagccucgggcucugguggccggcggaccucaggcacuaugaggggcucuucaccuucacagcaggagagcaugacaugguugcagggauagcccagguugggguuggacucacaggacuggcccucagcccgcacucggagucccaggccacagcagucacagcauugcugagggagacagaccaucacaaccaggaccucagagcaugccuguucccacagucuaugugccugugauucauucagggucugugggcacagccuggggcagacucugcagugaauuaguauugucugguuccucugucugccugugugcucucccaggguggaagguggcccaccccuacaucccaagucuggagaaggguagacuaauguuaauuuuccuuaaugaaugaauaaaugucccuuggaaagaacuacaaaugaagaccaggcacgcucaccaugccccacccucagaagcagacuuuaauccugucagcucaacaaagacagcauuuccuaagggcccuugcaauccgggugacuucauaaaguguucgggacaggaucuacuuggaaguguaccugucucucucucccugcucauccuccuuagaguguauguguuggagcuccuggaaucacaucaaguuaugaagugaccugaagcuaacacuacacacugaccauucaacaaaacgacaaagagagguugggucccuaaggauaugcagacccaucgguucagacagccaacugacaugggggaaaucugguuugcacugucaaacuguagcaauggacugguacagcaaaagcccagcugaccagccuccccggcauccacacucuggagccaaacagcucagagacucagagagugaccaugcggcucuggcucaaugacuugcuuuggucacuagggugagacagaagugaucaugugcccauuugagccuagccuucuaaaggucuugugugucacuauagcuugagguuagcauaugccuacuccaggacccagggugggucuaauggcagauccuaggucacugagggcaugcccuugaaggggacuuggggacacuggucucuucucucuuacauaagaaacuggcuuuccuaugcacaccaugccacaccaugauaccucaccacaagccuaaaggcagcagggccaagugagaacaaauggaaccaaaaccuuucacucacaaaagggaucuucucgggcauguuaucaggugaggaaaacuaagcgacacguaugcuuucaaucucuuucuuggggcccuaucugaaccaggcucagcuagcccauugugggagaaacuucagggaacaaagauaguucagcugagccaccugacuccagagcagccaccagccaacgacagcuacacaggcccacccaaacaagccagccacaggcauagcuacagggagugacacccuucaccugaugcuucaauacccacugccaaaaaccacacgaacacaagcucuaggugcuggcacugggccaggauggggauuccuuguccauguuuuaugcauggagaaacugaagcuaagagaagaggucuggacuugggguaaaaaucaccucagaagccggacucuauacucuccucuccuaacaccaggucuucuccucuuccuccugcuaucuccccugccccugaugcagccugggccuccagccuccagccuccaguauacacaugcaaagaaagcuagcauccuaggacuuuccauugcuggccaccacacugcuccuagaacaguugugugcuccagcacagccuuugcccacagaccucuucacuaccucagacaaaccauuccuugucacauucaaccuacucugccucagagagagcaagaugucuccugggucucugaugaggucaauacauaauuuguggauuuguugaccaauaccaugacuguuaacauuuucugggcaggugugagucugcccccacccccaccccaggauguggugucaaacaucucagccaugauuguggcaagugggacuugccuuguagagugagacgccgcagguaucauuguccucugcuccacaggucucacccuccuuggcucccaugaccccagccacacagcucuucucuuucaaguaggagaugcagcauugccucugggcuauccuaaaacaggggaauaccucaguaccuaauggaugggucccucucaaggagggugacaguccccaccucacaggagggagauggaguggaauguagagaagggaagcccccaccugcagucuacagcaaguggcgccagggcugguagcaaaucagacacaacccccaccaagucacauagguuugauuugggccugggacccacuggccucagcuguguccuugacuucuggaggaagguguuggcauucagaguuccacuaccaguucucagaaaguuauagagacccaaccucaggaaagauggaguagaucugcuggggagaguagucccugggucccuggucaccuccuguuccucuccauaugaauaaucuguuaaagagguggcuggcgagccagcaaagcaugggccaugagaggcaggacucagcacuacuugggagggacacgugcagggaucagcugaccaguaauggaguuguggugugguccauguggcggugagcucuaucucaagagggauguaaguauuuauaauggcugcaaagcucaaaacuuauggggucugaagaguguacaugcucuagucauucaguaaccccaaacagaaguggcaaaaaggaaagagaagagacaagguuagaauuuaaaguucucuaaagaaggcagagugggaccaggcaugguggugaaugccuuuaaccucagcaugugggaggcaaaggugggcagaucucuuugaggccagccuggucuacauagagaguuucaggucaguagggcuauauagugagacccugucucagaacuggaagaggagaagaggaggaggaggaaguagaggagauggagaaggaggaaaaggaagaggaagaggaggagauggaaggagaaagaaggaagaagaggaagaggagaaaagaaaagaaggaagaagaaaaagaagaaaagaaggaagaagaagaagaaggggguaggggaagggagaagaaggagaaugggcagggacagaacacaguagacauuagaaaauaugaguucuaauucuggccauacuggugagcugugcagcacuaggugaaucacacugccucucugaacuuuaugaguaggccaugaaaguugagaaagggagagaacagaagaccaauucuggcaagggaagcagagcgcaggugucugagucacagcagaggugacagaggaggauagaaagggaucggcuccggggcauucgggguggggagccccggauccccaaggugaugauggcacuuugaauuugcucuaaauaguacaccauuuacucaccaagccagccacagauccauguggucagcugacccucagaaccagucagucuccccacauccgccuggccagauggcucauuguauucacuuuuggucacccucacacaucugggguccagggaaggcaagagcaguucugcccacccaaagccacuuaccuacagaugucacucugggcaccauucucggggaucuccuggcacucaucauugucgauggcccacugcuggcccgcugcacaacaggucucgauuagguccuugguggagccuguggguugcaaugaggagcugugguuggguuucagggccaccaaguguaauacauacugcaggcucugugcaggggaaccucucaccucaaccccacccaccccugaccugcacuuccagccccucccuuguaaggaagcacugaggagccuugauccucuugcagggcggguagagcaaugggcagccaaugacuggcuccaagaacgcgcgugugcgcgcaugugcgcgugcgugcgugcgugcguguguguguguguguguguguguguguguguguguguguguguguguguguaggggaugcucucuccagagcccacaggacuggacuacacagguaacagcugacaggugauuugucuagccccuucccuaaccccuagacuguuucugccaagacaugucucuaaaugaaccauugcagacacaagaagcccugagcuggguucuucugguccaaguaacccaaauagggcaggagacagaaaagagccuugagggcuugugggauuccauuuagagccaucuuaaguugcuuuucucggagauuugguuguaaugaugaagucuaaauuauaaaaauuaauacuaauuaacaaucauuauaacacaaugaccaaaaccaaaauugauguauucaaauagugguucuuaauacaguaauaaaaaaauuaguagaaaaguauggcauuuaaaagagaaauccagaaauaaacaggcaguaagcauguugaccaaaaagagggacucugucugucugucuccuccuccuucucuuuccuuuuagauuuauuuuauguguuacuuugcuugcauguguguauaugcaccaugagugcagaacccaagaagcccacaagguggcaucagauccccuggaacuguaguuacugguaauuuugggcugcuauguggaugcugggaaugaaccuggguucucugcuggagcagcaagugcuuuuaaccacuuuauuugaaacacauaccauguacacauacucgagaagaggggcaaugcacucaaguugugaacucuccuuuaugugagacacaacuuuaauacaauuauaaucaaagacccagucugcuuaugggauuugucaaggugauucucaaauucacaugaauagccaggccugguagaaacagucuauaauccacuacuaagaaggccaugcagcaggauuguaguucaagaccagcauggacaaccuugugggacuugucucaaaaugaagacuuaaaaacaaagaggcagaauuauggcucucaaucaggcuggcuucuuccuuuucacuuuucagggaucaaaucuccucagagaaagucucccuggcaccuguguaccccaaccccauccaauuaccccacucugcccccauuaacaaaauugacuaucuaaaaguauacaagccaggcauggaggcuauaaaacaagcacuccggaagcugagguaggaagauuacaaauuuaagccugggauccauaaagagaaccugucaccaaaagaaggaggaggaagaggaggaagaagaggaagagaaaggaagagaagaaggaggaggagaaggaggaaaaggaagaggaagaagaggaggaagaagagaacgaggaagaggaggaggagaaagaggaagaggaggaaaaggaggaagaggagaaggaggaggaguauaauguggauguggccaagaugaagagaugguccacuggcugaggacccaggcuguaagacauaaugagccuuuggugggacauuucauaucuaaacccuaacacuugaccuuccuucuacagucuggaaucuucccucccuaaggcuuuucuaagaaagcccuaugggauuacaagauugcgccagauccugggguccuggugaggcaauauaugauagaugcccuaagagaucacaaugacagccccaaugugcugagcgccaguaacaacccaggcacaaggccaaacacuccaacuguuguuacucccucugcccaagaggaaguggaggauuagacagcacagccucgauuucccccuucccuuucccucuccaggcacaggcaucuugaugcagccagucugagagagcucacucaaacagagccuccagcaggccaaggugccgccuucauguggacucagggguuuucuagucucuugaucucaggccagguuucagccugcacuugguagauuuccacuguucccuggcuucucccacccuagcucucucacuucagagccaucuggagcugugaccuccugcuagaaggucaaccuacuuggagcaugagggggacugggucuaauguggacucaacauccaagguaugggaggcaaggucgaaaugaggucucuaccucacaacucccaaggugcuccugaggcagcuccugcaggccugcuugcaucccucccugaccccagacaccccagccccucucucuggugauuucuugaccucugacuucuggccuguggagugaaccccaaggccucucauccuccucauaaucugacuguagugauaugcuccaaucucugggugcccugugucaccuugccuuggccacuccuacaguucuaccuaaccuggccacaggaauuugcaccccaucugcagcagacuugcuucaggcuaccccuggcuucccaagacuggcauuuggcuccuucuaaucccuaagcugcuucuugcgucacugaaaucccucccuggcuguucugaggacauaccucccagggccacuaccucugaagcacacucaacccacccaccugucuccuuaccucuggacccucugcuccauauguccuccagucacuuccagguugguacccaggugacaguuccacacacagaaaacagaugaggauuccucugugccugugcaacuccacgaaaugcuccugccuccuccuuccccacuugucccuucucagcgcucucucucucucucucucucucucucucucuccccucucccaucuucccugcuccccuccucccuucccccccucccuuuuccugagugucucaggcucauuccuacccagggcuacugcaguugcuauguugucugcccagaaucuuccaccccuccuccugccuguccccaccucuacucucaaccaagccaacuccuuucuccuuuucagggaucacuuuuucuuagagagggucuccccaacuucugugcacccuaacucuacuuaucacuaccauacaacuucauuuagccuuucucauacagcacuggccuuguuggggggguggguaguagcucugagucauuuuggggaaccuuggaauugcguaaaaagccauuacaggacaaauuaccacucuaugguguaacaauaaaggucuucaaaacaguuuuugccccucuaccuagucacuugggccucugcuuacugcuacuuucauuggugauggucugugcuagaagcauccuccuucucccuguccaccuggggaauguccaucuaucaagccugaagaggcccauccaauaugacuucccugccccuccaucuggccagcacccaccuaccucugggcagaccacucagcuccugcuucuaguuaaacaacacacacacacacacacacacacaccaaugauaucccugccaugugacacacuuaugccaacaccauccuuggaagguccuguguccaagacugggccugagucaccucaggucucuagugggcagcacagggcccagcacugacuaggacaucacagauucugcuucuaggaggaucauucaggaucucagcauccaucauuguucaaaguucacaccagcccaugaugccuguauauguaguaaaggggccacccuuguccgucagcacacaaugugguguugcaccuuucugaaugaaauagaccaucacaggaagagaaucaaucccuggguggaagaaugggcugggccacuguccauugagugaugcccaucugcucuucugcuuccucugggucggcuggaccucccuauuccucccaaggaugacccuccugccgagcaguaacauggccuggcucuggaccacucugccauggucuucagaguaucaggcuuccggguccugauagccagacaguauggaaccccugaccuacucggucaaacggcaccucucacaccccuaggugacagagagagauugauaaaguggaaaacuugcccugccagcuguugaaagggaagcugugcaaauucauuuugcagagauuuuguuauaagaaaaaaaacaaaaaacaaaacagaaauagauacuccaggggcccuaggccacugaaaggcccaugcuagaaaugucuuaccaggcauggucucuauacuucaacaagucuuuccaaugacagccacagccaccaugcgacaugcucauaucccacaagcaugacauggggaaagacacuggccacaggaagagacaaaaacaugaguggauaagguaacaggacuagaaaaaucucauaaugaagacagaucuaagauuuagaaaugauagagcagcgagcccgacacagacugcugauagcaccuguuuccacucagauucagagacagaaaguaguguagcaggcaccaggagcuggggaagaugggaagucucccuccacugugacugcauuuaaugcuguugagcugcagacucaauagcuguaaauuucauguuauuuuugaaaaaaaaaugcauugcaguacaauauaaagaacugugagcugacgcuucccccgccaggaaucucauauacugacacacacacacacccaugugcccagacaggagggucccagaagcgugauguauuugugacagcaaagauuccagaaauaccuaacaauccgcgaugaaauagugaagcugcucccagccaaucgcacacggguguuaaggagccaggggcagcguaugugugccugaaaugaaaucacuccugaagguacuucaggcagaguucaggagauauauaaacugacauuugucuuuaaaaggauuacauggauauacaccaggcuucugaguggagacccaagacccagccacagauggugucuuagggaggaguccagccuucuguauacugcaggcagguauuagucauuccagagccugucccuuguaaauagauucagagauccggagacuauagccuucuuugaucacagaacaauggaugucccaaacaauccaggccagacagcaagaccccuggacaguccccuuucccugccgcgaaagcccugaagaauucuggcuuugaaacugcggcagagccuuuucucuccuggcaggagggcagcaguggggguucucugcuaggcccacucaacagaauguuugcuuuguggccucagaacaaagcccagaggaugacaaggcauugugggucccaccagauuugagggauaucgaaggcauuuacagcagaacccagggcaagcccuuccaggccacccaggagccgugagcaucuuucugaggccuguaaaguaggcaaacuagcaaggguccuggccuccacucugccuucugccccagguucauaggagggggcagaugagccgcugagguggggguccaccugaguccaccuggccuugcuucucuaugucuaugucuccauacccuuguucuuuccagguguuuuagcauacgagucuauaugagucuauuuagcuauaggagucugccuuccaguaggcucacuuaaaccuagucaguccuacugugugcugagcugagccagagucuagcagugacugcugaacugcagccugcacuugaggucccauccccagggcucucaauagagggucccgacacugucacuuuuacagauggucagacagaggccugaccuaugguauaccacacauacucacaggcaaacgagaacaaaaaggaucagcuagcuacaaggaaagguacuugcugacaccauucucaggaaugugacuuaagagcaagaagagaugcugcucuacaccagagccaaggaugaaaggggcuguaacagagaugagggugcugggaacccaccugccacacacacauguguaaacucagugcauauaaacuucaagaugcucucguaaagcauugagaaacaucaaucaaugccaugcacccuucggucagcagauccccacccaagcaugccguaaauacucagggacgccucccgcuccccaaagacacagaggcaugugccagcagcacagcccccaacucuccaccagcaucacagcagaucaacaaguaugauucacuccacagcagaaugcuacugaggcauuccgguugccaucgcaacgggggcugcaauuaacugcuccuuacaagaacauggauaggacccaaaguguuuccuuccuccaaaagagacaggcacaaaucauugccauucuacaaaauaaacucaagaauaggcaaggguauugucaagucagaacaauggcuuuaauggggccaggagagaguaagagcugacaagcuggaggcaacaccugagaacccugguuucuaucuguggguuagagcacagguguugucucccuaagcuguccaccgagacccaaagcgcugcugucugcaaauuaaguucggauaggacauuuggcaauuacacuacaucaaaagacacccgagaguaguguguguauucaggggaguuucagaaaaacaaacccaagggguauaaccaccaagguaaagcaaacacuggcuaaucacccuugauuagauauagccuuuaccaaacaagcuuuacagaagaccuggggaacaauuagaguaagcagagcauuauauggccuuagggaauuaacugaguuagauggaguauuuuuuuuuuuuuuuuuuuuuagaguuuuaagauacagguccaagacuggagaugcuuccagaaugcacgugucauaggcuggucuuccuauccacugacucugcagcuguggauucaagcaacucaauuuaaaaaaauauuucuaaaaguccuguaucuguauugagcaaaggcacacagacauccuuugcuuguucccccacacagugcaguagagcagcuauuaacacaucguauucacccugucucauaauaaccagugaucuccagguguuugaaguaggauucacaccgguucuaugcauggguuuuacauaagagacauaagcauccuccaacuuugguacccaagauagagacggggguguuccuggaaucaguucccugaagauagcgagcggugacucuccguaaaugugugucuuagucaggguuccuauugcugcaaugaagcaccaaaagcaaguuggggaggaggaaagggcuuauuuggcuuacacuuccacaucacuguucaucauccaaggaagucagaacagaaacucaaacagggcaggaaccuggaggcagcagcugauuuagaggacauggaggaguguugcuugcuuuccauggcuuguuuagccugcuuucuuguagaacccaggaccaccagcccagggauggcacuacccacaaugugccggacccuccaccaacaauaacuaacaaagaaaacacccuacagcuggaucuuagggaggcauuuuccccaacuaagauuucuuccucucuaauggcucuaacuugugucagguugacauaaacuuagccaggauggugacucucucucucucucucucucucucucucucucucucucucucugugugugugugugugugugugugugugugugagagagagagagagagagagagagagagagagagagagagagagaguugcaugaugcugucuucuaugacaacccuauugcugccuugaaaucaaagcagcagugaccgugcaugcagugaauucugaagggugggccuccuaacauuccuuuguggaagugagguugagccuugcccauucccccaaggauguaccagcaguuagcaauugcugcugggacacacccccuguuaaguuguucauguuucucauaaccccaacuaaacccacaguagacuuggauggaaucauucauucuguuguggucuuagccuccccaggaaauaacacaaauguaaguauauguguacccaugugucuccaugaguaucaaaugagucugcacuggaugauaauagccccacaaauagcccuagcuguccacuauggguuaagagagagaaagcuugcaucccauggucaagggcacaagcccagugaccuaaagacaccccacuaggcuccacuuccuaaaaguuccaccucucacagcacuaaacugggacuaagcuucuccauuugaggcucugggcaauaggucagauccaaacuguugggugccccagcuuccgauuccuacuggucacguggccucucuccagguguccgcaccucacaccuugagcagccagcacacaaccacaggcuauaaagaucagggagugugcugcugugcccauaccugggaaauggcacaagagggugccuuaucccuugcuaacugugccuacgugacuauccuccccaaagccugcugcucucgccucuuucuuccaagcaaaccuuccacccuguucagcccuguucauugcucagcaggaaaguggccuggaggggggaagccuggaauguccauggcauaggggcccgacugccucuguuccucaagccagagcugaugcucuagugaacugccaccaaucccuauaccacaggauccucuugguccccucagaucaaaucaggccccuucaugaaacugcuucacaggggcuuuuuuuuuuuuuuuuuuggcauagcuagacagggucaucauagggacuagacagggucaucauagggacuagacagggucaucauagagucaggacuucugguaacaccucagagcuugcuggccuucagcaagcuccuuacuuaucccuggccucuucagaguucugguugugugccuagggaugggaaggaguaagaaagucaacacucacagcagcaagacuaggcccacugcaagcuuucuuggugcuuuagacuguuugagugagcugccaauauuuacaugaugggagcuuccagaugaaaucccagaucccaggcuucugagaaaacccaagggaaucaugcucagccuucucagcccaagaaacaacagacccggaaguuuccauacaaugagaucugaucucccaccagcacaucauuccuacuacuuccaggucaggagccucccuaaggucugcagacccccagcacugagucacagcugaccccaucccagcaggguaagacuucaccucugcccccuacagaucccuaggcacccaacaccauauccaugagugaguggagaagugaguggagaagaaggggauaggggcugaaagcaaaccagagaccuauccccagcucaguggcucccuaagcaugagcagacagucggaaccugugcuuagcuucccacacuuuaccacauagaccccagagaaucuggauuucuggauucuggacuccaugcuauaauauugcccaggccagaggcuagaaaagaggccacagccugccagcuaugcaccagcccugcccugcccaaugcugccagugcccuguaauaguuccagagccuccaucuggacaacaggggaacauuuguuagcacaguauagcugggcacucagaaagauggcauacagggcuaggaaauaccagggcaaaaggccaaguggguagccagcacauuucucugcuucauuggccuugggaccuuggacaguucccuuaaccuuccuaggucucagucauccacuuauaaaauggguaugaagauagcaaaccccugagaaugucuucuaaaaugaaaauaucuauacauagccaccauugaauccaguaucugacacauaaucuagccgccugcccuugcuaauggaaugccaccuuguugccaggcaucugcacacagaugccaaagugaugucaggggaguacagugugagagauaggcagggaggagcacucagcuggagguggagcacaaaauaaaaagggucaggcagggaggagcacucagcugcacaucugaaagcagcuggaaugacaaacacaagggaagggcaggaaguguucagcuaaacaccccggcacaaccccagcaggccuagcccuuagcucuguagccagaggaacaggcuucugaucagcagaaacagacacagaucuguuccaacaaaagcacaaauccauucuccuugcacucccagagcacuagcaacccugcuguagagacagcauggaagaacacaccacacagcucugggcagccacucugagcugcucauuguaucagacuuccuacaucuuccagauacagaacugaggcucagagagggugcgucccuugccugaggucacauauccaggagaagcaggagcuggaaucugcucacugagagucaaacuggguucuuuuccaguguaaugcaguaccaagcugggaagcauuguauggucauggggguaagggcccugcagauuuuaaucaauauugccuuccagaggcagaugaaggaggcaguaaggccacuguaccuuuuacagggcagccaagugauuaaccugaaggcuauacagugagagggagcugggucauccaagcuggggagacucucagcaggaccagaggacaagagcucuuguggggaucacaaggaaaaugcuuuuguuguggggagcaaauaugauggggaccccugaggcuccugccacagggcugagggcugacacuccggucuagggagacuccuugcccaaucucccaccacugcucaucccucagggucugcugaggacuuugaaguaccucucauucagucccugggccuggccaggcuccugacagggcuggcuauggauagcaucagaagcaagagcauugcuggugcugagucugcauauaaggaccaccuugcacuccucagcuguguguuaggaugggcuggagcaagccaaucaagcaugagaaaccauggagcacagagaagucaauguggguaaacagacaaggcaaaggggaacagggguaagacaauagagcagauaggagaccacagagcagagacaaguccaugggggucaaaaacaagaccaggcagagcagaaacaagaccauguagaguggagacgacaccggguagggaaggcagagaggacaucuaugaagaauaccagaagaaccacagugcuauggcuugggaaagaggaagagaggcaacccaccaacagcccuggggauggcacauggccuggaaacccugguaggaagguuucugaguauucuagaccaucuggaauccacacuuccagugggcaaaagagaggugaguagcagccagaggcugugaacacuagggcaggacaugguaucucuagcauggugggaauauccuggaauuagacuuaaaugauuuuugcauaacugggaaaguauuaaaagccacggcacuaugccuuuaaaugcaggggacuuuaugauuguaaauaugaucucaauaaaucugcuuuuaaagaaagacauuaaagaaacagcaaauuuagagaaaccugguccugguggagugacagcccugggagacaccauggggacaucccacuuaugaaaaugacagaaacuuuagagaacuuugauucccauggucuugauccuucaggcauaguggaauguaucugugcuggguaguuuguacuaucaaccuaucauaaucuagagucaccugggaagauggaauuucagcugaugagacuggccugaggccaugucugagagagauuaucuugauugaugauguggaagggcucagcccacugugggcaacaccaucccuaggcaggugggucuggacuacauaagaaagcuaccugagcaugugucugaguuugagucaacagacaguguuccuuugugguuucugcauaugcuccugcccugacuucuuuccucaaugauguacugugagcagaaaacguaagcccaauaaagccuucccucuccaagguguuuaccacagagagaaaauaagauaauagguauuauccccagaacuugaaaaacugaggcaggagaaaggcaaaguuuagagccagacuggguuaugaagugaaagucugucucaaaaacaaaacaaaccaauuaaagaaacccaagccuuggguucaaacccucacucuagggacaacuguaaaauguaaccaguaccuaacggggaggauagagccuaggaaauccagaugagcuaccugugaguccuccaugggaucuagagcccacucuucccacagggagguagggucuaccugccaccauuucugcuaugacauccaggaaagcucccugaccugggaugacaguuucccacucuauggaugggauauccucauggugucuuccagagcugucucuucaugcuucaagcagagucucagaguaacaggccugaguacaacugccaaccacuauuggcaacaccagagcugagauggagggucagcagcaaccagucugaccagugggaagggcucuccuugccugcccacaggcuagccuaugguauguggccauaccugccuaucaaucaacagugccaagcaaaaguggaucugcugacauccugaaucucaucucauguccaguaucugcagaucaugaugaccacaaggauguuuuguagagaagcugacaaguagaccaaugagggcaaagauggcagaucagcaaaccagaggagggcaccaggaucauacugcccaguugucccuugggauccuaagggcaguggacccaggaagccccagcagaggccucaaauagcaggugcuccagucccauacaagagccugccuggccucuacacggccauuguaugcucuaaaucaucucuagacuacagucacguguaacuaugcagugugaacagcugucacauuguuguuuaggguauaaggacuaaaccauaugguccacacaguuccaauucuuuucucaaaugucuuguauccaaagcugauggaagcacagagcaugagguccucugugucuccaaagcccagacaugaagcucugcacacucacugcagcuggugaacuccaggccaggccuugcugagaacaggagaggcuggagaagcuggagaagccccaggcuucuuccagcacacacacacacacacacacacacacacacacacacacacacacacauauaccaccaccaccagcagcccugacacuucuccaaugccuagguccugugagcuggcaguagggaggacagagauuagcagagccccaaguuccccuuccccaacaguucuuccuccuaucagucacagcagcuccucuuaaccaaauuucauuucaacuggccgcagaggcuuuauagagacgcuccccaugccuggaacuaccuccccccacccccugcaguggccacaacacuaacacaguugcucuguccuccagaagacagacucccuauccacaggaggagucagagcuccccacccugccccagaugggcacagggcacugccaccucauccccaaccuccccgaaaugagaccuuaacaucugugacuacugagccuggaucagcaaccgggucacccagagcucccccaggguggagauauggguuucacuccucaauuuuuauucagcaucucagaaacugggucacaggacagagcaaugcagacuucaagaugacgccgauucugccauuuccugucacuguguccacgggccagaaggcagagcucucuggaacucucugggcuuagguggggaugaaacggcuuaauagucacugagugcccaaaagauggugucugugacagagagaaccuggcaccuaaacuugagcaccagugagcagacaccugcccugcagucugggacucccaaggaagggacucuuucuuuccugccuggcuuucugagagacucuucaaggccagggccaccgccugcuguuucaguggcucccucugcuauaccagcacaucagagacagcacccucccaaagucucugagugacagcagaaacagacgucagagcccuucuccauggcucgaagaggcaagcauguggcuuccauuuaggccacaucuggacaugcucagaggcagggacagcccagcugaggcaguggggaucccugguacaauucugacucccaggcaggauccccgccccaguugggccagggcgauggauggaaaccaccuucuccaggccucagggcugccauggcaacugggcuggggucauuuccggccugccucucaguaagcccagagggucauguaaggcaaaacugucucucuagccccucccccauccauggcccccagacucccguccgaaaccagccugaagauccuauguuccagacucuacuuuccucaaacgcuuggcaggccaucaagagccccacccacauaaggccugcugucacccacccucaccagcugcaugcccugucggcugcaccuuuaucuguuuaaugcacuccuuucugcuaguccccuaagggaauggcugaggcugccuuguucucuagcucagccccugguauaguaagggccccacgaaugccugauuaaggcgagagcuguggcugaagaacagauggaaauaaaaucaguaccauaucucguaauccucagugauugcucggcucaugccaaccacggccacaaaugagcucccugcagcuucaaaacagacucaaagcagggcgucuacgcugucugcagauggcggaacugagguauaaagggccaagccguuuguccguggucauggagucaacauaugaaaugguagccauggugagcucaaccaaaggcuaagcaagaagacaguggcugagaacccucuccagcugacgcugcaacgccagccuggcccugcucacuagagucuucccggccuuugcaugagcugggucccugcuaggauggcccugcaguugaugaagguacuccagaccuagcuuccaccagccuucaucaacaccauagcccaaacacaucugagaaagccaggcacaaagaucccucaagugagcaaaacuggucccagguucuacagagccaauggacacaagcaguuagagaagccaggacuguuucuauucuggaaacacagaggcugcaggcacugagcacgcaugcgcgcacacacacacacaugcacacgcacaugcaugcacuccauuagaccgucccuguucccugcacuuccaggcucagggcuggguggagaacaucuggggccuggucccaggcagucccaggccuccccuauagccaugccucuccagcaggcugcaggcagggaaucccaggaaggaaaguaggcuggaagcagagguacuggugauaugaggaucauaggcaccaacuggugagaagaaugagggagagaggagguagacagggucucccaccaguuccauccagcauccaacauuuauagagcaccaacuguaugcacguggugcuggaacccuugggcucagcacaaaaucuggcuugugugaugcuaaauuccagaaaagcaauaaacaaggacccaagucauccugucuguaauguaagcugugacugagagagaucaaagcugcaggaaggaaggagggucacagagguaacccggcacagaacaaagcaacaaggcauccagacaccuccaagagcaucucaggcaaaagcuguagcaagugcaaaagcccugggacagaggcugcccucccaagaacccaguggccugggcugacugugggagcaugaagagccaggaggggaggggaggggccacuggguggaugagaaggacauguggucaccauagggaccuuagcuucuacuuuguauaaggugugagccacuguaguagcaucgagaagagaggacugaugaguuaacuagacucaggcuaguaggagcagcagagcuagagccacagcagaacaugcccccucugccaccagcccacagcugggcuucuguaggaaggcacucagaggcaguuggccauggcgaucugcagagcccugugauuacuacuaagacacccuuggacuccaggaggcaggauugggcucuauucugaugaagaaaaccuucugugccuuuagccagagcccaccagaggcccuguaccuccuagaacaaggaccucucugugucccugucucagaucucugagagggcagcugcugagaccuccccuggcccaugccacgcuguuugaggcuggcaagagagcagccaugggaaacuaucaacucggaccacuuugucucaggccugagagaugguagcugcgaggagcuagcuaggauagucagcgacuauuccuuccagguucgguggcccuucaggaacacaggaaauggaucuuaccaucaagaucaccucuggggacagaauguacugaguuggggucuaugucuucuucugcccggaaucgagguagcaacuguggaugcugggguauuucuucaggugucucuggggagggggagaccugggcucggucagguggcaguguagauagaguggggugaucgcugggcuuuacuggguccucugaagagcugucaguggccagagauggacugagagcagccaggccugaccuuggcagaggugcagcacccuccugcaugacacuucgaggagugaccugggcaucaggaauaagguuuuccucaggcccugccuuagcuucagccuccuucuccuggacagggaaaccaggucuggcuggggaucuugugggcaggcuguccagccuuccaggacugccugcuguugguggcucagugacuagugucuccuccucuucuucuuccucauccucuucaguguccaaugucacucuccuggcuuuggccugcacaggugcugggggacccagggcagcagcugcugugggucugggaagggcaacuggccaggguguuacucugauggaggacgguggcagauucccuccucccagagcagcuggggggcccucugcaccugccuggaccucguucacaauggccguaguagcuucugccucugccaccuccuggucauagcuguaggggucuucauacugccucucagagucacccuccucagcauccgagaaguucccauggcaaccaggaagcugguagcaaaugagcucaccaccagcgucaggacaguggcaagcccggcaggaugagagguggacgguauggccagcagcauacuuacggccacuguggacacagcccaccuggccacacugcgggcagcugucggcuacuacuacagcuucaaugcaguugggugguagcucagggcacagcaugaacuggcagcugaucuugccaccaccgggugggcaggagcacucggugcugccaaaguccacaaaguaggacuggccggcugguacacggccauccacaaacccuccuuguacgcagucguaguacugguagccuucgcaggcacagcccugcugcacacagguagcacagcaggcuccuggcuccaacgccuccucgaugcaguucuccagcaggggacacucagcaccugugcaauccugccacgggacggccaugcuugggcucggagucagagcugugaccagagccaaggccagccacacuccugcagauuccuggagcagcaugucucaggagucccuaggagaacagagaggaagccugucacacuaaggacauagagagagaugagguguaugccccaacaugucuacacauagcacacaccaucucuaccuccaggcaugccuuccuaacccacacucauacaucacucagcccugcucucucucacacagacacauacggggaagauauaggaacaggagugugugcacucaggagaugaagcaauguggccucuggaauggaaucugugugcucagggugacuugaaccuucugaaccaucuagcccacagucucacacacagguaaagcuaagcgaguacacaugagugcacacucacucagccuaucacuguggccucuccaugcccagucacccagacacacccaugagucauccugcacacauacugaagacacaaaugggggcucucacaccaccagugcuuucugaugguaccugucugaugugugugugggugggugaguccacauccgcacacagccgccagaacaguuuuccuccuccagacacugacuguagucagggggugaagugagggaugcuggguaggaacagaccccuugcagaguggcccaaacauccaaccucggguuuacugcacucccagcccuuagacuucagagcucaagaucaucuaucccaugagacccugggauuucaaggucaaccugggacgcuccugccaccuccucgugccgaaucacugucucuguccuguccauugccaagacuggcucucacugcucugcugcuccacgcaacaccucccaccugcccaaccugaggcccagccauccaucuccccaucgugccuccuugacucacugggacaccagagugcucuaggagccacuuccauacauacggccuaucuggcuugcaggagccucucucuucacgcuauccucaaaguccuccacaaccacucauaugccaucuuuccaccaauccucccuccugcaaaaguuacagguccccacaggcagcgggugacucagcaucagggcagcccucuggacaccacaauccccaaaugggggcucucacaccaccagugcuuucugaugguaccuaucugaugugugugugugugugugugugugugugugcacacaucuuggggggggaaacacccaugugugcacacgugugcaugugugagcaugccuguugcacaugugggugauuacaaagaacaaccucagauuuuauccucagacacacugucuaccucuuuugagacagggucccucacugacugagagcuugacaauuagguuagccuagcuggccacugagccccaggacuccuuccgucuggcucuccagagcugcaguuacagggacauagcacugagcccacgugcuggugccagucuuacuaacugagcaagcccagcccuguuuuuuaucuuucagaaaauacaacgaaguaucaucccuaaaccucaacauuuauccuuuuuaaaaaauaauaauaauaaaggaugaugucuuuucuauuuagagacagaucucacauuguauucacagcuguccuugaacccgagagaauguuccuuccucagccucccaaguacugggguaguaacaggccugcaccgccacgcccugcucucacgucaaacauuaagaagaugcuaacuucucaaaggucugaggcaagaaagaggaguaaagagagcgcugagcuuuccaaagaauggaugugcuugaguugcccagcucccucugagaccagcaggguaagcauggucugucagcauggcccgagcccugaaggcagcaauggaauaaugccaagcuggucacuaccagcuggagguaccagcugcaggcaucagggaucugugauggacacauccagggacuggggguuugucagcgucagcuaguaagaugggccaccuggcugaccuccuguggggcaaguggaccgugccaccagacagaagaacugguaagguugagcaggcucaaacccuggggaaucucagaauugagaauggcaggcaaggagccagcucccugccaaacuaccugauccgcaacacguaaccaugacgcccuacugagaagaccaugacaaucgguuacggagcacaaaaaccuggaguucuccaugccaaugagguagcuagauagaccugaguguuuagccaaugagcuucccuuccugggcauuccuucccacaaaagguauuuaauuccugguucaaccuuaguaagauguaugcauuuacaucugccaucuacuaaaacaguuuggacgagcaaacuguugaugaagaccaucuccuucaucaaagaucucagcaggggagggggcuucauuguaaagagucacaccuaaaucuccuggaaaaggucuucucucucuuccacucagaaccaaaccagauuccacucccaucccaggcucagccauccccuucuugccugguaagcagaacccuugagcaguagcucagaccacagagcaccccuacccccauucccaacucccagagucugggcauacaggagacugggaaccacaguguccaacucacucugcuguuucucacccagggaaacacggacugggaccccuauuagggacuguguucugccuccccugagaggcuugcugauggcacucgggcaccccaccagcaagccagacaugcagccuggcagccuuccagggcugauggcccugaggguagaugguuugcucccaccugugccaggcacucauggcucuuuaaaacaguaaauagagaaauugggaaaggucugguugugaagccugauaccucugugagccagggaagguuucugaagguuucgggagguggcaucugacugaggcuggaugacuugcuggaggcuaagugcuucaggcucuggacagcaagugcacaggcuagagacaggagcagugggaggcagaugaggaaguuggaugggagagggagccuuggggggccuggcaacaggugagcaugggagaguggcgaaagaaggccagguuuuucuugcugagugacauauggggugcuggcagcccaggggccugacaaccuguggcugcucugugcugagggcagcaaagaucuggacagagcaggaaguguggaauacaggagagaacaagacugagggguggggaugggaggugagggguaggguggaaggcuguuccugugaagaucaagucuacggaguuuguggacagacaggaucuggucaggcagggaauggagcaagaguucuggaagccuagaaggaucaacagauggagguccaugcauauacugggggaugugaaggauuggacuaggcaggauuugggaagucaggaagcauacauaccauaaagauaacaguggaggaaggagccugugcccaugccaaguacagaaucugaaggaucuuuggcgcucugagaguucaccccaacugacuaaauccuguaccccuccagaaggugucagaggaggaaggggaaggaagggagauccaagcagccuccacaaauguccagugaacuccacaggccuccggaggccuucacaagacuucucaguuggcucuuaccaugcauggaugcaguguuucagaguaaggucucggccacaccuagcuggggugucccagaguuucccugugagucccacccuccagagaugaagugcagacaggacauaugcuagagcagcaucauaugaggacaacuccaucccgugugcccugaagcuaccacacuacauggcacacacuccacuauaugcagcuggcaaacacuccacacccagggagcacugagcuggucugugggaugaagguaccgcugugugaguugaguuacugucuggcugucuaucucaagcugugcuggucugugccagagagacuggacuuggcugcaaccccaucuugguucuccagcuuucuguucagucaaagggaggagcagagaggcuggggcgugucuacuccucauuuuuccccuccuucccucugggauaucguggcuccuuuccccagggccacaacuucagcuucccaacucucccuccuccuucauagcuaugguugguuccaccuggcugccccucguccuccagacccagguagccacagcuccauuuuuguccugccugcagccugagagccacauccuuugauggaccccacggcauggaaagcaggacccagugaaccuucaaaguggacagcuaaguggaaaggguaggaaaaagaccagaaauagucacugcagcagcccaacauguacaaagcaagcguguuccaguggcaguaagacacaugcucagggagcugggggcugggccagccuugcuuguuucccgagcacgaggaccucaguuugguucccaggucccaccugagaaucugggugcagucacacacgccugcaaucccagcacuggggaagaggagacagggggucccuggccagccaucccagcugaaaucagugagcuccaaguucagugggaaauugugucucaaaaaguaacguggagaaagaggaagacaccaacacugaccucugaccuccagacacauccacacuuacaaaugugcacauucauauaccacauggacacacaacauuuuaaaaaaauuuuuggacaaugcaugccuugacuuuaccaugcacagggccuuauggguaaggagcccacucagcaaaguuuucucuccaagggcaugcaguggagacacucucuccacacccuucucacacaggccccugggugagcaaggugaucaagaagagcaggccucugccauaccaaucacagugcuccaggacuucugcuggucucuguaacugaacgcaccuccuccuuauguccucacuguucccugacccucuacagaccacaguccuccagugaagugauuaacagguuaaccuaugcacuguguacaacucugagcuggcaaggacguuggaaggucacaguguccccaggaagacauacuguugcugccauuguaaaagugggaucugcccccaaggagagcaauggccacucuauggcagaccccagcaauccccccuaucaucuggaagagcaucccuggauccccaggggcugccugagaccucgaacuucuaucaucugggaaugcaccccuggaucccuagagggugccuaggaaugcaucccuggauccccagggggugcaugagaccucaaacaucuccauguuuguugcgacugcauguugugacuuuaaauggaagcacucucagcagcaagcaaccuuccuccuuuguugcaaaccuuacuccuuucccauuaacaagcacuccauccuucucuuuggcauaucaauuaccacuaucagcucuugugucagcgcuucuguccuuugggguuaugauuaaguggcaugggaccacuuaaaggcaagcucuaucacagccuguuaagugacuagcgagaggguagugaacacgguguggauccacuggacagaguagcucaggucccaggcaggagggcgcuagaugucaucacuugcaccagaauccacaucauuucaaaucugugaaguuugcugcugagauuuuucuacuugauauuuugggcugugguugguugcagauaauuaaacuguagaaguugaaaauugucaacaagagagcauucugcaugugacuuggguuagacaguaagaccaguccuuugcuucuccaguucuggcaacuucugacucugacaagaagaggccugcuaggacuaggaaauaaaagcccagggcaugcgguccugcugggauuucagaacagcaaugagcacuagcuuagcguaagugagccccugcgauauuuagacacauauucauucgcugugugucugaaaucuugcuuuaacugguagccuauacuggaugagcagcucuggaugaaaaccucagccuggcaucauaugccuuaaaacuucucaagcauuuggagggaaucucccuucaaugacaagcagcuacagaaaacccuggggcuugcaaacagcuggauugacagcugguaaauaaacaugcaagcccuucuuguuggcuauucagaacaagaggaaucaguuugaccugaccagaggaccaccccagagaccgccagacccauccucacauccagccagaggacagcaaaccagcagccagcccauuugugcacagucccacccaugggaccuuguauuaugacaccaaacuguccacacugucacugcugcucuggcagaacuuagccucaccagcucucugugagaucugagagcucccaaucuugacuccacaaagacuugggcuucucuuuuguuugcgacacagucugccauguaguccuggauagccugaaacucacuguauagaccaugaugaccuuaaacuucaggguuauucuuccucuacuuugccuucuguacccucuacuugguggccaccguguccagccucuagucacccucaaucugucagccucuucagauccaaucaucagccuacaguuccucaagaccucaauggugagggggucccaaauccccauuggccucaagucuggaauauggguguguaugcacugcaugcuucagcaggccauagcuccuggggacccagggucccagccucaguguagcacuauacugucaauggaucuugcaggguaagggccccagagcucagcccucucccuacgaaagaccagggagagcugugccaagaugaggaggaucuggcagccaagagcaagcagcuggagcagguacaggugugagucauuaguggccaacacuugacaacugggagacaacaggugggaggaaacuggagccaugcagagcugugucuagcauauacacagacacagaaagaaacaaagcaaacacauacccugcacagacccacacauacaaagacauaaaaagacacacagaacauauacacacauacagucaaacacacagucagacacagagagagaugcacacagagauauaaaaaugcacacauagacacacauacagacccacacauauaaagacacauagaacacacacaggcacacauacauucagacacacacacaaauaaaugcacacacagacacauacauacauacacacacacacacacacacacacacacacacacaaacacugacaaugacuugguucuaaaauuguccagaaccuacuuuaaaugcacagauuaucuuggguucaucuaagguccagaaagauaagaccaugucuuuuaaaauuaaucccaaaugcccacacucaccacugcaugcugcccacuggcagagaggccaguaaagacaagccacuuauccugacaauggaauaccaccagccucagcaaggacauucuggcacaggcccccacguagauggcccuugaggacaugauguccagugacaagcuggucaaaauggacacucacuaaagagucuacuuacaaagcuacacggagcaauuggacucagacagaauggggauggcgggugccaggacacacggagggagcuggcauuggauggccagaguuuuuuuuuuuucaggauuaaagagucuagagacagaaauggugggagcugcacaacacuguagcugcucuuagugacacugagccacacacccaaaaaugauaaaaauuguauguauaauuacaaaaaaagaaaaaagaacaaaaaaccacaugcacucuaaagccaaaagccaaaagagggugacuaagucacagagaggggacagagaagaccugaaaggaagcaaccacugcuccugaagcccgacuuuaguaguaagcuuccuggcagccagugccaaaagggaaauuagagggugacccggcacuccuccucugauaagaggaagucauuaguucacugagaaaauaagcuuguucuuggcacaaguucauuagucugagcuucaaggcuagucagguucauacucacagugccagacaccauucugcgagggccugggcguguuuagcucauuucacuacauucgcugaugagacccacaaucagaaagggugauaaagggauaugagcucagaccucaauggcgauaggagcccgaguccuucaguucagcaagcaccucucuccaccucacccccaucagcccugugccagauaccaagaugggacagugaacaagaacaaaagaaguccucccucugggcauaacugucaucccagcacuuuggaaacugugacacaagaucaugaauucaaggccagccugggcuacauaguuagacuacuaccaacaauaacaaccagaacauaagcaaacaaacauagaaagaaugugcaugagauagauagauagauagauagauagauagauagauagauagauagauagagaaggagaaagggagagagggagagggagagaaggagacugacucugacuuuuauggaaccaauaaccuaauguagaaaaaaagcaggaaagaaaucaguaagacaauuggggcauugugacagagaacuagacacacccuugauaaaagaggacagaggaggcugaggagguuacauuucaacugagauccaguccccucccaaaaugugcagccacccaaaugucuaggaauggcaaugggcagaagaaaugcaugugcaaaggccccagggcaugaaacaguuugccucacugugggugguugcaagugagacagcagaagaugggaagugggcaacaagaaaggagggggucauggggggaagggagaagcggugugaacgaccuuaguuacacaggucaguaacagcaugcuugggauucaaagaaaagcugcacacauccccuucgaagguccgaggacaauccaguccuagaaagcaggaaaucuagaaaaacccaguugccaagugggcauauccaaccuccagccugcaggccggaugguuccagcagaucucugaauguagcccacacaacuguaggcaacaauggcaaaaggcuggacaccccuauuuauaggauaccaugccucccuguugccaagucuucuggaagaagggcccacagagccacaaugccuuccagggacagccucuugauuuacaaagguggugucaaccaagggucuguucuccugccuaccccaaugcugaagcacauucuguaugcgugcuuuuccuccuuaagaugcuuuacaaaacaaacaaacaaacaaacaaguaguucagaaaaauguaacaaaagggggcagggagcuggggaauggacagauggcaagagacacgagccacacacaacugccaacugucaucaggucucccuucuaccugaaucucuacuuucuucccuuccugugacccagugucacaacacaggauggugugacuggucacagaccaagccuggcugugcuuggaaggagucagcagggaccuagggaagggucugggguccucuagggcacagaacuugagcaaagggguaggccaggaaguacuguggaagcugaagauggugagugaaaggcuaugggacacccaacccccaauucccugggaagagaagggaaaugcuggguccaaaugcaaauuguggauuaagucaugccccagagucaggcaugguggcacauguguaugguccaagcuacuugagaugcugagguaggaagaaaugcugggccagccugggcuacauaauaauaaauuaaauauuuuuuaaaaaugaaaaagacaaaaacugaauaagcucgcuuggcccgaugugagauucagggugccaggcagcucgucacccacccuccagccccugggcuuuccuucaaaggagugagcucaugagaauguuggaaaaacaaacucucaauggaacagccaggcuucacccucccuucccacuccucccuaagaaagaaaagaauuuuauucugccaagugucgggugagggcugacccuuggauuccuagguaugaaccgcuaaucucauaaccaagacaagcaggugaaaaauuacacagcuuaacgcccagaacucuucauuagcuuucaagaaaagaaaauguugcuuuuggcucgggggugcuccauccgugccuuccccuguuacuaaagccuacagaguggaagcagucccaggguggagcagugaaaggagcuggccugggccaagacugaucucagcauuccuaccuggggcuccauccagccuacaacugugcacccuugaccucccuguagcuagcuccaggucccgccugccugggcugucuccacugaucccgcucagugcccucuguaaacacugaagcucuguggggcacaaaggauggaugugacuauccagcacaccccucuguaagaacagccccuagauuacccucugaggcccacugcaugcaacucagcauuucucacuucccacaccacaguggccagugguagacaccaagucagucagagccuacaggacccagcucaggggauacaguggagaacaaccugugucuaucgccuuguaugagacaucaagaaucucugaagucauccuguccucagagggacacugaggauauuggagccaguucagcuggaagaaaggagggagagggauggagagagagguagguggugcauggccacagcugucuagcagcugcacuagcuacaccuaaaguuaauugaaaagacaaaccuugcagugagcuagcccaagcuaacucugaccggacuuucacuagcucgcaagucuuaauagacauacaggcuuauucuguggaaauagggacuugugccuggccucccaguugaaaugaaaaaguccaaaagucacucuccaagccacccaucucucccaagcuaccuccucccucuggaguccuccaaagaaccaauuccuaacaaaccagaagguuuuucuuuguucacagacaauccucuuauuaccccaaccugagaugcuucuccucugaaguugcagccccuaguccuaucccaugcuuaaagccaagcccaaaggguuaggaaguggcuaaaggagggggggggguaguagauaauaguggauggaugcauggaugcauggaugggaaagugagagagaagcugggagguggcuagauggaugaaagcguaaguggaugaacaagaggauauauagguaguggaugggugaauuaggugugugugggauauaugggaggguuacugggugaguggguaaauggauaaguggaugagugggcagguagagaagugaguaggugggucgacagaugguuuaguacggaguugacugugucaguaaauaagugaguggcuaguuagcugagaggaucagaagaaagauagaugggugaaaaggugaguuaauaaauggacacaugaacuuaucccccagaaaaguggauaagaaaauggauucuagugagccagguaggugggcugcugaugaguggaggacagauugacaggaagguagauuuguggguagcucaguacguuuguggguggcaguuggguggaugugagaggauggaggauggaggugggugguggccagggccaccagcaagggaugaauagagucccaggccagugaacaguagcuguacacaugggaguaaagagccaggcuuguccauugauuuuacagaccaagggaaguccagagucaaaguucuuuacuuccccaacacagccugaggcaccaccacuggccagcaccucagacagcucccugcccuggggacaagcaccagagcucaggccccagagucagacaggccuuguggaggucccagcacaggaaguuccccugcugugugucugcaggugaaaggcucuggcucucugagcucagcccccagcccugcgcaggagaacaccaucgucccgaacuggaaagccuuuugacagaggccagugugagacagcacagagagggccccucaaaauuuccauccuauuaaaagauugcuuuaaaaauugcuccaggccuugaagauggaaugugccucccccuccucccauuauaaaaccaggaaaauccugaaaucuaaagcagacacagacaguacaagagaagaccucacugcccacuccccgcuaaggccucagaugccagaagccacacaaggcuggaagucagcacggcuccguacugccaggcaagagcugaaagaaaauucaacacaaacaucccuagaugcugaaauagaagcaauaaaauccaacucuguggaauccaagccucugagaagggccagccccucucuuccuagagaaugagauggcuuuucaaggaugggguuggagccagcauggccgccaaugauacagacacauagucucucacagcccaggcugcagagccagagccucccauauccacaaauugcagguccagcaagagcccacuaugugacaagcuacucacacauuuguaggggagggagagccccucgggggcugggucaggcucucaccugcccuggcucucucugaguugucuuaacuuuuuuuuuucuugaagccuuuuugggguaaacaugaagauuaauuccagggucauguaugcauauguagccacacaugugaugggcucccauucaccuggccauuucccacuuuuucugaguaagugccagcucuccagcccuggcugcugagcauagccacuccccccuccccagaccauacagccuucuggguccuuucagugacugacaggcucucugcauccaucuuccucagcugccaacacagcuguacagagaugccagccaagagagauggcugcugguuucucuacaacucccaagagucuuugccaagugacaauuauugacacagaccuggauuuuggauauuucucaagauugccagagaagcagguggugugcaaaacccagcaagaucuagacacaguccugguccaaccaucaggcuaaagaucugagaaacccuacccuacccccaacccugccaacaggccaccacugccaaugcaaugccaaugcagagacccaucaggacgaaacugggugcuccugaaaauggagcucaaaaucaaacccaugguugcaaggcaacugaaagcagguggcucagaacccagaaauauucugccaugcaaccucucuguggcccugugaggauuaggagguaguguggaggcugaagaacccagugacucacuccacaggcaacugaacucacauguaugcgugcagggacauacauaaauaaaauaauagggaguguuugucuauggguacaugugacugugggugugugguucuguguguuuucuuaugugcauauguguguguggaugucagggacuggaggguauugguagauuguguuuacaagauauucuauguguuaagaccaccugucucaaugccccgauccuugguucucaggagggcuuccccuuuccacaugcuccacacuguucuuucucuuucccccccucccucucccccucucccucucccucuucuauuucauccacacccccaccucccuggcucaucucacugaccuuaggaucaguucucacaacuuaggucagaccaagggaaauagcagggagggugcucagggcucccaaggguuccauacugcaauguuuuucugaugugcuuuuaggaugagaggacucuaaagccagaaguuucuagauuuccuaagugcucccuuggauaaaagucagggcugggcauucacugggggucacagguaggggacaaugaacucugggggcaccaaggaccaugagaccaaacaucaacuugaggaaugacaccucagcacccagaggagugaaugguaacaagaaagaagccaccauucgguggugcuguccaccugucuagaguguguugggggcggggcaugcagcuuaugaccauccuuccaucuccaccagccucugggaggaggcugucacucaacccauuccccagauggagacucugaagcugggagagacacccugugacuaaggccaaaggcaaguagccagccuuuuccacacaucccacacacugccuggcccuccucacacuucagagccucuuucuacaugcacaccauccaugaacccaaaggucagcagagccaaaagcauuauccucaccucagacaugagcuggcggaggcccaaugagaugagagaccuugggggaucaggccugccuccuccuguggaugcagcacaugguacucaguaccccagcccccacccccacccccgaggcucccaccauccccuuggccucugcccaguaccgguggguggcaccauuuccuugccagcuggaagacguggguggggacccuggccagggacaauacagucagcucccaccccgaggaaggaagcaaccuuccccuagaccugcacuuucucugcaacaaucagccugcaugcagaggcauuucuguacgguuuccagguuacagcaacuucgaagacaauggcuguaaaugacgcacagccugacccucaagggacccugggaaaagacgagccaaaaggagaccggcagcacccaccacugaggacaugggggagaacagagcuggcuccggcccauuccuccucucuagugugacugccaacagucauguccucucagagccuuggucuaccugcuuugucaccucagcauucuggccuugucccucuauguucaauguauucucaaaugccugucacuggaccuuuggccaacauugggaguucucugucuccaggguucugucuaccucccuucucaugaucaaaccacucaccaagagaagccagacuuucucagggccccaucucucucauucuuucuucccauuggaauggugguugcaccccuguccaggaagcucuccagcucccugaggcucgucuggaugugucugccucaugggucagccucugagaccucugaacucucugcacucuucuccugauuggcugugcacccagguugagugugcugcagcccccagcccccagacugccacaaaacagaucuugucuuccucacuugguguaccugcuuuagcacacaugagagcuaacacaugagccccaacuccagcaagcaccucccuggacauucgcccacuagacucucaaccaucccuaaguguggccaaccaguuuucacugcucccauugaggccgucaucccacagucuccauuuaccccaucaguaugcacccuggcuacaacuguaguagaggcuaggagauaaccugaugaggggaggagauaacccagauguugccuccagcuugcucuccccuucacaaccauggggauuuugaaccuccaguggucagccccgcccaucuccauacuguccacuucuauuaccuucagugaggugggcagcuaccacccuguagccaauucuggccacuugcucuugacaggccuucugucuccuggcagcaguacccaggguggggucccuaauguugagucucuguccuagguauccuuaccaccccccaucugcucacagggacauguguacuaaucugccucccaucugugucucccaccagaucaagcucugugauucagaaagaaauggccugggucccuggguuucccucagcacucagaagcacacugcacacacaguggaugcucaggaaguaccugcugcaugagggcaauacaguauuugggcagcagaguugugcacuucauaggaggccaaagggaauuuuuuuuuuucugcaccagucucuccccauacaagaguggggucugagccacccccccugggcugggcgauaugccuaggaccaagugagggcuuccaaccaaaugcccuuuccagacaacccgcagggauuaaacgggagugcacaccccaggaaaggaggcaagaggaaagggggaggggaagaggagguaauuuccuuuugcucacuggcuagacuuugcaaaucgagacuuuggcaccauacgauguaaucacuguggaaacuuucacaggucgugccagggagaaguccgucuauucauggaggucacggacgcagggaugugaauggcgacccucacuugucacccaacacuucacaaguguacacccgcucgcugguggcuuucagcuuugugcaauguuuggaggucuauuuccugugucacuagggguggcuuucagggccuuauucacucgacccauaggcucugcuacugauaauaccaacuagccucuccugcauguucugagccuacaacacuguaacaaagcauacagugggaagucucaccuccccucugcugccccucccaggugggcgcaggucaccuuuccucugggguagugaccacugcucauguagcccaugugaauguguguuccgaucugacaaaaggcagcacggcuacaccaagugacagcuccuccuuuccuucuuccagcagaccuucuagaucuuuccacauagcauacacccuaacauuuuuacagcuacauaauaugccacaaaagacuaugcuggccucuguuugaccagcacaugucacaggaagcuuagugaccccuuccaggccuagcuccccauucgcauguauuuucucaagauggggccuaccccgaccccaggccugucucuaaagagggcucaguggucacaugguaccauucugcagagccaugaaaccuccugaaccugcacauguccagaacaucuuuacaugaaccuguaucuuggggauuccugguucaaaccuucuagggacucuccuuuaauuugggacacuaaggaggcagaggaagggagaucucuaggggucagaggucaaucugguugacauaaugaguugaggccagccagagcuacauagcaggauccugucugaagaagcaagauaaagcaaacuaaaaacuuccaggaaauuucagacucccugcuguauacccugcaccuucucugucccuacuguccccuucccacaaaagcuccaccaccaccccuuuugcucacacacaagcaccaaggagaaucucauccuaggcuccuugaacuugcugucauugucauugucauucauaucucaguuuagaaaucccuccucaaagagacccuuaaccucaucccuaagccuaggcuaccaggauaaggucuagaccagcccucugcauagcaagacuccauuucaaaacaaccaaacacauacacauacacacacacacacacacacacacacacacacacacacacacacacacuccuggccauauaccucuuuccacaauauguucccaucuggaucccacuccaccccaccccauccugccuccuccaguuagaaaaucagcugcauaacaacaugcacagcaucugcuucacccacccccagcucccaugagcaucuguacccggccagaacaaaaugcuagacagucauccccaucucugccuccucacuguaagcucaugagcacuggaaagugccagaagucucuacugugcagaagaaaagacugagguccaggaaaugggguugggaguagagcagggccucaccucuagacuaccucccuagcaaaaaaucuccaagaagcaccaaggagaagccaguguggcugcacccuccucauguccccugagcuguagacaggcagccacaugucacaggggugcuuagcauaccuacgauccgccacaugcggaagaugaguguagaagaucacagaaauuucagcuuagaauaacacaguggccaccagacccugaaccacccaucaagcagcugccugcaggaacaugaacuuggcuugugugguauccugagucccucucuguguggcaucuccuuugccaaggccagcuagggaaauaagaaaaaaacaauuauucacagccuagcuuccaaauuuaaggcacaaggccagaagauguccaagaggucacgccugagugaugccauagauuuaccccgacuuugugaucuccacuugagggccacaggagucacagcaaagagggcugucacucccaucagacaucaaagggccaggcuguguguaaucuuacgccugagccccagguucugcucuaccaugaucccaaggagcaaucucuuugccuuagucaugccaggagcauuuauugagcaccuacuguguguccucuauggacgagacucaggaaacuccagagucacugacauccaggucucccuuucucgggauucaaugcuggaaggacagagagccuggaagaacagagagcuuuguuccaggguaugaaaauguuccuuugcuuguugaauucuuucugagccucccuuuuccagucaggagaaccagugugacuuuacagaggagcucucagaauaacaagaaggaaaauucuaugcgaggucuaucucagguccaccaggagcucugaccuuccuccuauggggacaccaggccaucacccccacagaccagcacaaaaugucuauacuaucauuagaauccccuguaaaccugauccuggacacucccaccuuuguggugaccaacauccugaaugguaggaggcuuacuuaaggcauggcagagccuagccugggcucacccuugagauagcaauggauuuaaaaggcuacaaccagaacaggucuccaaaggccagacaggagcccagaagaaagaucugguagagacugcaaccaaaggugccccuggcccaucccuaagggaaggcagccagcagcacugguugaagcacuccacaaaagcauaugaauccuaaccaccagagcuugcuuuuuuuuuuuuuuuuuuuucaagaaaagacggaaauccggacuuuucugugaaagcugccaguuaguaaaugcuggcagcuaauuaaauuuuuaaaaacaauaauagcauacugagagccaagcaaaacaugcagagcuagucacagccggggcuggcgggucugcaccuccagucagaugcuuucuacauacuacaugaaggggugggcgggaagacaagagguacccacccuuggcaacaucucccauccugccuuuccucuuggggguccugcacacacacacacacacacacacauacuuggcaccucuggaaggugaggcgagagcuccgaucauuccaucacaaauauguauuagcuccacucaaugccaagcccagggagcccucugcugccacccacccacgucacccaagcucuccuggagagggucagguucagcauccucugagcaacaaggacccacacaccacaaauuccuuuuugucucucuggccagucauagaacaccugcuggcucagaccaacuucggacugguccaaguggccaucaccgugaagcagaugggcacgaucucaggcuggcugaggaagaaaggauggacucuugccuaggagagggggggcggggaaacaagagguggugaggagccaagcccaccccugaagacuuagccccuccugggcccccuaggccacuccaagagugagccaagacuaacaccagcagccaccuccuucucucuaggcugaggcucccacucagcaggggaaccgcagaugcuagggaccaugacucugucugugaaccugaguguggggcccucuguguccaacacaggcccgugugggagauguguguggaauagcggauggagauaagcgaagcauugaaccaaccggcacugaaccaaacuuucuauggaugucgaacgcacacgugccuaacacggacacauaugcaugucugaaggaugccuaaaacaugcaagugugugugaaagcacucacgugcagagggaugugggagaagugaacgugcacagccccugcacgagagauucugggcuggguguugggguggccugugccucugcagagcuugcaguaacuucugcuagugugagugcauguguggcaguuugugacugaggguggggugguaccagaccgagaggcccaaucuuucccgccggggauggggggcagcugggggagugacccugggagacccugaaggacuagucuggugucuggagagccagagagacgagccagcgaucaagagaacgugacugaccuagaggaagcgcgggguggagaucgaaggcucuguacuuacccggugcucuguguugagcugcgccgccgucagucuguccgcgcacccgccgucggugaauccagaguccggguggcgcgcggcucgggguuggagaagagcgggacuagccaggccuugagaccccgccccacaggucccgccucagggcggggccucgauuuugcuaagacuucgcccaacccagugcucaacaagcccaaauaggagcccaggagccggcgcucuccuguccgggucucugagucccucuuuccacucccucucaccaugcuuuggcuauauugagacucagaugucucaguacugcgccacccuuuagcuucuccuccuggacccagcacccugugauagccagagguacccaggcucaaagcugcccagggacaggucugcagaaacuaggcaugggcaugcucccaucuuaguucuccacugucuagauca

SEQ ID NO: 3226 - RNA, 517 nt, Mus musculus
gauggcgccaaaagcgaagaaggaagcgccugccccucccaaagcugaagccaaagcgaaggccuugaaagcuaagaaggugauucugaaaggcauccacagccacaaaaagaagaagaucuaaacguccagcggcccaagacccugcagcucuggaggcagacaaaauauccucgaaagaguaugcccaggagaaacaagcuugaccacuaugcuaucaucaaauucccacugaccacugagucagccaugaagaaaauagaggauaacaacacucuaguguucacuguggaugucaaggucaacaagcaucagaucaaacaggcugucaagaaacucuaugacauugauguggccaaagucaauacccugauaaggcccgauggagagaagaagguguauguucgcuuggcuccugauuaugaugcccuagauguugccaacaagauugggguccucuaaacugaguccagauggauaauucuaaauauacacuuuuuuuuucaccauaaaaaau

SEQ ID NO: 3227 - RNA, 1303 nt, Mus musculus
cacuacaugcuagguugucuucuucuuuuuuuuuuuuuuuuugggugcagugaacuuuauugaugguauucaagagaguagggagggcucccuaggccccuucuguuauuaugggggucugggauggaaauugugagggagaugcucaguguugggggccgaguugggauagggccucucucuugcucaguguccuugcuggggugggugguccaggguuucuuacuccuuggaggccauguaggacaugaaguccaccacccuguugcuguagcuguauucauugucauaccaggaaaugagcuugacaaaguugucauugagaacaaugccagccccggcauugaagguggaagagugggaguugcuguugaagucgcaggagacaaccugguccucaguguagcccaagaugcccuucagugggcccucagaugccugcuucaccaccuucuugaugucaucauacuuggcagguuucuccaggcggcacgucagauccacgauggacacauuggggguaggaacacggaaggccaugccagugagcuucccguucagcucugggaugaccuugcccacagccuuggcagcaccaguggaugcagggaugauguucugggcagccccacgaccaucacgccacagcuuuccagaggggccauccacagucuucuggguggcagugauggcauggaccguggucaugagcccuuccacaaugccaaaguugucauggaugaccuuggccaggggggcuaagcaguugguggugcaggaugcauugcugacaaucuugagugaguugucauauuucuaaugguucacacccaucacaaacaugggggcauuggcagaaggggcagagaugaugacccuuuuggcuccacccuucaagugggccccagccuucuccaugguggugaagacaccaguagacuccacgacauacucagcaccggccucaccccauuugauguuaguggggucucgcuccuggaagauggugaugggcuccccguugaugacgagcuucccauucucggccuugacugugccguugaacuugccguggguggagucauacuggaacauguagaccauguaguuaaggucaaugaaggggucguugauggcaacaaucuccacuuugccacugcagauggcagcccuggugaccaggcgcccaauacggccaaauccguucacaccgaccuucaccauuuugucuacgggacgaggcuggcacugcacaagaagaugcggcugucucuggaacagggaggagcagagagcccuaggu

SEQ ID NO: 3228 - RNA, 771 nt, Mus musculus
aucauccaaacaguaguuuaaugucccaggaccuuccugacccuuucagcugcuuccugagaugaacaggaaucacaggguagaggagacacagcacacuucacgggauaccaaagacagaggagagagguguggauagucaacccaugugaacucaaguuggucugguguccccugggucugcucccucccaugcaagacagggagccuaugcgugugaaggagaaacagcugcggcagcgggcgaucgcggcgaucagggaggcacauucccgcagugacugacaguuuucuguuuagcacagucccugcgcacuguaagaaagcggaagagaugagggaucugaggauagccucgggauuaguaacaagcagcaaccacuagaccuggcaguggauaugugaaccccaucacgugcuacugauaaggaaacuaaacaacaccuggagucaagccucccgcaucaggaggaagacgaacucggggguggggguggggugcggcggggaggaggcuauuucugaagccuaugagagcuguuucugccauggcagaaauaugccugcucgcuuucccuuuccauuugauacuuaguaccaugauguuccuuggaaguuauuuuucacacauguucaucuauugggcaguguuccuuuuccagaucucaggcagaagucagugaaacaucucagcguaaagagccgcgggagcagucagcaccgaaggaggaagggucggaagacgguucucagggaccaaggcaaggaaag

SEQ ID NO: 3229 - RNA, 14764 nt, Mus musculus
cacgcgcagacaacuugaggcuuaggcagggcgguaacuuuuguccugcgucccgccagguccuggauuccacgagaagucuugcagcucuguggcagacaggaggucaccguauucugcguuccggucgucagcccaauuccuagcggaauagagcaagacggcggcagcgaaccaagcccaccauggcagcgaacguaagugcuuccugaugcccgggugacaccaucauccgggccgcuuuuucccuggauccgcgcugggucuuacaggggugcuaccccagugggugcagcugcccucagcucucugagcuucuccaucucgggcugcgcguuugugggccucagcaauuagucgaguccgcucgugcacggcugcuucuuccacuccuaguuucucucugggccccuggggauacgaaacuuggggaacuuggggaacugaaggaccacggggaaagugucuauuggugagcagacugaugaggugauccugcccagguggaacuguccagcaaaugcuucuuuggucuucgcucccuaggggguguguacucaaaggcugugugaugcuacuguagcuggacuagccuggcuggaugacguggagagggagacuuuucucugcugccggguuccuggugcacugauuugguuagagccccuagcugaggauaguucacccagaccucuggccucuuccuacugcaacuaguccuuaagaauuuuccuagugaaucuuaacauucauucaacaaacggagcaacaccaccuacuaggggacugggugugggagaagccggugagucaccagugccucuggugaaagcgccucugaagccaucucaggagcacugccagccccaggcacacccuuacucccuccuugguagagugucacuacagcccuccuugggccuguuacacccucuucccaggccccuccucaguccggcagacuucaccuccugggaggccggaguuuguuucacccacugugcaagcaauaucuguuuggcauauugucuggcccuggcaggggaagagaaccaaagguuaggaaugcugcacuggagccagaggagaaggcaaccagcaggccagccuggcaagagcaggcagaccccuucugauccaucucaucagcgucauaucucaccguuccccagaagaagacaccugcuugggggcucguagccagcuuggcaugcuacauccccagccugggaaggugcugaugagggcagacuuuggagacaagcccggaggcaaauccagauucuucuacucuaacuccuuuggguuuacucucucaugggaucaguuacuuugaaauuugaggaagguugcugggcacagagccugguacaugggagguacuuaauccuugaaaaaguuacucuuagaggcuagcccacacagucuugguaggcagagaccaucuuggauucucacacuaacaaacauagacacaaugggauaucuucagaugucuuuguccauuuauuguuauauuacuuuccugggaagacuugagcuuuuauuaaugucagcaggauagccauagaccaacuccaucuuggugaaccaaagagguuaucuugggugacugauggaggugugugccgucccuucuguuagcccccugucuccuguauccucuagcaguacuguacacugcugggggugugacauaggaggaggugagaggcuagaaucucaggugaugguauaaagauccucguccacucuuccagggaacaugccugaucaugugagggguucaucuaagcuauuugggucucaauaugaccauggcugugucaugccuagagacaauaccaaagcauccauacuguagcugagucaccaggcaggguaagcaagaaaaaucuuaagacagugaguggaacaaaagcuccugaguucaguauaacaacuuuccugucagguagguauuaucaccagcaagugaggagucaggaccagagagguggagcacauguugccagguuccaaagcaacagagcuaggauuccaacccuggugugccaauauccaggcccaguauguucccacccauugauucaucauuuauugauucucagcccaguaugcuggaaguggaauguguuacuuaggauacauaaguguacauauacacagguauauacauauagaugcuauuucccaccucaccucucucccagcuggaggaacaucuuccuggccucccuuccuuccuggccuuaaggggagccagcaggaacacaggacuuuuuuuuuuccauucuucagcuucaauuucagcuaagugaugaagaagacagucuaggguagaggggccugccugaguugaacaucuacucaguacuuacaaguuauugauccaggcagauaaccuaagcagagucucgaauucuucaucugugaaauggguauuaguagucucuuuaccguugagccagcccaugguuggccuguaacaaaugaauaugcuauugugggcauccugcuggcugagauugucuucuugucugcaacaguugucucaacugaguuuuauaugguauuguucuggauacaguggguguccucagcaggccugagccaacaguggagagcagccagaagaaguggcauuugauaugcucaaggauucugucucaaauccauccuuggauacugggcaggaaggggccuggcucucugagguaccugccaggugaccacuuuguaucucugugacuuucauccacacccacagucuggguggcagcucuaguuucaguuauggagaaaucugauaauguuccuauuagcuguaacucccacaggugccuaugaggccccagcacugagccaccaccccaagcuugggauuuucacccccacuuuacccaugaggaaauggaaggcccacagcuaguggauggcagagccaggauucaggcuuagucucuguucuuggugaugaacacuagacauacuucagacaguaccgaguugggugaagccugcuccacugaccuguggcuuguggccuauggaaagcugcccgggcaugcccaucugcucugucucuccagccuuccacagccauagcagacaggcuaugcuguucuacauuccccugcuaaggguacccuuucccugaggucugccucuaugcccccuccuccaaguagucugucuugauguccuagcuagaagguguacccagcacugagcccaccuuucacuggacacucagcacagccucccaguaguucuuggccccaccugccauucucacagcacagcaugguccucaggaaacccagccguuacuucucagguuuaaucaaaaauauauuucuagcugcuuuguaaaauagcuuguuggugucuuuuuaacauacgcuaacuuacggucuagaaauucugugccaaaggauaguugucuaccaaugucuguggggaagagagucucuucugggaaucuccuugcacaucaaaaucauuucucaaaacucaucaaacugucaauuccucccucaguauuccaguaccagcagcaggaaagaacaugucaaagugacuucugagccccagccaggcuuccuggagcggcugagugagacuucgggcgggauguucguggggcuaaugaccuucuuacucuccuucuacuuaauuuucaccaacgagguaagaugcaggcugaggauccaguggcugggcucugaaacaaagggccuaggucuuacaggagggaagggggugcugagguaaucugaaacaccucaguggaagccagggcggcagcgagggacacuuuucucgggcagccccuucccuugugggagcagauauggacccagcauuuccagucucacauccaagcaguuuagacuuagagaaaaagggaaccaugaauuuauaaaucgguuuaacagccaugucucagguucuuggcuuaggucucagucuuuugaaccaggacaggacucagccccaccugaacuacaugaccugugagggaggggaguaagcaagagaugcuggaaaagguccccugccacccuagguucuccaagggcugcaucuggauaucucccugagaccaaggcuagguaccuugagugagcccgcugaagugugucagcuaagcagagaacacaucuggcugguuaggccuggaucacaugauuuggacagggguucagccuggucuuugaaagccacauggauugggggcgaggggaguggaugguagagggaaguggaggcgcaggacuaggucagggcaaggagauaugcagcuuucccccagcuucaggcagucugagauuagcggggucuuccugggaaagcagggauccuggguucuagucucgagucugcaguugcuagaccucaacaucucuguucacugaggcccacccagccuuugcugugcccacagcaaggagccaagcagcacccgagcuguugaacuccacucuucuacuucugacagggccgagcacugaagacagccacaucgcuugcagaggggcugucacucgugguguccccugacagcauccauaguguagcuccggagaaugaaggaagacugguacacauaaucggggcccugcggacuuccaagguaggcuggcugacugggugguaguggcuaacugcuggagucaaggacugggccucagacacagaaccuccauggcuguguggacaggucacuucucagucaguuuccccugugcuaaugacaacaguaucucagauuacuguuagcacucagacagucugaugauaguaucucugcuguugucugagcucagcaucauaggcguuguguugagagcugagguuggcagccucaugcuggucuccuucacccccacuucuggucuugccaccucugucucucuuacuuagguuacuaugggccgggaacucuggacugcugugagcuuggucauuacauguuuguuuguuugauucuguuugaagcucuugucugacccaaauuaugggguccaucuaccagcugugaaacugcgacggcauguggagauguaccaguggguggagacagaagaguccaggugaggagccaggcacagaggacuuggagggcaugaagagcucagguguuaagcugaagggcaguggcuuucuugccggcaccauuuaacuaaauucaaagugcagggucugccuaucagaaaagugucaaaccuccgcauuagugcaugguuagcaauaaucuagugcagagugggccaaagcugccucaccuggacguuccagggugcagcccaaggcuuaacuggugucacugggaucauuguggcccucccacucccaguugcugcucagcuuuuccuucauugguccauuuucucacagaggguacaaguugcuucucaauucacucacagccuaucagaaggcccagggcaggcucucagcggccagagggggucaccugcagacaggacuggacgcagccccacuugaacuacacgacgaccuauaccaggaaaagaguagucaugggaugcuggagaagguucccugccaccuuagauucucccagaggcugcagcuggauaucuguuugagcccaaggccaggugccuuugggugagccagcuggagugugucaggcuagcugagaaaacauaucucuuuaggcaggcuuucuggagcuaguaccugcuccauggagucuggggacugucuauuccugagcccaccaggcuuucacucccuguggggagcuaggccuugaagccacuucugcccugagacccuuagagaguagauggcuuugggcaccugagcugauugcugcuaacugugcuuuuucugcagugaguacacggaggacggacaggugaagaaggagacaaaguacuccuacagugaguccuggaccucuaagcucuguccauccccaggacacgugaccuccauucuaguccaggcuggcagugugggcaguacaguggggccaugggcaagugugaaaggccacggcacccaccuucagagucuugcaugcccagcauccagggaggccugagcagccagccugauccccaagggccaugggugcuaguaagaggaugcugaggccucucuuaacuggucugaauugucccuucuuucucuucauguagacacagaguggaggucagaaauugucaacagcagaaacuuugaccgagagauuggccacaaaaaccccaggugagaacuuggccuggguccgaguccagccuugcuuaccuugcaggcuccagccucauuuaaucugagugaugggucgaguuaaccccacagguuuccccacagguuagcaaacacaggagacaccguuuuaaccacacaccguguugaugccacaacacaagagcuggucuuugcugacccucaaguuaacacagaccuggugaccgacugagaggucucucugcgcacugaagugccuuguuacucuuagcucagguuggggacacuagggaguagugacauuugagccuuguuaagauuccucagggagaacucacucuauugccauggcaugggguggggguggggggagacaaucauguagcucuuggccuuggcuagaucauuugcagccaugguccagguagagccaggaagaugguccagguugaccaggaaagcuguccagauggaagcuguccaggcugcaagugguauguggucauggcuaauagggcagggcaggcuggugggucuggguaagacaguaugguaauaagacagaguagagaugcucaacccagagagggaaaugggagcccuagaggccauacugugccuagucuugcuggauccccuuccugguuccauuccaacacaaagggaagcagaucccauccuggugccccaauacggauuguucccucucuccuacagugccauggcaguggagucuuucacagcgaccgcccccuuuguccagauuggcagguuuuuucucucagcaggugagucucaggccuccuguggaggugcccacccaaaggccuuuccauccccuuggcuucuuccagggcugggucccuagcaccgagcaggcccacagccaaugguugcuaucaggguccagcuggcccccaucucagagucauacucugggaggggccagagggaggugaguccucaggggguagaacccccccacucuagccaguucuucugaagccuagacuguucuagaaauuacuccagguacuacauccuugucacauuuuagugcaugucuguucugagcagauauugcaccagagaccugccucaaccagcucucagccaggaguucagacaaggucuucccucccuccgaccucuggcuccaccugugagcccugccuggcaucuagcucugccacagggaggugcauugcagccuccguugcgauuguaaggagaaacccacaagguuuaagguggcaccaugagucauaguaacugagguucaacucuggaccuaaccugggagggugacagacagacccuugagacccagauagccaagcuuagccuggcugucucaauagcucugccacucagcuggugcuggggggaggggacuccagccuagauguggauggguauauucugaagagggguagcugaaaccaagccacccuucgaacuguagcccaacuggcugagcaggagagggcaugggaaagcuauccaggaggaguuagugauugaguaaggccgacuccgacacaggggaguucuagaaggggugggauuagagaaaagggcauugcagcugguguggcacaugccuaucauccagcacucaggguucugaggcaggaggaucauaaguuugaagcuaacuuggccuacagugaaagucugucaccaaacaaacauaaagaacccaugccugacagcguagguuugucgucccagcacuugaggagugaagguaguaaggucaagaguucaaggccaccuucagcuuuauaacgaguuugaggccaucaugggcuacaugagaccaacuaccuaaaaaaaguucacuccaucugggagagacaaacaggucaaagcuagagggugaaggcuuuuggcccugcugucugagggcaccaaagauagaguaucaggcuacagggcuagcagaucagggguucugaguggaguccaugguuucugagcauucugcuuccgucaggccucauugacaagauugacaacuucaaggcccugagccuggccaagcuggaggacccccauguggacaucauucgccgcggagacuuuuucuaccacagugaaaacccuaaauacccggagguacgugggcaugcgggcugcucagacagcagaggccauggcuuuucagugugugcagcagcuggacccaggcugcgcuugcccagugagaccggagaccaggggaugggacagucaggacaaaagagugaacauccaagcgcuggagaguugaugggaucaccauucacuaacucgucccacuucucuuccacccucagguuggugaugugcgagucuccuuuucuuaugcgggacugagcagcgaugacccugaccugggcccggcucacgugguaacugcuucccaagggcugaccccagucucaacucccugggcccagacaccuugggauguguccugaccaccuugugccucacccauuugcacaggcaucaggccugcucuugggcacuuucagaaggccagcaggggcuuuucccuguguagaucugccccaacaugggcuucguccuaagcgccaucccauagacacaaggagagacaagccccaggucuccucaccuccuggcugguguggagucugaagggugggcugugggucucaccccgugccccugucccucaggucaucccacucagcucuaauacugacuuucugaccagguuacugugauugcccggcaacgaggugaccaacuaaucccauauuccaccaaguccggggacaccuuguugcuccugcaccauggggacuucucagcugaggugaguugagacugccugugugggcacacccugcccuucuucccagugaccucuagaggucauggccagccuuuaggcaagaggggaacucgacagcagccuccugugugagcaggcaccugaggacgggcacugcccucucaggcugucagccuugggguggggagaucaugagaaaggccaggaagugaggauaggagugugggcagccaugguccagcaugauggauaucuaauagacaaucaguuucuguggccagggccucugugacaagccauuauugcggaggccucaaaauggacagguccacccuagaauaaucaagucaggcaggaaagggugcacuuugucagugggcaccaggaggagaagcggccacucugggguaccucuucuuccuucaggggcaccagugcaggguuggaacugcaguaucagggccaugggagugagaugaucaccuacacacaggucccaccauccaccgggugugccuuuuccagcuguauuugggaagggccauguguuacccagugcugagauggaggcaugccgacucucaccucugugccugagacagugagacagugguugauucucacucuugcugagacagccagaggaucauugcuaggcccucccuguguauauuaagccaaugugcggguuucaauccagaacagacagaaaaggccaaggguacagcuggcuucagagcauggcuguagcccuucugcugcuauuucuggaugcucagcugcucucucuccucccuuccagcuacaaccagugugucauggugucugggcacaaccugcuccuuuuaccuggccaagauagggugugguuggucuguuguuggggagccugguuaccaggcuuaggguggggcuacuaccucccagccugggcugagucacccuagggaccgcacuaaaauuagaaaguccuuuucucucucccaggacuuccucugcccagccccugguuuccagccuccucaggcagagucccaggucucagagcuauccuccagaaagugguaggcaggauguguggcugaggagacccgagagggaagguuuggcuauagacauggcggugggcacacagaacugagaagagagcugggccccaaagucagaaugcuggaacucagggucuggagagcucagggguccagaccacagcacugcccacaggugccugucaagcccccuccucauccuggcacugccucccaccagcuacaaaccaugagccagugucuuauccucaucugugaaauaaaacauuuuaaaaacaccgccaccauccguaucucauguggguagcgcaggcauaucagaacaguuuucaaguucacugccuauggcgaggccauggaguuuugugacaacuucacagagccucagcuuccugucucuguaaaacagcaaagaaguuuccaauuggguuaagagucggaucagugcgcuuguuaaccacagggcagugacagcuagaggcugagacaggcauuguccaucauuguguguugucuuagaguuggacgguauagaguaguguucaauccauggcugggaaagacugaggagaagucacaucuaagccgagacuggagggaaguacacagacugcacaggacaggacacuugacuuggccgcaccauagguggcccuggcccugguggaggaucagaggggguuggagcuauggcagcugcuguaugagaaugaagugaggaaacaaagaggccagugaagcuaauguaagagccugguguggagcaaugauggcguggaucaugguagacagcagggaaacagcugacagagcuggcuucuauagugagggggaccaggccauaccugaccccagguugugccucuggauaggucagguuaugugcugccauggagaagacagagucagguugggguggggcucugagucagugcucagcaugucaagagggugcgacaaugucuaggaggugguaggaacugggcaguguggcccaauagcagcgcuacauguauaauauuauguuucaguuacgggcucauggggugcauggcagguccuggaaugaagcagccaaaggauaucagcauuuacagaccaggaagagaaccagggacagcaagggagcagaaggcucccccuacagaguaggagggagucaguuggggucagugugccugaagcggugagcacuauccugggguugaaggcuaaugcuucacuuaggaucagcgugcacacccaaacuguccacucagaaggaccggagguguccacauaugagauagaugcagugggaaggaaggugaccuuuuuccagaugagacaacuuaaagccacaaagaucucuuauuccauggucuugagccagacaggcagagacuuaggcacugagucuuagagucuuuggugagagguuugccugucucccugugcucuguauggaaauggccaacagcacccccaccaccgccacacugcugcuuguugucuaaguccugacaccacgccaccuuguccuacaggagguguuucguagagaacagaagagcaauuccaugaagacauggggccugcgggcggcuggauggauggccauguuuaugggccucaaccucaugacacggauccucuacacccuagguagguguggaaggugcaggagcuagccuucccuccgguagcccugugcuaggcacacugccaucagucaaccuuucagccuggugggauccuugagaaagacagcaaacauccggccuaucuguaucucccccacccccagguagcuuuaggaugaacgagcagagaaaggcaggcgugagggacagucauggauauuccugccuaggcuuccuuuucuugccccuauuugggaguuucaugcaugaaaacacccuccaaagccagaccaggugugcagcggcuagcacaucuggagccuggggagcggaugcccacuuguccugagucugacaucagagcccagguuuaagccaacuugguucaagucuuggugcccaggacauggagugugccaggcugacauuguccgugcaggaggagagccugcucagggagacccaguaacaaggccucugccccaguauggccucaguauggccccauccagccaaacccuucucccacugagaucuaugagcugagagaggugucgauggagcgcaucacagauuggcaguaacuguuggguggggguucgggaggauuuucccauugacagaugggaaacaggucauccaucccucagacucucccuggacaucugaggugugcucgcaaauaccagccacauugugagcacaucagagaaggaucagaauuuaaaccaaacucucuuggccaugggacugaggacaggcuaaucccugugagucucaguccccuccauguuugagaugcccuaucugugauccuggguucuuccauuggaggccugcuggcacucagggcagacgucguuauagagggauaaugugagcuguggcaggacccaaguggcccucccuguccaucaguaaacaugaccugcugaacccuggguccuuccuaugcaaggcauggagcagugaggauagacaagcccguccucugcaggcuugcacagaggcuuagagcucaggcucugacugaacaguguagauugucagucagugcuggcucugggagagaggguuuuaugggugucuuuucaguggccucagcauggacuuugaaaguccaaagcacucacacuuggaucugggcugcacagaauaguauugugguagcuugcugagucccccacccucaccccgugguaucuuagguauguguguggcuauguauggcucuacuuagugacuguuuccucccucaaaugguagagaggagcagucuagggcagggagcacagucuccucggggacucauggucuucccuuuccccacaguggacugguuuccugucuuccgagaccuugucaacauuggccugaaagccuuugccuucuguguggccacuucccugacccuguugacuguggcugcuggcuggcucuucuaccgaccgcugugggcugcucuaaucggcugccuggcucuggugcccauuaucauugcacggacccgggugccagccaaaaagcuggagugaagccugagaggccagauucccugucaccucugcccagcucagcuggaucaggcaucuacacaccccauucuuccaggggccaguguccacaccugcauguagggauucgguguccugcuuaaugccuuccccucucgggcuucauuccacccagcugucagcugaccugcgggugaagggcucagccuucucacccaucccucauugcuggaaccaagugccaagacuaccacaaccaucagcuacaacugcaaccugagaaaacagacaucacccucuacugcggggccacaccacaucaguaggacaccccauacccaggcuuggaggagugcacgccacaccaagccucuggguagaaucugauguggccugaagaaacccugaaggucacugucacuguggcgggacagagugcuucgguauaagcccgcaggcuucugguucuugguucuauuaugccacuucuccgguucuuucuaucccaaggagagugugacugggucacacucacaguugcuguuacugaaaugaacucugcaggaaugguguuucagcgggugcggcuugacugguuugaguucccgaggccaaggggaagcuuuagcuuugcucugcuuuugaaccaguguugggggauucccugucgugcuggguugggacuguggaggcggcacccucuuuauccccugcuaucacagaugaucuguucacuugaaggugauuuuuaucuuguagucaguguuacaagaaaaggcuggaagcauuucuacuaagcgaggcccuuuacagugaccuccaggcaacugaagucaagaaucaggacucgggcuugcugcaggaggcccacgucuggccuuuuucugugggacacuucugaccuugacacuccggccucaagcaguugcugcagagugguucuuuuugcauuuaaugcccaucacuauccucaucccaaauaaaauccauucauacuaguggacaucauuucuaaguuuccuugcuacuguuacacccuuugaacggaugcuuuagcucugaugucgucacagagccuugguuuauccuguaccugucauuucuguuugcaacugguugcuguagcaacaagaguguuugguagcugaccaaggugucaggaucccugacccuagcgauacuuaacaguucuucccauguccuaugguaucugugcuuuuggcuggguaaaaguacagccagagacggcuuacuggguuuagaauggaaacaacauucacuacuguucagugcaugcugguacaaucucuuagaaacuccuaagaugguuugggaaaauacagugcaauuagugauggcuaaauacacagugcuugggauucagucuguguaacauuuucuucuguguuuuuuaccagccagcucaaaaguuaagagcaaauuauggaagaauaauuugaugucuuugagaaaccaugagguuucuuuguauuaaaauuugaaauaaauuucuacuuaucuuuugguauuggaucuugc

SEQ ID NO: 3230 - RNA, 1028 nt, Mus musculus
ugcuuaacauuuguuuuuaaggauuuaaaagaaauguaugcauauauaugugugucugugaguggguaugugcuuggugcuagggaggccagaagaggguaccaggauaccuggagguaguuacagauccacgugagucccuagaugugggcaugggagcugaacucugguucucugcaagagcaauauucucucuuaaccauggaaacaucucuccagccccuuggcuaaauauugugauccauagcuggcugagagaaagaauagggugggaguagggacuacagaaucaaagaccuggguacugaccccugcaaaaaguauucagauguccauacauagacucuuguguguccuugucgggucaggcuguagaacccauccuucccaggguucuccaggggcuuugccucucccuuccccucagguagcccuggcucuccaauucugucuugauuuuuccauauaaaugaaaccacagggagucuggcuucuuucacccagaguguucagagcucccucgugguucugcgcaucccaggaguccuuuugcuagagcugcaaucacucaguuucuauuuuccuguugauacaaccaggcuguuuccauuuuuagcugccaugaauugugcagccauucauucuugcacaaggggguagaauuccacacggcaauaccugggcgugggguuguuaguucagaggccaaauguucagccugacuagaaauuucuaaccuuaucuagaacugccaagcuguuuucuacggcgguggugcccuccuauguucuucgcggggaguggcgaugggcuaggguaggagaagaccagaaagaaggaggcuccugcagucacccccagggagcuggcuuggccacgcagcagugugcgcuugcuugcugguuucccuacaguuuugccucuauccucgaugcauucccucccugacucuggagcagucugcucccucggagagaggaggaaguggggcucggggacuuaccuccccaagaccacauccggcaaug

SEQ ID NO: 3231 - RNA, 75013 nt, Mus musculus
cgcccaggcccggccaagcugguauuuuuccacccagcaggaugggugaugcggagagcugccuguucagacaacagacacgcgaggucagggagaagccgcuuauaaauuaccgcuuccuccgcgccgccgccagcgucgugcuccgggaccugguugcugccgagcucccgugcccagccgccaacgccgcgaucgccgccagucccgccagccucgccagccccgggccauccgcugugggcuuagccacccagguacccagggcgugugggccgcgacugcagcccccuccccgggccgcgcuccgccaccucaccgggucccugcgggucuggccuccccgcgcucuuucauccccuucaccccugagggagggacugagggucuccuguucagcucugcuggagagggaguuauuguuucccuggcgaaggggcuggggcugcuggugcggcggcaggugugugugugugugugugugugugugugugugugugugugucccacggggugccuccuugucccuggaugucucuguuucugagaguggcuguuucuccacccuaggcagccguguacaugugcgccccggggugugugauaugaccagggcuauguccggggcugccuuaccugaguguaguguggccguguggcucugucuucugauacacacacacacacacacacacacacacacacacacaucuugccuaugugaaccuguacguguggcugugucuccggaacccuggccgugugcacgugugugugcccgaaugugccuggaucccuggaucugugguugggggcaagucuagugucuucuagcuguacccgagaggccaucccuugugcccagugggcccaauggacaucuuugguucuucguaguauuuaggagagguaaaagggcgguauggcuccaggugcugccuggguguggcacgcaggugugacagucgcucccaggcuugaguagcagggcugaggcccgaaacgacagccaggggcaauggguagcaccagcugaacacaucuuccucuagacugcuccccuucacuuuauggguuccucuuuugggugggagguucuggucugcucccacuggggaagccacacaaggaaccagucucaggaacagauccuacagucccaaagccucaaccuaggcuguagccuggcggcaagggaggcgugugcucagcagggccaccgaccuggcuauuuuggucacugccuggccucugccagaucccugccuucccuaggaccagccccaaaggcuugggagacagccugggcccccauuuccugccuggggaaauaaaucaucucaaagacuggccaggcgcuugacccggaggguccucggacugcggauugguagcacguggcuccaauuggaugucaguaaauuggccuccgauuuggcacagcuagcuuucaaauaaaugucauagagaucuuuuuuaaauuaaaagaaaaaaaaaauuuuuuuuuuguugcugguagggaggggaucucacucagagucucuaagccagaaggaguuuauuuuuaugagagagcuggugagugcuuagcaacggccugccugccucccucucuaccagggagucaucggggaguggggggugagagggagguguuuuagcaagaugaugguggguggcuggagggggaccuaggcaccagcugagaacccacaauaggaugguauuggcagaugguuggagguugucuuaggccuugguucagccacucaguuaaccuugggcaguauuucuuguccucagucucuucaucuguaaaauggguggggcauacuacccauuggauaugucaacuggggauccaagagucuucuuguccccagaaagacuguguuccucuuaauggugaccuuggguaguucucuuagcuugggcuuggcuguccaggcgacaaggacgcuaaggccagccucgccuuguccuugaagggauugagggagaugaggcugaauaagcuugugguaagcuguaaagccgggcucggcucuagagcugcugauuagagggugucacgaggucucaggucacugugguauguggcaagggccauggugcuguccggagagagcuuuuguccuuuggggauacccugguacugccuguagcucuguuguggucagccuuccugacuuucuaacccccucuguauccacaucugcuugguagaaucuggaggcucagggcugggggaacagcccauucuauagaugggucaaugagaacugccuaggagccugccuugcuugcacuauacagaauugggauuccaaaaagcuuugccauggccagcuguacauuuaggcuucacggcacuugggccacugauuuguuggggacauuaagauggggacauuaagguggagaagguucuggagaaaaggagagacaaagguauucugguccuuagggcuggaggguguaugggugggggugguccuuaguaccuuauauuccuucuugcuucucugcaccuuccaguggagcccagcuaccauccauccaccugcagcagguguugugccaccccacccccacccaacccaaaggcaggcugggcacugggggugaggggggcucccugcuucuaaccucaacuugucaaagguuuaguucuccgaaaguuuccaaaggucucagugauaaggugccaugagucacugagcacauuccuggagacaggaaagagcugucaaucacaaggacucccuggaauguugcccagcuacugccauugcugcgaucugggugggaauagaggguuggccugggguuccagcugugccgacugacuuuggcagugguuguaggcaagaaucagacucuuugaggaggcugcagcuugcuucgugguguuugucaaguuagccuagccaaagaaguuugaaucuauguguuguguggaguagcuaugguucuggggcauccaugcccugguggagaacuagggcucuuuuuuuuuuuuuuuucuagacaggguuucucuguguagccuuggcuguccuggaacuuacucuguagaccaggcugaccucgaacucagaaauccaccugccucugccucccaagugcugggauuaaaggugugugccaccacugccuggccuagggcucuuucuuaaugugucucauuuaggugguuaagaaacuuuggcugaggggcuggugagauggcucaguggguaagagcacccgauugcucuuccgaagguccugaguucaaaucccagcaaccacaugguggcucacaaccauccguaaugagaucugacucccucuucuggagugucugaagacagcuacaguguacuuacauauaauaaauaaauaaaucuuuaaaaaaaaaaaaaaaaaaaaaagaaaccuuggcugaggucagcucugggcaggcauuggauuugggguagaauguuggcuuugaggcacuaauaaccuagagggaguagcugcugcaaggaccacagccauccaugacugccuugagggagacuuaagagcccgugagccagugugugcuuggugaggcagagguaauauuggagucaaugcuucuuaugggcagagaggcagggugagcuggccugguaggcagggacacagaggguuuaaauguaccgugacaugaaauagcuaauagaacguguccauagggucucaguuagagagaggccaugaauagauguggccagagccagaugauggagggcuauggguuucaggcuuauaguuaucaggagggcagcagggagacaaauagguuugaacagcauguagggacgguagcaggagucaaucaagguuggagccuggggagagaccccuaaugguaagcaaggaacuggauugggcuccaaagaucaaggguggcugccuacuggccuaccauuagacaggguacaagguauuuucuggaccaaagaaucuggccccaaguucuuucuguaaacaccaggugaagccuggacacccuguuuaacagguaccaggcaggccauuaacuugcugguuuccaccucccuggagcgugcagaucuggcaucuuuagggaaaguuaugggcaggccugagagcggcaggauuuucccuucugaccacuuuggguuaaaggauucuuuuggaaacacgcgcugaggcugggcuuagggggguggggucggagaagcaggaagauagaaauguuugucuuugugugugugugugugugugugugugugugugugugugugugucagggguggugggggaguuggggaaguuggccuggaacuuauuauguagcccaggcuggcguggaauuuugcuacacuccugcuuugggcuuccaaguucugggauuacaggugugagguacugugccuaacauuucccugagauauggcucaucagguaaaaucacuugccaggaucaccagguccccaugucggaaggagagaauuccacagugaucucuuuugaccuccacaugagauccuagcaugucacauaagauacacauaauaauuauauuuuuucaaggaaaaagauauuuuaaggguuugggacuguacaauguaugcuuaacccgaguuugaucucuggcacacacacuccucuccaccaauuaaauuaaauuaaauuaaauuaaaguugaaguauaaugcagagaugcuuugaaguucaguaaauucagacaucaguguaacuaucagccagauaaaaacaucccuauguuuugcacacauguuuguguauaaacauauguguguaugugcaaauauauguguguguacucguggaagucagaggucaacauuagguaucuuuucaguugcuuucuaccuguccugugugugugugugugugugucuguguggugugcaugugugugaauauguucauguuuguacagauguguguggaggguagaguuccacaucagccugccuuucuccuuuacccuuuuacucuuuuuuuuuuuuuuugagacagucucucacugaaccuggagcuaggaugccagccagcucacucuuaucuucucauuuuuguccccacuguccccagugcugagcugcaugaguuuagggccacaucugccuuuuuauuuucuugcuggggcccugcccuugcuuuuccugcucacacaaccagcugucugaccugcaaaggccucucucuagcuccucugcuccuugcuuuuuugcuugaggaggggauggggacucuacccuugcuaggcagacacuguaccacugagccacauccccagcucucuccacaccuuaagagagcuacuuuuagaugucugucacugugaaugaauuuugccaagucaccuccccauaucaguggauuugugccaggcagugugaaucacccuuguaaucccaggacuguauguguguauuauauauggcuaacuguagcacugacuauuaaaugaaaaauucuggaaaugagcaguucauguguuguugaagacauuuuaugacaguauuggguuauauauaauucuaguuuauuaugagcuauugcucucagaaugacuaauuuauaaaugaaacuuuaucuuaauuauguguaaagggaucggauagaaggcaguauagacuggaggucauugcuuucuguauuugaauacuauagugugcccucugggcaagaggcaugauaaccauacaacagcuuguccaucuguccagcuuguccaucuguccugcagaugcuuuaucuguaggcguaggauugugagagaaucuccugugggcauugugugcuagcuuuuuuaauggacauaccauuucauuuguguaggaaugacaaacugccaaaugacucacuuuucaguuacaaaaauuauauaccucaagcaauacagaacucacagaagcuaaaauauauucccuucagaucauuacaaaauauccauauaaaagguuggguugaggguauaagcuggggauugcaugcuugccaagugugaggcgcuggguuccucccccaaugcuaauaaaugacuaaauaaagaucuuaagacuaucuguugcucucacaugcagcucuagcugugugguaccugcagugucugucggaaugcagacugcuuuuaucacuuucuggguccauuuucauuuccuugugggaguaaggauuugcucagcaggccagccagccaaccagcuagccugcuagccaguugugguuugguuuuguuuuuaacaaaaacagcgucauacuguuccagguucugucacuuggucuguacaaacaauggcccauugugaccugccaccccgcagaaugcccugcagaacacacugcagaacguacaagcccaccagcccacugugcacauccuuggcuugugacccucuggccucuucuguccuagcugaccaaccagacuacagcucagugagggcgucgccucacucaguggcuuccaacuugccccgaaggugaacaaaccgcugacaggagugucuuucuaaauacaggagcucacccauucaauucuccugccucagcuucccagguggcugaaacugcagguguguaccaccgguugcaccgcaaaugcuuauugagcaccuacugaaugucaggcaccgucccaaggguaggaagggcaacaaugaauaaaccagucucuggugcugggcggcuugcagucccucaggagagugaggccaacauagggagggggagaagaugaguaucuggagguuaauguacaaucucaggccuuuuaugcugagggcaggcacuugggaacaagucgcaggugugcggaagagugguccauugacuggaguucagggauuguggacuuugggaucacccagcuaaccugccccacccacccaccuaccucagugacuaggagcucuggugaggucugggcgagguguuuaucaguggaagagauccaaccuuccaauuaccuauuguucaguuucccugccucugcugugcccaccauucugguuauguaaaacuccccuucugggagguagguuaaggacacuggcaagaucuugugcaacugacuuuucuggggauggaucccagggagguuucaacaguugggcaggugcuagccacaccccagccccucaccucaguguuuccaugcugcuguucuuagucucaguuaaugggaaagggaugggaaggaagcacugcccucccccucuccaagggcaggcugcuugagagauaaucacaguccaggacccaacuuccagaaagcuuggggaagaaccuggagccugguacugaugaccugaucugcucagcccaagacugagcugcgugggggaagggugggaaggacauucugcccaaacuuguugggcauccauuggacaggagacaucuauaacugagccuaccuaucuccuggucugguuagucuguuuaccuugucccauccccauuccccacccucugcccccagccuugguaucucuguugaguagauggcgcuuuuaggcuaggucuccuagcugggacauucugaguguccuguuuccauggugcuuguaacaggguagaaguggaauaugacugguugccauauucuaucaacccccuuccuacggaaagcccaaaggcugagauugcuagaugcuuggcaggggguagagaaguguggcuggccgguggaucugugcagucaugccuagugggugaagggcacuggaacagggccguucugaggacucugccccugcuccagggcuaaucagccccaauggaaggcuggucaugauuucaaggaccaucauucuaucaccagauggcaacuggcauccacagccuccugaccagccaccgugucuccugagcaccucucuguaccaucuaggaggugaugcugagccaaucuccugcucaagaggcuuccuguggcuccagagcacccugugaacucugugaccaacucuaaagaagaauuugauguuagacucuuccccagaucgggcucaccucuccuuguagucugggguucuccgccgaaccuaguccuuuguuccccaucuucuucccacuccucaaguacagcuugaagcuuccugguccaagaagcauuccuugaccccggguggugcuuaacauacaggaaaccaaagaucacaagaaucaaagaggacuugaacuucccuaccugagcuccuagagcucuguccccgcggccugaucuuggaccucugugagccugccauauauccaccugaccaccagcuggggacacacugagagaaggggagauacuccagcaucuagcagaggggucuggcucucagaagugcacccccauccugaaaugagagccuauucuuugaacaucuauugguccaggcuuggacccacccauccacccaccuagcagguacuuauuccuuccgggcugugcggauaucgccaguggauagggcagucugaagucuucccuccuggggcugucugcuuggcaagggugauggauauccagcaaaaaguuaugcaggugaacguauaaaaucaaagccgggcauugcgaaccagggcugguguccuuggccucugguuuucuuacugugugaccuaggugaauccuuaucccucucugguccuugggugugaggagaucacuuguggaucaugaggagaagaguccuaagucuguguggucccagugugaggcgcacaccuauacuuguccucuugcugauuuuccaggguggcccgacccuugcuuugaaaggaggcaucccaguuuggagacuagaauuccagaguggugcugagcagagcuguggcaagccagcuuuucguauggaauaaucuccuugggaacaauguggguuugccuaaacuauuagugggagaauauagauuagaacaaaccuuuaaaaagagagaaggaaaaaaaaaccaaaacccacgccugccagccccuucccuuggugcuguggagucuauuucugucuuucguuucucgcaguagaaggugggcuucuuuuaaagguauccuguugugagccuaaaaaaaaaaaagugucaacucuuguggaauaucucuuccgcaccccacccccacccccugucaacuuuuagccaugccaaguguuuuguguauuuuuugggggguguggguuuuguauuuuuuuggagggggggugcuucugaggaugagacccaguaagguaagggcuuugcuccaguccugggaagaagcaauaugaaacacugauauuauuucuuucucuguacccgguucgggcacaguggggaagguguggcacgggggacuguggcaguggcagaaguuggaugugguguggagggugcuaagcagcagcugugagccuccuugugucccugaaccccacuggcucggaaccugccaccucucguggccgugagggagaagucacccugccucaaugauucaagggcaccgagucagugugguuuggaugagggauugcugggagcuugacguucccugagauuaugcccaguucucuggcuagggugaguuccaggguccaugugugugggucugcuuuguaagaaggcgggggcagugauagcuggaaaggggaacuggguaggggaugagucggucggucggucguuaagaggagcggaacucaauucccagcaaccgugcgaugucucacagcugucuguaacuccaguuccagggcauccaacacccucaaacaggcaaugcacaugaaauacaaauaaaucauuuuuuuuaaaagggcuggaacugggaaaucacuuggaacccgucacaguggucuccucccuaggcaagagccaccccuucuuagcguuagcuucuauuuugaguucugggguacaggcuccagccaaaggauaauuugcuuccuuugaaugugaagaguccagccucugccagcauccuuggaaagccccaaaccugccaccaggaaaaucuuguguauuguugucucucuacucauuggggaucgcuaacaccaguuuucccugaggccccagccugagccccucagcccauuaguaauauuucuuaacuuccuaacauuacccugacuugagauugcuguuaccagguccuggagcuacuagguguuguucauugugguguuguggaguuguaaaucauauagaccagcucugaucagauuuugguuuuagaugugauuuuuuuuuuuuuuuuuuaauuuuucuacagcccaggauggccacaaacucaugauccucuugcuucagccuccugaaugcugggauuacaggugugcaccaccauucuaggcuuucucccugucaugauacaggucaaguuggagucuccaaguugggaccuagcauucgguauuccuuaaaagccuagcugagauagcuaccuguacaguggguacaccugugguccaguuaugugggagguugacgaggaagcguggccagagcccaggaguuagggcaguauagucuccgagccacauagggaguuagacccaggcuguagacccuucuucucaaaagaugaauaauaugauaaauucgguuucccuaguguucauauuuugcauaggaaagccccaaagccuuccugggggcaggugacuggcucaaggucauagggcugagagcuggcuuagccggccuugggccagugccaccuuggaaaggaugcuuauggggaagccgcuugcuacucugcaguguuggcgguccaaaaaagccgcaggaggcuuuugcaggcagccaagucggauguaagucagggagagcccagggccagccaggcccugcagacaggccuaguggcuccaggcagugugucaggacaaggcccccagcaugggaucuggcuuguugccugcugggguggcgaugguggaggggagucuuugagaggcuuuucagcuccuggaagacaacacagggccugcugcaacaccccucacauggccucugguuaucuagagacauucuagcaugggggcuagcagaagugcuugacccaggaccagugcugcccuuguggaaagcugcaucccucugaaauugucuccaguugagcucugcauugaggaugcaggggggcccugaggucuaguuuccuaccugccugggccgcauguuuacaugggucacugggcuucaguaaguggaagaaaaagauagauugagucugaguucuuagaacaugguggucacuggaccagaagugacaguuaucacaggacaguggagaagaauaggcggcuccauccauaucuggcauucggagcuggggaugggguucgcagucuguggugaagaguccuccagauguuucacaggccuaccagugaggacugauuuaaacauguaugucuuccugugugcccuggagugagggcuggggaugagggggagggucaggccuaaguuuugcaacagacacaugauagaaugucaggcuguggggaaccucagaugucaagucauucugucaccuguauccuccauguugguacuaaugggcugaaugucagauagaaaggagcauaaaaugacacagcagguucaagccagggcacaggucaguuggucaguugaucugucugucugucucuguuucucucucucucucuuucucauacacacacacacacacacacacacacacacugcugaggauggacacaggaccuugcucauaccaggcaacacccuacccaugagccauaucccuagauauucaauuaauuauauugguauauguauauguuuuuguauguauguauguguguauguguguauguacaagugugaauccuagaggccagaagagggcuucagaucuccugaagccagagucacaguugguaaugagucuccuaauguggguguugggagauaaacuccagcccucugcgagcacagcaggcacucuuagccacuaagccaucucgcuagccuuguauuuauuuaguuuuugagaugagguuuuucuauguagcucaggucagucuccaacucacauucuuucugccucauucucuccagugcugggauuacaugugugauucucuaugcccuaagaagacuggguucagcaaaaaucaguuuaaauuaacuuuagagguaaauagaacauugacugcuacauuuaccugaagagcgcagcuuaagaauccuccagguguggcuauauucgggugcugagauauuguuaguuugcuccauuucuggcuccguguuccucagugcuuacuccauucucccugaaggaccuuagcugccccagugaaaccccaucuccacaagccaucucaacuuagaagaagccucuucuaacuccuccuccugcuccuccuccuccucuaaauaauuuuaggauuauguaugugugcaugguguauguauacguguguguugggggcagugcacaugacuugacaugcauguggaugucauaggaaaacugaagucuguuuucaccugucaccuuuguauggguucuggggaugguauucaggcuuccaggcuuauauggcaagugucuuuaacccacugagccugccgacuccccaacucccagugcuuuuaacaagaguucuggcugucauucgaauuguccaggcauagucaaguccacgagugagcaacucugauuggccaggucuaguucacauguuccuccagaaguaggaggugagauccguuuccugauaggaugagauugauagaugugccucaccagguuaaaucaguucagacuguuccuacauuggguaugagugccagcaagccacacagacccacugauacagagggccgcucuuaucugucugaggcaagcuggccucuuacuggucaggauuuauccagacagaaugccauugcucaagguuccuugaacaaugugcugagaauuugugcuuuaaacgcagugucuccaucuuccucguuaucuuccuuccuuuggcauggcccaggagagucagguacuuguuaccauuucccaucucugugccucacccguugcagauauuacugacucaccucggcuucgguggggccauguccaccaaggaaguggaggaaggcccagugacuucccacucauguuucagucucaccuuagguaggguucaggauuccuugagaacaggggaccucggcuucuugaggugcggucuuuccucaaacacugccugguacaugguaggugcuuaagaaauuguugacaguuccuaccauaugguaccguggacucagugccugagcucagugugcuuaguguguagcagugagugcucugaggagggaggcuggcagugaacugauagagcagccagaacucugcucagguuguggaagaagcuagaguugcugccagagaggagagguggagcuuaaggaggggucaggugccucugccuaccuaccccccuuauccuuaucccuguacaucaccauuaauuccaguuuaaguguccuugaaaucuuagcucuucauugauaagaaugcuuuucuugauucuacacauuuuuauaauccaggaaggcugaaaggccuuccugugucugggccagcaacucugcggguggccugagacgccaggcccagagcucugccccugcuugucugaacagagacucccuguuuuggggugcagcccuacuguggugcucccacugaaugugcacaaggcucuggggguccacccugaacacucuagguaacaugaacaaguaaaucaaaauucaugagauggcuucugggccauccccagaggauagcugcuguccagcagauuccagcaggcuuccugggcguaaugggucucaguaaguuuaaugugguaauugggggacugugccuuucuuaagaaucuuggggcuggacaguuguggugucucagcuggcaaaggaacuugcugccuccuaaacuugacccaaauucaguccccaggagccucgugcaagcugucccuugaucuccacaugccccuuccccccaccuccgccugccacacacagaaauguaacaguaaugguggugacaguaauaaagagaaucugucuagccuuacgcugucaauaggggauagccagugacuggucugggaccugggcagauuacagagcuagugggagugcaggcuuucuagucuggucuggugaguggcucaccuaugcacaccagcaaaaagaaccuaccuuaauauauauauauauauaaaauauauacgugauauguguaucuguaucugaagcauauccagcaucaauguagaagucaaagggcaaguugcaaagaguuaguucucuucuuccacugugugggucugucaaaucaaacucaggcuaucaggcuaucaggcuuggcagcaagcaccauuaccugaugagccaucucccugaccccaaagggaccuuuauuagacaucaaacccaccagggcuuccagcagccccacacagugugcaaagacaguugagugauucacugggacuugggcugucuggguucaagagcagugaauccagagagaggauucagagucaguuagagggagaacaggagaggaggagaggggagaggggggagagagggagagggaggagagagggagagggagagagggaaagggggagagggagagagagagagagagagaaagagaaugaauguuugcaucuggguggccaccugagugugcaugagcacaugugugagagugcacgucuaugugugcauacacaugcuugagauucagcauccuucaucccugguccagguccccugggcucaaggaguccccucucuagcauguguguugggaguuacccaugaucagaccuggucacccugggcaugcaggcccugaccacaccucuuugcuuccuguuugcaacaggugcagaaccagugccacagccucuucagaggagcaucucaagcguaaguaauuucucagcuuccuuauuggcucaggcucaccaccacccacagcaggaucccaugggggaggagucuccaauuuagugugucuuccuggcucuaggagagaaguuuccugagauggccccagcaucuaaugcuuggccccucuggguggagggccacuuggucugccuguacccaugcuguggcaaggaguagccgagguagauaucauugggggugggggaaacaggaguuuggaugagaugauacugagccccaacuucaaggggguccuggcucuaaagagaggaucucuuccgugugugugugugugugugugugugugugugugugugugugugugugugucugugugugugucugugucugugucuguguucugagcucuaccacgagcuacagccccagcuucacugaagguucuauuugaacagaacagaaaauguucaguagguugugagugaaucucuugaguuucucaugcccuuccucugaugguccugggguugaugcuggccaggggcucuuaucccugugcacugcugugaagaaccacacgaacaguauuuuugcugaaucacuggggaguaagucacaaguggggugccccuucccuuagucuuucauguauuuccucagagcaaggccauugucuuauguaaccacagcccgauuaucagccugggacauuuaacauugacauaguucucauaucuaaucagcugauugucuugguacuacaccuugcuuucucuucucuuuaauguuuccccccuucuucaaguucaaaauccuaacagugccugcaagaaggauuuguuuucaggcugauuuagcugauuugggacuugggauucaaaguccuuuaaucuugacaucuacuaaggaacacuggaguguguauacgcauucuggagaacauuccagguucagguccuugcccugugaucugguuccagguucagguccuugcccugcaaucuguccugccacuuuguugaucuugugacccacuuguggacccugcucucaaauuugagaacuccaccuuccuugauagagauuucuuaauaucuaaucuccuccucccauuccacacuccucucucuuuuucucucuucuuuuucauuggcucuggggucguugcuuuccagcauaaacaaugcuucauccugagcuguucucuuagcuuccgaggaagucucucacugacacagggcugguguauggucaauuuggggucauccgugggacucucacgagacccuucuuaacugccacuguggucggacccaauugcacuuuuggucaguuucugaccgggugugcuccuguaucaaaaaagccaacuggagaccauagguucucugaugucagauaugcccauccccagagacucagaagaccucccccagcagcuauugagugggcagagaaccaugcucagagucucaccuuaauggucgugugucagggacauuuauugccuguggguacuagaugguccucgaaguguaacacauuagcuuguuacaaccccuagaaccaugcuacagccucaagagcuaagcugcaggagguaggaguucuuguucuuucaguaaaaauggcagaugaacagguggaaugcuuacugagugccaggcaaggccgcaucccucagcagcuuggaugcagacuuugagugccguugucucguaaguacuguuagccagcaccauugugcagacugggaaacugagacuuagggggaccucccaaguucucacaaccacgaacucacuugcccaaaucuggugcccgcuugguggcaacugcccuccugauagguggggagccccuuccauccccagcgacuucccuuuuccaaggucuuccugcuacugguuaaugagcagccaaggauagugggagccagggaggccacugcucacucugaggcuggaaugugaguuuuguuucuagauaaagagucuugugcaagugacuggccccacggggccuggcaacguccuaggcagagcauagauggcgaccaugcuguuccucuucagcgcugauuccagcugcacaccaggcuaccuaggagggugcuuuggcccucagacugccccacaucacucuuguguagcccuccuggcuugccguuucugaaaagacucauggccuccccuccacccucuauguggaggucaaugggguuugcagggaguauauuaugcagggaugauacgcugucugaguucuggguguggcccacucccacauauuccuggggcccgagaagggcuagaucuaucuuuuuagccuuaaggcaggucugaauucauuccaagucugggggcugggauguggcucuguggcccuuuguaaugccuggagugcuuucucuacaauacaaaaaagcucuuagcccagccccagccuaugcaggaugugugacccugaagggagucacuaaacaucucugagccucacacucuaaccucuauaauggaguaguuauauccagccaagagagcugcaguacacugcaggacggggguuggcagaacaggugacauggacacgugaugaguccaggggaguuuuaugggcucaggacaacuaaccugaguagcaagcacaagacucaucgaaggagucccuagagaggcugcauccccucgauugaagaggcaagucuaccucccagggugcuguucucuagggugcuuguccuuuagguugcuagguacuccugcuugccuguggauaccgauguccugcucccuggaggccuccacggugagaaaaugcuuacuuaucauguuuacucugacuauaaaagucauguuuucaauacagagauaagggucccaccacacagaggugaccacaguauaauggaguggugugugcauucacauaugaguccauaagcugauccugguggaacaugucugucauccucccacaggcgggcugaggcauggaggucuuucuagcccaggcucuauuuagcuuaggaauuuaaggccaguuaggguugcagaauaagacccuggguuguuugguuauuuagguuuuuguuguuguuguuguuguuguuguuguuguuguuguuuuuuaaaagauaaaagaucugaaggcaggccaugguggcagaggcaggcagaucucucugaguuugagcccagccuggucuauagagaccagagaaacccuaucuagaaaaaccacaccaagccaaaccaaaagauaaagaucuggaaucuugcuguguugucugggcugggcugaaacucacuugcucuagcccuuccucugccucagccuccugaggugcugggaccaccauuaacuagcuaaccagcuuaucuuaaacagacugccuccaccuccccacccuaccccucuggcuuccagacccccagucucuauucccaucuuggaagcagucacucacucagauuuaugauuuauagcuugccggccuuggggaauuuucuuuaaucucuaacaaaacuguccucuuugaauuuaaacaauaacaacaaaaaauaacaaagugaucccggaguggugacacaugucuaugaucccagacuuuggaaccugaggcaggaggauaacuauaaguggaagcuggucugggcuacauagagaguuccagggcucuugaggaaagcauuuauuuaauccccaagugagaacuuguuuuuaguuacgcucgccaauaaaacacuccacagugaacaaugcccugcuucuauuuuuuuauugcaauaaacuauauauaauguguaauuaauugauugucacucuugggagggggcugggugcuaggaauggaauggggcgucagcaggcugggcacgugauccacucugagacucaccugagccccacuguagacacucugccuucagggcucaguaggggugacagugccccccaccccaggagccagcucugggcuuucugucugaugccccgaccauaccugcacauggccauaucguacaccuugaugcaauguacaagucuuucccuuccccacauggggaugggacccagggugcgugcucgccucagauucugcuacuuagaugcacuucuacacugggcuacccauuuuaaagauguacagacucccaauguugaaucucugguucucuagagagcauacucuuugacaucagugacagcuuugggguacuaggaggaaguggcagcccugcucuagggacaccucugccuuuggggccucagagaaagaaauuaaaauaucacaccuagaccuguccuuacccaucccuucucauugggagaagacuagaaaaucccagaaaaacgaaaccaaaaacccaucaacacugggaaauuaaaaccaaacucuacccucuagugaccccuaauccggucuuaccacauauggccguugucaaaaugggcaugaagucaugcauugcagccuucugggagggucaggaaagaaaaaccaaaaguuuuugguauagugacaggcauauaguuugcucaauaaacaguagcugucauugcuacaccuuccugcuccugguaugauugggcucuacuguuucagguaagccaggacacacagccagagcucuagauuucacaaugcuuucugcauuuggcacucccauagucaucuaagauagcucuuacugccccaugccacuggugggaaaacugaggccccagaaggcagugacgaucucuggcucuuguuuucuaugcugggacauggcaugggcuuccucacaaaugccagggcugacuggcaggucaucuauccuggccauauuugugaccagaaagcuugggccucuaugacggugccccagguaaagcuucuuaguccuggugcuugauuucagcagggcucaaacaggaauucugucaaggacaaggucucuucaggaacaaacaaucucuuggagaucagagaugcucuccacucuugaaagaagucuguggaugguauuucuacuuguucaccuauuuauuaucagccuggucugcagagggagcuggcuucagacaccccugcaggagauccucuauggugucuuuaucaggccuuaggcagcugcucuaccucucugggcuucuuuuccccaugaaaacagaggaggugggucacauguuuccagauaggcuuuuggggucacaaugaccagacaaaagccgcaccuuuacuuaggggcuucaugcacugguacaaggcuccuccccucuuugugcuaagugcuccggucuguaaaccacguguccugugacaucuguggaacacaaggaaacacugauccugcccaggucccagucccugcucaaccccagcuuggcuuugugggacacgucugugugucacagcucccaaucccacucuuguuuuggcuggcauuccucuguccauuguuucccaggcuaaaucuuuaccuccaggguuaucccucaacucucaaccaucccugcacccuugcccuucaucccucuucuuguucuugcuguuuucuaacaccaguuuuuaucuggggcccuuaaucauuccucuuacagagcuuucucuugucuugugggaagaaugccacaaucgauuaguaaugucugucaggggagcaggcuagcagaagguggaaugcauaucauuuguguaauagauaccugaagagggaaaucccagaggacuucaaaaggucuccauagccagcaggaaagaggcuucaugggggugggaagaagagaaggggggaccuggggaaggaggguggguggacaccuugauuuucacaccaggcagccugaguauucaaacucucacauuauacuaugcuuuguguuuugugcuggggugugaaugacacagggauccuuugggacacuggauaggcuugccagguaaaauacagggcacugacuccgugagaauucacauguaucacucuguaagccacuccgugaguccuuugcaagaacggcaagugguuuuaauucagccccugaguuugguaguuuuuuguuguuguuguuugguuuuucaagacaggguuucucuguauagcccuggcuguccuggaacucacucuguagaccaggcuggccucaaacucagaaauccaccugccucugauucuuaagugcugggauuaaaggcgugcaccaucacugcccagcugaguuagguaacuuuaaaagcaagugccucuuauuaaugcaucugucaaaucauggucacaggacauagcuggggguagcggggagguugccacauguaauaaaccagacauuuagggacaugucauccuaaaagagacagaaccagaguggccuucuuucuuggcuuuugaaauagggucccacuguguagcuuugguugacuugggaacuuacagugauccuccugccucaucuuccugacugcugguauuauaguuaugagccaccacacgcaacucuuagagaguggccuuuuccaggcugacugaugccuggguccuauggacaaggagaaaugucaccucagcuucugaccugaucugcuuggggcaggaucuugaccuucccuuagccuuuguccuucccagucuuugagaaaguuuacccuuuuauguuuccagcuuugccauccccgggaaagaccagggcuggcaagagugcuugguggcaggggaaguuugggggaaacucucugaagcauaugaaaagugagaaucgaaagucuggucaucagccaucaaaagcuguggacuuuugcugcugugggcguguuuguuugcucucccagcuccugggagguggugcagagcucacagcuacccucagcuucacagugaaauggaggccagccucagcuacacgagacugucucaagaaacaaauguagucaccuucucaguguuucagucccuccugugucccagggauucagaggugagugacagacaaccccccccccccccagccuggagauucccagggccaugggagucugaagcuaucuuguuacgugugccugugcacaugcgcuaggaauggaaaccagggcuugcccacagccaggcaaacacuccagcacugagacucaucccuguagggaugcucuggacacucacaccauuucuggaggucuuaagcaacaggugggcagaagcccggaagagcauuacccagagaggaagcagugugucuaaacgcuugacguggccgagagugaaagugaugagcgacuuucaggaagccaagucuuagccuggccuuucuucucagcaggggcggggaaggggaguggagaagagacugucaccuggugaccucagagccacuugucauguccgggcgggcguugaucuugauccacuuaggggaaccagaccccuggggaucaguggccauauucuguagcuccaaguaggggcuauaagguuugggcgaugggcaucugugagggaaagggcacagcuggucucucaccccagcacaguggcuggagguucugggagaaaugcuaagucucaccuagucagacauuccacagggcuuggggguuggccauagcgaaccaauuugccagagcuccuguuuuacacgugauggagaaccagaagaucugguguuguccccgagggacacaccaccagcucuggcuuuguuucuuccuuugguggaguugagaggggccuggucaggguuaguguuuguuugaaaagcucaugaaauaaaagcugguuggucuugggggggcggggacgggggcggggggggggcagaggguguguuacgucuccuggagcaaaucugauccugugcugcagcccuuccuccagccuuaccuuguguaauuugagaugguccauuuaguagauggugcuacugaggcccucugggagaagccaagguccugaggucagcagugacccauuaaaauuccaaucaaaaucuaggugaagcagcagaggaggccaguagauuuagggaccagauucucagaaggaggugucuuccgcuauggacuucagagaauaaggcugcagaagccaggggagggacccuccuuuccagucaccagucacgugacaccaguauuaauguagaacucggccacgggguggggguggggggaggucagaaggaacuccuugaccaaauaaauagacgagucaauuaaaaaggauggaguuaggggcuauuuauagcgguggccugaaucacagguauccuugccccacggagaaaaaggagaccuuuuuuuggguggcccaggcuguauacaugauaacuaagcugauuaagcuuuggguuucagagggugggacucuggagucugucugagugaugagcccuugagaaugacagcucaggaaaggugaggggcgggagcgcugcuggggcaggcaggggguggggaggagccaucagcuuguagaaauggcuugcacugggauagacccuggaguuggcugucuccaccaaugauagucacuggagaguaucuguucccuggacuuuggccuccugguugaacuuaaugggugaaaaaaaagagcccuuucucuuagcuggagggguuggcauuuagcaauuacagcuggucucccugacgcucaccugaaaaacacuuagcaaggcccguguggcaugucuguugcugcugucacugccaucugccacauagcugccccgccacgcggcugcauccggccugugaaggcaauuaugguuuggguuagaucugaagaugagggcucuuaauuugguggaggaggguuuauuuugcacaguguucccucuaccuuuugccacugucaguaccuucccaugccaaguugaagggguuaggacuuugugguauuaaaggcgauaaccuggaaacaguccugagcucagcaguuagggauccaagacuccagaguguguuucuuccugcuugcguaaaccuuggucaagcggcuuaaccucuugagccuugguugggcaucuacaaaguggggcaauggcucucaucucgcuggcuggugaggguuggguaccgagagccagcugggcauccuggcauguauuggcugagcaggugggugucucuuggugugcauaugacauuuccagagugcuuuuguuccugcaggcuaagaugcucugacgucucauuaccuuuggacuaauuaggagauaagugagcggcggcaaucacuggagaaggauuuaagggaagaagggaaauauuuagccugauuaaaaacaacugcuauuagguggaauuauauaaagcacccagagcuguguggccacaugucagcugcaguuauuauuucaaccauaggaaaacaguuggaauuagaggaacaaaggguugcuaugacuacggcaaacccaggucuuucucagugcaccuggggcagacccagcccccgccugguacagaaagcaaucugaggcuacccaagaagguucaggauuacagcuggggaaccagagccucaucgcugggagauggguguaggcuggguagggagggcuucccugaggagguagcauugaagauggaggagggccagaaauauaucaggugccugggaguauaucccucugugaauugucagggcugccauggugauuagagguuggaggaggucucccuuucuggcuuuagcuccacuaagagacaucauauuucucuugugcgcgcacucucucucuucccccuuucucccucuuaccccucucucccccucuacucccucucuuugucucucccuuucccucgccucucuuuccaucucuccuucgcucacucucugucucccugucugucucugucucucucaguguugugcugaggacagauggaaccagaggcuaugcacauacugcuacuggcuaagccccugauggggauuauuuuuuacgguuuauugaaugugugcacacacacacacauauguauauauauguguguguguguauauauauauauauauauauauacacacacacacacacauacacacauauauguauauaguaugugcaccacauggaugcagugcccauagaggccagaagagggcacugguuccccuggaccuggaguuccagaugguugggagccaccacacucuaauccucugcaagaacagaaagugcucuaaacuaucagacuauaaacucuauaagcucuaaacuaucaggcucuaaacucuucagcccauggagauuuuuuuuuuuuuuuuuuuuuuuuuuugguuuuucgagacaggguuucucuuuauagcccugacuguccuggaacucacuuuguagaccaggcuggccucaaacucagaaauccgccugccucugccuccugagugcugggauuaaaggcgugcgccaccacgcccggcuauuuuuuuuuuuuuuuuaaauagcaaaguuauuuuucaccaugauguaaaaaaaggaaacauuuuaauagcaaaacauuacgaaugggcuggggugcaucucaguggccaaguaccuagcauuugaagcccugggcuaccauccccagcacagcaggggggaaaaaagaaaggacugugaugcuagaaggcaggggauucugcccccccaaauaguaccagcuggugaaggcuuuguccccgauggacacuggccaucagccuacacagccauggggcaaaaauccuccggaagacaagagucagaagcagugaucacuacuguccucagccccccccccccccccacaaagggcagccccuugaaaaugacugauguaggagaggagggaggggccaaggaggggcaggggaggaggugggauaacauuccauguuugagucccagugguucuuggcaucuaaauggacacucagcaggacugugcccaaguccugacugccagagguuuagggagaaugucagucacuuuugucauugucuugucagcuggggcucugaagacccugcagugccagggcucaccuaaucccaacagugcuacuaaacagggcuguucucuagagacugcauugugagcucucucucucucuuucucucucucucucccucucucucucucucucuccauguguugugccugugugugugaggaacagcgaggcauuauagcuccagguugugggguuccccagccagcugauucaaaccucgcuccagugacagacagucuggccucagcaguggagacugaggccuucaaggucuccuuacuguuagcuuccauggcagguauuucucugguugggaauauucuguuuucaccccuuucuuacaaaucccagacugccccuguggcauggugcuguaagaggcuagccugcaaagugaguuccaggacagccagggcuacccagagaaacccugucucucugaaaaagucaaaagccaaaaaaaacaaaaaggggcuaagcuggcuaauuugugccccucccaggauaccagcccaggcggaccuucugaauccaaggcugcccacugcacuuggguguggcagggacacuuuguguuugguucagacaggcagaccuccaaagucacaccaccagcccucgccuuugucucuuaaacuccucccaguuaaguguuuuggccuugucuagaauuggaagcuuaccugguuaccugggaccagggcccgagucuucccuaagccugauugucucucuuuguaaaauaaaaggaguggguguggcgaggagcagccuuugaaggccucugaaaggccucugccuuugcuaggcccccaguguaugcaggcuggcacaaaugcacugcaucagccaaccaacggcucuuccacuggucaguuuuguuugacauuuuauccagugccucccaggucccagcccugcccuucccugcguuucuugauuuuaagacuccugggaagcggauguaacgggugagauuuccgggcuccaccuuaaagauuugagucaauagguccagaugggucuagguacuuacacucuagauuugucucuggguucuacagacuaucaggccaagagcuggcuggcuggaagugauagaagcagauggagcucucugaguucaaggccagccugguuuauaugaugaguucugggccugcuaggacuacacaaugagaccaugugucaaaacaaaacaaaacaaaacaccaccaccaccgccaccaacaacaaaacaaaaacaaaaagaaagaaaaagaaacugagguuucucaaacugaucuugaaacuuugcccaaacuuucccaguucugaaccagagugcagccccuagcaaauagaagguuugaugaggcagggugugugcugggccucguugggcaucccaagagcuuaccugggcuuacgguggagagacagauguggggguugcucugggagaugcccugugcauggggaagacacagcugacugugucaaccuccugauacuccccguguggauuuuaacgcugaguuuuucuucuagccaagcaguagcugguguuaggcaccaucuuguagcccuggaagccgcuaccaccgccacccgcugcaccaacguccgucagccugacagaguuagauaugacucccgugcacccagguuugccauaggaguuuacucucugccucuggugccuacuguauccacagggugggaguguuaggaguguccccacuccccuaccucccucaggcucccucucuggagcacgucuccuguggccauccauguccgugauagagugugguagggccuuggucuugguuuccucccccacagagugggauugcaucugaaugcacuucuguggcccuaccaugcagcuuccaagggaagucccugguccuugagaaaccuuuggggaaagaccacagcacguucaccacagaaucauccagagagcgcaccgcucaggggaugcauugugugauagaaauggaagcgaagauuuggggcucuccaaaacaacaaaaaagacuguucaucuucuuggggaaguugugcucuguggccgggaacagguucaggucaucccuccucucuuucaagcauauucuaggugucugucugucugucugucugugcuuugcccuguggcucugcagcgcaugccugcccugaacaucugcaggccccucaacacucuuugauguguuuacugugauugaugucuggaagcagcuaggacucucaguggaaggggccagugauagacugcugagcucaggcuggugguguggugagagaggccaugaggccaucaccccagaggcugccugucacagccuggugaggguucuguucauuacucuuggauggacuaguguuccccaucaagggcacucuggagccaagguguggggugugagacagcagccuuuggaggucuucuagggggaagggugaggaagcaggcacagugucuccuuuguucagaacagaggauggaucuggguagaggaugccaugcuuuuagguccacagucugauugauugauugauugauugggccuuggugugagggaggaaggacguccuuccugugggggaaaaagaagcauuaaaagaggaacacugcagggaaggguacauuuaaaauaucacccagacauuguacucacugcauagaggguaaggcugaggcccaggggcagugacucgccugaggucacagagcagagugcacugccugcucuccaugaagccagggcuucagacagcaccaaugauaacauuaggggcccggcaguguggaggggucacaagguggcuuggcuaacucuugggacuucucuugcauuucugcagagagaggaagacaaaagggcucugcuucccuuucauacacaggugcagugcagccuuggguuucuguagcuugcaaagggggaaguuuguggacgugguagccgccuccaggaguagucccggccuccacagcgccugcccaggacccuguagcccuggugcuggggaagugacacugcuggaagugaaugacagcccuguggccgggugagucagugccaggagccggggcccugcugacucacccuccccuggcuccucagcugagggggaggggagaggaggaggggaaaagggggagggacugaguugccccuuuggagccuagagcuuguccaccuaggcauuaaaggcgacagguggcuggccaggucaggagcugggcgaggcgucucugaagcuuuguguacacaaucuccaguugcacacaccccggcccugcuucuaagacaggcccugagcacccuggagacaccagggugcagucaugucuccuuucuuccuucuucucccuccccgaucaguuccccccucuuuucuucccuccuuccuccacucuccuccuccucugccucuccccuccuucuugcccuccuuuccuucuucucuccccucccccucucccuccugccuagcuuuguuacuacaagccggaggucugcccgaauaacauuugguggccaggccuuacucccccagcccccagccucggcucugggcguccagcucagaggggagggaucuuuuauguaccuccccuuugcagccucuucuuacuuuggaagccccuccugucuuuccuaugaacuucccacaauuuuugcuuucccacugucucugauccuaggaaacaauaggaugaccccauaaccagaccaaacaaguagaugacaggcaagugacagauggggcuuuguuucacacagccaucuccugccacccgggagaacugcuccucugagccaggccuggagucauguuuuguagaaggguggcccuguguuuuggcuucaccucuggagucuggugcuagcccugugcugacagacacugucuucccuauaucaccaguggugggccuuaggaaggucagcuacccauugguccuuugcacacaaagcagcugccagacacccauccccagaguagcucugcucagggggccagaguguagccccaggguguuggggucaaaugaccagaaggucacauaacaccccaaguaggcccuucagacucacuuucugagcuggaaggagggcuagccagggacuuguagaugaaaggguuuucaccccuuaguggaaugguggggcacucaggauaaaccuaaguuuaaaccuagccuacuggaauccucgggcuaccuguuuaguugccaggucuaguuuaacugucuuuuaaguccuauuuguuuguuuguuuguuuguuuguuuggcuuuucgagacaggguuucucuguguagcccuggcuguccuggaacucacucuguagaccaggcuggccucgaacucagaaauccgccugccuaugccucccaaguucugggauuaaaggcgugcaccacaacugccuggcccuuguuuguauuuuugagacaggguuucacuauguagcucugucuggacuggaacuugauauguagaacagccuugccucaaacucauagagauccaccugccucugccucccgagugcugaaauuaaaagggcauacuacuaugccuggagauaucuaucuguauuuaucugucuaucuaucuaucuaucuacuuaucugucuaucuaucuaucuaucuaucuaucuaucuaucuaucuaucuaucuaccucugguauucuucacugccgaaccaccccuucagauccuaguaugacugucuuuguguauucuuuccccuccccucagaacucuauucccccaagaucuuuuagauaggucucagcuugauggcagugugguggaaagcauguaccaucuggauauagauuccagcugugugcgucgcuguaaacagaauucauaucgcugaucuucucggccccauaagcugguaaaagauauuauucaauuuuucagguuccaucuggagguucucugguguccugggggaccccaguguccuggauucuggguauaaauccugagaauuuggggcaagagugucccugcucugagccucaggcuucagaggguggggcugcagccggcucaggagugggaugcggagucccagguagacaggcaccccguccggagauggaaagcugagauaaugcaaguucacuuucacucagaugagagcaaggcugcucauuguuuugugcucugcuucuggcuagugaaaucgccagcuuccugguugaccucauggggacaagcccuuguggcucaagccaaagagccaaguauauauauccugacaagccucgcccugccuucacugggguuaugaugacugcgcugggcuguggccugauugaaguggaccucgagggacccagacugggucacacacacacacacacacacacacacacacacacccuuuuucuuuguguuuagaagacaaugugcuagagaaauugagaaauaaaucuguguaguccagaucucgaucucucucucucucucucucucucucucucucucucucucucucucucucuuuauuuuuugguuuuucgagacagggcuucucuguauagcccuggcuguccuggaacucacucuguagaccaggcuggccucgaacucagaaucggccugccucugccucccgagugcugggacuaaagacgugcgccaccaccaccuggcaguccagaucucuuaagacaccucagaggauauggucucgggggaucccagucccagaggcgccuuugguguugggaaccuagagguguccauuuucccugcuccucuuuucugccuuugccugccagaccccuggagaugguucaguugucacacuugacuuagccucguugcacaaauagauaaccaaaagaugaaggccauuuuaugauucaauuaaaugauuaaaucuguuaaagguguguguacuuaaacagaaaaacaaaggcuuuaaaaauuaauuucuccuccuuuuuagccagucucauguagcccaggcuaaccugaauuuuacuauguagcugaggcugaccuugaacuccugauccugaaguuuccuccuaaaagcugagauuaccuggcucuuaaguucccuuuacagaagcauuuacacugcuuaaagggcagagcugcauuguuaacucggcucacuggauucagugagcuugcaaaacacuucuaagggccaagaauggaacaugagcagaacagcauacccuugacagaccauucuaguagaucacagcccuccuacucagacauuacuaauggaucccagcccuccugcucuuugcaccuggauguauuuauuagucuguagagacuguaacaacgaacccuuucugaucugugagauguucuugcugacagaagcaggccccugugcacacugguguuuuaucugugcccacaacacagucccaugaccccugguccagccugucaugucauguggcccuucacuucccuguuuguccuugaguuugguuccccaaucugucagcuggucccguggcuugucuuuauuuuuuauuuuuuuucuaaaaauuauauuuauugaguguguauggguuugugugugcacgaaucacacuggcugugugaagguuagaggacaaccuuuuggagucaggucaaucccaucguguggguucuaggaauuguugugaaacacguuugcccauugagccaucucaucagccuguagcugaccuccuccuucuccuucucuuccucuucuuccucuuccuccucuccuucuucuuuauucaaagaguuuauuuaauuuuauuuuauggguauggguauuuugucugcaugcaugucuguaccacaugcuggccagagugggugucggaucgccuggggacuggaguuacagguagugagcuaucacguaggugcugagacugaacuagcauccucuggaagagcaguaaauguucuuaaccacugagccgucccuccagcccuguagcuggcuucuuaaaggcaccaggcucuauuuuacuugugaaguuguagagaugacauccauaacugucacaagugguugaggacauggcuuuggagguuuggauggaccuaggagcuauucacagcucggguaggcaucguguggccaugaccaagugacuucaccucucuggguggugucaucaguaaggugaugaggcagguuuggagggaguuaaaagauugccugagggaccuuugcguagugccgagggaacaugugggcaccauuaugugcaggucuuucugucccuuuauaauaauauuuuuuuuuuuuuuuuuacauggaugaguguuuugccugcaugucuggugugccucaugcccacugaggcgagaggagagcauuagauuccuuggaacugaaguuacagauaguugugagcuaccauguggaugcugggaaucaagcccugaugcucuuagccauugagccaucucuccacucucuguauuuguuuaguuauuuuuguuuucagacagggucaugcuuuguaguauaagcugcucaccauguagcucacguugcuggcaauccuacugcuucagccucccgggugcugggguugcaagugugugccaccacgccuggcuuaugauuuauuaaaauuggggcaacaauuguauguauuuauguacaauguaugugcaacauguaauuuuaauguuuuauuuuauauauacaaauauuuagacugaauauacgacuguguaccacaugugugcagugccaggaaaucuagagaggauaucagacccccccagaacuagaguuuuauggauggcucugagcuaccuuguagguccugggaacugaaccugggucuucuggaagagcagcaagugcuuuaacuucugagccaucucuccaacugaacaugagguuuuaagaugcauaucuguaaugaaguggcuuaaaccaacugucuuaacuacuuacagucuggagagaacacuaaaucuauaacucucuugacaguuuucaaauauauuuauuauuauuauuauuauuauuauuauuauuauuauucaaguauauuccagugagggaaguggagcacagagaggcugcuccuugcccugggucacucaucuuuauggcucuucucuggagcagacacuacaaagggaucuagccacaggcuccccucugcaggagaccuccaggcuaaggugucucugugugugcaaugguugagggacccaucuccugucccaguuuugagagaugcucacacgcucacacuguacacagaacaucuuguuccuccugcagaggcucucucccugagcgccagcccugucucucacuaagcucuuuguggggacaugcugugugcuaggcacuggggugggcugggaauaagcacaagaggaagcagacccaugccugacuccuugauaagagauaccauugauaagauguuaaucauuucuauugggggucuuuucuuugaggugaucaagguucugcaggggugugcuaacucugggagcugggacuuggugccucuuugucuuagaguauagaggcaaauacuggggagggaggggcaguuuuaaucaacuucaagaccugccuggcugguacauggaugucugagggccacagggacuagacaggcucugggagggaagugggcagcagcugucucugagucccgagucugugagcucugcaucugacagggccacuucucugacccagcagcccuauguauguucaauagacucuucugaucuguacucugcuguaggcaugaagcaagauggggauucuggcuccaucugcccuggccccuguguguagccuggggcaggcuaccauuuuccuauccacccaucugcuucuguugugugggaacacuuuagaagucucugugcgcuguggagcagcucagugguagagcguuugccuggcaugugccaggccuuugguucaaaccucagaacugcauaagcccaggggugauggugcuggccuguaauuccagcacugcaaagggaaagguggaggcaggaagggggaucagauguucaaggucaucuuugcuaugagugaauucaaggccaaccugggacacaugagacccugucuucccccucagcacaccucccuuccuguccuccaaagaaugacagaaugggaaacaguucugaaauagguuagccugcgugcuaaaaacaucugauguuuuuaaccuggccagaggguacaaaaguacaucuggcugaugucacuggccccggggucaaccugacuguguauguggcaaaacuugucagugaucuucacgcaagccagcauucaggcacagcuacaucuggcuugccaccccuggaaaagggacaguguuuucaguauggggagggacacuuagcccuggagcuuauaacuccaugcauucuaaucaccuguagcugugguaaccacgaggacgcucccagaaugagaauuagggaucuacaccacugcagaacaaccccaggcaggcccugagccaagagaaaacagcuccuggcuuggagaagcaggcugcaagcagauggugugaaagggccucacugcacugugcuguggccacuugaucacuauggggguggacuggucuaagugugagucuguaaaggguggacccuagggaggaugucucaagaauucagucugagccagcagagggcuggcagaggcagacucagggucugugugauaccagcucauuccagugaccuggauucagaguuagcggagccuuucucauuucucccugaguggauagagaaggccuuauccacagugacacuagcuauuauuuuagggugugcuugcuacaugccauuugcuguucugagcuauucucugcacccccucauuucuuccucuguaccccaugacaggcacuacugcuccacagaugagaacauugaagaccagagaggcugagaaguugccuaaggucguucagcccuucuaaguggcucucagcuccuuugucaagucucauguucccuucagggggcauagggugugagaggagcuacagcacuccuguggggccagugauccacaaggggggaugggggucuaaggguuugcuugagaccucgaaggaccaggggguggggagaggccuuggguuucccucuagcaaugaaccgagagagcuggggguccauucugaaugugauuucuaagcugccuucagcuguugcacgagaauagacugggggcagcagagcagcaaggagaccuaugaggaggcugcuguagaugccugcgcuaggggcugcuggcugagagagagagagagagagagagagagagagagagagagagagagagagagagguugccauggugacagggaaguggggguggaugccaagaaugugcagaguggaucugcaggucuugcugcuggaaugguauaucgcagggccgcuggucaggcacacgcgacaaucuuggaauaagaauguaagaggaaaaagggcagggugccugugucucugcaggaccuucucuggauccaggaaaguccagagccuggguggugcccugccccccacgacaguagcccugugauuucuagccagccugagggugggaggugaugcugaggcaggaccacugagcccugaguucuccaaaggcaaauggguuugaaccacacucucacagguaggauggugaagaaggaucagacuucuggaugcacccgagugacuaagguguccccaugaagaccucccagugccagccacaggacagacacugcgcugucucacucaggccccagccaccaugguucagucucgggugacaugaugauagauggaggcccgagaguauccagggauagauuucuuauguagcaaaucagucuagacacaggggucuuugggaauccucuauucucuggguucucugagaucagacuuguuugugggucuaaaggccaggaccugggcugucagggcagcaggccauagggcaucagaauauggcuucuuauaggaccagccuuggccaauagcugacagugaggugaggagacuugucccacucccauccaucucucccuagugcuggaggcugcccuccuccuccuccuccuccuccccccuccuccuucuccuccuccuccucccccccuccuccuucuccuccucccccucccuuuccucucccccuccccucccccuccucuuaaguuuaaaggcuaggcugaccuuguaaagucucaaggacugagacguguccaaaggguggaucagcccuucucuguuggaggcuccaggucauucuugagcggacccuucccugggagggagcggagucccacauccuccaauuaugcgcccaccacaggccacaaugagcuguugagauaaccaucggggucugcugaccugcugcaggaacaaugcuggcugcccgagcuguuuucacaguggccacagaccugcagagccaugaggcccccggggagccgcagagaaaggccaugcggaugcucccccagacagaggaaggacuccggggucugcccaguggcuccaggaagccuuucuuggucugcuuacuaccagauagugaaacaauuggggucccccaccccaagccagccagugagaggaaggaggcgugggggaagcaaaguuauugcgcacccccacuccccagggaccugguaugucauuccuguguacuuuaaugucuccgucagacacacugagacuuagcgcaaggccucaccauaucccccuuggagcugagguucuguuguccuacugugugccgggcuuccuucucuccacaagccuacgggcuggcuguggggaagacagcagcugaguuccuguucagguaggguuggcuguggcaagacaaaugcagccaagcaggugaagguacucucccagagggcaugcucugggaacagcgugcccugcaugcacgccagucgcugcucagaugaagaacacagauccugugugcucugaccuuccaguuuuguaagagaacuucagauuuuccauuuuuuucuccaaaaucugauacuucaguguugccucccugcucagaugauaaagacaaaugaaagauguccuaggcuauguggcuaccuucacugucgcucuuuuuuauuuugcagauagggaaaccgagguucagaauagagcaggaagggccacuagcucugggugccccugggccagccuuauccugcggcccugugccaugcuguguguaugucugugcacacagggcccugacuuggcacagggcucuaaugugugugguuaucuuuauguguucuuugauggcauggauggauggugaccaccacugggugggaggauacugccucucagcuaagcuucagagacacaaggagaugcuaggagaagauggugaguaucagcuagugcaacccuccauccagagugggguccaagcaggaggugcaugaggggacccuaaacugugugccaggggcuccuuaugucugagacuagcuggugccagagagcaagaccccuacuugcuaggauccauguguuuagccuggaaucagcgggacugaagaauggauacuaaauaucaagcccugguucacagucugggcaugggacccaggcuuuccuuacccauuccacacuugaguggccccugcguuguauccucggcugccacaaacauccuuguaugauucuguauaagaaagacuuuuuuuuuuccugcuacaaaaccauucuguaacuguccauuuucuauacucuaauggugaagccuguuuucccaguacuguguccuguggaauccuaacuucuuugcuucacuucuucagccgggagcaggugccuccuguaggccgggcuccauacuagguucugcacugaggugucacuaagacgugaguugcugguuuuuuugugcagacuucaaaucagaaaaaugucugucaguguggagagcugcagacaggcucucucucgccuuuggaagaggaggaacuguccaggguacacaggcugguguuugaggaugacaauccugggacaccagggcuuccgguuuagcuggugccugagaaacgaagccgguugccucuauagguugcagguguuucagagcugaauauugaaauccuugggaucuagcuggcuucuuugauggagacugauggagugacaggcucccacugaagccuggggagguuggaacuggucuuaagucacuggggaaggccuucucauucauguuguucuuccuccaacagaaaacgaagagauggccacgaaggagaagcugcaaugucugaaagacuuccacaaagacauccugaagccuucuccagggaagagcccaggcacacggccugaagaugaggcggacgggaagcccccucagagggagaagugguccagcaagaucgacuuugugcugucuguggccggaggcuucguggguuugggcaacgucuggcguuucccguaccucugcuacaaaaaugguggaggugaggcugggucauauugaagccuggggucagagggugagagaucuuuuacuagucuguguccuuucccaguccagguauacccugcccagauguaccucagacacagggucagcaugccugagagcauggcguugugccagccuccagcuguguuaccuuuuggaggacccucccucacccucucugauccucugguuugcccugucugacccauggccccucagccucagauguucagauguucaugaucuccauuccuguauuucgucaucucugagagccuccaagccuucccuuuugccaucuuugauaccgauuuuugcuuuuugaccucacccuauguauuccccaaagcuaguuaugucucuuucuguaaguggcacaccauuaucauuugccauuaaugcaaaggggaagggggacaaaggacauccauguucuagcugugguggguugguuuguuggguuuggguuuggauuuguguguguguuguaucuccuccugcuagggucucugagagagcccucugggguguccaggugaggaaguagcagcuuagagacugguacuuagaggcuggugcagagugggaccagagaggaagaauguagguggcacccaccugccacaugaguguaaaggcaggcauacucccugcugcccuagaaagagaggcauuuuuugaagaacccucucuuagugcuugguuucuugaccucuuguagguaucagacccccugggaacucugaugagugucuuagaugcuucccagaacaaggcagauagccuagacccaaggugcccacaauuucacaugguuuguucucccgcugaagccauuaguguacaacagguaggaccacccucuccagauacuuugcucacuuccucccccuggcacccaccaccaguuggagauagccaccuccugccuuccacccaaccugcuucuggacuuuccuggcugccaacccaggcuagccuguggcagaugggugaagcuccaaccaggagguagugcugaaucugggucuagcagaccaagcaaccucuguugggaaggauacuggggagaaggcagacagguggcaggcauaggcaucagccugauggcuugaagaaacugguagauuuacagauuagugggugggauggguaggcaggccuggaggaucuucagcagaguccgaguuuggccucugugcuugcaucccuaacuccugauaccuuugcuugggagggcuugggagugagcaccucaccagccaugccgugacagacacagccucacccucucuccuuugcucauuggcaggugcguuccucauaccguauuuuauuuuccuguuugggagcggccugccuguguuuuucuuggaggucaucauaggccaguacacaucagaagggggcaucaccugcugggagaagaucuguccuuuguucucuggugaguauguggcuggagucaccagggucuguaugcauugggacugccagauuuuuuuaaguggguuuuuuaucuuuuggguuuaucagaccuugccuauaucagugccagauccagggcagcucauguugucugucaccgacacuggggagcauggggaaggaagggagauacagcagguuccugacuauuuagaaaguccccuuggggucuuuguggguguuuggaugagugagcuggcugcugucuuaggaugcaggagccuggagaucugggguucaggccuugcuuccuucuccuuggggugguuuuagggaaguuauugagccucaauuucuucaucuagaaagcaauauucucacucuauggaguuacugugaagacagaaugauagcaaaucuauccauucauguguccauccauucauucuucuauauuucuauccaccuaccauucauccauccacccauccauccauccauccaucucucuauucauccacccaucuuuccauauuucuauccauucaaguuucuauucauccauauuucuauccaucuaccauccaucuguccaucuauauuuccauccaucuuuccaucuauccauccauccaucugucuauccauccauucuuccuccaucuuucucuucaucuacccaucuuuccauauuccuauccauccaagguuucauucauucauucauucauucauucauauuucuacccaucuauuuauauauuggcccaucuauuuuuucaucuaucucuccaugcauguuuccauccaaccauccaacugcacagucaguguccugaccccacuucuuccauucauccugugacuccuccagcugccauuucucuaaccauucagccacuugucccuuuauccaguugcuccuucauccugcgacucucuccugcuuacuguugagauggccccuuugucccacagacugggcacaucagugccuccccaguugaaagugccuccuuugugacaugugucuauuugcuugucccacccacaggcauuggcuacgcauccaucgucauugugucccuccugaacguguacuacaucgucauccuggccugggccacauacuaccuauuccacucuuuccagaaggaucuucccugggcccacugcaaccauagcuggaacacaccacagugcauggaggacacccugcguaggaacgagagucacugggucucccuuagcacugccaacuucaccucacccgucaucgaguucugggaguaaggcuacaucuugggagggaggaguggugugggcaggucaagaggggacaguaucuuccucugugauuguggcauacccuguuucuggagggaaggaggacacacagcuguagaacaaacacucugugccuuugucuuguacgagcuagaguugaauccuaguuuaccgccaaacggcuauuugauuuuuguagggaagucccccuacuuuaccuuugagccucaguuucuuuaacugucagaugaggaaaauguaucauucuuccaugggauuccuguugagagauguacagguauuugaaaauuauaguuuucuuaauguauuuugggaaaaacauucuuuaucacacagagaaaaaugcauuuauguauuaugcaaaugaaaaggugaguugauagcaaaaaauauauaucaguuagcucuuaguguguaacaaucaucuccaaacauggugguuuuaaccaaguacuauuuguugagcucaugacuaguugcuggaaguuugagcugugcucaguuugguuggucugaucuugaugugucuuguggauaguucuuuuguggccucaaaagggagugaguguuaggagugaguggcuugugugaccucaucccuuagucuucccccuuuggcuuguuacaggccacucaugagcaauagaugggcaagucccagcaugcagauaaucuccuuguguuaauggcauugggguaacucaugaacuugcauuucagggcauccucacagcucauggaaguugauuagaaaccccugaguauaucacucucccuguaagcaugugcuccuaacucagggugcucagucagggguggccucucgccucugaaaugacugggaugaggccucauggauagccaggagccaggggagaggaaggucugucccaggcuaccacaagaugagaaucccucuccuuggcuucaaggaagcaaaccuagggaccaucaggagcuguguugugauuccuacagggaugagucagcuguuuucaucugcaggaggcuucguuuggguggccucugccaugccugggccuuuuguacuacauucccaggcagggcccugggcuuuggggacuuugggucuccugguguauauauuuuccacuagcaaacaaagggaguguuaaaagcaugguccccaacccuguuccccacccuucagauaguugaguuuuugaacaaaggaauguuggcauuucauucuuuucccuugaaggggcccaaggccacaagccuuggccuuucuguacuguucuuggcauggcuuggacaccggggcugccccucccaggccucuggcaccuggccagcuucugaggugucugcugaaccucauuaccuucugacuuugaacuuguguucuaucacuucugucuugggcagauguggucucuucucugggccucaguguccuuuacuugggauggucacaguauguccuagggaucauccugcagcccuacauggccacccugaaaagcugcuccuucaccucaggguauugugcaugucaugucaucauugugauuaaacauccuuucuggggcauuuagaaucuguauguaaccccucaaauccccacaggcucuggugacaagggagucacauucuuuucaccuuugccugguaccugcuauuaugacaugaaggucuuggaagacuuaagcucagcgcucugcucagacauccccagcccgaguccacucuagcaccccuguguuguagaagccccauggcuuucguuccucaucaggaaaacagagacaaaaccauuucaggaaaaccccugguucuccaggcucuugugcaggcuccucuguggugcccguggguaugcuuugcuuucaugagggcugacuucugcccacacugggccugcacaggcucuggaccugacuuugaauucuagaagaaccucuaagcauuccuuagcaugagccugggauccagcgagcagagcuacugagcaagcugaggugaagaccuggccagcuucuugcugauccugugugcagacgcggucagugggcagaagcaucagcaaaucuguggggcuuccugcucccaagaaccuacccuuguguuggguuugaaacaguggaaaagaaggcaaaagggugagagcaaugaacuauuuugaugcagaggcuccugcuuccuuuucuuuuccuucuccucuucuucauuugauuuauuuuaggagggcugggguaagcacaucaggacaugcgugccggucaaaggacaaggacuaucgacucaguucucuucucacacuuuuuacacgagucucagggacugaacucggguuguuagauuuaaaggcaagugcuuuuucccagucagcccucuagcuagcaucugagauuucuuaaguaggugaaagagcaaggcauugugggaaacucucacauuucauaugcaguucacuggcccuccaucaugcauggcaggauccagccacucucccugugcacaccgcaccccuugaugaacccuauauugcagguaaaggacacucguuggcuucuugcuugcucucugccuuguccuugaaacucucucgcaucccugcuaaagagccucaccugucuuccccacguugugaucuugcccugccagggaggaguaggugagggcagugcugcucacugagccuggcccagguuccggcagcuuucccuugugucuuuugcagaucuuaaggucuggcagccaaagagggguaacaggcuuggugggagcagagugcccccucccccaguuucuaaucacuggaugacugucagccacccugccgccccucccaucugcugguuaccaaggaggcaggaagaccucagaggggaacuccccuccccaguguggcuuaaguguggcucccacacgucccagcccucugaugucagggcaguuggaaugccaagccucagucuccuccugcucugugagccagaguuagcucagccccaacacucacaucugcucucuggcauucaggaaccuggaugaguuuugguuuuaggguucuggggagccagcauggacacagguccacucuuagugaaccuuuggucuguguuccaccccucaucccacaccgugauacagggcaggcccuggagcugaguccauggucacaggucacauggugcacugcugccuaugugcaugcacgucuguguuuccucagucucuggucaggcauggacuccuguaucaggggucuguaucauagacugacccugccauacuuaccugccuguaaagccaggaacagccucagcucagauucccacgagaagucaggaggcuccagagacugacauuuuaugcugacauuaggguacguuuaguggcuacaugguggggucacagagcuucugccccuguggccccaucccacacugguccucacccucugaggucaccucugucucuaaaacuccugcuucccucacaggccuuagaggacaggcggggccaggucuggccaaaagcccuucagcaggcuggagccaggccuuccucagaggcuccugcagagcccccugggagcccagcauggaucauuagauucuauuagaaucaaagaaaugagucauauuugcaaacaaacccugcucagccaaucuuccuccauagcugucggaaggaggagguggugcgggaagggccgugugggggccccaugcucaggcggacggacggcccuuuuauaauuguucccucugccagucuccaggggacugcugcagccaauaaacggcuggccugcugucaaaaggaaacgauuuggcccacuccgagggcgaauuuacaucuccaagugcugacuggacggcagcagggcagccggcugcaaacacauguccagcccagccacuccuuuuuaguucccguccuggcaagauguagcccuuuuuuucuuggaaaagaucugcagcuuaccucuggaagauagugaggagcccaagccugcaaguccuggcuugaggcacacuggggacaucagaaagaaaggagccagcuccaggcuugaugacugacugccuagggucaaugagaggcugagccucaguuuuccccagcuaccaaauggcucuaaugaauucccucaccuaaugucaggugagcuccuucaugugccaggugcugugguugggacagaugcagguccuguguacacagagcuagcuugguaguagacagacauguuaaccauucagaaaguacaauccuaauggaaaagcucucacugcagaacuagugcuagggaaggggacugcuggggugcucuugauggaggguguccuggggagcggugccucagugagagcccuggaaagaggcugucugugaaugguggaauugugcagcugaggaagccacuaguuccacaguucagggaccacacacaacccccugaggaagacgucagggggcagaugagggagagaggcagacagcuguacacccacguugucuggcuuccuguguuugcuguccgagucuucuuguuaaguacuuuccacauucuuucaagcauauagcuuugaguggaagguaacagggacugguuaggauggaggugggaagagguggagccaaggggcaugugagcuggcacugcagauucuguggggucccucugacaagcguggaggacgauauagcagggaggcugggaaggaguuacuguaguggguuggggaugugguagggccugagcagggcauugugggagaauguaggaggcaccugagagugcccuguggcagcgaucccucaugcacagcaccacacaguuuacugagcccugugcucaaagcugcgagaaggcccaggggaauccaugagucccccuuguugggaagcaacagagagagcacuaggggagggucccugcuggcauucagguggcuggcuacucagcucagcucugccuagggcuuugccagagcccgacaggacaguuugugacccuggugugcuauguaaaaccugaggacagaccuguauuauuucaguauugcauaaauuuaggaagaggcaagaggaucaaccauuuaaggccauccugagcuacaugagacccugucucaaaacaaacaaaaaaaccaccaccaccaccaccaucaaacuguuuaaauauguuuaaauauguccguaaagcuauaucacaaauaaacagcaagagagcugccuuuauugcugagucccucucccugggugaugcuuacuugcugguauauguucaauuucuaucacaauggccauccugugcagauguacccuacucugcuggcucccucugucccccaggguguuauauugcuuuaucagcacaucaagaacuugacacuggucuguuggccauguggcauuccagugugccugccccaaagcuuucuguacccugcagaggggcacuuuggugcauacucugucuaugagcccccaugcuggaagaauaauagaagauggucuuggaaauggaguuaucgagucagggaaauguaccuucaaaugucacucgaugucaucaugggugucaucaugaguccuauagggacuguccccagcagcagaggaacagaggacuuacaugcucaucuuagcugcccagagcuagucugcaugauggugccuugcagggugagcacuguugggcagcuggcuugccuagcagggugggagaauggauagcaaggugguuguguucuggauggggcugucaggaccaggaagaucuggcuuuagaguuuugagcuucuugaaggauugccccaaagaacagagacaugguuucauggccaaacaucaacugaauaaauggcugucagcauguuguccauggaguggucggagccggugggaagagagcaggcuucagcaagucacccggagcaucaucagcaguggagggcaggccagggagagggcugugugugaggguguggaauagggcuacauuuuucuccccugauguggcccauucacagagagcacgugggcuguuucuccccgcgcuuugagcuucuguggcuggcacccaagugcugaacguuaaaugggaagggcuuuuuguucuguggugcgugcugccaggucucagcuuggcaggggcccaacuggacgugauugaccguuagccugcuuugugaagguaccccaugaugcugccccgaggcaccagaugauccuagcuuguaguggagacuggaggccccuguacuauuuaaaacuguuuuuaugucuauagauguuuugugugugugugugugugugugugugugugugugugugugugugugugugaagggggugggggagagagagacagggagagggaguguguguguguguguuaccacuuguuugccugaugucccuagaaaccagaagagggcgcuaugucucuuggaacuggaguuacacaugcuuaugaacuaccaugugggugcuaggaauaaaacccagauccucuggaagagcauacaguguucuuaaccuuugagcuagccuucuagcuccuggaggcccuuuaaaaguaggugcuauuuuuuuuuaagaucagaccauauugcaacacaguugagagagcuguggcuuuggaaucaggcaggccccuggaguuuuggugaccuugagaugugggcaaguggacccuccaagccuugguuuucccaucugugaaaugggguagugagccguaccccuuggaaugaaugagauaauggcagucaggcucugcaggcuucuguuucuugugugaggcucacacaccauucuagcuacacagugagggcacugauaucacugugaacagcaggauaaagaucaaggaaaggaagguugccucuccuuuagacuuggggcuauaucauccauccauccaguaaugugaggcuugguucuucuggggguggggugggguggucauucacucaguggguguuuacugaauuccgcuguguuccaggugucauccuaggucccgagaacaaugaacgacuguaggucguaugugucgcuugaaggccauuugagagggacccugggauuuauuccacauuccauguggaggcugcuuugcucagagggcagccuuauggucuuuacuccugcagaggguggccugggacccagagcuggaaagaaaacagucuuugucugggacucuuggaguguggagacccuguguccuaucagcuguggguggcaugucaccuggaggccaguguccagggaagcggucucaugcucagcaggggcucugcgagacacuggauaccugguuucacagccauuuuggcuguaaguaccccauguggcuuccuauggcuccuucccuauagggagggccccagggagagagugugugugcaacagcagacuagcaaagauggccagaggucaggagagauggccagaggucagcaaagauagccagaggucagcacuuaaguccaguuucugacuccacagaccccagcucagcugugugacccugagcaggguuagaggccucuucucccggaauuguccuaaaagccauggacuugcuucuucuugagagcaggguuuugcuuaagcaucugcuguauaccagcaucuucucuguguguauacucucauccugcaguauguggucagguguaucaggggacagcaccagcagaccuugguaugguaucagacuuuuuucugugguuauuuuccucauaagcuacuccaguaagauagguacccuggguacccugugucuauacaggacccacuuugccuuucugaguguuauaccuugaggaaaauuuagauaauaugcaggguauuuguuguuguugaugacgauguuguuguuguugcugguuugguuuguucuuuugagaaaggaucugacuauguagcccuggguaaucuggaacucauaauccuccugccucagcuugagauacagguacauaccaccaccauucccagcuaacaauccgaguucuaucaaggaagcuagcacagagggugcugggaagggagucacgcccacuuuacauacuaagagaggccuggauugguuagauaacuugcccaagguuaacaguuggagagaggcugagacuugaacccaguguuugccccacagucaaaauugaagguuguagucucaagcaugggucauacaggugaucacuccucauuuacaaauguaugugugcacguguguguguguguguguguguguguguguguguguguguguguguguguguacacgugugcgugcggucagagaacaacuugaaagagccaauccuuuacuuccaccaugcaggucccaugcaugcaggccaguucagcagccuuggcagcaaguaccuuuuugcucagccaacuaaaucagucuccacuuuacagaugaggaaacagaggcucggggacuugacuugcucauggccaggcuggagugagccugagaucaccuauuaagaauccugacuuugguuuuuuuguuuguuuguuuguuugguugguugguugguugguuguuuuuuugguuuuuuuuggguuuuuuuuuuuuggagacaaagucacacucugucgucuaggcuggccuggaauucaugauguagcccaggcuugccucaaauucaaggcaguccugucugccuuaaccuccccaguguuggaaugaaaaugagcacuuuguaguucauuuugucauggugccgguaacagaacccagggucuugcccaugcuggcuuagcugccaaguggcccccaaccccugaccucuuguucucuuucccuaaaggcgcaaugugcucagccuguccuccggaaucgacaacccaggcagucugaaaugggaccucgcgcucugccuccucuuagucuggcucgucuguuuuuucugcaucuggaaggguguucgauccacaggcaaggugaguggacuccauccccugccucagggacagccccacuguggccagcuccucuugaaggcugaaguaccuuucagugagugcuaccuagaaggagguuccauguuggacauaggagugcucugacaagacacacacacacagccccguguggcuuugucucuuacuggguaaagucccuggguguccccuacucacugaucaggagauuagugaccuugugacuggcaggcaaccaagguguccccacugagcuucugucaccagccacugaugugcacuguugguauggugagcuaagcuagcggagccaaaggccaguggcggcccuacugcuggcuuugauuauccacccacaauguggacccuaacuuugcaaagugaucuggcagcacccagaguuuaaaagagaugcugaagcaggaccacccagcugcccuguaugacuguccuuguacagggugcagagcccccugcuguacugaaccucagucugaagggaagccagccaggccuggaccacucccugcuaacauucuccguaagacaaauaggcaaugugauguugucuguucucuuagggacccugcccacugugcuuccuacugccccacaguccugggagcgugcuuguuauucuccuauaaacaccaaggaagcuaagacucauaagaggucaggcagcuugucuaagagcagccccuccccugagcugcccccuuggcuguugaacagugaacuugaggguugagaugaggcacaucaagauucaggucugcagaccaauggaccuguccuucacucuugaggaaguagcaauugccuucuucccucugccuccuuuucccauauaaagcuagucuguccaggagugucugggggaacucuggugcuaagcaugcuggagagagucaguccgguucaguugugauguccuuugagccucuuguauguggaucucguuguagaaacagagugaagguaucuacauguucaacauguguggcuacugggaagagcuagaaagaugagcagggggcacaugugccauuuauaggguggcugggcaaaagugacuguggugacugagccaacaggaguaggggauagagaguugaguaucugaagaggguugcagacagaggcaguggucaguguaaaaggcccuggagugcaucuggccaggauguagggagcuuacuucagucuuauggaguaaguugaugucuacaaggcacagucagcaauguuugagacacagcacacuuacaaaggggacagagccaaggccaaauaggggggugccaggguguagcuauggcuacugugaaaacaugacuggccagaggcaccccaaucuacccugagcuauacccugcuugugaggcacgugugguuccuagaacaauagcagcccugaugggucagagaagccaagacaaacaacucuguggacuuucuccagcucagugcugagaggccuucagaggccauccgccugcccgccuaccccauuuaggggcccacccacuggcuggcuucagcuuccagcccuggcugcacaccagauguggccaaguuuguuucuguggcuaacuuaguccaggagacgggagggugauggauggaggacccgaguucaggugcuuggcuuuucuuuccuggccuuuccaacucucugagggucugaaacaggucccaggaugaaugucaguuucacuuauucaacuaaccagguugcugaaauacucacgagucaccucuauguuggcgacagcucauuuaaucccccugaaguucucugauccuguacaauugaaacugagguucagagagcuuaacuaacguuccccaacgcuacacagcuugucggugaccagacugggauuugaacucaggcaacucccuucucccaccucuccgucucauccucgugcuggcuggcaggugcagggaggcagaagccuggcauguuccugcuugcucucacaaggagacagguuguuggugcucacccuggaaaggucuggaucuguguguggcugggucuguggucacacuccaggacagccuguuuugucagaaacaaagcagaauggggcagacagggcuaguucuggguuuggacccagcucuguccauuauaaauggaaugacuuuacaaaaccucuuaccuugcucagccucaguuuccccugguguaauguaaucgaaugagcuugcuggucaggccaucugcucccaaguaaagcuaaguagcaggagaccggaagccaggucccucuugcaaacccacuaaccuccagaggaccagggaugaggugcccccuaagccuccauuuuccacaaggccucuggcccuguucugaaggaucagcaacaggaguggaaaaauaccacgucccacagcaaggccuacugggccacagucaggggcccaagguggcgccuggcaccagccucucccuagaggaucccgagggacagucacggaaaaguugagagaaugguucucgggcucauccaaggaguagcaaaggcuacaaaacaaggguagcuuuuucuagagagacggcuggguaggugugauggggagguggcagcaacaguaacacucccaaagauaggggagccccaaaaguacuuggccuagauuagauccuaccucugaacaccuacuucuaacuggggacuccagacaggugacaugacggcugguauggccuguuugcucacaagggaagggacauguuguaauggcucauccagguaugguaaguauuaaguaaguucauagcacauaguaggcuuauugaagaggcaagccagggagcccuccccaccccagugagcccaccagugcuucuggccacaguccacugacucugaaguguuuguagcccucuggggaaccccguggcgugccuuucuauggucauuguuuaccaguuuggguguggcuuugcagggccucagagaggggaccuggccaggggugccugccugccuagccacaggaagggaggggacaggaggauuuucuuucuuuuauacuuuuaguggcuuccugauuggccuuugucccgggugucugucagaccaucacgggaaaagaagcgaggguggcuggggacacagaggcccagagaaagaaaaaaggcauccaggggagggguagcaggcaggagagggcccuccuuuaagcccugccaccaccuucugggcuguuuccaaacacucccugaagaccucgguagagggugagaucagaguucccccuggaagcggcagccacaguugccaacugggagguaggauagaugagcgguaaacuccagcugacccucugggccaguccaucuccuuaucuuagccucagagcugggaaccuaagccuaucuaguccacgucucuccccuaaaaguggggaaggguagugauaguaccagccauugugcuugaguuccucuccaaggggcuugaccuccuagaaaguauggccucccucaggccuucuacccaugguaaaggccaacuacccugcagugggguggcuaaacagcucauaggaccaggcaaagggcauuauuacccaucucuuccucaucccaacccuagccacacagcgugaccccaugggucuccuguaagcugggaaccugcugggucuuucccauucugggcaugaccuuagggaaguuccugccuaccucucaagucacugucaagcaggcuguaugucuugacagucaucggcugggcucugaccgugccgaugcucacccaucuuccccuggauaagggcugcugugacucuuguccucauuguauaugagaagaaacccagagagagugaccaacauggccugcaucucagaguuggagcugaccccuugucucacucuguauccccaggcaggccuugaacacaucugccucagccuccugggugcuaggauuacagaugugcaccuauaccugcuucugucuuuuuuuuuuuuuuuuaaauauguguagguauguugccuaaauauuaugugugccuggugucagagaugaccagagaugucagguccuuugcaacuggaauuucaacugggucuaagcugccacguggaugcugggaaucaaucuuggguccuuugcaaaagcagccaguccucucagccacgugucaucucucgagcccuuucuuuacucccaacccccccaccgaccccuguguuauacugauaguugucaugcuagccgauaugugcugagugccaugugaccacgggcugagucguugccuagggucccugauaguugacucagucuguauguuuguauuuuugcauaaucucuucaaagggugggcaugcuuucugucuugccugcuuuguuaaauucugagccugaaugggcuaugugaauuauccacaggauuuuuuuuuaaaucuauaagagagacccuuaugucauauuuaaggaaaguggcagaggcucaggggucgcacaacacacuaaagacggcacggcaagugagaccaauaugucucuaggguccuugcugcacccagggcaagcacgugccucugagagaagaggauggcccacacuucauugcagcaaggacacucacaagucuacccgaugccuucucgacaacagguugucuacuucaccgcuacuuucccguuugccaugcuucuggugcugcugguccguggacugacccugccaggugcuggugaaggcaucaaauucuaccuguacccugacaucagccgccuuggggacccacagguacagcagggugugguaccucaucccaagacccuguauaaaccgguggugcacacaggguacagauggcaguguuuucucuggcucuuugaugcccauguguagccaaccauuacugccugguacuucucuccugggccaguaguggcucacaguccuucugagcuacagagccugccucaggcaaucacuccuugcuaaggcgaggaggggccccuguuccagccacaucaggaccagagacucaauguuuaggauaccauccucagauaggaucaauggugcucugaagguuaagggggucaaauuguaagucccccugucucagcacauagcugaagaguguuagaguuggugaaaccccuggaggcuuuugugugucuuuugagaccuuugucccaggcucccaagccccugggaagcaguugaaaauuggagcagagcaggguugguggccagccugagcuguaagcugggaagguaggcuugcugccuuccagagcuauaagcuacagucccuagagaaguaaagaaugccuuguguucuaacuuaggucucagacuaagccaucacagccgucaaagcugccuuggugugcuugauguggaccguggcaacuuagcaauagacucagagaagacugcucuuuacugaguguggaaaguuguuugcaggggcaggguaggcuaggggcccauucuguagauaugaaaagcaagguuucaggagugguacuggucacuccagaguuagaggccuuaacugaugcaggaagaagagggucuuccucugggguucuagaucugcccucugggguucuagaucugcccucugggguucuagaucugccucugggguuccuugcagcucgccuguguagacauugucaugguuaaucaccccaggcaaccacccuaaugcucuuccccucuucagguguggaucgacgcuggaacucagauauucuuuuccuacgcaaucugccugggggccaugaccucacugggaagcuauaacaaguacaaguauaacucguacaggcaagugucgcgcuggcgggcccgguggacguuagaaaugaugauuaaagaaaaaaaaagagaaguagggagcguggcuuccuuguguugugauuaacuuacccccugacguguguguaacuuagggacuguaugcugcugggaugccugaacagugguaccaguuuugugucuggcuucgcaauuuuuuccauccugggcuucauggcacaagagcaagggguggacauugcugauguggcugagucagguacgguggugucgguggcagugguggugggcacugccaccuaguguguaagaugaguacugcaggcauggagccagaccccagggggauggagggagccuggcuuuuacauagacauccccucuccccccaagaugugcucccauaccugaguacaaaggcuacaguuaaagguccucagugcauucuggcccacugaaggugggaggagcaagggcgguugagaugaaacuugguggcuguuuuaguuguggucuuccagcccccaacacuuccccagcauccgcuggcuuuagccauggaaguugguuuucuaauaaggcucaggucagccacagcuagcacaccaaucaccagcgcugcugacaucucagccuugguuucugugguuugcauuuggcaccuggcgggcuccagugccaagccgauccacucuugaguccuuccugucuauguuccaaaccucaccccucccagccuccaccacagucaccaggagcgagagggcaggggagaaacaucacucagagcccacgacagagccgauuugggaguaggauaugaggacacuguugccuuuggggaguuggggcccuguuggccccauguugcuacucaagaugcuaacauucacagaauggauggucgaucuuagggucaggggcucuuccuuagcaacaugggauccagaacuccagcaaagaagguucuggaacauggucuugacuccuacuaccucaucacgguuuuuuaggggucugggcucuagucgcccuguaguggaugggguucugggguggauaucaccaggggccaccuccucaccccauucucuugcaggguggucagguguuauccaaccuaauuacucuggggcuucuagaggcugccaagagccauggguugggucuuccuucaggccacauggaugggugagauagggaagacuguccuucauuauucuagguguuuuuuuacagaccagggcagguacccuaagucccugccauucucuucccucgaucuccuuauauuugaaacuuaaggucaugucucaguucucugauccugagccuugguauuggaaggucagaggguaccuugauacuuugugucuagaucaucuagauauucaugucucagcggagaucagguugccuugguauuggaaggucagaggguaccuugauacuuugugucuagaucauuuagauauucaugucucagcugagggcaggcuaggcucauaggcaauguaucuggaugccgagucuccacccacuacacgucuggagagccauccaauguggccauuucacuggauccucugaccucagggaccucagagacuauucauccucugucagcugcugggccauaacgcagccccuccuccagugugaacagcacacugugcacacauaucuauuucacugugucccaguuggacacucagaagaacuauuuacccauucucagaagcuccaaaggcagggaagggccugagggcacaggaccucaaucacagccucuuguguuggaaguuguuuagcaaggggcccagcaccucuuccagacccucuacaaaugucgauaucccccacuuacacaugcaaagugauuccaaagccguuacgggguuccacuaaaaacacagaggaaacuuguuaugggagaaagaugggguucaccaaagagaucucugugcacaaugggcauguucacaccgugcauguagucaguccgaguggcuucuuuucuuuuauccacuucaaagaccucguccacgcuccuuccccacagugauguguaagcagccagcacagcaagagggauggugacucuaagauuuuuuuggcaagcaccauaacaaagaaaagugcauuugaacaaggguauugcacaaccaagggaagcccaggcagaacauggcgugcuucacucggggcaucccagcagucuaaguauucucggcuucuacucgcucaaguuuacugugguuguagaggagggugcuuggccccucuccugaggcugguuugagaaaaucuaaaaugaaggacagaaagaagugaauugacucuguucacagugccuggugcggaggguuggggguacaccaccuuuuacaucugucuuguaguuggcuaguccugauugcucauucuugagguggacaaggcagguccagagcuuugaacuucagggggagccgaaugcuuuugguucuaacuugagcccaaguauauguuucaugauguccccggugggaggugcauguucugagcccccugcucucaaucuugcucauccaagcagcuuucagcuugguaagcagccgcaccuguuccccucacagaaucuucuaguaucaccuucuagcaaaacucagcggcugccccaggucguuguuucaguaggguuucucauuucucaggcugagcagaccucauuguaagacuucuccucccccgccacaguugggguuguugaugcuuuacuaagugaauuuuuuuuuuucaaaauugguuuguuuuuguggauucucccccccccccccccccccgccuccuucuuaagccauucauccaguuuugaugauuguuuaauguuugcuuuaaaguguaaaacaucucccgcaguuuggcccauauuucuucuugauugguuuguuuuguuucuaguaguggauuuuacuuuaguuugucagcccucuugugggcccagucccagcuagcuaaucucucccaggagucuguuugguggugguggaggaggggggcguuguaagcaggagauguuuguguucaaaugacccugugagaggcacucagagugggcggagcucuuguccccuuugccucugagucuggccagagcccuuuucugggcagugguauccacuuccaagaaucugaacaugaggauccugggacuacgacccucagaucucaggggaaacugaugucccccaaaacauauagaggaagugguggaugaggacugagauguggcuagucuccugggccucggcaccuuccuucagugccaggccugacuguuuuuaccuugccuugugugaacuuggguccuguaggggacagaggcccccauaggcauguccuugaagagccauuuacccuguggggcaucugaaugcuuuuuuuuuucucuuuccauucaguguuuuagccauuaacucaaaaacagaaacgguucuuugcaaaagaggguuuuauggaucagauaaccacaacuuuccuuccagccaaugucaaugugccacuuugguguguaaggggaggguccuacuuuccccaaaucucuggcuaccugagccccagauucagcccccacucccugccccuaggaucccgugucuauacggguuuagauucaauugagaggaggccaugugcuggguaggagacagacgcucacauggggccccucccaagccccacuggucucuuucucuggcuccuccugcauuuugggcuuaggugaccccccucccuacucagaugugaguguucugugaggcccaggguuucgaguagcauggugcugauguguguucuccuguguccccccuccccguuucucucccucagguccuggcuuggccuucauugccuacccaaaagcuguaaccaugaugccgcugcccaccuuuuggucuauucuguuuuucauuaugcuccucuugcuuggacuggacagccagguacguauauguggggcuguggcgcucgugugggcagccucacugugagaagccauccuuauugaagcugaggcauauucagacucuucccccucaagcucccaccucacaggcuucaaccugguucccccagggcccuggguugaagaaggccucagcccagcauuggggggagauccuccacucuaacacucaaggcugcuaccucaagcaaggagaugagggugacuggggcugugguuaaggucaaacuauaaaugagaaauagaaggcugggacccagagguacaggugucagagcaugugucagccauugucugggccacuacagucuguccagaaaagaugaaccacauuugggacacugcuuuugguucaggccagcuuguccccacuccucugauugcuauaccaucugccccgucuggcccucccaguuuauuucuuggguggaauccaaggcuucacauggaucaagcauguacucuacucggagccaugccccagccccaugcuaggguuucauaagaggcaguucgcuacugggaaguaaguguuggugacaaccagccugaaucuagcucaggagagguaauacagugugacaauggccacauccaucucuuuccuaugagccucaguuuccucauccuggcuaauggguacgguuugugaagcacgaaguucagugccagauauagagaauucaggugccuaugagauucaugggagcuugugugucccuuucucugaggugagugucuuuuggugggauauuuuugaaacuccaggagggagacugugguacgugugcugggcagguggucaugggcucaggccagcuagagagacugggaaggcagagacuccugugugguguggguuuugaguccagcuaccuugggaaaaguucuucaaauugaaguaggcugugagaucaggucuggagacugagacuccaagacuccucaucacccuuccuaagggcauggccuaccuccaguggcccugacaggaugggucccuggggacuuagaaccaauggaggugaaugaguccagagaggggcggcagcuagcaaggucaggagcacaguguaaaucuuggcagccaagggggucagauaaacagagaagacagugaaaaccucuccaaaccagaaaaacagauccuuguggcguuggugaugggcagacgcuguuguaaacaagcaaggguucuguuaaugauucuugcuuggcccugggagcagaccccaugcagggccuuuuaguggcuuuuagaacaucuuccaggcucagaggggaagaagaaaacaaaaacacaaguuaauaaguggcuaagcgugaaacauccuccagcgcuccaaacagggcuuacaggcucacaaguggcugggggggugggggaccugggcucggugcaggcugcgugacucccaucugagccagaggcugaguggaggaucuuggggggcugugaaagcuuaccuugggguguuccucuuuacccugcuuuauacauuggggcucuuaaggauugguauuuaaauggccugauaguaucaucacucaaauacaagugggcaaggaaagaggaggcggcuggucuccagucuugguuagccuggggcugcguggccauuuuucccccaugugcagcucaguuggcauugaucuccagcaguuuucuuuauuugcagugcuggacaucaucagauccagggcuuugcccagaauagacgacauucuucccuagcccacugcauccagauguuuauacauuagcuccugucccugccgcucuccugccucugugucacuggugccuuucugcaggcagccagagaaacuauuucaguucugggucauagccuuucguguagcuuguguagcuuggcccuggggcugccgauuagccacagcucaguucuuuucagguucaaauuccccuugggcacaauagucagaggucaugaggucuacucauagaaccucuuggucaccuugccccugaauucuggccucagagugccgguaccuuuaggcacaugaaagggauuuucucucugucccuuaggaugcaggaaaggggucuucucucuggucauguccauucuuggacacucccucacggucucccaaaggucuccauaguuggaucuuuuucguaggaaugccaggggaacgucuguccccaacccaucuugucuuuuuauuucaugauggcauuuuguguagaccaggccucaaauucagucaggucugacucugaaaauguccuagccuucuuucugccucuaaccucccaauuucugggauugcaggcauguaugcuguaccugguuaugcugugcuguggaaccaacccugggccuuugccugcuagcugagcacucugccagguguuuacaugcccagccuuuagcauuuuaauguuucagugacucagagcagucugggugaggcuccucuagucuaaguacuuuugugucccucaaacccccaaauacugccaagaccuguguauuugugccuaaagucugauaacuagggauguuguugccaguaucauugguuggguuaaaggugauguauccagagggugcaguuuuaugcugcuguuaaaaggcaagauagaucuuuguguagggacauagcacaguuuccaagauaaaucauuagguacaagauugaaaagauguagagagacugauaaucauccuagagcaugggguguguguguguguguguguguguguuccuaaauguuccagaauuuucuuugucuggaaccaauggaucuuggaucacaggauuucuggugggguuaagccaccaugugagucauaccugaaguaccuuuagugcucuggauggggaaacugaguccaggcuuugcccagagucucccaacugguuaaugcaaagguugaccuuagcuugcuguggcugagcagccccugugaaaggcugggcuaggcauucauugcuuuaguguguguagcaucagccuugacaaaggaaagaggcugucauggccacaccucuccccccaagaguguccgggcaaagagcuggcccuggcuuccuagagagucucuagugagucaggucuccagugacaagggugggaauggcccaaguacagacauagcccugaguugcuuggaccacagagcacaguggcugccugcacagcucagggucuggcgacauggauuuccaggugggucucaugagagguagcccagcccuccuccugagcuccagacccguuucucucucucccucuugcccucaguuuguugaagucgaaggacagaucacauccuugguugaucuuuacccguccuuccuaaggaaggguuaucgucgggaaaucuucauagccaucuuguguagcaucagcuaccugcuggggcugacgauggugacggagguaaguggcuguuacucugggggcugugaguuuuucccuuccuacuuaggauuucucgaggccacaggggaggccacgauugggagaggggccugagggggugagaggguuccccuuaccacaccuccuuuagguugauccugcagcuucccccauauucccuuacugagaugcuguggucaaaccaagauuguggcacuugcuuggcaaguacucuaccauuuguguggguaucugcugagcagagcauacgcucuucccagagagcaggagccauacuugaggaggaaaagaagccaggagcagaagggaacagaaagguugaaggcuagacauuucaguggcuggaaaaagggcagauaagagggcacgagccugggaucccccagagcaagcuuuccugccuccgggacauuggcacgccugaggucucuaggagaagguugucagucacuucccaaacccuauucaagcuuucacuuuucauuaccaaaauagaagcuuuuugggaacugcuugaaagaacacuccgucuguggcuguaaagaugucucagggugaagagcacuaguugcucuucccgaggaccuagguucaauucccagcacccacauggcuacucacaacuguagcuuuacuccuggggauccaacguauacauggucugcagacacaccuguaggcagaaugucuagucacauaaaauaaaaauaaaggcuauaaagcauuaagaauaucccucuaaagucagaucgccucucuacucaccaagcauagguuccugugacuuggccacacuugguuuuaagacacccuguauauagacuagugugacccuuuggguugcuuagauguguuaaacucuucgcccaacccuguguguuuugucaaacaugaaguugaauuuguuauaacuggccuugaacucucagcaguucaccuguguagacuuccagaggauuuguuguaagacuaugagccaccacauuuggcccugaauauuuuuuccuuuguuucuuuucuuuucuuuucuuuucuuuucuuuucuuuucuuuucuuuucuuuccucuuuucuucucuuuuccuucuuucucucucuuuuuaaaaguaccuguauuugguccuccuagcuuuugccaauuuuucuuuggaauuuuuaaaaaaaaaguauugauuuaccauagcucuuuauauauggagaauuggagaccauauaacaaaccaacuuuauccuugauuuuuuuuuuccuucacaggguggcauguauguguuucaacucuuugacuacuaugcagcuagugguguaugccuuuuguggguugcauucuuugaauguuuuguuauugccuggauauauggugaguauacauguuugcacaucguuuuucuagcuguucauuugggcagagaauauaauggaaaagcuucccuugucuggaauagucacuucaggauucucccugagcacaucacagauaaucccacugaaggcacaagaugugaacauguugcuauaaauauaacacugucaccucagaaccuagggugaccuacucuuuggcccagaaaugguccauuuugaucucuuagagagcugggauuagccaugcuaagauguggacucugucuaagacuuccagcaaaaugcagguacccagcugcacugaaugucacauggccgugcuugguguggagacauaggcccggugguugagauggugaccccagcugcguuguuuccuggugcuauucuggcuuugaccaccaugucaccggggacccccacugcuaucucuuguaggcggugauaacuuauaugacgguauugaggacaugauuggcuaucggccugggcccuggaugaaguacagcugggcugucaucacuccagcucuuuguguuguaagucucaccugagcgugacauuuucaccuugugaucucuugcauucugugggcucugguaaagccagcuucagcuauaccugggacagugggggcaguuugcuuuauguugccuugguugcauaggguuuuguaggaccaauaggaguuugugaagaagaggaagcaggaagggcagugucaggcugcuguccucugccugccaccuuggagcuggcuuugcugcuugcauguuaccuucucugagacucugcuugugaguaccaucgagcuuuugcagcagagccuggccaacacccuagggaucuucaugugugggcguucucccuguacugcuguuccuggucagcaucuuggggaguccagauguucguugcuuuaaaaucagugcuuagugauuaacagguccccucuccugugaccucuacucccaggcuagaccaagugacaugcugauugacuccucugucuaggccucagucuuuucaccucaccuugucaccucugugacaaggauacccugaugugagaccucagugcaggugacaggguuuagaaucugaugagucugauuguggcucucggcacacauaucucucaacaaagucaagagacugcaaaacagcaacuggaggcucaacccagguaggguugcagucagcugggcacaggcccguaagccuguccuuguucacaccaggcuugugccuggggucccucucacacuaaccuccgauuuccuauccucuagaccagugguagucugcacucugguggcagaaugaggcccucugcuggaaagucuagguagaggccagagucacccaccucuggggcucacuuuuacggaagcugaagcuguuuaggcagaaagcaacagagaaggguaggcucugugggccaccuguccccaccaugcaccacuaucacccaucagaccugguuuuaggcagugaguaguggauugguuuugccauggcacucccuggguugccucauuuuuuugagaaggauacagagggcaguucuuccagagucagagcgccuccucucaaaggcaaagguagacucugcacagcuuuaggguucaggacucaccccaccauucucuucaggaccaaggccaggucugcauccugucacugggaccagaccagugugacaagagauaauggcauuuaggccgcuggcugccccgcucucauccaugcuuuuggcauuuauugugcaccugcuguguaugucuagaaccacaucugguguuaaaagagaggugcucuagaguggugguucuuagccaucgccccaccgcuuuucacugggguugucugagaccacuggagaacacagacuuuuacacgaucagucauaauaauaccacgauuacaguugugaaguaacaacaaaaauuauuucauggcugggggucaccacaacacgaggaacuguacuaaaggguugcaguaucaggaagguugagaaccacugcuccagagggaggggaacagccgaacucuggguaucagagccacaucgcuucugaagggaaaagcuggggucuggguagguaaggccagcgcacuggaguggacgucgggugaaaagaugaaggaaaaaggaugggcaggaggaaguggccuuuguuaaggcccugggcacauucgaaagagcuggaaagaaccccgagggguggggguagauaaagaaggguggggucggcuacgagcugaccuggggagccaggggagggugagcaggugacugggucagauuugccuuggaaagauccauaaggcaccaugccaccccaucuccauaguaaggauagaggagaggcccugccccagauaaaguccacacugcucucaaaugccuacgggcccucugacugcuugccccgucucuccacagggauguuucgucuucucgcuugucaaguauguaccccugaccuacaacaaaguguaccgguacccggauugggcaauugggcugggcuggggccuggcccuuuccuccaugcuguguauccccuuggucauugucauccuccucugccggacggagggaccgcuccgcguggugagcacggggcaugggccaugcgagauggaggacagacagugucgguuucugugugaaguuaggcaggauucucgcccucucugaaucccaggguuucucucaccccaugaaaggccugagagccaaggcaggaaggaguacgcugugggcagacagacaggugccauucacguuggagaaggcuuuguggugacauuuaaagggggccaugaacuuaagaggaaugugcccaauauagugugagguagagugugguccuggugugggguacagagggucagucaguaggcuagagaggggacagaggccucacgugccaaguuagaggcugugggaaaucucuguucugagucaggguaggagauaaauucuggagaggaagcccggcacugcccaaccaugccacucucugcuggggugugccgccacgucugcccugcucccaaccucugugacugccugauuccucacggcgacccuucccuuucccccagccuccuuaggaauucuucccacaaugugggagccuccaggccuggcaguccccugcucuuuccgcgaaaucccuuucucagaaucuacuuuaaccuuugcccccccugggccagcuccaaggccccaccguuuuauuuugggcuguuuuuauucucuuacaaaaagaaucuggagccaggauguccuggggcccuggcucccccuugagcuggcccaggcuuccuccuguggagggggcuguguuggcugggagaggaguggagaccaggaaggagccagggcaucacagcuuccccagaggguagaggaguggggaugggacgccaccauuaagcuggagucaaagcagccaccucuguuguuggugcugaaacagucagcuccagacacacagguaacugcagggccugcucugagccaacuccggucaccuucaaagguuauuaguacccagacgugaguuaguuggccuuugcagggguguuuagagguguguucugguuacagggucucugaaaaccugaauguuuuuguuguggugguggugacgaugguuguuacuuugguuuuugugacaguaucuaaaucuauagaccaagcugaccuagaacucacucaaguccaaguuggccucaaaccucccuagugccagaguuauggguagaagccccacugccugucuuaaagccccauuuuaagagguugguuuggccugcgugcgcagauuuguucagagugagcugcugggggaggcaggagcagcuggcauggaugucuccccacagcuagaaagagccacagccccgcuggcagcacaagcuauccugguacccuccuaaucgugagguagcaaggggcauaucaaguucuccaacccaaucaggguuccagaccaggcugugccucccagcagacagcaugguggcugccaguguggguacgauuucccacuuuugcauuuggagcgcaguguuccaauguaagggggggcggguugaaagcaugcaggcagcaggcuaggucgguggguaaggaggagccuaccugcucaaagcagcgcagguguuugugggaggggcauggccugcgguuaccaggucuuguguuuguuuuccccccacuccuagagaauguggaaauguggauucuccaagugagaugaugucuuuuuuaaauaagccgcuucucccagguccuuugacggugccagggagaacaccaggccuggcccaugcaggcuuaaagcagcucucccgcuuguaauuugccaugguuggauguaaauaccuagaagggccuuuuguucccuucuuuucuuuuuuuaaacugcuggcccguuucagucugagcagacacccggcaggaagugggcaggaggcagaggugggagccaaguuccacucccacucugcuggggacuuccuagcacagggcucuucccucccuagcuccaggaucagucaccacacugagaagccgaggcucuauggcuagagugagaauucuccuguagucuccuaucugaaagggcaggcucuuccccgcagugggcuccuaggcccaucccuucaggagauggagcuucuugaggaacugucuccugaagggagaccaaggaguacaaauuucuucuugggggcggggucuggaaaagaggaaggauuaggucaguuuuccaacucuaagacauacuguagaagcagaaagucagagaaacccgggagaauaaaccauggggagauaggacucaacuccucaggggaaagaaaucugccuguggaggucauguguguacccugucuguaagcaagaauacagggguuggcuggggggaucacuccauuuagaaaagauccauaaaagggccagaaaggguggcagaugccugggauguucuagaggugggugggaaggacccuccguaauccacuccugaucugcuccucuuucuuccacagagaaucaaauaccugauaacccccagggagcccaaccgcugggcuguggagcgugaaggggccacacccuuucacucccgaguaacccucaugaacggcgcacucaugaaacccagucacgucauuguggagaccaugaugugagguccgggccaugugacaggcgccgcuuuccugcuguuuacuaacguuagauucucauaggaccagguuuacagagcuuuauauuuguacuaggauuuuuuuuuuuaauugucacagaaaauguuacucuauguguguguguauguguaucguguaugucuguauauguguguuuuguuuuguuugggggauauuuuguacaaaaagaaaacccauaggccuacguccuggggaagaggauggacuuucauauugauuuccauguauuuugugggaacuugguaaauuuuucuuuguauuuuuuuuaacauauaacuauauauacuuagagucugucauacacuuugccacuugaauuggucuugccagcaauggaucucguuuuucaaaagcaauucuucggugcuuauauagcuggcagaaaguucugcccaaaaacaaaugaaaaaagagaaaaaaaaaaaaaaccugaaugcuggguggaauuuuccuaugauaguggauacaucuucaagaacgguguagucccuucugagcugguucaggaggaagaacacagcugaggagagggagccccccccccccacuagcugaacagaccugaggggcaggagagagcagggcuauggacccucagccaacaagaaagaugccaaaauacuggcccacccucagcaugaaugauagaucucagagcagcugaagcgguuguaccagggccaaacgccugcccucuuacuuggaagaagacaugggugguagucagugggacuggcugaaccaccauggguauuacaggcagggaugggacgucugaaugucuggugaggauguggcucaggucugggagccugccucugcaggcguaggccgaaucccuguccuuucuugaacacucaguauggcugcccgaagccaggccacaggagcugcuggggcuucagagugggggucacacucaggaagugucugcgguauuugaguggagucaugguggguggugaccagaguauuccccaagcagaauguauuuuggugagggcccggggugagggaggccaguggaccaaaugauauuagcagcucaggagggugaguguaccccaggcuggcaaguguaccccaggagggcacuauucuuccuugccucuugacaaacucuugugaaaguuaccaccccagaaccauccagcagcucccagcaaggagugcuccaaguggcuguagacccuggaucuuaaaggaucugaguuccaguacagagccagcuugguagugaccucagaugauuuccaagccacugcauuggcuguuggacaggcguuugcccccaggggacggcagagggaaggcgaagggaaguuucggucaguugaagcuaucuccacagaagugaggucaguacuccagagcugcccaaugucagcuucugaaccaggagagggcacuacaccuucaccccagccuccacugggcccaacugugccauccugaacuucuuugacaaauguacacauuuuuuccugucuccaaagcaauguacucugccaagugacccucuaauccucuuccaguggcuguugacucagccacccaugauuguacuguguuccuguuguccuguguauuucugguugcucucguguuauuuugaguguuuggaguucuccuuccccgauuuuaccgacuuguaauguacccugguuuucuuucguucaacggaaccuuaaaaguaaccacugugggugacugaaagacaggugaaguguaagggagaggggggcucguccagcuguggcagugucuguggucaugcccgucuacccuaccccuaacccccaccgggcacgccccucuggcgagccuucaguauuuuggguuggcagacaaauggcaccauucuggaaauggccugagaaaggcuuuuuuuaaucauucccagaucgaauucuagaccaaagacacagcgggccaaguccccaggcccugccuggauuuggaaggccagccgccucccgagcccacuccccagcaguguccccucaccugucuucaguggcccccacucucaccccgccccugccccugaugacccuuauugugaugcuugucuuuucacgucugcauguaaguaacauuuugaaguagagcucgugacucugguccgccugccuccuggagagagggcuaagcuguucaccaaccagcccuugccuggaacaggccagauccuguccugccugucagauggagacaggaagcaagggacauugccugguuuagaugaggacauuaggugggcccaggagacccugggagauguuauuugguccuaagagugaugugaccucccaaauggagggucccugcugggcacugugggcagccccagagggcccugauccaaggcacuuauguaaucaggagaauaggccuaguguggggacuuacacugugagcuaaguggaacuggacauuugagucauuuguagcuucagguucuccaagacuuaguagagggaaggcagguccagggcauugucuaaguaaacugucaagccuucccugucaaccaaaggccagagcugaugagggcccuugcuccauauucauggaacacagagcaauacccacgugugccaguccuuaccgcccugcucaccccggccccgugccacccuuccuuccuuccuuucuccuccaaagccuuugggaacuaggaauugauacacccuccccucaaguuguaccacaggaaacugagggccaaagacaucacuagugugaagagccuuagcuaggguguaugggcaggccuuugaccuccauguagcccaaggcuaugcaggaaguagccugagaggguuucuuuucccucucugccucuggccuccaguccucaccucagcuccauacccuaccauggaaagccacgcagaccauggcagcgcaugaggagaaagcagcacucgcccccucugcacaggaaggggcuuucucuaucacagugugucaccaccauggccgacagcauuccaguccugccucucgggacggggcaaugcucuagcaaccagucuaacaggugccagcccaguuccucucuccaagaugcagacacaagccaggaaggcaccuuagagaaggccccucacagucccacucaaaccugagaccccugucccuauggacacuguaaauaccucugugugcacaccccuuccuucaucaagccccaaaccacacacacaacaaaacccagauacuccaagauggagaggggcaucccggaagccagagcagugcucccuccuccccuccuccaucugaucgccuaggagucagaccuucacaggaaacuggcuguccaugcucucugggagggaggaguggugucauugucauuacaggcauguucuggcauguucccugaaggacagagcaucuuauuauauauuuggcuucaaaaugagaugguaguuccauuuucuuuuuuuaaaaacaauuaaucuuuccaaucccuaacaacugugacuguauuuagcacaagagaaaagcugagaacguggguuuugccuccuucagaaauaugucuggcucaucaggacauuuuuuaaaaacuucaaaauauuuuuaagauauuuuaaacuuuuguaaaaaacaaaaaacaaaaaaacaaaugcacgcacacacacacacauacaacacacacacacacacacacacacacacauacacacaaagaaaaaaaaccugaaaccaaucaagaaggggaggagcguuuguguuugaaggauccuuggugugugaccugucuugcaguauacaagcucuguguauguuuaauuacaacgaccccgcauuuugcaggguuucgguuuuuuuuuccucuuuugcuuuuuagaugaauauguauauugauauuuuaaauccaucuuugcuuuuuuuagaggaguuuauaaucaccuuguaacacaacaauaaacauuuccuuuuuaaaauccaag

SEQ ID NO: 3232 - RNA, 75013 nt, Mus musculus
cuuggauuuuaaaaaggaaauguuuauuguuguguuacaaggugauuauaaacuccucuaaaaaaagcaaagauggauuuaaaauaucaauauacauauucaucuaaaaagcaaaagaggaaaaaaaaaccgaaacccugcaaaaugcggggucguuguaauuaaacauacacagagcuuguauacugcaagacaggucacacaccaaggauccuucaaacacaaacgcuccuccccuucuugauugguuucagguuuuuuuucuuuguguguauguguguguguguguguguguguguguguuguaugugugugugugugcgugcauuuguuuuuuuguuuuuuguuuuuuacaaaaguuuaaaauaucuuaaaaauauuuugaaguuuuuaaaaaauguccugaugagccagacauauuucugaaggaggcaaaacccacguucucagcuuuucucuugugcuaaauacagucacaguuguuagggauuggaaagauuaauuguuuuuaaaaaaagaaaauggaacuaccaucucauuuugaagccaaauauauaauaagaugcucuguccuucagggaacaugccagaacaugccuguaaugacaaugacaccacuccucccucccagagagcauggacagccaguuuccugugaaggucugacuccuaggcgaucagauggaggaggggaggagggagcacugcucuggcuuccgggaugccccucuccaucuuggaguaucuggguuuuguugugugugugguuuggggcuugaugaaggaaggggugugcacacagagguauuuacaguguccauagggacaggggucucagguuugagugggacugugaggggccuucucuaaggugccuuccuggcuugugucugcaucuuggagagaggaacugggcuggcaccuguuagacugguugcuagagcauugccccgucccgagaggcaggacuggaaugcugucggccaugguggugacacacugugauagagaaagccccuuccugugcagagggggcgagugcugcuuucuccucaugcgcugccauggucugcguggcuuuccaugguaggguauggagcugaggugaggacuggaggccagaggcagagagggaaaagaaacccucucaggcuacuuccugcauagccuugggcuacauggaggucaaaggccugcccauacacccuagcuaaggcucuucacacuagugaugucuuuggcccucaguuuccugugguacaacuugaggggaggguguaucaauuccuaguucccaaaggcuuuggaggagaaaggaaggaaggaaggguggcacggggccggggugagcagggcgguaaggacuggcacacguggguauugcucuguguuccaugaauauggagcaagggcccucaucagcucuggccuuugguugacagggaaggcuugacaguuuacuuagacaaugcccuggaccugccuucccucuacuaagucuuggagaaccugaagcuacaaaugacucaaauguccaguuccacuuagcucacaguguaaguccccacacuaggccuauucuccugauuacauaagugccuuggaucagggcccucuggggcugcccacagugcccagcagggacccuccauuugggaggucacaucacucuuaggaccaaauaacaucucccagggucuccugggcccaccuaauguccucaucuaaaccaggcaaugucccuugcuuccugucuccaucugacaggcaggacaggaucuggccuguuccaggcaagggcugguuggugaacagcuuagcccucucuccaggaggcaggcggaccagagucacgagcucuacuucaaaauguuacuuacaugcagacgugaaaagacaagcaucacaauaagggucaucaggggcaggggcggggugagagugggggccacugaagacaggugaggggacacugcuggggagugggcucgggaggcggcuggccuuccaaauccaggcagggccuggggacuuggcccgcugugucuuuggucuagaauucgaucugggaaugauuaaaaaaagccuuucucaggccauuuccagaauggugccauuugucugccaacccaaaauacugaaggcucgccagaggggcgugcccgguggggguuagggguaggguagacgggcaugaccacagacacugccacagcuggacgagccccccucucccuuacacuucaccugucuuucagucacccacagugguuacuuuuaagguuccguugaacgaaagaaaaccaggguacauuacaagucgguaaaaucggggaaggagaacuccaaacacucaaaauaacacgagagcaaccagaaauacacaggacaacaggaacacaguacaaucauggguggcugagucaacagccacuggaagaggauuagagggucacuuggcagaguacauugcuuuggagacaggaaaaaauguguacauuugucaaagaaguucaggauggcacaguugggcccaguggaggcuggggugaagguguagugcccucuccugguucagaagcugacauugggcagcucuggaguacugaccucacuucuguggagauagcuucaacugaccgaaacuucccuucgccuucccucugccguccccugggggcaaacgccuguccaacagccaaugcaguggcuuggaaaucaucugaggucacuaccaagcuggcucuguacuggaacucagauccuuuaagauccagggucuacagccacuuggagcacuccuugcugggagcugcuggaugguucuggggugguaacuuucacaagaguuugucaagaggcaaggaagaauagugcccuccugggguacacuugccagccugggguacacucacccuccugagcugcuaauaucauuugguccacuggccucccucaccccgggcccucaccaaaauacauucugcuuggggaauacucuggucaccacccaccaugacuccacucaaauaccgcagacacuuccugagugugacccccacucugaagccccagcagcuccuguggccuggcuucgggcagccauacugaguguucaagaaaggacagggauucggccuacgccugcagaggcaggcucccagaccugagccacauccucaccagacauucagacgucccaucccugccuguaauacccauggugguucagccagucccacugacuaccacccaugucuucuuccaaguaagagggcaggcguuuggcccugguacaaccgcuucagcugcucugagaucuaucauucaugcugagggugggccaguauuuuggcaucuuucuuguuggcugaggguccauagcccugcucucuccugccccucaggucuguucagcuaguggggggggggggcucccucuccucagcuguguucuuccuccugaaccagcucagaagggacuacaccguucuugaagauguauccacuaucauaggaaaauuccacccagcauucagguuuuuuuuuuuuuucucuuuuuucauuuguuuuugggcagaacuuucugccagcuauauaagcaccgaagaauugcuuuugaaaaacgagauccauugcuggcaagaccaauucaaguggcaaaguguaugacagacucuaaguauauauaguuauauguuaaaaaaaauacaaagaaaaauuuaccaaguucccacaaaauacauggaaaucaauaugaaaguccauccucuuccccaggacguaggccuauggguuuucuuuuuguacaaaauaucccccaaacaaaacaaaacacacauauacagacauacacgauacacauacacacacacauagaguaacauuuucugugacaauuaaaaaaaaaaauccuaguacaaauauaaagcucuguaaaccugguccuaugagaaucuaacguuaguaaacagcaggaaagcggcgccugucacauggcccggaccucacaucauggucuccacaaugacgugacuggguuucaugagugcgccguucaugaggguuacucgggagugaaaggguguggccccuucacgcuccacagcccagcgguugggcucccuggggguuaucagguauuugauucucuguggaagaaagaggagcagaucaggaguggauuacggaggguccuucccacccaccucuagaacaucccaggcaucugccacccuuucuggcccuuuuauggaucuuuucuaaauggagugauccccccagccaaccccuguauucuugcuuacagacaggguacacacaugaccuccacaggcagauuucuuuccccugaggaguugaguccuaucuccccaugguuuauucucccggguuucucugacuuucugcuucuacaguaugucuuagaguuggaaaacugaccuaauccuuccucuuuuccagaccccgcccccaagaagaaauuuguacuccuuggucucccuucaggagacaguuccucaagaagcuccaucuccugaagggaugggccuaggagcccacugcggggaagagccugcccuuucagauaggagacuacaggagaauucucacucuagccauagagccucggcuucucaguguggugacugauccuggagcuagggagggaagagcccugugcuaggaaguccccagcagagugggaguggaacuuggcucccaccucugccuccugcccacuuccugccgggugucugcucagacugaaacgggccagcaguuuaaaaaaagaaaagaagggaacaaaaggcccuucuagguauuuacauccaaccauggcaaauuacaagcgggagagcugcuuuaagccugcaugggccaggccugguguucucccuggcaccgucaaaggaccugggagaagcggcuuauuuaaaaaagacaucaucucacuuggagaauccacauuuccacauucucuaggaguggggggaaaacaaacacaagaccugguaaccgcaggccaugccccucccacaaacaccugcgcugcuuugagcagguaggcuccuccuuacccaccgaccuagccugcugccugcaugcuuucaacccgcccccccuuacauuggaacacugcgcuccaaaugcaaaagugggaaaucguacccacacuggcagccaccaugcugucugcugggaggcacagccuggucuggaacccugauuggguuggagaacuugauaugccccuugcuaccucacgauuaggaggguaccaggauagcuugugcugccagcggggcuguggcucuuucuagcuguggggagacauccaugccagcugcuccugccucccccagcagcucacucugaacaaaucugcgcacgcaggccaaaccaaccucuuaaaauggggcuuuaagacaggcaguggggcuucuacccauaacucuggcacuagggagguuugaggccaacuuggacuugagugaguucuaggucagcuuggucuauagauuuagauacugucacaaaaaccaaaguaacaaccaucgucaccaccaccacaacaaaaacauucagguuuucagagacccuguaaccagaacacaccucuaaacaccccugcaaaggccaacuaacucacgucuggguacuaauaaccuuugaaggugaccggaguuggcucagagcaggcccugcaguuaccugugugucuggagcugacuguuucagcaccaacaacagagguggcugcuuugacuccagcuuaaugguggcgucccauccccacuccucuacccucuggggaagcugugaugcccuggcuccuuccuggucuccacuccucucccagccaacacagcccccuccacaggaggaagccugggccagcucaagggggagccagggccccaggacauccuggcuccagauucuuuuuguaagagaauaaaaacagcccaaaauaaaacgguggggccuuggagcuggcccagggggggcaaagguuaaaguagauucugagaaagggauuucgcggaaagagcaggggacugccaggccuggaggcucccacauugugggaagaauuccuaaggaggcugggggaaagggaagggucgccgugaggaaucaggcagucacagagguugggagcagggcagacguggcggcacaccccagcagagaguggcaugguugggcagugccgggcuuccucuccagaauuuaucuccuacccugacucagaacagagauuucccacagccucuaacuuggcacgugaggccucuguccccucucuagccuacugacugacccucuguaccccacaccaggaccacacucuaccucacacuauauugggcacauuccucuuaaguucauggcccccuuuaaaugucaccacaaagccuucuccaacgugaauggcaccugucugucugcccacagcguacuccuuccugccuuggcucucaggccuuucauggggugagagaaacccugggauucagagagggcgagaauccugccuaacuucacacagaaaccgacacugucuguccuccaucucgcauggcccaugccccgugcucaccacgcggagcggucccuccguccggcagaggaggaugacaaugaccaaggggauacacagcauggaggaaagggccaggccccagcccagcccaauugcccaauccggguaccgguacacuuuguuguaggucagggguacauacuugacaagcgagaagacgaaacaucccuguggagagacggggcaagcagucagagggcccguaggcauuugagagcaguguggacuuuaucuggggcagggccucuccucuauccuuacuauggagaugggguggcauggugccuuauggaucuuuccaaggcaaaucugacccagucaccugcucacccuccccuggcuccccaggucagcucguagccgaccccacccuucuuuaucuacccccaccccucgggguucuuuccagcucuuucgaaugugcccagggccuuaacaaaggccacuuccuccugcccauccuuuuuccuucaucuuuucacccgacguccacuccagugcgcuggccuuaccuacccagaccccagcuuuucccuucagaagcgauguggcucugauacccagaguucggcuguuccccucccucuggagcagugguucucaaccuuccugauacugcaacccuuuaguacaguuccucguguuguggugacccccagccaugaaauaauuuuuguuguuacuucacaacuguaaucgugguauuauuaugacugaucguguaaaagucuguguucuccaguggucucagacaaccccagugaaaagcgguggggcgauggcuaagaaccaccacucuagagcaccucucuuuuaacaccagaugugguucuagacauacacagcaggugcacaauaaaugccaaaagcauggaugagagcggggcagccagcggccuaaaugccauuaucucuugucacacuggucuggucccagugacaggaugcagaccuggccuugguccugaagagaaugguggggugaguccugaacccuaaagcugugcagagucuaccuuugccuuugagaggaggcgcucugacucuggaagaacugcccucuguauccuucucaaaaaaaugaggcaacccagggagugccauggcaaaaccaauccacuacucacugccuaaaaccaggucugaugggugauaguggugcaugguggggacagguggcccacagagccuacccuucucuguugcuuucugccuaaacagcuucagcuuccguaaaagugagccccagaggugggugacucuggccucuaccuagacuuuccagcagagggccucauucugccaccagagugcagacuaccacuggucuagaggauaggaaaucggagguuagugugagagggaccccaggcacaagccuggugugaacaaggacaggcuuacgggccugugcccagcugacugcaacccuaccuggguugagccuccaguugcuguuuugcagucucuugacuuuguugagagauaugugugccgagagccacaaucagacucaucagauucuaaacccugucaccugcacugaggucucacaucaggguauccuugucacagaggugacaaggugaggugaaaagacugaggccuagacagaggagucaaucagcaugucacuuggucuagccugggaguagaggucacaggagaggggaccuguuaaucacuaagcacugauuuuaaagcaacgaacaucuggacuccccaagaugcugaccaggaacagcaguacagggagaacgcccacacaugaagaucccuaggguguuggccaggcucugcugcaaaagcucgaugguacucacaagcagagucucagagaagguaacaugcaagcagcaaagccagcuccaagguggcaggcagaggacagcagccugacacugcccuuccugcuuccucuucuucacaaacuccuauugguccuacaaaacccuaugcaaccaaggcaacauaaagcaaacugcccccacugucccagguauagcugaagcuggcuuuaccagagcccacagaaugcaagagaucacaaggugaaaaugucacgcucaggugagacuuacaacacaaagagcuggagugaugacagcccagcuguacuucauccagggcccaggccgauagccaaucauguccucaauaccgucauauaaguuaucaccgccuacaagagauagcaguggggguccccggugacaugguggucaaagccagaauagcaccaggaaacaacgcagcuggggucaccaucucaaccaccgggccuaugucuccacaccaagcacggccaugugacauucagugcagcuggguaccugcauuuugcuggaagucuuagacagaguccacaucuuagcauggcuaaucccagcucucuaagagaucaaaauggaccauuucugggccaaagaguaggucacccuagguucugaggugacaguguuauauuuauagcaacauguucacaucuugugccuucagugggauuaucugugaugugcucagggagaauccugaagugacuauuccagacaagggaagcuuuuccauuauauucucugcccaaaugaacagcuagaaaaacgaugugcaaacauguauacucaccauauauccaggcaauaacaaaacauucaaagaaugcaacccacaaaaggcauacaccacuagcugcauaguagucaaagaguugaaacacauacaugccacccugugaaggaaaaaaaaaaucaaggauaaaguugguuuguuauauggucuccaauucuccauauauaaagagcuaugguaaaucaauacuuuuuuuuuaaaaauuccaaagaaaaauuggcaaaagcuaggaggaccaaauacagguacuuuuaaaaagagagagaaagaaggaaaagagaagaaaagaggaaagaaaagaaaagaaaagaaaagaaaagaaaagaaaagaaaagaaaagaaacaaaggaaaaaauauucagggccaaaugugguggcucauagucuuacaacaaauccucuggaagucuacacaggugaacugcugagaguucaaggccaguuauaacaaauucaacuucauguuugacaaaacacacaggguugggcgaagaguuuaacacaucuaagcaacccaaagggucacacuagucuauauacagggugucuuaaaaccaaguguggccaagucacaggaaccuaugcuuggugaguagagaggcgaucugacuuuagagggauauucuuaaugcuuuauagccuuuauuuuuauuuuaugugacuagacauucugccuacaggugugucugcagaccauguauacguuggauccccaggaguaaagcuacaguugugaguagccaugugggugcugggaauugaaccuagguccucgggaagagcaacuagugcucuucacccugagacaucuuuacagccacagacggaguguucuuucaagcaguucccaaaaagcuucuauuuugguaaugaaaagugaaagcuugaauaggguuugggaagugacugacaaccuucuccuagagaccucaggcgugccaaugucccggaggcaggaaagcuugcucugggggaucccaggcucgugcccucuuaucugcccuuuuuccagccacugaaaugucuagccuucaaccuuucuguucccuucugcuccuggcuucuuuuccuccucaaguauggcuccugcucucugggaagagcguaugcucugcucagcagauacccacacaaaugguagaguacuugccaagcaagugccacaaucuugguuugaccacagcaucucaguaagggaauaugggggaagcugcaggaucaaccuaaaggaggugugguaaggggaacccucucacccccucaggccccucucccaaucguggccuccccuguggccucgagaaauccuaaguaggaagggaaaaacucacagcccccagaguaacagccacuuaccuccgucaccaucgucagccccagcagguagcugaugcuacacaagauggcuaugaagauuucccgacgauaacccuuccuuaggaaggacggguaaagaucaaccaaggaugugaucuguccuucgacuucaacaaacugagggcaagagggagagagagaaacgggucuggagcucaggaggagggcugggcuaccucucaugagacccaccuggaaauccaugucgccagacccugagcugugcaggcagccacugugcucugugguccaagcaacucagggcuaugucuguacuugggccauucccacccuugucacuggagaccugacucacuagagacucucuaggaagccagggccagcucuuugcccggacacucuuggggggagagguguggccaugacagccucuuuccuuugucaaggcugaugcuacacacacuaaagcaaugaaugccuagcccagccuuucacaggggcugcucagccacagcaagcuaaggucaaccuuugcauuaaccaguugggagacucugggcaaagccuggacucaguuuccccauccagagcacuaaagguacuucagguaugacucacaugguggcuuaaccccaccagaaauccugugauccaagauccauugguuccagacaaagaaaauucuggaacauuuaggaacacacacacacacacacacacacaccccaugcucuaggaugauuaucagucucucuacaucuuuucaaucuuguaccuaaugauuuaucuuggaaacugugcuaugucccuacacaaagaucuaucuugccuuuuaacagcagcauaaaacugcacccucuggauacaucaccuuuaacccaaccaaugauacuggcaacaacaucccuaguuaucagacuuuaggcacaaauacacaggucuuggcaguauuuggggguuugagggacacaaaaguacuuagacuagaggagccucacccagacugcucugagucacugaaacauuaaaaugcuaaaggcugggcauguaaacaccuggcagagugcucagcuagcaggcaaaggcccaggguugguuccacagcacagcauaaccagguacagcauacaugccugcaaucccagaaauugggagguuagaggcagaaagaaggcuaggacauuuucagagucagaccugacugaauuugaggccuggucuacacaaaaugccaucaugaaauaaaaagacaagauggguuggggacagacguuccccuggcauuccuacgaaaaagauccaacuauggagaccuuugggagaccgugagggaguguccaagaauggacaugaccagagagaagaccccuuuccugcauccuaagggacagagagaaaaucccuuucaugugccuaaagguaccggcacucugaggccagaauucaggggcaaggugaccaagagguucuaugaguagaccucaugaccucugacuauugugcccaaggggaauuugaaccugaaaagaacugagcuguggcuaaucggcagccccagggccaagcuacacaagcuacacgaaaggcuaugacccagaacugaaauaguuucucuggcugccugcagaaaggcaccagugacacagaggcaggagagcggcagggacaggagcuaauguauaaacaucuggaugcagugggcuagggaagaaugucgucuauucugggcaaagcccuggaucugaugauguccagcacugcaaauaaagaaaacugcuggagaucaaugccaacugagcugcacaugggggaaaaauggccacgcagccccaggcuaaccaagacuggagaccagccgccuccucuuuccuugcccacuuguauuugagugaugauacuaucaggccauuuaaauaccaauccuuaagagccccaauguauaaagcaggguaaagaggaacaccccaagguaagcuuucacagccccccaagauccuccacucagccucuggcucagaugggagucacgcagccugcaccgagcccaggucccccacccccccagccacuugugagccuguaagcccuguuuggagcgcuggaggauguuucacgcuuagccacuuauuaacuuguguuuuuguuuucuucuuccccucugagccuggaagauguucuaaaagccacuaaaaggcccugcauggggucugcucccagggccaagcaagaaucauuaacagaacccuugcuuguuuacaacagcgucugcccaucaccaacgccacaaggaucuguuuuucugguuuggagagguuuucacugucuucucuguuuaucugacccccuuggcugccaagauuuacacugugcuccugaccuugcuagcugccgccccucucuggacucauucaccuccauugguucuaaguccccagggacccauccugucagggccacuggagguaggccaugcccuuaggaagggugaugaggagucuuggagucucagucuccagaccugaucucacagccuacuucaauuugaagaacuuuucccaagguagcuggacucaaaacccacaccacacaggagucucugccuucccagucucucuagcuggccugagcccaugaccaccugcccagcacacguaccacagucucccuccuggaguuucaaaaauaucccaccaaaagacacucaccucagagaaagggacacacaagcucccaugaaucucauaggcaccugaauucucuauaucuggcacugaacuucgugcuucacaaaccguacccauuagccaggaugaggaaacugaggcucauaggaaagagauggauguggccauugucacacuguauuaccucuccugagcuagauucaggcugguugucaccaacacuuacuucccaguagcgaacugccucuuaugaaacccuagcauggggcuggggcauggcuccgaguagaguacaugcuugauccaugugaagccuuggauuccacccaagaaauaaacugggagggccagacggggcagaugguauagcaaucagaggaguggggacaagcuggccugaaccaaaagcagugucccaaaugugguucaucuuuucuggacagacuguaguggcccagacaauggcugacacaugcucugacaccuguaccucugggucccagccuucuauuucucauuuauaguuugaccuuaaccacagccccagucacccucaucuccuugcuugagguagcagccuugaguguuagaguggaggaucuccccccaaugcugggcugaggccuucuucaacccagggcccugggggaaccagguugaagccugugaggugggagcuugagggggaagagucugaauaugccucagcuucaauaaggauggcuucucacagugaggcugcccacacgagcgccacagccccacauauacguaccuggcuguccaguccaagcaagaggagcauaaugaaaaacagaauagaccaaaaggugggcagcggcaucaugguuacagcuuuuggguaggcaaugaaggccaagccaggaccugagggagagaaacggggaggggggacacaggagaacacacaucagcaccaugcuacucgaaacccugggccucacagaacacucacaucugaguagggaggggggucaccuaagcccaaaaugcaggaggagccagagaaagagaccaguggggcuugggaggggccccaugugagcgucugucuccuacccagcacauggccuccucucaauugaaucuaaacccguauagacacgggauccuaggggcagggagugggggcugaaucuggggcucagguagccagagauuuggggaaaguaggacccuccccuuacacaccaaaguggcacauugacauuggcuggaaggaaaguugugguuaucugauccauaaaacccucuuuugcaaagaaccguuucuguuuuugaguuaauggcuaaaacacugaauggaaagagaaaaaaaaaagcauucagaugccccacaggguaaauggcucuucaaggacaugccuaugggggccucuguccccuacaggacccaaguucacacaaggcaagguaaaaacagucaggccuggcacugaaggaaggugccgaggcccaggagacuagccacaucucaguccucauccaccacuuccucuauauguuuugggggacaucaguuuccccugagaucugagggucguagucccaggauccucauguucagauucuuggaaguggauaccacugcccagaaaagggcucuggccagacucagaggcaaaggggacaagagcuccgcccacucugagugccucucacagggucauuugaacacaaacaucuccugcuuacaacgccccccuccuccaccaccaccaaacagacuccugggagagauuagcuagcugggacugggcccacaagagggcugacaaacuaaaguaaaauccacuacuagaaacaaaacaaaccaaucaagaagaaauaugggccaaacugcgggagauguuuuacacuuuaaagcaaacauuaaacaaucaucaaaacuggaugaauggcuuaagaaggaggcgggggggggggggggggggagaauccacaaaaacaaaccaauuuugaaaaaaaaaaauucacuuaguaaagcaucaacaaccccaacuguggcgggggaggagaagucuuacaaugaggucugcucagccugagaaaugagaaacccuacugaaacaacgaccuggggcagccgcugaguuuugcuagaaggugauacuagaagauucugugaggggaacaggugcggcugcuuaccaagcugaaagcugcuuggaugagcaagauugagagcagggggcucagaacaugcaccucccaccggggacaucaugaaacauauacuugggcucaaguuagaaccaaaagcauucggcucccccugaaguucaaagcucuggaccugccuuguccaccucaagaaugagcaaucaggacuagccaacuacaagacagauguaaaaggugguguacccccaacccuccgcaccaggcacugugaacagagucaauucacuucuuucuguccuucauuuuagauuuucucaaaccagccucaggagaggggccaagcacccuccucuacaaccacaguaaacuugagcgaguagaagccgagaauacuuagacugcugggaugccccgagugaagcacgccauguucugccugggcuucccuugguugugcaauacccuuguucaaaugcacuuuucuuuguuauggugcuugccaaaaaaaucuuagagucaccaucccucuugcugugcuggcugcuuacacaucacuguggggaaggagcguggacgaggucuuugaaguggauaaaagaaaagaagccacucggacugacuacaugcacggugugaacaugcccauugugcacagagaucucuuuggugaaccccaucuuucucccauaacaaguuuccucuguguuuuuaguggaaccccguaacggcuuuggaaucacuuugcauguguaagugggggauaucgacauuuguagagggucuggaagaggugcugggccccuugcuaaacaacuuccaacacaagaggcugugauugagguccugugcccucaggcccuucccugccuuuggagcuucugagaauggguaaauaguucuucugaguguccaacugggacacagugaaauagauaugugugcacagugugcuguucacacuggaggaggggcugcguuauggcccagcagcugacagaggaugaauagucucugaggucccugaggucagaggauccagugaaauggccacauuggauggcucuccagacguguaguggguggagacucggcauccagauacauugccuaugagccuagccugcccucagcugagacaugaauaucuaaaugaucuagacacaaaguaucaagguacccucugaccuuccaauaccaaggcaaccugaucuccgcugagacaugaauaucuagaugaucuagacacaaaguaucaagguacccucugaccuuccaauaccaaggcucaggaucagagaacugagacaugaccuuaaguuucaaauauaaggagaucgagggaagagaauggcagggacuuaggguaccugcccuggucuguaaaaaaacaccuagaauaaugaaggacagucuucccuaucucacccauccauguggccugaaggaagacccaacccauggcucuuggcagccucuagaagccccagaguaauuagguuggauaacaccugaccacccugcaagagaauggggugaggagguggccccuggugauauccaccccagaaccccauccacuacagggcgacuagagcccagaccccuaaaaaaccgugaugagguaguaggagucaagaccauguuccagaaccuucuuugcuggaguucuggaucccauguugcuaaggaagagccccugacccuaagaucgaccauccauucugugaauguuagcaucuugaguagcaacauggggccaacagggccccaacuccccaaaggcaacaguguccucauauccuacucccaaaucggcucugucgugggcucugagugauguuucuccccugcccucucgcuccuggugacugugguggaggcugggaggggugagguuuggaacauagacaggaaggacucaagaguggaucggcuuggcacuggagcccgccaggugccaaaugcaaaccacagaaaccaaggcugagaugucagcagcgcuggugauuggugugcuagcuguggcugaccugagccuuauuagaaaaccaacuuccauggcuaaagccagcggaugcuggggaaguguugggggcuggaagaccacaacuaaaacagccaccaaguuucaucucaaccgcccuugcuccucccaccuucagugggccagaaugcacugaggaccuuuaacuguagccuuuguacucagguaugggagcacaucuuggggggagaggggaugucuauguaaaagccaggcucccuccaucccccuggggucuggcuccaugccugcaguacucaucuuacacacuagguggcagugcccaccaccacugccaccgacaccaccguaccugacucagccacaucagcaauguccaccccuugcucuugugccaugaagcccaggauggaaaaaauugcgaagccagacacaaaacugguaccacuguucaggcaucccagcagcauacagucccuaaguuacacacacgucaggggguaaguuaaucacaacacaaggaagccacgcucccuacuucucuuuuuuuuucuuuaaucaucauuucuaacguccaccgggcccgccagcgcgacacuugccuguacgaguuauacuuguacuuguuauagcuucccagugaggucauggcccccaggcagauugcguaggaaaagaauaucugaguuccagcgucgauccacaccugaagaggggaagagcauuagggugguugccuggggugauuaaccaugacaaugucuacacaggcgagcugcaaggaaccccagaggcagaucuagaaccccagagggcagaucuagaaccccagagggcagaucuagaaccccagaggaagacccucuucuuccugcaucaguuaaggccucuaacucuggagugaccaguaccacuccugaaaccuugcuuuucauaucuacagaaugggccccuagccuacccugccccugcaaacaacuuuccacacucaguaaagagcagucuucucugagucuauugcuaaguugccacgguccacaucaagcacaccaaggcagcuuugacggcugugauggcuuagucugagaccuaaguuagaacacaaggcauucuuuacuucucuagggacuguagcuuauagcucuggaaggcagcaagccuaccuucccagcuuacagcucaggcuggccaccaacccugcucugcuccaauuuucaacugcuucccaggggcuugggagccugggacaaaggucucaaaagacacacaaaagccuccagggguuucaccaacucuaacacucuucagcuaugugcugagacagggggacuuacaauuugacccccuuaaccuucagagcaccauugauccuaucugaggaugguauccuaaacauugagucucugguccugauguggcuggaacaggggccccuccucgccuuagcaaggagugauugccugaggcaggcucuguagcucagaaggacugugagccacuacuggcccaggagagaaguaccaggcaguaaugguuggcuacacaugggcaucaaagagccagagaaaacacugccaucuguacccugugugcaccaccgguuuauacagggucuugggaugagguaccacacccugcuguaccuguggguccccaaggcggcugaugucaggguacagguagaauuugaugccuucaccagcaccuggcagggucaguccacggaccagcagcaccagaagcauggcaaacgggaaaguagcggugaaguagacaaccuguugucgagaaggcaucggguagacuugugaguguccuugcugcaaugaagugugggccauccucuucucucagaggcacgugcuugcccugggugcagcaaggacccuagagacauauuggucucacuugccgugccgucuuuaguguguugugcgaccccugagccucugccacuuuccuuaaauaugacauaagggucucucuuauagauuuaaaaaaaaauccuguggauaauucacauagcccauucaggcucagaauuuaacaaagcaggcaagacagaaagcaugcccacccuuugaagagauuaugcaaaaauacaaacauacagacugagucaacuaucagggacccuaggcaacgacucagcccguggucacauggcacucagcacauaucggcuagcaugacaacuaucaguauaacacaggggucgguggggggguugggaguaaagaaagggcucgagagaugacacguggcugagaggacuggcugcuuuugcaaaggacccaagauugauucccagcauccacguggcagcuuagacccaguugaaauuccaguugcaaaggaccugacaucucuggucaucucugacaccaggcacacauaauauuuaggcaacauaccuacacauauuuaaaaaaaaaaaaaaaagacagaagcagguauaggugcacaucuguaauccuagcacccaggaggcugaggcagauguguucaaggccugccuggggauacagagugagacaaggggucagcuccaacucugagaugcaggccauguuggucacucucucuggguuucuucucauauacaaugaggacaagagucacagcagcccuuauccaggggaagaugggugagcaucggcacggucagagcccagccgaugacugucaagacauacagccugcuugacagugacuugagagguaggcaggaacuucccuaaggucaugcccagaaugggaaagacccagcagguucccagcuuacaggagacccauggggucacgcuguguggcuaggguugggaugaggaagagauggguaauaaugcccuuugccugguccuaugagcuguuuagccaccccacugcaggguaguuggccuuuaccauggguagaaggccugagggaggccauacuuucuaggaggucaagccccuuggagaggaacucaagcacaauggcugguacuaucacuacccuuccccacuuuuaggggagagacguggacuagauaggcuuagguucccagcucugaggcuaagauaaggagauggacuggcccagagggucagcuggaguuuaccgcucaucuauccuaccucccaguuggcaacuguggcugccgcuuccagggggaacucugaucucacccucuaccgaggucuucagggaguguuuggaaacagcccagaaggugguggcagggcuuaaaggagggcccucuccugccugcuaccccuccccuggaugccuuuuuucuuucucugggccucuguguccccagccacccucgcuucuuuucccgugauggucugacagacacccgggacaaaggccaaucaggaagccacuaaaaguauaaaagaaagaaaauccuccuguccccucccuuccuguggcuaggcaggcaggcaccccuggccagguccccucucugaggcccugcaaagccacacccaaacugguaaacaaugaccauagaaaggcacgccacgggguuccccagagggcuacaaacacuucagagucaguggacuguggccagaagcacuggugggcucacugggguggggagggcucccuggcuugccucuucaauaagccuacuaugugcuaugaacuuacuuaauacuuaccauaccuggaugagccauuacaacaugucccuucccuugugagcaaacaggccauaccagccgucaugucaccugucuggaguccccaguuagaaguagguguucagagguaggaucuaaucuaggccaaguacuuuuggggcuccccuaucuuugggaguguuacuguugcugccaccuccccaucacaccuacccagccgucucucuagaaaaagcuacccuuguuuuguagccuuugcuacuccuuggaugagcccgagaaccauucucucaacuuuuccgugacugucccucgggauccucuagggagaggcuggugccaggcgccaccuugggccccugacuguggcccaguaggccuugcugugggacgugguauuuuuccacuccuguugcugauccuucagaacagggccagaggccuuguggaaaauggaggcuuagggggcaccucaucccugguccucuggagguuaguggguuugcaagagggaccuggcuuccggucuccugcuacuuagcuuuacuugggagcagauggccugaccagcaagcucauucgauuacauuacaccaggggaaacugaggcugagcaagguaagagguuuuguaaagucauuccauuuauaauggacagagcuggguccaaacccagaacuagcccugucugccccauucugcuuuguuucugacaaaacaggcuguccuggagugugaccacagacccagccacacacagauccagaccuuuccagggugagcaccaacaaccugucuccuugugagagcaagcaggaacaugccaggcuucugccucccugcaccugccagccagcacgaggaugagacggagaggugggagaagggaguugccugaguucaaaucccagucuggucaccgacaagcuguguagcguuggggaacguuaguuaagcucucugaaccucaguuucaauuguacaggaucagagaacuucagggggauuaaaugagcugucgccaacauagaggugacucgugaguauuucagcaaccugguuaguugaauaagugaaacugacauucauccugggaccuguuucagacccucagagaguuggaaaggccaggaaagaaaagccaagcaccugaacucggguccuccauccaucacccucccgucuccuggacuaaguuagccacagaaacaaacuuggccacaucuggugugcagccagggcuggaagcugaagccagccagugggugggccccuaaaugggguaggcgggcaggcggauggccucugaaggccucucagcacugagcuggagaaaguccacagaguuguuugucuuggcuucucugacccaucagggcugcuauuguucuaggaaccacacgugccucacaagcaggguauagcucaggguagauuggggugccucuggccagucauguuuucacaguagccauagcuacacccuggcaccccccuauuuggccuuggcucuguccccuuuguaagugugcugugucucaaacauugcugacugugccuuguagacaucaacuuacuccauaagacugaaguaagcucccuacauccuggccagaugcacuccagggccuuuuacacugaccacugccucugucugcaacccucuucagauacucaacucucuauccccuacuccuguuggcucagucaccacagucacuuuugcccagccacccuauaaauggcacaugugcccccugcucaucuuucuagcucuucccaguagccacacauguugaacauguagauaccuucacucuguuucuacaacgagauccacauacaagaggcucaaaggacaucacaacugaaccggacugacucucuccagcaugcuuagcaccagaguucccccagacacuccuggacagacuagcuuuauaugggaaaaggaggcagagggaagaaggcaauugcuacuuccucaagagugaaggacagguccauuggucugcagaccugaaucuugaugugccucaucucaacccucaaguucacuguucaacagccaagggggcagcucaggggaggggcugcucuuagacaagcugccugaccucuuaugagucuuagcuuccuugguguuuauaggagaauaacaagcacgcucccaggacuguggggcaguaggaagcacagugggcagggucccuaagagaacagacaacaucacauugccuauuugucuuacggagaauguuagcagggagugguccaggccuggcuggcuucccuucagacugagguucaguacagcagggggcucugcacccuguacaaggacagucauacagggcagcugggugguccugcuucagcaucucuuuuaaacucugggugcugccagaucacuuugcaaaguuaggguccacauuguggguggauaaucaaagccagcaguagggccgccacuggccuuuggcuccgcuagcuuagcucaccauaccaacagugcacaucaguggcuggugacagaagcucaguggggacaccuugguugccugccagucacaaggucacuaaucuccugaucagugaguaggggacacccagggacuuuacccaguaagagacaaagccacacggggcugugugugugugucuugucagagcacuccuauguccaacauggaaccuccuucuagguagcacucacugaaagguacuucagccuucaagaggagcuggccacaguggggcugucccugaggcaggggauggaguccacucaccuugccuguggaucgaacacccuuccagaugcagaaaaaacagacgagccagacuaagaggaggcagagcgcgaggucccauuucagacugccuggguugucgauuccggaggacaggcugagcacauugcgccuuuagggaaagagaacaagaggucagggguugggggccacuuggcagcuaagccagcaugggcaagacccuggguucuguuaccggcaccaugacaaaaugaacuacaaagugcucauuuucauuccaacacuggggagguuaaggcagacaggacugccuugaauuugaggcaagccugggcuacaucaugaauuccaggccagccuagacgacagagugugacuuugucuccaaaaaaaaaaaacccaaaaaaaaccaaaaaaacaaccaaccaaccaaccaaccaaacaaacaaacaaacaaaaaaaccaaagucaggauucuuaauaggugaucucaggcucacuccagccuggccaugagcaagucaaguccccgagccucuguuuccucaucuguaaaguggagacugauuuaguuggcugagcaaaaagguacuugcugccaaggcugcugaacuggccugcaugcaugggaccugcaugguggaaguaaaggauuggcucuuucaaguuguucucugaccgcacgcacacguguacacacacacacacacacacacacacacacacacacacacacacacacacacgugcacacauacauuuguaaaugaggagugaucaccuguaugacccaugcuugagacuacaaccuucaauuuugacuguggggcaaacacuggguucaagucucagccucucuccaacuguuaaccuugggcaaguuaucuaaccaauccaggccucucuuaguauguaaagugggcgugacucccuucccagcacccucugugcuagcuuccuugauagaacucggauuguuagcugggaaugguggugguauguaccuguaucucaagcugaggcaggaggauuaugaguuccagauuacccagggcuacauagucagauccuuucucaaaagaacaaaccaaaccagcaacaacaacaacaucgucaucaacaacaacaaauacccugcauauuaucuaaauuuuccucaagguauaacacucagaaaggcaaaguggguccuguauagacacaggguacccaggguaccuaucuuacuggaguagcuuaugaggaaaauaaccacagaaaaaagucugauaccauaccaaggucugcuggugcuguccccugauacaccugaccacauacugcaggaugagaguauacacacagagaagaugcugguauacagcagaugcuuaagcaaaacccugcucucaagaagaagcaaguccauggcuuuuaggacaauuccgggagaagaggccucuaacccugcucagggucacacagcugagcuggggucuguggagucagaaacuggacuuaagugcugaccucuggcuaucuuugcugaccucuggccaucucuccugaccucuggccaucuuugcuagucugcuguugcacacacacucucucccuggggcccucccuauagggaaggagccauaggaagccacaugggguacuuacagccaaaauggcugugaaaccagguauccagugucucgcagagccccugcugagcaugagaccgcuucccuggacacuggccuccaggugacaugccacccacagcugauaggacacagggucuccacacuccaagagucccagacaaagacuguuuucuuuccagcucugggucccaggccacccucugcaggaguaaagaccauaaggcugcccucugagcaaagcagccuccacauggaauguggaauaaaucccagggucccucucaaauggccuucaagcgacacauacgaccuacagucguucauuguucucgggaccuaggaugacaccuggaacacagcggaauucaguaaacacccacugagugaaugaccaccccaccccacccccagaagaaccaagccucacauuacuggauggauggaugauauagccccaagucuaaaggagaggcaaccuuccuuuccuugaucuuuauccugcuguucacagugauaucagugcccucacuguguagcuagaauggugugugagccucacacaagaaacagaagccugcagagccugacugccauuaucucauucauuccaagggguacggcucacuaccccauuucacagaugggaaaaccaaggcuuggaggguccacuugcccacaucucaaggucaccaaaacuccaggggccugccugauuccaaagccacagcucucucaacuguguugcaauauggucugaucuuaaaaaaaaauagcaccuacuuuuaaagggccuccaggagcuagaaggcuagcucaaagguuaagaacacuguaugcucuuccagaggaucuggguuuuauuccuagcacccacaugguaguucauaagcauguguaacuccaguuccaagagacauagcgcccucuucugguuucuagggacaucaggcaaacaagugguaacacacacacacacacucccucucccugucucucucucccccacccccuucacacacacacacacacacacacacacacacacacacacacacacacacaaaacaucuauagacauaaaaacaguuuuaaauaguacaggggccuccagucuccacuacaagcuaggaucaucuggugccucggggcagcaucaugggguaccuucacaaagcaggcuaacggucaaucacguccaguugggccccugccaagcugagaccuggcagcacgcaccacagaacaaaaagcccuucccauuuaacguucagcacuugggugccagccacagaagcucaaagcgcggggagaaacagcccacgugcucucugugaaugggccacaucaggggagaaaaauguagcccuauuccacacccucacacacagcccucucccuggccugcccuccacugcugaugaugcuccgggugacuugcugaagccugcucucuucccaccggcuccgaccacuccauggacaacaugcugacagccauuuauucaguugauguuuggccaugaaaccaugucucuguucuuuggggcaauccuucaagaagcucaaaacucuaaagccagaucuuccugguccugacagccccauccagaacacaaccaccuugcuauccauucucccacccugcuaggcaagccagcugcccaacagugcucacccugcaaggcaccaucaugcagacuagcucugggcagcuaagaugagcauguaaguccucuguuccucugcugcuggggacagucccuauaggacucaugaugacacccaugaugacaucgagugacauuugaagguacauuucccugacucgauaacuccauuuccaagaccaucuucuauuauucuuccagcaugggggcucauagacagaguaugcaccaaagugccccucugcaggguacagaaagcuuuggggcaggcacacuggaaugccacauggccaacagaccagugucaaguucuugaugugcugauaaagcaauauaacacccugggggacagagggagccagcagaguaggguacaucugcacaggauggccauugugauagaaauugaacauauaccagcaaguaagcaucacccagggagagggacucagcaauaaaggcagcucucuugcuguuuauuugugauauagcuuuacggacauauuuaaacauauuuaaacaguuugauggugguggugguggugguuuuuuuguuuguuuugagacagggucucauguagcucaggauggccuuaaaugguugauccucuugccucuuccuaaauuuaugcaauacugaaauaauacaggucuguccucagguuuuacauagcacaccagggucacaaacuguccugucgggcucuggcaaagcccuaggcagagcugagcugaguagccagccaccugaaugccagcagggacccuccccuagugcucucucuguugcuucccaacaagggggacucauggauuccccugggccuucucgcagcuuugagcacagggcucaguaaacuguguggugcugugcaugagggaucgcugccacagggcacucucaggugccuccuacauucucccacaaugcccugcucaggcccuaccacauccccaacccacuacaguaacuccuucccagccucccugcuauaucguccuccacgcuugucagagggaccccacagaaucugcagugccagcucacaugccccuuggcuccaccucuucccaccuccauccuaaccagucccuguuaccuuccacucaaagcuauaugcuugaaagaauguggaaaguacuuaacaagaagacucggacagcaaacacaggaagccagacaacguggguguacagcugucugccucucucccucaucugcccccugacgucuuccucaggggguuguguguggucccugaacuguggaacuaguggcuuccucagcugcacaauuccaccauucacagacagccucuuuccagggcucucacugaggcaccgcuccccaggacacccuccaucaagagcaccccagcaguccccuucccuagcacuaguucugcagugagagcuuuuccauuaggauuguacuuucugaaugguuaacaugucugucuacuaccaagcuagcucuguguacacaggaccugcaucugucccaaccacagcaccuggcacaugaaggagcucaccugacauuaggugagggaauucauuagagccauuugguagcuggggaaaacugaggcucagccucucauugacccuaggcagucagucaucaagccuggagcuggcuccuuucuuucugauguccccagugugccucaagccaggacuugcaggcuugggcuccucacuaucuuccagagguaagcugcagaucuuuuccaagaaaaaaagggcuacaucuugccaggacgggaacuaaaaaggaguggcugggcuggacauguguuugcagccggcugcccugcugccguccagucagcacuuggagauguaaauucgcccucggagugggccaaaucguuuccuuuugacagcaggccagccguuuauuggcugcagcaguccccuggagacuggcagagggaacaauuauaaaagggccguccguccgccugagcauggggcccccacacggcccuucccgcaccaccuccuccuuccgacagcuauggaggaagauuggcugagcaggguuuguuugcaaauaugacucauuucuuugauucuaauagaaucuaaugauccaugcugggcucccagggggcucugcaggagccucugaggaaggccuggcuccagccugcugaagggcuuuuggccagaccuggccccgccuguccucuaaggccugugagggaagcaggaguuuuagagacagaggugaccucagagggugaggaccagugugggauggggccacaggggcagaagcucugugaccccaccauguagccacuaaacguacccuaaugucagcauaaaaugucagucucuggagccuccugacuucucgugggaaucugagcugaggcuguuccuggcuuuacaggcagguaaguauggcagggucagucuaugauacagaccccugauacaggaguccaugccugaccagagacugaggaaacacagacgugcaugcacauaggcagcagugcaccaugugaccugugaccauggacucagcuccagggccugcccuguaucacggugugggaugagggguggaacacagaccaaagguucacuaagaguggaccuguguccaugcuggcuccccagaacccuaaaaccaaaacucauccagguuccugaaugccagagagcagaugugaguguuggggcugagcuaacucuggcucacagagcaggaggagacugaggcuuggcauuccaacugcccugacaucagagggcugggacgugugggagccacacuuaagccacacuggggaggggaguuccccucugaggucuuccugccuccuugguaaccagcagaugggaggggcggcaggguggcugacagucauccagugauuagaaacugggggagggggcacucugcucccaccaagccuguuaccccucuuuggcugccagaccuuaagaucugcaaaagacacaagggaaagcugccggaaccugggccaggcucagugagcagcacugcccucaccuacuccucccuggcagggcaagaucacaacguggggaagacaggugaggcucuuuagcagggaugcgagagaguuucaaggacaaggcagagagcaagcaagaagccaacgaguguccuuuaccugcaauauaggguucaucaaggggugcggugugcacagggagaguggcuggauccugccaugcaugauggagggccagugaacugcauaugaaaugugagaguuucccacaaugccuugcucuuucaccuacuuaagaaaucucagaugcuagcuagagggcugacugggaaaaagcacuugccuuuaaaucuaacaacccgaguucagucccugagacucguguaaaaagugugagaagagaacugagucgauaguccuuguccuuugaccggcacgcauguccugaugugcuuaccccagcccuccuaaaauaaaucaaaugaagaagaggagaaggaaaagaaaaggaagcaggagccucugcaucaaaauaguucauugcucucacccuuuugccuucuuuuccacuguuucaaacccaacacaaggguagguucuugggagcaggaagccccacagauuugcugaugcuucugcccacugaccgcgucugcacacaggaucagcaagaagcuggccaggucuucaccucagcuugcucaguagcucugcucgcuggaucccaggcucaugcuaaggaaugcuuagagguucuucuagaauucaaagucagguccagagccugugcaggcccagugugggcagaagucagcccucaugaaagcaaagcauacccacgggcaccacagaggagccugcacaagagccuggagaaccagggguuuuccugaaaugguuuugucucuguuuuccugaugaggaacgaaagccauggggcuucuacaacacaggggugcuagaguggacucgggcuggggaugucugagcagagcgcugagcuuaagucuuccaagaccuucaugucauaauagcagguaccaggcaaaggugaaaagaaugugacucccuugucaccagagccuguggggauuugagggguuacauacagauucuaaaugccccagaaaggauguuuaaucacaaugaugacaugacaugcacaauacccugaggugaaggagcagcuuuucaggguggccauguagggcugcaggaugaucccuaggacauacugugaccaucccaaguaaaggacacugaggcccagagaagagaccacaucugcccaagacagaagugauagaacacaaguucaaagucagaagguaaugagguucagcagacaccucagaagcuggccaggugccagaggccugggaggggcagccccgguguccaagccaugccaagaacaguacagaaaggccaaggcuuguggccuugggccccuucaagggaaaagaaugaaaugccaacauuccuuuguucaaaaacucaacuaucugaaggguggggaacaggguuggggaccaugcuuuuaacacucccuuuguuugcuaguggaaaauauauacaccaggagacccaaaguccccaaagcccagggcccugccugggaauguaguacaaaaggcccaggcauggcagaggccacccaaacgaagccuccugcagaugaaaacagcugacucaucccuguaggaaucacaacacagcuccugauggucccuagguuugcuuccuugaagccaaggagagggauucucaucuugugguagccugggacagaccuuccucuccccuggcuccuggcuauccaugaggccucaucccagucauuucagaggcgagaggccaccccugacugagcacccugaguuaggagcacaugcuuacagggagagugauauacucagggguuucuaaucaacuuccaugagcugugaggaugcccugaaaugcaaguucaugaguuaccccaaugccauuaacacaaggagauuaucugcaugcugggacuugcccaucuauugcucaugaguggccuguaacaagccaaagggggaagacuaagggaugaggucacacaagccacucacuccuaacacucacucccuuuugaggccacaaaagaacuauccacaagacacaucaagaucagaccaaccaaacugagcacagcucaaacuuccagcaacuagucaugagcucaacaaauaguacuugguuaaaaccaccauguuuggagaugauuguuacacacuaagagcuaacugauauauauuuuuugcuaucaacucaccuuuucauuugcauaauacauaaaugcauuuuucucugugugauaaagaauguuuuucccaaaauacauuaagaaaacuauaauuuucaaauaccuguacaucucucaacaggaaucccauggaagaaugauacauuuuccucaucugacaguuaaagaaacugaggcucaaagguaaaguagggggacuucccuacaaaaaucaaauagccguuuggcgguaaacuaggauucaacucuagcucguacaagacaaaggcacagaguguuuguucuacagcuguguguccuccuucccuccagaaacaggguaugccacaaucacagaggaagauacuguccccucuugaccugcccacaccacuccucccucccaagauguagccuuacucccagaacucgaugacgggugaggugaaguuggcagugcuaagggagacccagugacucucguuccuacgcaggguguccuccaugcacugugguguguuccagcuaugguugcagugggcccagggaagauccuucuggaaagaguggaauagguaguauguggcccaggccaggaugacgauguaguacacguucaggagggacacaaugacgauggaugcguagccaaugccugugggugggacaagcaaauagacacaugucacaaaggaggcacuuucaacuggggaggcacugaugugcccagucugugggacaaaggggccaucucaacaguaagcaggagagagucgcaggaugaaggagcaacuggauaaagggacaaguggcugaaugguuagagaaauggcagcuggaggagucacaggaugaauggaagaaguggggucaggacacugacugugcaguuggaugguuggauggaaacaugcauggagagauagaugaaaaaauagaugggccaauauauaaauagauggguagaaauaugaaugaaugaaugaaugaaugaaugaaaccuuggauggauaggaauauggaaagauggguagaugaagagaaagauggaggaagaauggauggauagacagauggauggauggauagauggaaagauggauggaaauauagauggacagauggaugguagauggauagaaauauggaugaauagaaacuugaauggauagaaauauggaaagauggguggaugaauagagagauggauggauggauggauggguggauggaugaaugguagguggauagaaauauagaagaaugaauggauggacacaugaauggauagauuugcuaucauucugucuucacaguaacuccauagagugagaauauugcuuucuagaugaagaaauugaggcucaauaacuucccuaaaaccaccccaaggagaaggaagcaaggccugaaccccagaucuccaggcuccugcauccuaagacagcagccagcucacucauccaaacacccacaaagaccccaaggggacuuucuaaauagucaggaaccugcuguaucucccuuccuuccccaugcuccccagugucggugacagacaacaugagcugcccuggaucuggcacugauauaggcaaggucugauaaacccaaaagauaaaaaacccacuuaaaaaaaucuggcagucccaaugcauacagacccuggugacuccagccacauacucaccagagaacaaaggacagaucuucucccagcaggugaugcccccuucugauguguacuggccuaugaugaccuccaagaaaaacacaggcaggccgcucccaaacaggaaaauaaaauacgguaugaggaacgcaccugccaaugagcaaaggagagagggugaggcugugucugucacggcauggcuggugaggugcucacucccaagcccucccaagcaaagguaucaggaguuagggaugcaagcacagaggccaaacucggacucugcugaagauccuccaggccugccuacccaucccacccacuaaucuguaaaucuaccaguuucuucaagccaucaggcugaugccuaugccugccaccugucugccuucuccccaguauccuucccaacagagguugcuuggucugcuagacccagauucagcacuaccuccugguuggagcuucacccaucugccacaggcuagccuggguuggcagccaggaaaguccagaagcagguuggguggaaggcaggagguggcuaucuccaacugguggugggugccagggggaggaagugagcaaaguaucuggagagggugguccuaccuguuguacacuaauggcuucagcgggagaacaaaccaugugaaauugugggcaccuugggucuaggcuaucugccuuguucugggaagcaucuaagacacucaucagaguucccagggggucugauaccuacaagaggucaagaaaccaagcacuaagagaggguucuucaaaaaaugccucucuuucuagggcagcagggaguaugccugccuuuacacucauguggcaggugggugccaccuacauucuuccucucuggucccacucugcaccagccucuaaguaccagucucuaagcugcuacuuccucaccuggacaccccagagggcucucucagagacccuagcaggaggagauacaacacacacacaaauccaaacccaaacccaacaaaccaacccaccacagcuagaacauggauguccuuugucccccuuccccuuugcauuaauggcaaaugauaauggugugccacuuacagaaagagacauaacuagcuuuggggaauacauagggugaggucaaaaagcaaaaaucgguaucaaagauggcaaaagggaaggcuuggaggcucucagagaugacgaaauacaggaauggagaucaugaacaucugaacaucugaggcugaggggccaugggucagacagggcaaaccagaggaucagagagggugagggaggguccuccaaaagguaacacagcuggaggcuggcacaacgccaugcucucaggcaugcugacccugugucugagguacaucugggcaggguauaccuggacugggaaaggacacagacuaguaaaagaucucucacccucugaccccaggcuucaauaugacccagccucaccuccaccauuuuuguagcagagguacgggaaacgccagacguugcccaaacccacgaagccuccggccacagacagcacaaagucgaucuugcuggaccacuucucccucugagggggcuucccguccgccucaucuucaggccgugugccugggcucuucccuggagaaggcuucaggaugucuuuguggaagucuuucagacauugcagcuucuccuucguggccaucucuucguuuucuguuggaggaagaacaacaugaaugagaaggccuuccccagugacuuaagaccaguuccaaccuccccaggcuucagugggagccugucacuccaucagucuccaucaaagaagccagcuagaucccaaggauuucaauauucagcucugaaacaccugcaaccuauagaggcaaccggcuucguuucucaggcaccagcuaaaccggaagcccuggugucccaggauugucauccucaaacaccagccuguguacccuggacaguuccuccucuuccaaaggcgagagagagccugucugcagcucuccacacugacagacauuuuucugauuugaagucugcacaaaaaaaccagcaacucacgucuuagugacaccucagugcagaaccuaguauggagcccggccuacaggaggcaccugcucccggcugaagaagugaagcaaagaaguuaggauuccacaggacacaguacugggaaaacaggcuucaccauuagaguauagaaaauggacaguuacagaaugguuuuguagcaggaaaaaaaaaagucuuucuuauacagaaucauacaaggauguuuguggcagccgaggauacaacgcaggggccacucaaguguggaauggguaaggaaagccugggucccaugcccagacugugaaccagggcuugauauuuaguauccauucuucagucccgcugauuccaggcuaaacacauggauccuagcaaguaggggucuugcucucuggcaccagcuagucucagacauaaggagccccuggcacacaguuuaggguccccucaugcaccuccugcuuggaccccacucuggauggaggguugcacuagcugauacucaccaucuucuccuagcaucuccuugugucucugaagcuuagcugagaggcaguauccucccacccagugguggucaccauccauccaugccaucaaagaacacauaaagauaaccacacacauuagagcccugugccaagucagggcccugugugcacagacauacacacagcauggcacagggccgcaggauaaggcuggcccaggggcacccagagcuaguggcccuuccugcucuauucugaaccucgguuucccuaucugcaaaauaaaaaagagcgacagugaagguagccacauagccuaggacaucuuucauuugucuuuaucaucugagcagggaggcaacacugaaguaucagauuuuggagaaaaaaauggaaaaucugaaguucucuuacaaaacuggaaggucagagcacacaggaucuguguucuucaucugagcagcgacuggcgugcaugcagggcacgcuguucccagagcaugcccucugggagaguaccuucaccugcuuggcugcauuugucuugccacagccaacccuaccugaacaggaacucagcugcugucuuccccacagccagcccguaggcuuguggagagaaggaagcccggcacacaguaggacaacagaaccucagcuccaagggggauauggugaggccuugcgcuaagucucagugugucugacggagacauuaaaguacacaggaaugacauaccaggucccuggggagugggggugcgcaauaacuuugcuucccccacgccuccuuccucucacuggcuggcuuggggugggggaccccaauuguuucacuaucugguaguaagcagaccaagaaaggcuuccuggagccacugggcagaccccggaguccuuccucugucugggggagcauccgcauggccuuucucugcggcuccccgggggccucauggcucugcaggucuguggccacugugaaaacagcucgggcagccagcauuguuccugcagcaggucagcagaccccgaugguuaucucaacagcucauuguggccuguggugggcgcauaauuggaggaugugggacuccgcucccucccagggaaggguccgcucaagaaugaccuggagccuccaacagagaagggcugauccacccuuuggacacgucucaguccuugagacuuuacaaggucagccuagccuuuaaacuuaagaggagggggaggggagggggagaggaaagggagggggaggaggagaaggaggagggggggaggaggaggaggagaaggaggaggggggaggaggaggaggaggaggagggcagccuccagcacuagggagagauggaugggagugggacaagucuccucaccucacugucagcuauuggccaaggcugguccuauaagaagccauauucugaugcccuauggccugcugcccugacagcccagguccuggccuuuagacccacaaacaagucugaucucagagaacccagagaauagaggauucccaaagaccccugugucuagacugauuugcuacauaagaaaucuaucccuggauacucucgggccuccaucuaucaucaugucacccgagacugaaccaugguggcuggggccugagugagacagcgcagugucuguccuguggcuggcacugggaggucuucauggggacaccuuagucacucgggugcauccagaagucugauccuucuucaccauccuaccugugagagugugguucaaacccauuugccuuuggagaacucagggcucagugguccugccucagcaucaccucccacccucaggcuggcuagaaaucacagggcuacugucguggggggcagggcaccacccaggcucuggacuuuccuggauccagagaagguccugcagagacacaggcacccugcccuuuuuccucuuacauucuuauuccaagauugucgcgugugccugaccagcggcccugcgauauaccauuccagcagcaagaccugcagauccacucugcacauucuuggcauccacccccacuucccugucaccauggcaaccucucucucucucucucucucucucucucucucucucucucucucucucucucagccagcagccccuagcgcaggcaucuacagcagccuccucauaggucuccuugcugcucugcugcccccagucuauucucgugcaacagcugaaggcagcuuagaaaucacauucagaauggacccccagcucucucgguucauugcuagagggaaacccaaggccucuccccacccccugguccuucgaggucucaagcaaacccuuagacccccauccccccuuguggaucacuggccccacaggagugcuguagcuccucucacacccuaugcccccugaagggaacaugagacuugacaaaggagcugagagccacuuagaagggcugaacgaccuuaggcaacuucucagccucucuggucuucaauguucucaucuguggagcaguagugccugucaugggguacagaggaagaaaugagggggugcagagaauagcucagaacagcaaauggcauguagcaagcacacccuaaaauaauagcuagugucacuguggauaaggccuucucuauccacucagggagaaaugagaaaggcuccgcuaacucugaauccaggucacuggaaugagcugguaucacacagacccugagucugccucugccagcccucugcuggcucagacugaauucuugagacauccucccuaggguccacccuuuacagacucacacuuagaccaguccacccccauagugaucaaguggccacagcacagugcagugaggcccuuucacaccaucugcuugcagccugcuucuccaagccaggagcuguuuucucuuggcucagggccugccugggguuguucugcagugguguagaucccuaauucucauucugggagcguccucgugguuaccacagcuacaggugauuagaaugcauggaguuauaagcuccagggcuaagugucccuccccauacugaaaacacugucccuuuuccagggguggcaagccagauguagcugugccugaaugcuggcuugcgugaagaucacugacaaguuuugccacauacacagucagguugaccccggggccagugacaucagccagauguacuuuuguacccucuggccagguuaaaaacaucagauguuuuuagcacgcaggcuaaccuauuucagaacuguuucccauucugucauucuuuggaggacaggaagggaggugugcugagggggaagacagggucucaugugucccagguuggccuugaauucacucauagcaaagaugaccuugaacaucugaucccccuuccugccuccaccuuucccuuugcagugcuggaauuacaggccagcaccaucaccccugggcuuaugcaguucugagguuugaaccaaaggccuggcacaugccaggcaaacgcucuaccacugagcugcuccacagcgcacagagacuucuaaaguguucccacacaacagaagcagauggguggauaggaaaaugguagccugccccaggcuacacacaggggccagggcagauggagccagaauccccaucuugcuucaugccuacagcagaguacagaucagaagagucuauugaacauacauagggcugcugggucagagaaguggcccugucagaugcagagcucacagacucgggacucagagacagcugcugcccacuucccucccagagccugucuagucccuguggcccucagacauccauguaccagccaggcaggucuugaaguugauuaaaacugccccucccuccccaguauuugccucuauacucuaagacaaagaggcaccaagucccagcucccagaguuagcacaccccugcagaaccuugaucaccucaaagaaaagacccccaauagaaaugauuaacaucuuaucaaugguaucucuuaucaaggagucaggcaugggucugcuuccucuugugcuuauucccagcccaccccagugccuagcacacagcauguccccacaaagagcuuagugagagacagggcuggcgcucagggagagagccucugcaggaggaacaagauguucuguguacagugugagcgugugagcaucucucaaaacugggacaggagaugggucccucaaccauugcacacacagagacaccuuagccuggaggucuccugcagaggggagccuguggcuagaucccuuuguagugucugcuccagagaagagccauaaagaugagugacccagggcaaggagcagccucucugugcuccacuucccucacuggaauauacuugaauaauaauaauaauaauaauaauaauaauaauaauaaauauauuugaaaacugucaagagaguuauagauuuaguguucucuccagacuguaaguaguuaagacaguugguuuaagccacuucauuacagauaugcaucuuaaaaccucauguucaguuggagagauggcucagaaguuaaagcacuugcugcucuuccagaagacccagguucaguucccaggaccuacaagguagcucagagccauccauaaaacucuaguucugggggggucugauauccucucuagauuuccuggcacugcacacaugugguacacagucguauauucagucuaaauauuuguauauauaaaauaaaacauuaaaauuacauguugcacauacauuguacauaaauacauacaauuguugccccaauuuuaauaaaucauaagccaggcgugguggcacacacuugcaaccccagcacccgggaggcugaagcaguaggauugccagcaacgugagcuacauggugagcagcuuauacuacaaagcaugacccugucugaaaacaaaaauaacuaaacaaauacagagaguggagagauggcucaauggcuaagagcaucagggcuugauucccagcauccacaugguagcucacaacuaucuguaacuucaguuccaaggaaucuaaugcucuccucucgccucagugggcaugaggcacaccagacaugcaggcaaaacacucauccauguaaaaaaaaaaaaaaaaauauuauuauaaagggacagaaagaccugcacauaauggugcccacauguucccucggcacuacgcaaaggucccucaggcaaucuuuuaacucccuccaaaccugccucaucaccuuacugaugacaccacccagagaggugaagucacuuggucauggccacacgaugccuacccgagcugugaauagcuccuagguccauccaaaccuccaaagccauguccucaaccacuugugacaguuauggaugucaucucuacaacuucacaaguaaaauagagccuggugccuuuaagaagccagcuacagggcuggagggacggcucagugguuaagaacauuuacugcucuuccagaggaugcuaguucagucucagcaccuacgugauagcucacuaccuguaacuccaguccccaggcgauccgacacccacucuggccagcaugugguacagacaugcaugcagacaaaauacccauacccauaaaauaaaauuaaauaaacucuuugaauaaagaagaaggagaggaggaagaggaagaagaggaagagaaggagaaggaggaggucagcuacaggcugaugagauggcucaaugggcaaacguguuucacaacaauuccuagaacccacacgaugggauugaccugacuccaaaagguuguccucuaaccuucacacagccagugugauucgugcacacacaaacccauacacacucaauaaauauaauuuuuagaaaaaaaauaaaaaauaaagacaagccacgggaccagcugacagauuggggaaccaaacucaaggacaaacagggaagugaagggccacaugacaugacaggcuggaccaggggucaugggacuguguugugggcacagauaaaacaccagugugcacaggggccugcuucugucagcaagaacaucucacagaucagaaaggguucguuguuacagucucuacagacuaauaaauacauccaggugcaaagagcaggagggcugggauccauuaguaaugucugaguaggagggcugugaucuacuagaauggucugucaaggguaugcuguucugcucauguuccauucuuggcccuuagaaguguuuugcaagcucacugaauccagugagccgaguuaacaaugcagcucugcccuuuaagcaguguaaaugcuucuguaaagggaacuuaagagccagguaaucucagcuuuuaggaggaaacuucaggaucaggaguucaaggucagccucagcuacauaguaaaauucagguuagccugggcuacaugagacuggcuaaaaaggaggagaaauuaauuuuuaaagccuuuguuuuucuguuuaaguacacacaccuuuaacagauuuaaucauuuaauugaaucauaaaauggccuucaucuuuugguuaucuauuugugcaacgaggcuaagucaagugugacaacugaaccaucuccaggggucuggcaggcaaaggcagaaaagaggagcagggaaaauggacaccucuagguucccaacaccaaaggcgccucugggacugggaucccccgagaccauauccucugaggugucuuaagagaucuggacugccagguggugguggcgcacgucuuuagucccagcacucgggaggcagaggcaggccgauucugaguucgaggccagccuggucuacagagugaguuccaggacagccagggcuauacagagaagcccugucucgaaaaaccaaaaaauaaagagagagagagagagagagagagagagagagagagagagagagagagagaucgagaucuggacuacacagauuuauuucucaauuucucuagcacauugucuucuaaacacaaagaaaaagggugugugugugugugugugugugugugugugugugacccagucugggucccucgagguccacuucaaucaggccacagcccagcgcagucaucauaaccccagugaaggcagggcgaggcuugucaggauauauauacuuggcucuuuggcuugagccacaagggcuuguccccaugaggucaaccaggaagcuggcgauuucacuagccagaagcagagcacaaaacaaugagcagccuugcucucaucugagugaaagugaacuugcauuaucucagcuuuccaucuccggacggggugccugucuaccugggacuccgcaucccacuccugagccggcugcagccccacccucugaagccugaggcucagagcagggacacucuugccccaaauucucaggauuuauacccagaauccaggacacuggggucccccaggacaccagagaaccuccagauggaaccugaaaaauugaauaauaucuuuuaccagcuuauggggccgagaagaucagcgauaugaauucuguuuacagcgacgcacacagcuggaaucuauauccagaugguacaugcuuuccaccacacugccaucaagcugagaccuaucuaaaagaucuugggggaauagaguucugaggggaggggaaagaauacacaaagacagucauacuaggaucugaaggggugguucggcagugaagaauaccagagguagauagauagauagauagauagauagauagauagauagauagauagacagauaaguagauagauagauagauagacagauaaauacagauagauaucuccaggcauaguaguaugcccuuuuaauuucagcacucgggaggcagaggcagguggaucucuaugaguuugaggcaaggcuguucuacauaucaaguuccaguccagacagagcuacauagugaaacccugucucaaaaauacaaacaagggccaggcaguuguggugcacgccuuuaaucccagaacuugggaggcauaggcaggcggauuucugaguucgaggccagccuggucuacagagugaguuccaggacagccagggcuacacagagaaacccugucucgaaaagccaaacaaacaaacaaacaaacaaacaaauaggacuuaaaagacaguuaaacuagaccuggcaacuaaacagguagcccgaggauuccaguaggcuagguuuaaacuuagguuuauccugagugccccaccauuccacuaaggggugaaaacccuuucaucuacaagucccuggcuagcccuccuuccagcucagaaagugagucugaagggccuacuugggguguuaugugaccuucuggucauuugaccccaacacccuggggcuacacucuggcccccugagcagagcuacucuggggaugggugucuggcagcugcuuugugugcaaaggaccaauggguagcugaccuuccuaaggcccaccacuggugauauagggaagacagugucugucagcacagggcuagcaccagacuccagaggugaagccaaaacacagggccacccuucuacaaaacaugacuccaggccuggcucagaggagcaguucucccggguggcaggagauggcugugugaaacaaagccccaucugucacuugccugucaucuacuuguuuggucugguuauggggucauccuauuguuuccuaggaucagagacagugggaaagcaaaaauugugggaaguucauaggaaagacaggaggggcuuccaaaguaagaagaggcugcaaaggggagguacauaaaagaucccuccccucugagcuggacgcccagagccgaggcugggggcugggggaguaaggccuggccaccaaauguuauucgggcagaccuccggcuuguaguaacaaagcuaggcaggagggagagggggaggggagagaagaaggaaaggagggcaagaaggaggggagaggcagaggaggaggagaguggaggaaggagggaagaaaagaggggggaacugaucggggagggagaagaaggaagaaaggagacaugacugcacccuggugucuccagggugcucagggccugucuuagaagcagggccggggugugugcaacuggagauuguguacacaaagcuucagagacgccucgcccagcuccugaccuggccagccaccugucgccuuuaaugccuagguggacaagcucuaggcuccaaaggggcaacucagucccucccccuuuuccccuccuccucuccccucccccucagcugaggagccaggggagggugagucagcagggccccggcuccuggcacugacucacccggccacagggcugucauucacuuccagcagugucacuuccccagcaccagggcuacaggguccugggcaggcgcuguggaggccgggacuacuccuggaggcggcuaccacguccacaaacuucccccuuugcaagcuacagaaacccaaggcugcacugcaccuguguaugaaagggaagcagagcccuuuugucuuccucucucugcagaaaugcaagagaagucccaagaguuagccaagccaccuugugaccccuccacacugccgggccccuaauguuaucauuggugcugucugaagcccuggcuucauggagagcaggcagugcacucugcucugugaccucaggcgagucacugccccugggccucagccuuacccucuaugcagugaguacaaugucugggugauauuuuaaauguacccuucccugcaguguuccucuuuuaaugcuucuuuuucccccacaggaaggacguccuuccucccucacaccaaggcccaaucaaucaaucaaucaaucagacuguggaccuaaaagcauggcauccucuacccagauccauccucuguucugaacaaaggagacacugugccugcuuccucacccuucccccuagaagaccuccaaaggcugcugucucacaccccacaccuuggcuccagagugcccuugauggggaacacuaguccauccaagaguaaugaacagaacccucaccaggcugugacaggcagccucuggggugauggccucauggccucucucaccacaccaccagccugagcucagcagucuaucacuggccccuuccacugagaguccuagcugcuuccagacaucaaucacaguaaacacaucaaagaguguugaggggccugcagauguucagggcaggcaugcgcugcagagccacagggcaaagcacagacagacagacagacagacaccuagaauaugcuugaaagagaggagggaugaccugaaccuguucccggccacagagcacaacuuccccaagaagaugaacagucuuuuuuguuguuuuggagagccccaaaucuucgcuuccauuucuaucacacaaugcauccccugagcggugcgcucucuggaugauucuguggugaacgugcuguggucuuuccccaaagguuucucaaggaccagggacuucccuuggaagcugcaugguagggccacagaagugcauucagaugcaaucccacucugugggggaggaaaccaagaccaaggcccuaccacacucuaucacggacauggauggccacaggagacgugcuccagagagggagccugagggagguaggggaguggggacacuccuaacacucccacccuguggauacaguaggcaccagaggcagagaguaaacuccuauggcaaaccugggugcacgggagucauaucuaacucugucaggcugacggacguuggugcagcggguggcggugguagcggcuuccagggcuacaagauggugccuaacaccagcuacugcuuggcuagaagaaaaacucagcguuaaaauccacacggggaguaucaggagguugacacagucagcugugucuuccccaugcacagggcaucucccagagcaacccccacaucugucucuccaccguaagcccagguaagcucuugggaugcccaacgaggcccagcacacacccugccucaucaaaccuucuauuugcuaggggcugcacucugguucagaacugggaaaguuugggcaaaguuucaagaucaguuugagaaaccucaguuucuuuuucuuucuuuuuguuuuuguuuuguuguugguggcggugguggugguguuuuguuuuguuuuguuuugacacauggucucauuguguaguccuagcaggcccagaacucaucauauaaaccaggcuggccuugaacucagagagcuccaucugcuucuaucacuuccagccagccagcucuuggccugauagucuguagaacccagagacaaaucuagaguguaaguaccuagacccaucuggaccuauugacucaaaucuuuaagguggagcccggaaaucucacccguuacauccgcuucccaggagucuuaaaaucaagaaacgcagggaagggcagggcugggaccugggaggcacuggauaaaaugucaaacaaaacugaccaguggaagagccguugguuggcugaugcagugcauuugugccagccugcauacacugggggccuagcaaaggcagaggccuuucagaggccuucaaaggcugcuccucgccacacccacuccuuuuauuuuacaaagagagacaaucaggcuuagggaagacucgggcccuggucccagguaaccagguaagcuuccaauucuagacaaggccaaaacacuuaacugggaggaguuuaagagacaaaggcgagggcugguggugugacuuuggaggucugccugucugaaccaaacacaaagugucccugccacacccaagugcagugggcagccuuggauucagaagguccgccugggcugguauccugggaggggcacaaauuagccagcuuagccccuuuuuguuuuuuuuggcuuuugacuuuuucagagagacaggguuucucuggguagcccuggcuguccuggaacucacuuugcaggcuagccucuuacagcaccaugccacaggggcagucugggauuuguaagaaaggggugaaaacagaauauucccaaccagagaaauaccugccauggaagcuaacaguaaggagaccuugaaggccucagucuccacugcugaggccagacugucugucacuggagcgagguuugaaucagcuggcuggggaaccccacaaccuggagcuauaaugccucgcuguuccucacacacacaggcacaacacauggagagagagagagagagagggagagagagagagaaagagagagagagagcucacaaugcagucucuagagaacagcccuguuuaguagcacuguugggauuaggugagcccuggcacugcagggucuucagagccccagcugacaagacaaugacaaaagugacugacauucucccuaaaccucuggcagucaggacuugggcacaguccugcugaguguccauuuagaugccaagaaccacugggacucaaacauggaauguuaucccaccuccuccccugccccuccuuggccccucccuccucuccuacaucagucauuuucaaggggcugcccuuuguggggggggggggggggcugaggacaguagugaucacugcuucugacucuugucuuccggaggauuuuugccccauggcuguguaggcugauggccaguguccaucggggacaaagccuucaccagcugguacuauuugggggggcagaauccccugccuucuagcaucacaguccuuucuuuuuuccccccugcugugcuggggaugguagcccagggcuucaaaugcuagguacuuggccacugagaugcaccccagcccauucguaauguuuugcuauuaaaauguuuccuuuuuuuacaucauggugaaaaauaacuuugcuauuuaaaaaaaaaaaaaaaauagccgggcgugguggcgcacgccuuuaaucccagcacucaggaggcagaggcaggcggauuucugaguuugaggccagccuggucuacaaagugaguuccaggacagucagggcuauaaagagaaacccugucucgaaaaaccaaaaaaaaaaaaaaaaaaaaaaaaaaaucuccaugggcugaagaguuuagagccugauaguuuagagcuuauagaguuuauagucugauaguuuagagcacuuucuguucuugcagaggauuagagugugguggcucccaaccaucuggaacuccagguccaggggaaccagugcccucuucuggccucuaugggcacugcauccauguggugcacauacuauauacauauauguguguauguguguguguguguguauauauauauauauauauauauacacacacacacauauauauacauaugugugugugugugcacacauucaauaaaccguaaaaaauaauccccaucaggggcuuagccaguagcaguaugugcauagccucugguuccaucuguccucagcacaacacugagagagacagagacagacagggagacagagagugagcgaaggagagauggaaagagaggcgagggaaagggagagacaaagagagggaguagagggggagagagggguaagagggagaaagggggaagagagagagugcgcgcacaagagaaauaugaugucucuuaguggagcuaaagccagaaagggagaccuccuccaaccucuaaucaccauggcagcccugacaauucacagagggauauacucccaggcaccugauauauuucuggcccuccuccaucuucaaugcuaccuccucagggaagcccucccuacccagccuacacccaucucccagcgaugaggcucugguuccccagcuguaauccugaaccuucuuggguagccucagauugcuuucuguaccaggcgggggcugggucugccccaggugcacugagaaagaccuggguuugccguagucauagcaacccuuuguuccucuaauuccaacuguuuuccuaugguugaaauaauaacugcagcugacauguggccacacagcucugggugcuuuauauaauuccaccuaauagcaguuguuuuuaaucaggcuaaauauuucccuucuucccuuaaauccuucuccagugauugccgccgcucacuuaucuccuaauuaguccaaagguaaugagacgucagagcaucuuagccugcaggaacaaaagcacucuggaaaugucauaugcacaccaagagacacccaccugcucagccaauacaugccaggaugcccagcuggcucucgguacccaacccucaccagccagcgagaugagagccauugccccacuuuguagaugcccaaccaaggcucaagagguuaagccgcuugaccaagguuuacgcaagcaggaagaaacacacucuggagucuuggaucccuaacugcugagcucaggacuguuuccagguuaucgccuuuaauaccacaaaguccuaaccccuucaacuuggcaugggaagguacugacaguggcaaaagguagagggaacacugugcaaaauaaacccuccuccaccaaauuaagagcccucaucuucagaucuaacccaaaccauaauugccuucacaggccggaugcagccgcguggcggggcagcuauguggcagauggcagugacagcagcaacagacaugccacacgggccuugcuaaguguuuuucaggugagcgucagggagaccagcuguaauugcuaaaugccaaccccuccagcuaagagaaagggcucuuuuuuuucacccauuaaguucaaccaggaggccaaaguccagggaacagauacucuccagugacuaucauugguggagacagccaacuccagggucuaucccagugcaagccauuucuacaagcugauggcuccuccccacccccugccugccccagcagcgcucccgccccucaccuuuccugagcugucauucucaagggcucaucacucagacagacuccagagucccacccucugaaacccaaagcuuaaucagcuuaguuaucauguauacagccugggccacccaaaaaaaggucuccuuuuucuccguggggcaaggauaccugugauucaggccaccgcuauaaauagccccuaacuccauccuuuuuaauugacucgucuauuuauuuggucaaggaguuccuucugaccuccccccacccccaccccguggccgaguucuacauuaauacuggugucacgugacuggugacuggaaaggagggucccuccccuggcuucugcagccuuauucucugaaguccauagcggaagacaccuccuucugagaaucuggucccuaaaucuacuggccuccucugcugcuucaccuagauuuugauuggaauuuuaaugggucacugcugaccucaggaccuuggcuucucccagagggccucaguagcaccaucuacuaaauggaccaucucaaauuacacaagguaaggcuggaggaagggcugcagcacaggaucagauuugcuccaggagacguaacacacccucugccccccccccgcccccguccccgcccccccaagaccaaccagcuuuuauuucaugagcuuuucaaacaaacacuaacccugaccaggccccucucaacuccaccaaaggaagaaacaaagccagagcugguggugugucccucggggacaacaccagaucuucugguucuccaucacguguaaaacaggagcucuggcaaauugguucgcuauggccaacccccaagcccuguggaaugucugacuaggugagacuuagcauuucucccagaaccuccagccacugugcuggggugagagaccagcugugcccuuucccucacagaugcccaucgcccaaaccuuauagccccuacuuggagcuacagaauauggccacugauccccaggggucugguuccccuaaguggaucaagaucaacgcccgcccggacaugacaaguggcucugaggucaccaggugacagucucuucuccacuccccuuccccgccccugcugagaagaaaggccaggcuaagacuuggcuuccugaaagucgcucaucacuuucacucucggccacgucaagcguuuagacacacugcuuccucucuggguaaugcucuuccgggcuucugcccaccuguugcuuaagaccuccagaaauggugugaguguccagagcaucccuacagggaugagucucagugcuggaguguuugccuggcugugggcaagcccugguuuccauuccuagcgcaugugcacaggcacacguaacaagauagcuucagacucccauggcccugggaaucuccaggcugggggggggggggguugucugucacucaccucugaaucccugggacacaggagggacugaaacacugagaaggugacuacauuuguuucuugagacagucucguguagcugaggcuggccuccauuucacugugaagcugaggguagcugugagcucugcaccaccucccaggagcugggagagcaaacaaacacgcccacagcagcaaaaguccacagcuuuugauggcugaugaccagacuuucgauucucacuuuucauaugcuucagagaguuucccccaaacuuccccugccaccaagcacucuugccagcccuggucuuucccggggauggcaaagcuggaaacauaaaaggguaaacuuucucaaagacugggaaggacaaaggcuaagggaaggucaagauccugccccaagcagaucaggucagaagcugaggugacauuucuccuuguccauaggacccaggcaucagucagccuggaaaaggccacucucuaagaguugcgugugguggcucauaacuauaauaccagcagucaggaagaugaggcaggaggaucacuguaaguucccaagucaaccaaagcuacacagugggacccuauuucaaaagccaagaaagaaggccacucugguucugucucuuuuaggaugacaugucccuaaaugucugguuuauuacauguggcaaccuccccgcuacccccagcuauguccugugaccaugauuugacagaugcauuaauaagaggcacuugcuuuuaaaguuaccuaacucagcugggcagugauggugcacgccuuuaaucccagcacuuaagaaucagaggcagguggauuucugaguuugaggccagccuggucuacagagugaguuccaggacagccagggcuauacagagaaacccugucuugaaaaaccaaacaacaacaacaaaaaacuaccaaacucaggggcugaauuaaaaccacuugccguucuugcaaaggacucacggaguggcuuacagagugauacaugugaauucucacggagucagugcccuguauuuuaccuggcaagccuauccagugucccaaaggaucccugugucauucacaccccagcacaaaacacaaagcauaguauaaugugagaguuugaauacucaggcugccuggugugaaaaucaagguguccacccacccuccuuccccagguccccccuucucuucuucccacccccaugaagccucuuuccugcuggcuauggagaccuuuugaaguccucugggauuucccucuucagguaucuauuacacaaaugauaugcauuccaccuucugcuagccugcuccccugacagacauuacuaaucgauuguggcauucuucccacaagacaagagaaagcucuguaagaggaaugauuaagggccccagauaaaaacugguguuagaaaacagcaagaacaagaagagggaugaagggcaagggugcagggaugguugagaguugagggauaacccuggagguaaagauuuagccugggaaacaauggacagaggaaugccagccaaaacaagagugggauugggagcugugacacacagacgugucccacaaagccaagcugggguugagcagggacugggaccugggcaggaucaguguuuccuuguguuccacagaugucacaggacacgugguuuacagaccggagcacuuagcacaaagaggggaggagccuuguaccagugcaugaagccccuaaguaaaggugcggcuuuugucuggucauugugaccccaaaagccuaucuggaaacaugugacccaccuccucuguuuucauggggaaaagaagcccagagagguagagcagcugccuaaggccugauaaagacaccauagaggaucuccugcaggggugucugaagccagcucccucugcagaccaggcugauaauaaauaggugaacaaguagaaauaccauccacagacuucuuucaagaguggagagcaucucugaucuccaagagauuguuuguuccugaagagaccuuguccuugacagaauuccuguuugagcccugcugaaaucaagcaccaggacuaagaagcuuuaccuggggcaccgucauagaggcccaagcuuucuggucacaaauauggccaggauagaugaccugccagucagcccuggcauuugugaggaagcccaugccaugucccagcauagaaaacaagagccagagaucgucacugccuucuggggccucaguuuucccaccaguggcauggggcaguaagagcuaucuuagaugacuaugggagugccaaaugcagaaagcauugugaaaucuagagcucuggcuguguguccuggcuuaccugaaacaguagagcccaaucauaccaggagcaggaagguguagcaaugacagcuacuguuuauugagcaaacuauaugccugucacuauaccaaaaacuuuugguuuuucuuuccugacccucccagaaggcugcaaugcaugacuucaugcccauuuugacaacggccauaugugguaagaccggauuaggggucacuagaggguagaguuugguuuuaauuucccaguguugauggguuuuugguuucguuuuucugggauuuucuagucuucucccaaugagaagggauggguaaggacaggucuaggugugauauuuuaauuucuuucucugaggccccaaaggcagaggugucccuagagcagggcugccacuuccuccuaguaccccaaagcugucacugaugucaaagaguaugcucucuagagaaccagagauucaacauugggagucuguacaucuuuaaaauggguagcccaguguagaagugcaucuaaguagcagaaucugaggcgagcacgcacccugggucccauccccauguggggaagggaaagacuuguacauugcaucaagguguacgauauggccaugugcagguauggucggggcaucagacagaaagcccagagcuggcuccugggguggggggcacugucaccccuacugagcccugaaggcagagugucuacaguggggcucaggugagucucagaguggaucacgugcccagccugcugacgccccauuccauuccuagcacccagcccccucccaagagugacaaucaauuaauuacacauuauauauaguuuauugcaauaaaaaaauagaagcagggcauuguucacuguggaguguuuuauuggcgagcguaacuaaaaacaaguucucacuuggggauuaaauaaaugcuuuccucaagagcccuggaacucucuauguagcccagaccagcuuccacuuauaguuauccuccugccucagguuccaaagucugggaucauagacaugugucaccacuccgggaucacuuuguuauuuuuuguuguuauuguuuaaauucaaagaggacaguuuuguuagagauuaaagaaaauuccccaaggccggcaagcuauaaaucauaaaucugagugagugacugcuuccaagaugggaauagagacugggggucuggaagccagagggguaggguggggagguggaggcagucuguuuaagauaagcugguuagcuaguuaaugguggucccagcaccucaggaggcugaggcagaggaagggcuagagcaagugaguuucagcccagcccagacaacacagcaagauuccagaucuuuaucuuuugguuuggcuuggugugguuuuucuagauaggguuucucuggucucuauagaccaggcugggcucaaacucagagagaucugccugccucugccaccauggccugccuucagaucuuuuaucuuuuaaaaaacaacaacaacaacaacaacaacaacaacaacaacaaaaaccuaaauaaccaaacaacccagggucuuauucugcaacccuaacuggccuuaaauuccuaagcuaaauagagccugggcuagaaagaccuccaugccucagcccgccugugggaggaugacagacauguuccaccaggaucagcuuauggacucauaugugaaugcacacaccacuccauuauacuguggucaccucuguguggugggacccuuaucucuguauugaaaacaugacuuuuauagucagaguaaacaugauaaguaagcauuuucucaccguggaggccuccagggagcaggacaucgguauccacaggcaagcaggaguaccuagcaaccuaaaggacaagcacccuagagaacagcacccugggagguagacuugccucuucaaucgaggggaugcagccucucuagggacuccuucgaugagucuugugcuugcuacucagguuaguuguccugagcccauaaaacuccccuggacucaucacguguccaugucaccuguucugccaacccccguccugcaguguacugcagcucucuuggcuggauauaacuacuccauuauagagguuagagugugaggcucagagauguuuagugacucccuucagggucacacauccugcauaggcuggggcugggcuaagagcuuuuuuguauuguagagaaagcacuccaggcauuacaaagggccacagagccacaucccagcccccagacuuggaaugaauucagaccugccuuaaggcuaaaaagauagaucuagcccuucucgggccccaggaauaugugggagugggccacacccagaacucagacagcguaucaucccugcauaauauacucccugcaaaccccauugaccuccacauagaggguggaggggaggccaugagucuuuucagaaacggcaagccaggagggcuacacaagagugauguggggcagucugagggccaaagcacccuccuagguagccuggugugcagcuggaaucagcgcugaagaggaacagcauggucgccaucuaugcucugccuaggacguugccaggccccguggggccagucacuugcacaagacucuuuaucuagaaacaaaacucacauuccagccucagagugagcaguggccucccuggcucccacuauccuuggcugcucauuaaccaguagcaggaagaccuuggaaaagggaagucgcuggggauggaaggggcuccccaccuaucaggagggcaguugccaccaagcgggcaccagauuugggcaagugaguucgugguugugagaacuugggaggucccccuaagucucaguuucccagucugcacaauggugcuggcuaacaguacuuacgagacaacggcacucaaagucugcauccaagcugcugagggaugcggccuugccuggcacucaguaagcauuccaccuguucaucugccauuuuuacugaaagaacaagaacuccuaccuccugcagcuuagcucuugaggcuguagcaugguucuagggguuguaacaagcuaauguguuacacuucgaggaccaucuaguacccacaggcaauaaaugucccugacacacgaccauuaaggugagacucugagcaugguucucugcccacucaauagcugcugggggaggucuucugagucucuggggaugggcauaucugacaucagagaaccuauggucuccaguuggcuuuuuugauacaggagcacacccggucagaaacugaccaaaagugcaauuggguccgaccacaguggcaguuaagaagggucucgugagagucccacggaugaccccaaauugaccauacaccagcccugugucagugagagacuuccucggaagcuaagagaacagcucaggaugaagcauuguuuaugcuggaaagcaacgaccccagagccaaugaaaaagaagagagaaaaagagagaggaguguggaaugggaggaggagauuagauauuaagaaaucucuaucaaggaagguggaguucucaaauuugagagcaggguccacaagugggucacaagaucaacaaaguggcaggacagauugcagggcaaggaccugaaccuggaaccagaucacagggcaaggaccugaaccuggaauguucuccagaaugcguauacacacuccaguguuccuuaguagaugucaagauuaaaggacuuugaaucccaagucccaaaucagcuaaaucagccugaaaacaaauccuucuugcaggcacuguuaggauuuugaacuugaagaaggggggaaacauuaaagagaagagaaagcaagguguaguaccaagacaaucagcugauuagauaugagaacuaugucaauguuaaaugucccaggcugauaaucgggcugugguuacauaagacaauggccuugcucugaggaaauacaugaaagacuaagggaaggggcaccccacuugugacuuacuccccagugauucagcaaaaauacuguucgugugguucuucacagcagugcacagggauaagagccccuggccagcaucaaccccaggaccaucagaggaagggcaugagaaacucaagagauucacucacaaccuacugaacauuuucuguucuguucaaauagaaccuucagugaagcuggggcuguagcucgugguagagcucagaacacagacacagacacagacacacacacagacacacacacacacacacacacacacacacacacacacacacacacacacggaagagauccucucuuuagagccaggacccccuugaaguuggggcucaguaucaucucauccaaacuccuguuucccccacccccaaugauaucuaccucggcuacuccuugccacagcauggguacaggcagaccaaguggcccuccacccagaggggccaagcauuagaugcuggggccaucucaggaaacuucucuccuagagccaggaagacacacuaaauuggagacuccucccccaugggauccugcugugggugguggugagccugagccaauaaggaagcugagaaauuacuuacgcuugagaugcuccucugaagaggcuguggcacugguucugcaccuguugcaaacaggaagcaaagagguguggucagggccugcaugcccagggugaccaggucugaucauggguaacucccaacacacaugcuagagaggggacuccuugagcccaggggaccuggaccagggaugaaggaugcugaaucucaagcauguguaugcacacauagacgugcacucucacacaugugcucaugcacacucagguggccacccagaugcaaacauucauucucuuucucucucucucucucucucccucucccccuuucccucucucccucucccucucuccucccucucccucucuccccccucuccccucuccuccucuccuguucucccucuaacugacucugaauccucucucuggauucacugcucuugaacccagacagcccaagucccagugaaucacucaacugucuuugcacacuguguggggcugcuggaagcccugguggguuugaugucuaauaaaggucccuuuggggucagggagauggcucaucagguaauggugcuugcugccaagccugauagccugauagccugaguuugauuugacagacccacacaguggaagaagagaacuaacucuuugcaacuugcccuuugacuucuacauugaugcuggauaugcuucagauacagauacacauaucacguauauauuuuauauauauauauauauuaagguagguucuuuuugcuggugugcauaggugagccacucaccagaccagacuagaaagccugcacucccacuagcucuguaaucugcccaggucccagaccagucacuggcuauccccuauugacagcguaaggcuagacagauucucuuuauuacugucaccaccauuacuguuacauuucuguguguggcaggcggagguggggggaaggggcauguggagaucaagggacagcuugcacgaggcuccuggggacugaauuugggucaaguuuaggaggcagcaaguuccuuugccagcugagacaccacaacuguccagccccaagauucuuaagaaaggcacagucccccaauuaccacauuaaacuuacugagacccauuacgcccaggaagccugcuggaaucugcuggacagcagcuauccucuggggauggcccagaagccaucucaugaauuuugauuuacuuguucauguuaccuagaguguucaggguggacccccagagccuugugcacauucagugggagcaccacaguagggcugcaccccaaaacagggagucucuguucagacaagcaggggcagagcucugggccuggcgucucaggccacccgcagaguugcuggcccagacacaggaaggccuuucagccuuccuggauuauaaaaauguguagaaucaagaaaagcauucuuaucaaugaagagcuaagauuucaaggacacuuaaacuggaauuaauggugauguacagggauaaggauaagggggguagguaggcagaggcaccugaccccuccuuaagcuccaccucuccucucuggcagcaacucuagcuucuuccacaaccugagcagaguucuggcugcucuaucaguucacugccagccucccuccucagagcacucacugcuacacacuaagcacacugagcucaggcacugaguccacgguaccauaugguaggaacugucaacaauuucuuaagcaccuaccauguaccaggcaguguuugaggaaagaccgcaccucaagaagccgagguccccuguucucaaggaauccugaacccuaccuaaggugagacugaaacaugagugggaagucacugggccuuccuccacuuccuugguggacauggccccaccgaagccgaggugagucaguaauaucugcaacgggugaggcacagagaugggaaaugguaacaaguaccugacucuccugggccaugccaaaggaaggaagauaacgaggaagauggagacacugcguuuaaagcacaaauucucagcacauuguucaaggaaccuugagcaauggcauucugucuggauaaauccugaccaguaagaggccagcuugccucagacagauaagagcggcccucuguaucagugggucuguguggcuugcuggcacucauacccaauguaggaacagucugaacugauuuaaccuggugaggcacaucuaucaaucucauccuaucaggaaacggaucucaccuccuacuucuggaggaacaugugaacuagaccuggccaaucagaguugcucacucguggacuugacuaugccuggacaauucgaaugacagccagaacucuuguuaaaagcacugggaguuggggagucggcaggcucaguggguuaaagacacuugccauauaagccuggaagccugaauaccauccccagaacccauacaaaggugacaggugaaaacagacuucaguuuuccuaugacauccacaugcaugucaagucaugugcacugcccccaacacacacguauacauacaccaugcacacauacauaauccuaaaauuauuuagaggaggaggaggagcaggaggaggaguuagaagaggcuucuucuaaguugagauggcuuguggagaugggguuucacuggggcagcuaagguccuucagggagaauggaguaagcacugaggaacacggagccagaaauggagcaaacuaacaauaucucagcacccgaauauagccacaccuggaggauucuuaagcugcgcucuucagguaaauguagcagucaauguucuauuuaccucuaaaguuaauuuaaacugauuuuugcugaacccagucuucuuagggcauagagaaucacacauguaaucccagcacuggagagaaugaggcagaaagaaugugaguuggagacugaccugagcuacauagaaaaaccucaucucaaaaacuaaauaaauacaaggcuagcgagauggcuuaguggcuaagagugccugcugugcucgcagagggcuggaguuuaucucccaacacccacauuaggagacucauuaccaacugugacucuggcuucaggagaucugaagcccucuucuggccucuaggauucacacuuguacauacacacauacacacauacauacauacaaaaacauauacauauaccaauauaauuaauugaauaucuagggauauggcucauggguaggguguugccugguaugagcaagguccuguguccauccucagcaguguguguguguguguguguguguguguguaugagaaagagagagagagagaaacagagacagacagacagaucaacugaccaacugaccugugcccuggcuugaaccugcugugucauuuuaugcuccuuucuaucugacauucagcccauuaguaccaacauggaggauacaggugacagaaugacuugacaucugagguuccccacagccugacauucuaucaugugucuguugcaaaacuuaggccugacccucccccucauccccagcccucacuccagggcacacaggaagacauacauguuuaaaucaguccucacugguaggccugugaaacaucuggaggacucuucaccacagacugcgaaccccauccccagcuccgaaugccagauauggauggagccgccuauucuucuccacuguccugugauaacugucacuucugguccagugaccaccauguucuaagaacucagacucaaucuaucuuuuucuuccacuuacugaagcccagugacccauguaaacaugcggcccaggcagguaggaaacuagaccucagggccccccugcauccucaaugcagagcucaacuggagacaauuucagagggaugcagcuuuccacaagggcagcacugguccugggucaagcacuucugcuagcccccaugcuagaaugucucuagauaaccagaggccaugugagggguguugcagcaggcccuguguugucuuccaggagcugaaaagccucucaaagacuccccuccaccaucgccaccccagcaggcaacaagccagaucccaugcugggggccuuguccugacacacugccuggagccacuaggccugucugcagggccuggcuggcccugggcucucccugacuuacauccgacuuggcugccugcaaaagccuccugcggcuuuuuuggaccgccaacacugcagaguagcaagcggcuuccccauaagcauccuuuccaagguggcacuggcccaaggccggcuaagccagcucucagcccuaugaccuugagccagucaccugcccccaggaaggcuuuggggcuuuccuaugcaaaauaugaacacuagggaaaccgaauuuaucauauuauucaucuuuugagaagaagggucuacagccugggucuaacucccuauguggcucggagacuauacugcccuaacuccugggcucuggccacgcuuccucgucaaccucccacauaacuggaccacagguguacccacuguacagguagcuaucucagcuaggcuuuuaaggaauaccgaaugcuaggucccaacuuggagacuccaacuugaccuguaucaugacagggagaaagccuagaaugguggugcacaccuguaaucccagcauucaggaggcugaagcaagaggaucaugaguuuguggccauccugggcuguagaaaaauuaaaaaaaaaaaaaaaaaaucacaucuaaaaccaaaaucugaucagagcuggucuauaugauuuacaacuccacaacaccacaaugaacaacaccuaguagcuccaggaccugguaacagcaaucucaagucaggguaauguuaggaaguuaagaaauauuacuaaugggcugaggggcucaggcuggggccucagggaaaacugguguuagcgauccccaaugaguagagagacaacaauacacaagauuuuccugguggcagguuuggggcuuuccaaggaugcuggcagaggcuggacucuucacauucaaaggaagcaaauuauccuuuggcuggagccuguaccccagaacucaaaauagaagcuaacgcuaagaagggguggcucuugccuagggaggagaccacugugacggguuccaagugauuucccaguuccagcccuuuuaaaaaaaaugauuuauuuguauuucaugugcauugccuguuugaggguguuggaugcccuggaacuggaguuacagacagcugugagacaucgcacgguugcugggaauugaguuccgcuccucuuaacgaccgaccgaccgacucauccccuacccaguuccccuuuccagcuaucacugcccccgccuucuuacaaagcagacccacacacauggacccuggaacucacccuagccagagaacugggcauaaucucagggaacgucaagcucccagcaaucccucauccaaaccacacugacucggugcccuugaaucauugaggcagggugacuucucccucacggccacgagagguggcagguuccgagccagugggguucagggacacaaggaggcucacagcugcugcuuagcacccuccacaccacauccaacuucugccacugccacagucccccgugccacaccuuccccacugugcccgaaccggguacagagaaagaaauaauaucaguguuucauauugcuucuucccaggacuggagcaaagcccuuaccuuacugggucucauccucagaagcacccccccuccaaaaaaauacaaaacccacaccccccaaaaaauacacaaaacacuuggcauggcuaaaaguugacaggggguggggguggggugcggaagagauauuccacaagaguugacacuuuuuuuuuuuuaggcucacaacaggauaccuuuaaaagaagcccaccuucuacugcgagaaacgaaagacagaaauagacuccacagcaccaagggaaggggcuggcaggcguggguuuugguuuuuuuuuccuucucucuuuuuaaagguuuguucuaaucuauauucucccacuaauaguuuaggcaaacccacauuguucccaaggagauuauuccauacgaaaagcuggcuugccacagcucugcucagcaccacucuggaauucuagucuccaaacugggaugccuccuuucaaagcaagggucgggccacccuggaaaaucagcaagaggacaaguauaggugugcgccucacacugggaccacacagacuuaggacucuucuccucaugauccacaagugaucuccucacacccaaggaccagagagggauaaggauucaccuaggucacacaguaagaaaaccagaggccaaggacaccagcccugguucgcaaugcccggcuuugauuuuauacguucaccugcauaacuuuuugcuggauauccaucacccuugccaagcagacagccccaggagggaagacuucagacugcccuauccacuggcgauauccgcacagcccggaaggaauaaguaccugcuagguggguggauggguggguccaagccuggaccaauagauguucaaagaauaggcucucauuucaggaugggggugcacuucugagagccagaccccucugcuagaugcuggaguaucuccccuucucucaguguguccccagcugguggucagguggauauauggcaggcucacagagguccaagaucaggccgcggggacagagcucuaggagcucagguagggaaguucaaguccucuuugauucuugugaucuuugguuuccuguauguuaagcaccacccggggucaaggaaugcuucuuggaccaggaagcuucaagcuguacuugaggagugggaagaagauggggaacaaaggacuagguucggcggagaaccccagacuacaaggagaggugagcccgaucuggggaagagucuaacaucaaauucuucuuuagaguuggucacagaguucacagggugcucuggagccacaggaagccucuugagcaggagauuggcucagcaucaccuccuagaugguacagagaggugcucaggagacacgguggcuggucaggaggcuguggaugccaguugccaucuggugauagaaugaugguccuugaaaucaugaccagccuuccauuggggcugauuagcccuggagcaggggcagaguccucagaacggcccuguuccagugcccuucacccacuaggcaugacugcacagauccaccggccagccacacuucucuacccccugccaagcaucuagcaaucucagccuuugggcuuuccguaggaaggggguugauagaauauggcaaccagucauauuccacuucuacccuguuacaagcaccauggaaacaggacacucagaaugucccagcuaggagaccuagccuaaaagcgccaucuacucaacagagauaccaaggcugggggcagaggguggggaauggggaugggacaagguaaacagacuaaccagaccaggagauagguaggcucaguuauagaugucuccuguccaauggaugcccaacaaguuugggcagaauguccuucccacccuucccccacgcagcucagucuugggcugagcagaucaggucaucaguaccaggcuccagguucuuccccaagcuuucuggaaguuggguccuggacugugauuaucucucaagcagccugcccuuggagagggggagggcagugcuuccuucccaucccuuucccauuaacugagacuaagaacagcagcauggaaacacugaggugaggggcugggguguggcuagcaccugcccaacuguugaaaccucccugggauccauccccagaaaagucaguugcacaagaucuugccaguguccuuaaccuaccucccagaaggggaguuuuacauaaccagaauggugggcacagcagaggcagggaaacugaacaauagguaauuggaagguuggaucucuuccacugauaaacaccucgcccagaccucaccagagcuccuagucacugagguagguggguggguggggcagguuagcugggugaucccaaaguccacaaucccugaacuccagucaauggaccacucuuccgcacaccugcgacuuguucccaagugccugcccucagcauaaaaggccugagauuguacauuaaccuccagauacucaucuucucccccucccuauguuggccucacucuccugagggacugcaagccgcccagcaccagagacugguuuauucauuguugcccuuccuacccuugggacggugccugacauucaguaggugcucaauaagcauuugcggugcaaccggugguacacaccugcaguuucagccaccugggaagcugaggcaggagaauugaaugggugagcuccuguauuuagaaagacacuccugucagcgguuuguucaccuucggggcaaguuggaagccacugagugaggcgacgcccucacugagcuguagucugguuggucagcuaggacagaagaggccagagggucacaagccaaggaugugcacagugggcuggugggcuuguacguucugcaguguguucugcagggcauucugcgggguggcaggucacaaugggccauuguuuguacagaccaagugacagaaccuggaacaguaugacgcuguuuuuguuaaaaacaaaaccaaaccacaacuggcuagcaggcuagcugguuggcuggcuggccugcugagcaaauccuuacucccacaaggaaaugaaaauggacccagaaagugauaaaagcagucugcauuccgacagacacugcagguaccacacagcuagagcugcaugugagagcaacagauagucuuaagaucuuuauuuagucauuuauuagcauugggggaggaacccagcgccucacacuuggcaagcaugcaauccccagcuuauacccucaacccaaccuuuuauauggauauuuuguaaugaucugaagggaauauauuuuagcuucugugaguucuguauugcuugagguauauaauuuuuguaacugaaaagugagucauuuggcaguuugucauuccuacacaaaugaaaugguauguccauuaaaaaagcuagcacacaaugcccacaggagauucucucacaauccuacgccuacagauaaagcaucugcaggacagauggacaagcuggacagauggacaagcuguuguaugguuaucaugccucuugcccagagggcacacuauaguauucaaauacagaaagcaaugaccuccagucuauacugccuucuauccgaucccuuuacacauaauuaagauaaaguuucauuuauaaauuagucauucugagagcaauagcucauaauaaacuagaauuauauauaacccaauacugucauaaaaugucuucaacaacacaugaacugcucauuuccagaauuuuucauuuaauagucagugcuacaguuagccauauauaauacacacauacaguccugggauuacaagggugauucacacugccuggcacaaauccacugauauggggaggugacuuggcaaaauucauucacagugacagacaucuaaaaguagcucucuuaagguguggagagagcuggggauguggcucagugguacagugucugccuagcaaggguagaguccccauccccuccucaagcaaaaaagcaaggagcagaggagcuagagagaggccuuugcaggucagacagcugguugugugagcaggaaaagcaagggcagggccccagcaagaaaauaaaaaggcagauguggcccuaaacucaugcagcucagcacuggggacaguggggacaaaaaugagaagauaagagugagcuggcuggcauccuagcuccagguucagugagagacugucucaaaaaaaaaaaaaaagaguaaaaggguaaaggagaaaggcaggcugauguggaacucuacccuccacacacaucuguacaaacaugaacauauucacacacaugcacaccacacagacacacacacacacacacacaggacagguagaaagcaacugaaaagauaccuaauguugaccucugacuuccacgaguacacacacauauauuugcacauacacacauauguuuauacacaaacaugugugcaaaacauagggauguuuuuaucuggcugauaguuacacugaugucugaauuuacugaacuucaaagcaucucugcauuauacuucaacuuuaauuuaauuuaauuuaauuuaauugguggagaggagugugugugccagagaucaaacucggguuaagcauacauuguacagucccaaacccuuaaaauaucuuuuuccuugaaaaaauauaauuauuauguguaucuuaugugacaugcuaggaucucauguggaggucaaaagagaucacuguggaauucucuccuuccgacauggggaccuggugauccuggcaagugauuuuaccugaugagccauaucucagggaaauguuaggcacaguaccucacaccuguaaucccagaacuuggaagcccaaagcaggaguguagcaaaauuccacgccagccugggcuacauaauaaguuccaggccaacuuccccaacucccccaccaccccugacacacacacacacacacacacacacacacacacacacacacaaagacaaacauuucuaucuuccugcuucuccgaccccaccccccuaagcccagccucagcgcguguuuccaaaagaauccuuuaacccaaaguggucagaagggaaaauccugccgcucucaggccugcccauaacuuucccuaaagaugccagaucugcacgcuccagggagguggaaaccagcaaguuaauggccugccugguaccuguuaaacaggguguccaggcuucaccugguguuuacagaaagaacuuggggccagauucuuugguccagaaaauaccuuguacccugucuaaugguaggccaguaggcagccacccuugaucuuuggagcccaauccaguuccuugcuuaccauuaggggucucuccccaggcuccaaccuugauugacuccugcuaccgucccuacaugcuguucaaaccuauuugucucccugcugcccuccugauaacuauaagccugaaacccauagcccuccaucaucuggcucuggccacaucuauucauggccucucucuaacugagacccuauggacacguucuauuagcuauuucaugucacgguacauuuaaacccucugugucccugccuaccaggccagcucacccugccucucugcccauaagaagcauugacuccaauauuaccucugccucaccaagcacacacuggcucacgggcucuuaagucucccucaaggcagucauggauggcugugguccuugcagcagcuacucccucuagguuauuagugccucaaagccaacauucuaccccaaauccaaugccugcccagagcugaccucagccaagguuucuuuuuuuuuuuuuuuuuuuuuuaaagauuuauuuauuuauuauauguaaguacacuguagcugucuucagacacuccagaagagggagucagaucucauuacggaugguugugagccaccaugugguugcugggauuugaacucaggaccuucggaagagcaaucgggugcucuuacccacugagccaucucaccagccccucagccaaaguuucuuaaccaccuaaaugagacacauuaagaaagagcccuaggccaggcagugguggcacacaccuuuaaucccagcacuugggaggcagaggcagguggauuucugaguucgaggucagccuggucuacagaguaaguuccaggacagccaaggcuacacagagaaacccugucuagaaaaaaaaaaaaaaaagagcccuaguucuccaccagggcauggaugccccagaaccauagcuacuccacacaacacauagauucaaacuucuuuggcuaggcuaacuugacaaacaccacgaagcaagcugcagccuccucaaagagucugauucuugccuacaaccacugccaaagucagucggcacagcuggaaccccaggccaacccucuauucccacccagaucgcagcaauggcaguagcugggcaacauuccagggaguccuugugauugacagcucuuuccugucuccaggaaugugcucagugacucauggcaccuuaucacugagaccuuuggaaacuuucggagaacuaaaccuuugacaaguugagguuagaagcagggagccccccucacccccagugcccagccugccuuuggguugggugggggugggguggcacaacaccugcugcagguggauggaugguagcugggcuccacuggaaggugcagagaagcaagaaggaauauaagguacuaaggaccacccccacccauacacccuccagcccuaaggaccagaauaccuuugucucuccuuuucuccagaaccuucuccaccuuaauguccccaucuuaauguccccaacaaaucaguggcccaagugccgugaagccuaaauguacagcuggccauggcaaagcuuuuuggaaucccaauucuguauagugcaagcaaggcaggcuccuaggcaguucucauugacccaucuauagaaugggcuguucccccagcccugagccuccagauucuaccaagcagauguggauacagaggggguuagaaagucaggaaggcugaccacaacagagcuacaggcaguaccaggguauccccaaaggacaaaagcucucuccggacagcaccauggcccuugccacauaccacagugaccugagaccucgugacacccucuaaucagcagcucuagagccgagcccggcuuuacagcuuaccacaagcuuauucagccucaucucccucaaucccuucaaggacaaggcgaggcuggccuuagcguccuugucgccuggacagccaagcccaagcuaagagaacuacccaaggucaccauuaagaggaacacagucuuucuggggacaagaagacucuuggauccccaguugacauauccaauggguaguaugccccacccauuuuacagaugaagagacugaggacaagaaauacugcccaagguuaacugaguggcugaaccaaggccuaagacaaccuccaaccaucugccaauaccauccuauuguggguucucagcuggugccuaggucccccuccagccacccaccaucaucuugcuaaaacaccucccucucaccccccacuccccgaugacucccugguagagagggaggcaggcaggccguugcuaagcacucaccagcucucucauaaaaauaaacuccuucuggcuuagagacucugagugagauccccucccuaccagcaacaaaaaaaaaauuuuuuuuuucuuuuaauuuaaaaaagaucucuaugacauuuauuugaaagcuagcugugccaaaucggaggccaauuuacugacauccaauuggagccacgugcuaccaauccgcaguccgaggacccuccgggucaagcgccuggccagucuuugagaugauuuauuuccccaggcaggaaaugggggcccaggcugucucccaagccuuuggggcugguccuagggaaggcagggaucuggcagaggccaggcagugaccaaaauagccaggucgguggcccugcugagcacacgccucccuugccgccaggcuacagccuagguugaggcuuugggacuguaggaucuguuccugagacugguuccuuguguggcuuccccagugggagcagaccagaaccucccacccaaaagaggaacccauaaagugaaggggagcagucuagaggaagauguguucagcuggugcuacccauugccccuggcugucguuucgggccucagcccugcuacucaagccugggagcgacugucacaccugcgugccacacccaggcagcaccuggagccauaccgcccuuuuaccucuccuaaauacuacgaagaaccaaagauguccauugggcccacugggcacaagggauggccucucggguacagcuagaagacacuagacuugcccccaaccacagauccagggauccaggcacauucgggcacacacacgugcacacggccaggguuccggagacacagccacacguacagguucacauaggcaagauguguguguguguguguguguguguguguguguguguaucagaagacagagccacacggccacacuacacucagguaaggcagccccggacauagcccuggucauaucacacaccccggggcgcacauguacacggcugccuaggguggagaaacagccacucucagaaacagagacauccagggacaaggaggcaccccgugggacacacacacacacacacacacacacacacacacacacacaccugccgccgcaccagcagccccagccccuucgccagggaaacaauaacucccucuccagcagagcugaacaggagacccucagucccucccucaggggugaaggggaugaaagagcgcggggaggccagacccgcagggacccggugagguggcggagcgcggcccggggagggggcugcagucgcggcccacacgcccuggguaccuggguggcuaagcccacagcggauggcccggggcuggcgaggcuggcgggacuggcggcgaucgcggcguuggcggcugggcacgggagcucggcagcaaccaggucccggagcacgacgcuggcggcggcgcggaggaagcgguaauuuauaagcggcuucucccugaccucgcgugucuguugucugaacaggcagcucuccgcaucacccauccugcuggguggaaaaauaccagcuuggccgggccugggcg

SEQ ID NO: 3233 - RNA, 1937 nt, Mus musculus
gaggcagggugugugcugggccucguugggcaucccaagagcuuaccugggcuuacgguggagagacagauguggggguugcucugggagaugcccugugcauggggaagacacagcugacugugucaaccuccugauacuccccguguggauuuuaacgcugaguuuuucuucuagccaagcaguagcugguguuaggcaccaucuuguagcccuggaagccgcuaccaccgccacccgcugcaccaacguccgucagccugacagaguuagauaugacucccgugcacccagguuugccauaggaguuuacucucugccucuggugccuacuguauccacagggugggaguguuaggaguguccccacuccccuaccucccucaggcucccucucuggagcacgucuccuguggccauccauguccgugauagagugugguagggccuuggucuugguuuccucccccacagagugggauugcaucugaaugcacuucuguggcccuaccaugcagcuuccaagggaagucccugguccuugagaaaccuuuggggaaagaccacagcacguucaccacagaaucauccagagagcgcaccgcucaggggaugcauugugugauagaaauggaagcgaagauuuggggcucuccaaaacaacaaaaaagacuguucaucuucuuggggaaguugugcucuguggccgggaacagguucaggucaucccuccucucuuucaagcauauucuaggugucugucugucugucugucugugcuuugcccuguggcucugcagcgcaugccugcccugaacaucugcaggccccucaacacucuuugauguguuuacugugauugaugucuggaagcagcuaggacucucaguggaaggggccagugauagacugcugagcucaggcuggugguguggugagagaggccaugaggccaucaccccagaggcugccugucacagccuggugaggguucuguucauuacucuuggauggacuaguguuccccaucaagggcacucuggagccaagguguggggugugagacagcagccuuuggaggucuucuagggggaagggugaggaagcaggcacagugucuccuuuguucagaacagaggauggaucuggguagaggaugccaugcuuuuagguccacagucugauugauugauugauugauugggccuuggugugagggaggaaggacguccuuccugugggggaaaaagaagcauuaaaagaggaacacugcagggaaggguacauuuaaaauaucacccagacauuguacucacugcauagaggguaaggcugaggcccaggggcagugacucgccugaggucacagagcagagugcacugccugcucuccaugaagccagggcuucagacagcaccaaugauaacauuaggggcccggcaguguggaggggucacaagguggcuuggcuaacucuugggacuucucuugcauuucugcagagagaggaagacaaaagggcucugcuucccuuucauacacaggugcagugcagccuuggguuucuguagcuugcaaagggggaaguuuguggacgugguagccgccuccaggaguagucccggccuccacagcgccugcccaggacccuguagcccuggugcuggggaagugacacugcuggaagugaaugacagcccuguggccgggugagucagugccaggagccggggcccugcugacucacccuccccuggcuccucagcugagggggaggggagaggaggaggggaaaagggggagggacugaguugccccuuuggagccuagagcuuguccaccuaggcauuaaaggcgacagguggcuggccaggucaggagcugggcgaggcgucucugaagcuuuguguacacaaucuccaguugcacacacccc

SEQ ID NO: 3234 - RNA, 1937 nt, Mus musculus
ggggugugugcaacuggagauuguguacacaaagcuucagagacgccucgcccagcuccugaccuggccagccaccugucgccuuuaaugccuagguggacaagcucuaggcuccaaaggggcaacucagucccucccccuuuuccccuccuccucuccccucccccucagcugaggagccaggggagggugagucagcagggccccggcuccuggcacugacucacccggccacagggcugucauucacuuccagcagugucacuuccccagcaccagggcuacaggguccugggcaggcgcuguggaggccgggacuacuccuggaggcggcuaccacguccacaaacuucccccuuugcaagcuacagaaacccaaggcugcacugcaccuguguaugaaagggaagcagagcccuuuugucuuccucucucugcagaaaugcaagagaagucccaagaguuagccaagccaccuugugaccccuccacacugccgggccccuaauguuaucauuggugcugucugaagcccuggcuucauggagagcaggcagugcacucugcucugugaccucaggcgagucacugccccugggccucagccuuacccucuaugcagugaguacaaugucugggugauauuuuaaauguacccuucccugcaguguuccucuuuuaaugcuucuuuuucccccacaggaaggacguccuuccucccucacaccaaggcccaaucaaucaaucaaucaaucagacuguggaccuaaaagcauggcauccucuacccagauccauccucuguucugaacaaaggagacacugugccugcuuccucacccuucccccuagaagaccuccaaaggcugcugucucacaccccacaccuuggcuccagagugcccuugauggggaacacuaguccauccaagaguaaugaacagaacccucaccaggcugugacaggcagccucuggggugauggccucauggccucucucaccacaccaccagccugagcucagcagucuaucacuggccccuuccacugagaguccuagcugcuuccagacaucaaucacaguaaacacaucaaagaguguugaggggccugcagauguucagggcaggcaugcgcugcagagccacagggcaaagcacagacagacagacagacagacaccuagaauaugcuugaaagagaggagggaugaccugaaccuguucccggccacagagcacaacuuccccaagaagaugaacagucuuuuuuguuguuuuggagagccccaaaucuucgcuuccauuucuaucacacaaugcauccccugagcggugcgcucucuggaugauucuguggugaacgugcuguggucuuuccccaaagguuucucaaggaccagggacuucccuuggaagcugcaugguagggccacagaagugcauucagaugcaaucccacucugugggggaggaaaccaagaccaaggcccuaccacacucuaucacggacauggauggccacaggagacgugcuccagagagggagccugagggagguaggggaguggggacacuccuaacacucccacccuguggauacaguaggcaccagaggcagagaguaaacuccuauggcaaaccugggugcacgggagucauaucuaacucugucaggcugacggacguuggugcagcggguggcggugguagcggcuuccagggcuacaagauggugccuaacaccagcuacugcuuggcuagaagaaaaacucagcguuaaaauccacacggggaguaucaggagguugacacagucagcugugucuuccccaugcacagggcaucucccagagcaacccccacaucugucucuccaccguaagcccagguaagcucuugggaugcccaacgaggcccagcacacacccugccuc

SEQ ID NO: 3235 - RNA, 83821 nt, Mus musculus
cgugcucgcccgccccccgccgccgcggugaggcuggcgccgggaagaggaagaggaacauucgcccuccuccucccagcgcgcgggcggcggcggcagcggcaccggggucacgaacucugaccuuucacugacaaaaacaauaacaaagcgcggucccuccgcgaccccggcggugccagggcccagcccgccgccccgcuccgcaccggcccgccgcggcgucccggccgcccgagcccccgggcuccugcccuccggcgccugcccggcccgcgcccugcccuccuagccgggggcgccggccgcagacacgggaucugcuccgcgguugugguggcgcccgacccugagguaagagcaagcccgccgggccaagccgcggcgcggcgcggcgcagcgcggcacggcggaggagggcaggccugcgccgccauggaggccgcggaggcugaacgcggccuuuuaccuuugccacggggcgguggcggcggcagcagcgggcgcuuugcauagugggccgggccgcacccuucccuccccucucuuccacuccccuccccucccgcggccgagcccggcgagccgcuguccugaccgggccggccgcgcgccgcgggggcggagagggggacuguccgcggccccgccucacgccuggcccuccgccagcgccgccaucuuguccccgcggcgccggccaggcuccccucggcgcgcgcccggccugcccgcuucuuccuguguuccccgcuccucaccccagcacuccccgccugccguuggcugccacccuggcccaaccgccguuuuuccggacuaggaggguggaaggggagggagggaggcgugggcagggcacgaccuccugagugacggccgggcuggccaaucguucccccuuauaggagggccacggccugcggcaccgcccccggggcugugcugguugguccaggugggagagggaggucccgggggccgcuagugcggggugugaggccgggcgggccagccucugaggaacuuggugggucucgggcugggaagcuggugaugcuuuuugaacccauggcgcggccagaagggaagaguucgucggcacuuggaggcucuccgggguucgcgcuuuccucacgacucuggacggagccccucuggcgggcucaauuucaguccaugaaauugggacaccagacguucuugccaagccucgccucucuccucagcauuguuugagggacuguucucugaaaauggaguccaagcuacucugccagccucaaaaguaauuugcaaauggugguguuaguuuuuucgucuuauuguggugcuggggacggcccugccauugaguaacaucccuagucccaaaauggugauguggaaauauauaaggaaccaacuggaguggaaaacuugugaggugauucucuuuccuacuuucauuaaacacaguugugcguagcuuuagacacuaggacacuacuuccagagauucaacugaccugggcaaggagccauucuccccccagaauuuuggaugccgaggggauacaaaggcucagagaauggucagagaauggaagaaacuggaugaugugcugaaggaaucgugagggcauuaauuuaauuggauggugaggaagucaggcuucacugaauguuugaauagauuucaggaaaagagcuggguucuggauagcaagcuugaagaugggaagggaagauuuucccacacuuuuuguugaguaaauuguugcugauacuauugauagcuaagugcugcauauuuaauuggugcauuuuuacccgaacuugacaguugggauagcaugcccagcaauaaaauguccauuauacuaagcagggaauuugaauuggacuucaguaggcauucuuuuaacauauuuaucuuucccagagauaaaauugauugaugcuaugaagcuacugaaaaucucauuuaucaaaguggaaaacaaacuuuacaaaauauaauguuagcuuccauuggaaagucugaugacuaaaauauuugugcauauaacauaguaggaagggcuggcuagcauguaggaaaucaaguuucauccuuagcacugcauaaacuuauguagugcugcauaucuguaaucccaguuacuggggcgguggaggcagaucagaaguuucagugucauucuuggcuacauagaguuuuaggccagccugggcuauaagauccgguauccaaaauaaaauauuugaaaucaaacaauaccuuuuuaauaauaugagcagucucaguuuuaauucuuucuuuggauaucucaagagacaguguaaguuaagccaagcaaacauuuccaaaaagagauuggaauaagcugucccaaagugacuugcagcccagugaguucuacacuguggauuuuaaaguuuuccugaauauuuaugaggugauagaaucuucaugaaauaaagugacaacccccuuucccacucccaaagcaugauggcucuuccuuuuggguuuucucuuuccaaaagcuggaaauuuuaaaaucacaauacaguugauauuguaaugauaucagaucuuuuaaggaugcagacccuucuuucaggcacaugggugagaaagugcccugauaccuuuaguuucugauaacagcaagaauagccuaaucacagguucaaggcuguucaaccacaaaagggcguucuaauuggagacacagcuaucaaucugaagcugcaguuuucuccaguuauuuuguaucgaaauccuugucagucuguagucaaucaaacuuuuaagagaccauccaaguauggugguuggcacaagacuuuaucacacacaagaguucuaggccagccagggcuacauaaugagaauucuguguugggauugggaguaaggucugugucaacagucucuucccuuuauaagaggaauucuaggacuuuuugaggguuuuuuuguuuaguucuguuguuuuguuugagaaguugucuagguuggccuuuuaacccuggccucuagugauuuccuguguuagccucugagcagcugagacuuuaggcuggucugugcuaccaugccuagguggagaaguuuuuaauaccaagcgaccugguaugauagaaggaucuugggucauggagucagaaaaacuuggucccagaaucuugauuaagcagucuuuuugagguuauacauuuguaagcuggggaagagggagccaacacaaggauggaagagagugggugaggauuugcugcaguaacugcagacaagagaggugagacuggugagauagccuguaucuugcuugagguucacauuugaguaugucuuugaguucuccugugugccauuugcuccaaagguuugaaguaucagaguggacaccaaaagggaucaucugugaagggagcuuagcaucucaaggggacugaagccaaucugggccacauaaugaguuccaggcuugcaacccugucuugaaaaacagaauaggaaauggcccuugaagcucaucaaaaccagccuagccaccugauauauauucccuacauuuuaguuugucuuccuuuauugcugacuaugaaaagcugauuuccuuuuuuggagacagggucuuauuauguagcccuggguagccuggaacucucagagauucacuugacuaugccucuugagugcugggaucaaagguauauguuguuauaucucacuuaauggcugaccuuuucuucugugugugaucaucaucugaaauucauguuucugugacacgcuauaggagaugguuuuuuggucuuuggagguuuaacuugccuaaaggcugacauucucugucauucuuugcuaucuuguuguuccuuccccauaaccguugcaacuuucugugaacucugguagcuaggauaccucuccugauuacuaaaaagcuaauguugaagcaggaaaagcuuucuaccuaaagguaugacagccagggaacacuuucaaguggcauagcucacaaugaugagaaggagguguguauagggggaauugaagcccaacucaguacauuggcaugggcauuguuuaagggcauuguuuagccagguucauaccuuagcaucugggcgucuuggagagaugagaaaugaaauguuaaggacaggaaaugaauaaguuacugcagacuuuuaucuggacuugaugaggcagucuuggauuuuagaaagcauuaugucaaugaaagucaguuucagggcaaaguaugacuuauaggcaauagaaaguacccccuccauuauaauaauaaaagacuuaaaacccuuuaauagguggugacaggaucuauuuuguauuuacugaucaguaaauacaaauuccucucuauuuacauucuaaccccaaagguuuuuggaaauguuagaauguaaauagagaggaauuucauugcaagauuauaauuuucuccaguuuggauucaugggagaugugaaagaaugugcuugggucuggagcaaagggcagcucuuaggagaaauaagguuggugguacugggcucaaaggugagagcucuccagaaccuuccuuguuuaccuuuacugcucuauguaguaagaaucagcuaugcaggagcuaaaaaagguuccuaccaagcuacccauaggugcccuuuacauucuaguacuggcugauuggaugccucuugagaaacugcucaaugcuggaaugcuucaguaugcauuuucagggucuucucuucuacagugaaucugauuguguacuaauggaacaugcuagaaaugacauuuauauugcucaugauccucucucccacaccccuauuuacaguaacacaagauuuacuagguugauaagaugaauaccuaguaauuauuguuuuaccaacguggaaagcagaugucacaagugguauuauaucaguccucagcugaaaaggcuggugacuagaauauauauauugacucacuuaguacaacuuuuaagaaaugagauuauuuuguuuuucuagagagauauaagauacucccuuauagaauguguaauugaaccggguguaguagugcauacuugugauccuagcucugcaucuucuagugugugacaggaucaugaaugaaugaaagguagugaucauacaaugaauaaguaccaccuauuauaguuagcaacaaaguaagagacgcuaaaaucuggagauauacagaaugaggggccuacuucaggugggaggugggaggauggcaaguuugaggucagucuaggcuacauagugaaauccuaucucagaaaagcaaaaacuaaaaaguaaaugaaaauaaauaaaaggguuuaaaguggaaaucagugauaaaacuuacuuagaaaguaaggcuugggcaugauggcuuacaccauugaucucagcagagacagguagauaacugaguuaaagacacgccagggcaagaucucaguuaccguaaggcaugaguaagacuauuuacagaaacacuaguauaagagcuccagacuagaaacaagcugaacaccagcuguaaaugaucaaguuaugguguagucauguguuagaauccuagaccauaaugaaaauggacugcaggagaagcuaaauacacauaaaguauauuacuuauaguuaaaaaaaacaagcaaaaacuauccuugauaauagauauuagaagaaaggaaaguuaaugauaacaggggaggugcuuuggagacuucaggcugcugguacuguuguuuucuggugugaauacauauucuguuaguagacagucaucacaguguuuaguuugagcacuuuuugcauuugcauguuguaguucaguaaaauuauuacuuaaaacuguuaaaaauugccaggugguggugguggugcaugccuuuagcccuaccacuugggauuugaguuugaggugaggcuggucuacagaguuccaggacuacuacagccagggcuacacagagaaacccuugucucaaaacaacaauaacaaaaguguuaaaaauuauccucacuguucuacuuauuuucuuuuuuuuuaaauauuuauuuauuuauuuauuauauguaaguacacaccagaagagggcaucagaucucauuauagaugguugugagccaccaugugguuucugggauuugaacucaggaccucuggaagagcagucacugcucuuaaccgcugagccaucucuccaggccucuacuuauuuucuaucuuaacaauuuuggucaguaaagucgcuauauagcuaaaauauuaaagaaauugucaugguggagcuggauuauaaaguccugacugcaguacugaaguauguaacacagagaaauuagcaguuguuuaguuauuaaauguucaacugauacccuguuacuguuuuucuuccuugacuuuuuguuuuucuuggaaaguuauuugaaguguaauguggucuagagguacuaguguaaguuuuaaagucagagugguaugaguuggaauacuagcacuucauuagcagcuggaucacuuuaaacauguuuccugugugucuguuuuucugacuucuuguuggagcuuaugcaucauacuaaagugcugagaaucaaaacauacaucguuugacagaacaugccauaggugcccagaagucugcccuccuuuuccaauugucuacuccuggcucauucuaacagaaacagaaucaauauuaucauuauuacacuuaagucauugguaggaugaagcagcagucuucacacacacacaaacaccuguaguaguuccccaguagcauaggaacaacauggcuguggaagcugcagcuuuucuacgauauucaucucccgccucccucgggaauguuauuuuuccuuuuucuuucuuucuuuuuuuguuuuguuuuguuuuguuuuguuuucgagacaggguuucucuguguagccuuggcuguccuggaacucacuuuguagaccaggcuagacucaaacucagaaauccgccugccucugccucccaagugcugggauuaaaggcaugcgccaccaugccuggcuauuucuccuuuuuucuuacuggaagaagaaacuaaucuccuuuggaugggcaugauggguagggaagcacaugacccagaggcuaagugaucauuugaagucuuaaaagcaucaggauuucgauaacugguuguggauuuaagcuuggccuuagagcccuagaggcaucuaaagggcauguuuucuacugaagaacauugguauuauauuaaacuuugauuuuuuucccccauguccuaauuccaaauccuaauuugacaucaaaucuguggcuuuguguuucuuauuuuaugucaucuagaguuuuauuuuuccacgaauauaaauagguuucuacaugggucuuaccuaggcccucugugcauauguuauaguuguguaacuuggucuucuugugggacuccucuaacaaugggagugagggcugucucugauccuuuuugcuugauuuugacccuuucccucuuacuggguugccucauccagcuuuaacaugagaggaggugacuagucuuauugcaacuugauauaccauguuugguugguaacccuggaagaccuacccuuuucagaagggaaguggaggaggaaugagguuagaggugugagggggagacuggaaagggaggagggaaacugugguugggaugaaauauauaagagaacaaauaaaauuuaaaaauguaaaaaaaaaagguuuuuaacagauuauacuuaaacuauaucaugaaauucuauccaguuguauccuuuuuuuuuuuuuuuuuaaagacaaggucucacuauguagaccagcaggccuugaauucacagggguuggucuaucucuccuaaaagcugagauuaaaggugugugccaucaugacagcuggcuugccugccuuuuauuuuucaaaugaucauuugauacugcuuuuuugggggacugggaaugggguuagggucucuuauuaccuaauccuggaacucacugcauagaacaagcaaguuucaaacaguaacaggguaucagauacuuaccucuuucauucauagacuagaacauuuaauuaauuuaaacaauugcuaauuucuacauguuacacuugggaucaaaaaggcaugcucacuacaggugacccugaauuuuuuuuuuuuuuuuuaauuuuuuucccccugagacaggguuucuguguagccuuggcuguuguggaacuuacucuuuagaccaggcuggccucaaacucagaucugccugcuucugccuccugaaugcuggauuaaaggugugggccaccaccgcccaaccuugauuuauuuuuaauuauuucagauuauacccuaauucagcccuuucauuuugcccagcuggcagcuuaacagugugaauuauaguugguuguuuauacaacauacauauauucaaucuugguuauaucuuaaagaauguuucacaguuuuaguuucugccuucauguuucuuugcuuuuguuuuuuugagaagguaaaaaaagcagcacuuucaacaaauaguagcuacaacauacaguuaguuccagauucaauauacacauuuuggcagucugaugugguuagcauuagagagaucagcuuagugccugagccucacaaccagggagacuugcucaggacaauaggcacuuugaaugcuguuaaguucuuguucagguaggcaguacauaagcaugagugauuugaaucccuugaucaugaaaggaaagaugaguuccuagauuccaguuacugaagacaguuucucuguugcugagugccauagcuauacuuccugcccacugagagagaccuguugcucccaucaagaaccugauuggcuguguuaggguccauaugccuacuuaacugaaaacaggguuucaucagcugucagucuucugugagucuggaagaguucauuugugcucuuguuacccuguggucugcaccacaguuuuuacuuacuguguccugcugucaucaugugcugcucaggauaacuuguuaguuugaaauuaaauuuaaggaucuacuuucauuucuuacuguugucaugagucguuacuggcuuuuguuugcaauauuacuuuuccugucaccuccacccugcuaucaaaaaaguuucuuuuguugaagaucagauacaaucauguuaaagcuauugaugguuccccagcauccagugucagccucugaucucucccauaguuuuuggcauauugccugcuguuccucaaauaccucacucugugucagacuugcuaguuccuuaagaacuguccuuccugcuuagaauacucuccauucuuccuuucuuugauaaauucccauuuuuaaaaaagauuuauuuuauguaugaguauacuauagcuguuuucagacacaccacaagagggcgucagaucccauuacagaugguugugagccaccaugugguugcugggaacuaagggccucuggaagagcagucagugcucuuaaccgcugagccaucucuccagccccaaauucccacuucuuaaaaccuaguuuaaauauaucuuuaagauacauguggagaacuacuugagggaguugauucucuccuuuuaccauguagaucucaggcugucagacuugagggcaagugcuuuuacaaaccauggaggcaucucacuaacucuucuuuaagaugucauuagcucuccagcagagggaguuacuucuuccuugggacauucaccauagccauuaaauugcaucagguucaucaaggacaaaggacuugacuucccuuauuuuguuauuucucaaccuucagcucauugucuggucaucauaguuucuuaauaagaguugguaggcuauuugggguuuaacacuuuuuuuuuuuuuuuaaacauacagugcuaugucuugauagcucuuggcaauuaguuggguucucuucuaucaacaugacuuuagguacaauuugaagauuagcuaguugaagagucaucuucagguuucuauagccagaacuagcuguguucuguucacaaugcuuauuaauacaacaccagcuguuaguuacuguuggugcugcuaagcuuaccuucauaaaccaagaaggcuuuuucuuuuuggugcuuuugaucaaagcccagaucuugugcauacuaagcaggcucucuuucacugagccauacaucuaguucuuccaggucccuaaaagcuuauuucuguaguaauagguuuuaguuuuguuguuucuagauuucaguuaugaaguuagugacugaguuuuccagcuaucacuguucuuuggagcuugccauuuugggaagggagaugcccucuaauugaaaacugaugccccauacuuuguuccauaugacuuaugucugugagguguccugugguuguaugguggugagacuugcccacauuaucuuuauuucaggagcacuuagcuacagguaccucacagcucuccuuccugacauuuccugagaguuuguuuuacuuacuuuuuacauugugauguccugcaaggagaagcuucauacacacacacacacagagacacacacacacagacacacacacacacacgugcaugcacacacacacaagaauaggauuugguuuacacaccacauuuucuaacauggcuaaaugcaguuuuaaaacucuaacuuaucugcucuaguuggauaaaagucuuucuuuuggaaucaugguugucugaaguuucucugcauguccuuugacugucuccucuuuucuuuucagaaggcauacauuacgccucuuucauuuuuauuuagcaguugauggcugaagcugcuugggagguaaaaaaaccaacauugacaucaagaauuccaggaauucaagagaugguacaggaaguggacaaggccuauaaagcugugacagugaaauaauggugguaguaaacagaaagauaaauaaccagugguggacuagagaaccugccauuauauguacacacucagaaggaaaccugaguuaugauggcagagaugacauuacagaucagugaugaaaggauaggucguucaguccacggugcuggaaaauugaugucugugccugacucaucacacucaaaaaacuaaugggcacauggauuaagagcuuacaaagugaaugauaacauuauuuagcacuuauauaauaaaauauguaccaugguauuuuuaacccuaggguaggacagaauguccuuaaaacauuaaaaugcagacugccagggcuggcaggauggcuugggguaggugcuucaaucuuuagagcccuuguaaaggcagaagaaucagcugcaaauuauccucuucacaugugcaccaccacauacacaugcauccccacuguaugcuaauaaguaaaaaaaguaauacacacuucuaaaauauugauccauucagcauuaauaucauacugcuagucaagacauguuaaaggaugggugaagacauucacaaauguauacacuuacacagucaaauaguauccagaauccuuagguuuuuaaaguuuaacagauguacuauuuccugacuuauacauaugguuacuagaauuauuuugagacucauaacuauuuuaaguugacugucccugcagauuuaaagugauucaggguagagguacaguuuggugcuuucguagcagguuuaaagcugugaauuugguccuuagcaauauaaaacaaaagcaaaacaaagcccauaaaguggaccauuggaauucagacaguugucuaugggguuuuuucaggaaaucccauaaaaagaaaggucuuuuaaagaauauucugauauuucuauauuauucaauaauaauucucuaccaguguuccaguguauuuagggucacuuauuuguacuuaaaacuacaguuagcagcagaaacagugacuauguuucagaguuauaaaaugauuaguuguggcugucugucuggauugaauucuuaucauauguuaccuauuggcuaucauuauuuucuucguugaagagugcaagucuagaccucauacauguagcuguguguuacgacuuacuugucugaauaucucaaauguugcuuuccuuucuuuuucuguuucucuaaguuggaaccaaaucauagcaaggacaaaauaaauaaauaaguaacaaaaaaauuuagacaaaaaccaguguucguucccucuuggauuuuuuuuuuuuuuuuuuuuuuuaagaaacaaaaaguuuuagcuacuuacaaaaaaacaaaaaacaaaaaacaaaagcaagcaagcaagcagacugguaguauagcuuacugguagaaugugcuuagcaugugauaggcucuagauuuguuccuuagccccauuauacacugaaagaaaagacuucagaguaagaagaugacuaaccccuauagcucaugccuggccauauuauauggaggugacucacugauaucugugaccugguaucgugucccuguugaugcaguaucuguacuuacagguucuaggucuuuuuauguugucaaccaguuucacacuccauucaccacucaucauuuaugcagugaaacaaucuaaauggaaauuaauagaaguggcuaccuaauaauggguagaagaauacagaaaauggccacaguuaaaaagcuuggagaucugagccucauaaguaggaaugccauagaaagguacguugugaaacuauucauuguauaauaguccaagcaagcaaaugaacuaguugugcaucuguguauauuacacauagauauauuguacaguaacacugaacaguuuuuauguacaaauucaaagauaauucugauagagcuuguuuuccuguuuugccugggaccuauccagauaaugaauugucccaaauaaacccuggcuuuugaaaagugucuagggaauacucauggagcugucuuguuugugcccagaagagauagagggucagcagugaauguguuuaagugacucugaccuaggaggcuaucaggcuuuuuggucuuccucaaauuuuacaaaugauagcaucaauauauuuuuuucuauuaguagaaagcuagggacacacacacacacucacucucucucucacucucucucucucucucucucucucucucucucucucucuccuucaaucccaacauuugggaggcagaggcagguguuggaucucuguguguuugaggcuaaucugguuuacaaagcaaguuccaagccugcuagagcuucacagugagacucugucucaaauauauauuaauagauacauauuaguaaauugauggguaccuugucuuguuagcauauucuuuuuuuguuguuagcauauucuuguucucucuuuguuaguguauuguuugucuuccagccuguaaaugagguguguaaucugagcaugguuuugcuucucauauugccacuaguaauaaaaguuuagugauagcaaucuagcaagcuaguauucuguccaaaguugacgguuuucucagauagccaccauuuuacucaguguacugugacuaagagcuauccaaaaagguaugugaaguuuccaccucuuugagagguuaaaccaagaagaucuuauaagucccuuauuccuuugcauuuauaucugccaagagaaauuuaccaauuugaaauguuucuacaaaaaguugguacauuaauuuuauggcauaucuagauaugauuacccugcuggcuuuguuuccuuuagaaggcaugguccuuguaagauaguaucaaagaugaauucugaugagugauaauuuucaaguagccuggcuuuccacaccugauagaaguugcugcauuuuuccaaacagguucucuaaugaucuugcuucaccauggcuacaaauauggaggggcugguucagcacagaguggggacccagcagguggcugaggugagugacaggggcuagcacaauagcuggcacccuugcuuuugaaaggguagaaaucaguaugcucugugguuuucaaaacagucccaaagaagucagcacaugauucaaauccaaagcaggaugcugacacuaaauacaaaugacaaaagcagcugugaguagguuuuucugcauggguaggauggguguguacaauaagaugacuugaaauuuuaucucagucucaagucaacaaaucugauuuuuauugugcaguaauuuuaauucuaaggcugugucuugguuucuuauauacuuguuauugcacaaugguagaucagauuguuuaaccacuugcaacugucuacaguacugaaauacaggggugcuuaccacacccaauuaaggaguaccaguaaguguaacugugugcacuuagaugggccuucaaugacaagcauuuuucagacaggccuagguaaguauagugagaaauuuugugacagauucuagagggguuaacaugagaaauuuaggaaaagggaucgaggcauaaaacagcuugguaccuguaggcagcaugauguguagaggggauauagucaggaccagaccuugaaaagugucauuacucuuaucaucacugauaauauucaguaaaccagacccuaugcaaggauaacucugauaaccuuuugagguugguuacuauuaccauuuuauagaugagaagccaugccaaaaacaaaacaaaacaaacaaaacaaaacaaaacaaaaaaaaccaaaccauguuguuagccaagaaauuauuguagcagaaaugggauucugaccuaggucuuuguacuuuuuauaaacuucgcugguuuacacuacaacuauguauucuacccuuagaagaaaugaagauuugcauuuuuaaauuauauuucugaaacaaagacaauuuuaccaaagaauggauauucaaagaaaagacauguguaaauguaugugugcuuugccugaauuuguguuugugcaccauauguguacagugccuacagaggucaaaagagguauuggauccucuggaacuaguguuacaaugguuaugaacugcugugugggugcuaagaauugaaucccaguccuuugaaagagcagccagugcuuuuaaccauugagccauuucuccagccccuagaaauauauuuuuaaauauauauauuagaacuaugaaaaugaugaggcuuaacugcuuguauuguuuuaauucaugacagaaauaauuaccuugauaauaauuuguugguuuuucaaguauucaguuuuauuuucacuuacuaaggauuucugauuugauaaguaugcacacaguccuaaaagcccaucaugaauucuuuaagagaagaaaagaacauuaauaucaauuucauguguacauucauugagucauacauauaaacuagcuaaaguuuauuucuagguaccauuccuagccucauagucccucuuagaucuguggagaaagucuaaaucuuaacaaccuucauugcucuuuuaucaucggggcuuauauaucuuuauugcauaaaacuuauaguuuccauguaguggaguguuuacaaauugagcucucucuugcucugaaacagcagucacuacuagcaaggacauauucucaaaggggagaaagcagucauuccuccagugucagauuucugagucuuggauuguccaaguuuuaugacuuaaauuuacuucucugcucucuuaggaacuagacauauacauuuccauauccuugucaaaaguaguguguguguguguguguguguguguguguguguguguaucgcaugacuuuagaccagcauuacuauagacuugaagcagcaaauauauuaggcuccugagccaggucugcuucacccuguuccuuacuccuauaucuuaauaucuuaauuugcuuucugcuuauaaaaaugucuuugcccuguuaguucuuaacuuaugaaguauaaacagugucuuuuuuuuucuuuaagaacucuuucuuugauauaaaacuauagaguuuugagucuugugauuccuuaugguaacucuccauuauauagacuuuuaaauuuuuuuaaauauauuuuuaugauuaugaguauuuugccugacaugaguucagaugccucauucccacauauaaaaagcagcaggauguggcagugaauaucuauaauucuagcaacaguaaguugacuuagagggguauucugagaucuugauggcuaggcaaucuagcagaauccgugagcucuagguuuaguaaaaggcuaucacaaaaaauaacaaagacuaauguuggugucugggagaugauugaguuucaaaguuauuggggaugggggcugugguaaaaauacucuugacaacagccccuuaaagcuguguggugguuugaaugggaaauguccccauccacucauguauuugaacucuugguuccugggugaugauggugcuggugagguggugcagucuuggagugggcuuugagaguuugucucuuccauuuccuguucaaucucuguguuuuuaguugaagucgugaucugucauuuuuuccuccagcugccugcucuaacaccuauccaacuauuauuauccaacuauuaucucucuggaucuauaaaccaaaguaaacuuucuucuuuaaguugccuuuguucaugguauuuguccuaguuaggguaucucuuacugugaugaaauaccacgaacaaaaagcaaguuggggaggaaaugguuugucugccuuauccuuccagaucauaauccaucacuagaggaaaucagacaggaacucaacuaagaaggguuggaaucuuggggcaggagcugauccagaagccauagagaggaguugcuagcuggccugcucagccuguccuucuuauugaacccaggacaaccagaccaggaauggcaccacccacaauaggcugggccuuccuccauugaaugcuaauugagaaaaugccuccaucuuauggaggcauuuccucaacuugaggcuucuuucucugggaugacucuagcuuguaucauguuaacacacaaaaccagccaggacaguacuuuauccuaguaacaacagaaaaguaccuaauauaggaaggaaggcuuuauuuugguucacgguuggaggucuagaauguuauggcauggaagacauaagacagcaagagcuugaagcaaauugcaaccacuguuaggaaaccgacaguccugggugguuguacucagcucacuuucucuuuuuaauacaguucaggaugacagaccacagaauaguauccauagugggccuaucuuucauuuaacucaguaagauaauccagagcuggauaaaugucucaaaagguaagagaacuuguuuuuugcagaggauucagguucaguuucuaccacccaugugguggcccacaaccuucuacagcaucaguuccagggauugaauaaccucuuccaacuucuguggggaccaggcaugcaugugguguauaguuauauauagguaggcaaacauuuauauaaaauaaaaauaaauaaaucugaggaggggagggaacugggcaugaugguauauaccuuuaaucccagcacuagggaaacagaagcagaucucuuguaaguuggaggucagcuugauccacauuaggaguuccaggccagccaaagcuacauagugagacuuuaacuucaaaauaaaacaggauaagccccuacaguuguacauagaggcccaucuccuaggugauucugguuugaaagcugacaauugagauuaccauaguggauuagaguacuuuuuacacaagcaauaagaccuaaguuuaaauuucaaguagccauguaaaaguugggcauggcagccucauaccuuuaaccucagcacuuugagggauguagauggaaggauuggcgaggcauucuggccacuggccuagcucuaggaucaguguaauacuaucaagggaaaauagggugaagaguggacaccugauaauccuucucauacuucugcauacagagacauggauguacaccuauacacaccuguguacaucacacacacaaaguagggaucgaggacagugccuuaguguuagguuuuuuugcucugaagagacaccaugagcaugacaacucuuacaaagaaaaacauuuacuugagacugucguacaguuucagagguucauuaucuucauggcaagaagcaugguggcaugugggcaagcaggaaaagaaugccacacuaggcauggcuugagcauaugagaccucaaagcccacuccccuaaguaacacaccuccaauaagaccauaucuccuaauaguaccacuuccuaauggcccguggggaccauuuuuauucaaacuaccacauuuggugcaaaaugcaguuagucuaaccucaaaaauccccauagucuguauacacacacacacacacacacacacacacacacacacacacacacacauuaucagcauuuaaaagucuguucaaaguuccuuuugagacucauacagucucuuaacuguaaucccuuacaaaaucaaaaucaaaaagcagaucacauacuuccuauauauaauggcacaggauauauauuaccauuccaaauagaaggugauacuggaccaaagcaagucucuaaaccagcuaggcaaacuucagacucugcaucuucaugucaaagccuuucagaucuccaauuccuuugugcuuuguuuucugcaacauauuucucuuucuugggcugguuccacuccuguuagcaacuauucucagcagguauuccacgacacuggcauguccaacaucuuggggucuucaaggcaaucuaggcuucaccuucguagcuucacacaauggcuucucucugacacauaccuggcuucagcugcuuuccuuggucuacaagggggaucccauaaucccuuucuuuuacccuugacucuaaagccagaaccauguagcugaagcugccaaguucugcugcuuacuggggcuggaauacagcccucuuguucuauuauaucuuccagcuuucuguuuuucaugguuuccuucacuguguaaguuuggcuguccuggaacauucucuguagaccaggcuggccuugaauucugaaaucugugucugcuuucccaguguugggguuaaaguuuugugcuacuguacccagccauagacuucuuaaauuccuuucacaaacugaaagcuuagcuggguuggaucuuugucaccacucucuuuuauuccauuuaacaucaggcuuuucuuuaaucuucuugagcacaggacuuagcucuauuccacuuccuggugccccuuuucuucucaaauuguacauuuuauaguuuucuuguuuggcuuacuccuuuucauuauaaauuugcaugagggugaacacuaauaacuacaccacagaguugauacuaaacuguuuugagauuuccucugccaaaucaauaaaucaacuuuucacuccagccucacaacucuucaguuuagccucaggcagauuuuuuuggacaaaaaagaagaaagcagccacauucuucaccaaaauaucacaagaacaguuuccauuccacauauuaaucuuuguuuccucggaaccucuuuagccaggccccccaccagaguguuuugaugcucagaacacucagccucaccaucuuccauguucuuacuaguguggcccacuaagcagugcuuaaagcauuucuuaacccaaaguccaaauuccuccaaacaaaagcauggucagaccaauggcagcaauacccaagugccugguacgaauuugucuuacuuaggguuucuguugcugucaugaaacauuaugaccaaaaagcacacuggggaggaaaggacuuagucagcuuauacguccacagcacuguccaucauugaagucaggacaggaacucaaacaggacaggauccuugaggcagaagaugaagaagaggccaugaugggauucugcuuacuggcuugcuccucauggauugcucaaguugcuuuuauacagaacccaggaccaucagcccaggaauggcaccauccacaguggacugaguccacccucauuuauuacuaauugagaacaugccuuauaguuggaucucauggagguauuacuucaacugaagcuuauuuuucucugaugacucuagauugugucaaguugacacaaaaccaguaaguuuaggaggagucuuaggguuuuacugcugugaacagauacuaugaccaaggcaagucuuauaaaggacaacauuuaauuaggacuggcuuauagguucagagauucaguccaauaucaucaaggugggaacauggcaguguccaggcaggcaugguggaggagggaguugcuuagaguucuacaucuucaucugagggcugcuagcagaauacuugcuuccaggcagcuaggaugaggaucuuaaagcccacacccacaauggcacgccaacuccaacaggaccacaccuucuaauaguguuacucccuggaccaaacauauacaaaccaucacaggaggagaagccauuaagaaaacaugggauaucaaccccuggcuucuacaugugcauauaacaauaguaacuucuuuauauugaggcaccacucauucaagacuaauacaaaauuaauuucuuaggaggacaaaauaggguaucgggcucauauuuugaauuuccuaaguagcagcuuucaaacuguuuaaaacauucaaaaacaggcuggagagauggcuuagugguuaaaugcacuugcuucuggcuuuggcucccagugcccauauauugguuugaaaccauucauaacuccagcucuaagggauccuauucucaucuccaaggguaucagucaugcaggugauguacaaaaaacauaaaaauaaauguaagucaauaaaaugguaucaguuaaacuaauaaacuauguaaauuaccucagaucacuuuuguuaauauuuaggagaacucacaauaucaauaacuuaaacuauccaccuaccaugucccagcucuucccaggaaggauaccuaguuaguucuaaguaauccagguauguaccugugagagauuaugauguuaacuagagcugaauuuauuagaaauguuaucaugaacauucaucaggcacuuaaaauuaucaucuacagcaaguuuuuaugagccuuaaaugagaaagaccguuuucuacauguagguaaauacucauacauaaaaauaaaaauuaaaaaaaaacuuuuuaaaaguuaaagaugcaggccaaggagauugcuguuauuaaaauacuugcagugcaaucacaagcacuugaauuuguauauccaacauguguguaaaaagcugggcacagugugaauucucauauuuuuagugguagagagauggagacaggaggaucaugggugcuuguuugccagaaagucuaggugaaucugggggcaccagguucagugagaggaccuugacucaaaacuagguggaaaaaccauugaguuagacaccauugaccuuuggcuacacaugcacacuacccccaugugcccgauuggcauacaagaauuaaaaauggauaacaaccucaaauauccuuucuaugcuuaaaaucuuaaagaucuuuuccagauuggaaaccuaaaccuagguauauauuuuaaacauauauuuuaaauauguaugcuaauagcugcagaacugacuaucucaugagaacaaaaccgcacuuuggugacuuagcuugauccuccaauugguuuaaaaaagaaaccucugaauacugaagugaguguugauuuaaacuuacucuauuguccauuagaaaucugaaacauuuucaguguggaaggucuucauuuuucccuuagaguuuaaguuauggggccaaacaaugacaucuugaaguagcuucugauucacacuuuggaauuccuucaacuucaucuucgcuauugcuucaguaccaguaaguaaacuucucuuucagagccucuacggugaggaugacuugauugguagcauugacuggcgugaguuuuacuuaucacuucucaggucucugauauauauggaguauugguuugucuuugugguguucuuagccaaaguuuuuccaucuuuggccuuuugcucucuuuacuuuuuaaaacagaacaauaggagauacauuuugcuguuuucccaaugaaggaguagguagguaggggacagugagggaaggaagugacacugcaguaacagauguuuuagcagaaucuaagucaccagcacugagauuuuuguuguuucugcagguacacaaugguggcugucugagcucaaggccagauauugucaguacaaagauuuuauguagagcuuccuuuuuugcagcuguugcagucuucagcagagggacccuuuuaaacaacuuuggaaaggaaaucugauugucaugacuaucuuaaagaaaggucguccuuaaagggguggauuugcuccagccucuauccugagucuguuccuggcauccaaaauccucaaaagaugccaccauauccucuucuggguggcugggauucuauucugucauaugguuaggacgcugaaacugaacuuguggacaccaaaucagagagaaguuaguaccuuaguuuuuguuguuguuguuguuuguuuguuuguuuguuuguuuuacacaguauuucaagauuaaccauaaggcuuucuagacccaugugccaccugcaugcugacucuuaacuuguuggaaaaccauccuuaucaggcuuaguucaaccaaguauuuagaugguaagucuuuugguuugcauuucagguccuuccaacaugcauagcagcacauagcccauaaagcauucugcugaguggcaacuugugcccuuuccucuagugauuuuucucauuguuuguuuguuuguuuauuuugguuuuucgagacaggguuucucuguauagcccuggcuguccuggaacucacuuuguagaccaggcuggccucgaacucaagaaaucuaccugccucuggcucccaagugcugggauuaaaggccaccacgcccgguuccucacaguuuuuuuuuuuaauauuuuuuauuagauauuuuccucauuuacauuuccaaugcuaucccaaaagucccccauacccucccccccacuccccuacccaccuaugccuacuuauuggcccuggcguuccccuguccugaggcauauaaaguuugcacaaccaaugggccucucuuuccacugauggccaucuucugauacauaugcagcuagagacaggagcuccggggagaacugguuaguucauauuguuguuccaccuauaggguugcagaucccuuuagcuccuuggguacuuucucuagcugcuccauuggcggcccugugauccauccaauagcugacugugagcauccacuucuguguuugcuaggccccggcauagucucacaagagacagcuauauauaucaggguccuuucgauaaaaucuugcuuguguaugcaauggugucagcguuugggggcugauuaugggauggaucccuggauguggcagacucuagaugguccauccuuuugucucagcuccaaacuuugacucuguaauucuuuccauggguguuuuguucccaauucuaagaaggggcaaaguauccacacuuuggucuucauucuucuugagauucauguguuucgcaaacuguaucuuauaucuuggguauucuaaguuucuggacuaauauccacuuaucaaugaguacauaucaugugagguuuuuuuugugauuggguuaccucacucaggaugaugcccuccagguccauccauuugccuagaaauuucauaaauucauucuuuuuaauagcugaguaguacuccauuguguaaauauacaacauuuucuguauccauuccucuguugagggacauauggguucuuuccagcuucuggcuauuauaaauaaggcugcuaugaacauaguggggcaugugucuuucuuaccaguuggaacaucuucuggauauaugcccaggagagguauugcaggauucucugguaguacuauguccaauuuccugaggaaccgccagacugauuuccagagugguuguacaagcuugcaaucccacccaaaauggaggaguguuccucuuuauccacauccucuccagcaucugcugucaccugaauuuuugaucuuagccauucugacuggugugagauggaaucucaggguuguuuugauuuguauuucccugaugauuaaggaugcugaacauuuuuucaggugcuucucagccauucuguaauccucaggugagaauucuuuguuuagcucugagccccauuuuuuuuucuuucauuuuuuuuuuauuacguauuuuccucaauuacauuuccaaugcuaucccaaaagucccccauacccucccccccacuccccuaccuacccauucccacuuuuuggcccugguguuccccuguacuggggcauauaaaguuugcguguccaaugggccucucuuuccagugauggccuacuaggccaucuuuugauacauaugcagcuagagucaagagcuccgggguacugguuaguucauauuguuguuccaucuauaggguugcagaucccuuuagcuccuugaauacuuucucuagcuccuccauugggagcccugugauccauccauuagcuaacugugagcauccacuucuguguuugcuaggccccggcauagucucacaagagacagcuauaucaggguccuuugagcaaacgcuugcuaguguaugcaauggugucaucguuuggaggcuaauaaugggauggaucccuggauaugguagucucuagauuguccauccuuuugucucagcuccaaacuuugucucuguaacuccuuccaugggugauuguuuccaacucuaagaaggggcaaaguauccacacuuuggucuuuguucuucuucaguuucauguguuuuacaaauugucucuuauaucucggguauacuaaauuucugggcuaauauccacuuaucagugaguacauauaauuugaguucuuuuuugauuguguuaccucacucaggaugaugcccuccagguccaaccauuugccuaggaauuucauaaauucauucuuuuuaauagcugaguaguacuccauuguguaaauguaccacaauuuuuguauccauuccuccguugaggggcaucuggguucuuuccagcuucuggcuauuauaaauaaggcugcuaugaacauaguggagcauguguccuuuuaccgguugggacaucuucuggauauaugcccaggagagauauugcgugauccuccaguaguacuauguccaauuuucugaggaaccgccagacugauuuccagagugguuguacaagcuugcaaucccaccaacaaugaaggaguguuccucuuucuccacauccucgccagcaucugcugucaccugaauuuuugaucuuagccauucugacuggugugagguggaaucucaggguuguuuugauuugcauuucucugaugauuaaggauguugaacauuuugucaggugcuucucugccauucgguauuccucaggugagaauucuuuguucaguucugagccccauuuuuuuaauaagguuauuugauuuuauggagucuaccuucuugaguucuuuauauauauuggauauuaguccccuguccgauuugggauagguaaagauccuuucccaaucuguugguggucuuuuugucuuauugacggugucuuuugccuugcagaagcuuugcaauuuuaugaggucccauuuaucgauucucgaucuuacagcacaagccauugcuguucuauucaggaauuuuuccccuguacccauaucuucgaggcuuuucccuacuuucuccucuauaaguuucagugucucugguuuuauguggagauccuuaauccacuuagauuugaccuuaguacaaggagauaggaauggaucaauucgaaaucuucuacaugauaacagccaguugugccagcaccauuuguugaaaaugcugucuuuuuuccacuggaugguuuuagcucccuugucaaagaucaagugaccauagguguguggguucaucucugggucuucaauucuauuccauugguuuacuugucugucacuauaccaguaccaugcaguuuuuaucacaauugcucuguaguacagcuuuaggucaggcauggugauuccacuagagguucuuuuauccuugagaaguuuuuuugcuauccuagguuuuucguuauuccagaugaauuugcagauugcucuuucuaauuuguugaagaauugaguuggaauuuugauggggauugcauugaaucuguagagccauuuuuacuauauuaauccugccaauccaugagcaugagagaucuuuccaucuucugaucuucuuuaauuucuuucuucagagacuugaaguucuuauuauacagaucuuucacuuccuuaguuggaaucaugccaagguauuuuauauuauuugugacuauugagaaggguguuguuucccuaauuucuuucucagccuguuuauucuuuguguacagaaaggccauugacuuguuugaguuaauuuuauauccagcuaguucauugaagcuguuuaucaggcuuaggaguucucuggugcaauuuuuagggucacuuagauauacuaucauaucaucugcaaaaagugauauuuugacuucuuccuuuccaauuuguauccccuugaucuccuuuuguuaucgaauugcucuggcuagcacuucaaguacaauguugaauagguagggagagaguggccauccuugucuaaucccugauuuuagugggauugcuuccagcuucucaccauuuacuuugauguuggcuacugguuugcuguagauugcuuuuaucauguuuagguaugggccuugaauuccugaucuuuccaagacucuuaucaugaauggguguuggauuuugucaaaugcuuucucugugucuaacgagauggucaugugguuuuugucuuugaguuuguuuacauaauguauuauguugacagauuucuguauauuaaaccauuccugcgucccuggaauaaaaccuacuuggucaggauggaugauuguuuuaauguguucuuggauucgguuaccaagaauuuuauugaguauuuuugcauugauauucauaagggaaauuggucugaaguucucuaucuuuguuggaucuuucucugguuuagguaucagaguaauugugccuucaaagaaugaauuggguagaguaccuucugcuucuauuuuguggaauaguuugugcagaacuggaauuagaucuucuaugaaggucugauagaacucugcacuaaacccaucuggucuugggcuuuuuuugguugggagacuaugaaugacugcuucuauuucuuuaggggauaugggacuguuuagaucauuaacuugauccugauuuaacuuugguaccugguaucugucuugaaauuugcccauuucauccagguuuucuaguuuuguugaguauagccuuuuguagcaggaucugauggcauuuugaauuucuucagaauuuguuguuauguuuccuuuuucauuccugauuuuguuaauuaggauucugucccugugcccucuagugagucuggcuaaggguuuaucuauuuuauugauuuuucucaaaggaucagcuccugguuugguugauucuuugaauaguucuucuuguuuccacuugguugauuuccccccugaguuugauuauuuccugcugucuacuccucuugggugaauuugcuuccuuuuuuucuagagcuuuuagguguguugucaagcugcuagugugugcucucucuaguuucuuuuuagaggcacucagagcuaugaguuuuccucuuagaaaugcuuucauugugucccauaaguuuggguauguuguggcuucauuuucauuaaacucuaaaaaguuuuuaauuucuuucuuuauuucuuccuugaccaagguaucauugagaagaguguuguucaguuuccacgugaauguuggcuuucuauuauuuauguuguuauugaacauuagccuuaauccauggugaucugauaggaugcaugggacaauuucaauauuuuuguaucuguugaggccuguuuugugaccaauuauauggucaauuuuggagaagguaacauguggugcugagaagaagguauauccuuuuguuuuaggauaaaauguucuguagauaucuguuaaauccauuuguuucauaauuucuguuaguuucacugugucccuguuuaguuucuguuuccacggucuguccagugaugaaagugguguguugaagucucccacuauuauugugugaagugaaaugugugcuuugagcuuuacuaaaguuucuuuaaugaauguggcugcccuugcauuuggaacguagauauucagaauugagaguuccucuuggaggauuuuaccuuugaugaguaugaagugucccuccuugucuuuuuugaugacuuuggguugaaagucgauuuuauuagauauagaauagcuacuccaucuuguuucuucagaccauuugcuuggaaaacuguuuuccagccuuucacucugagguaguaucugucuuuuucccugagauggguuuccuguaagcagcaaaauguuggguccuguuuguguagccagucuguuagucuaugucuuuuuuugggggaauugaguccauugauauuaagagauauuaaggaaaaguaauuguuucuuccuauuauuuuuguuguuagaguuggcauucuguucuuguggcugucuucuuuuugguuuguugaaggaucauuuucuugcuuuuucuagggcgugguuuccauccuuguauuguuuuuguuuuuuuuuuuuuuuccuguuauuauccuuugaagggcuggauucauggaaagguaaugugugaauuugguuuugucauggaauacuuugguuucuccgucuaugguacuuaagaguuuggcugugcauaauagccugggcuagcauuuguguucucuuagugucuguauaacaucuguccaggaucuucuggcuuucauagucucuggugaaaagucugguguaauucugauaggucugccuuuauauguuacuugaccuuuuucccuuacugcuuuuaauauucuaucuuuauuuagugcauuuguucugacuauuaugugucgggagaaauuucuuuccugauccagucuauuuggaguucuguaggcuucuuguauguucaugggcaucucuuucuuuagguuuuuuuuuuuuuuuccuuuucuuuuucuuuccauuuuuuauuagguauuuagcucauuuacauuuccaaugcuauaccaaaagucccccauacccacccacccccacuccccuacccgcccacucccccuuuuuggcccuggcguuccccuguucuggggcaaguuuucuuuuauuauuuuguugaagauauuagcuggcccuuuaaguugaaaaucuucauuauuaucaacuccuauuaucccuagguuuggucuucuuauuguguccuggauuuccuggauguuuugaguuaggaacuuuuugcauuuugcauuuucuuugauuguugugcccauguucucaauggaaucuucugcaccugagauucucucuuccauuucuuguauucuguugcugaugcucgcaucuaugguuccagaucucuuuccuaggguuucuaucuccagcguugccuugcuuuggguuuucuuuauugugucuacuucccuuuuuaguucuaguaugguuuuguucauuuccaucaccuguuuggauguguuuuccuguuuuucuuuaaggacuucuaccuguuugguuguguuuuccugcuuuucuuuaaaggccuguaacucuuuagcagugcucuccuguaauucuuuaagugacuuaugaaaguccuucuugauguccucuaucaucaucaugagaaauguuuuuaaaucugggucuagcuuuucggguguuggggugcccaggacagggugaggugggagugcugcauucugaugauggugaguggucuugguuucuguuaguaacauucuuacguuugccuuucgccaucugguaaucucuggaguuaguuguuauaguugucucugguuagagcuuguuccucaggugauuauguuagccucuaucagcagacuugggagacuagcucucuccugaguuucaguggucagagcacucucugcagggaagcucuccucuugcagggaaggugcccagguaucuggcguucgaaucugccucauggcagaacuuguguuccaccuaccagagguaguucuaagaucacuuggagacuccucuagggaccuuggggguguccgaugacgccgcgcccaaggugacccggugcuggcgcugaccagagggacuugugacccuggucaggcccaguuuucuguuucccuaauuaaugcugucucagguccugcacaauuggauuggaacagaaguaguguuccacucaccagagguccuaagauccuguggagaguccuccggggaccuuggggguauccggcaacucugcgcccaaggugacccggugcugcaccgacaggaagggacuuguccauaguuuguuguuguuuuuauuuauuuuuuuuuuuuauuuuauuuuuuuuuuuuuuaaagaaaagaaaaaaccuuuauuggaguggagaaagcguacuugagucacaacacucauguggccauuagaggacaacuuguuuugauucuauuccauucuuccaucauguggguuuggggaauugaccucaggucaaucaggcuuaacuguaaguguuuuaccuacugguaaucuugcuggcccugguugguugaguuuggaaacaggaacacacucuuuaguccuggcaauccuagaacucacuguuugaggauggccucaaaaucacaaagaucuaucagccucugccucuguacuggaauuaaagaugugcccuacuacccuuggccuccugaaauuuuuuuuuuaauugagcagucuucccuuacuaauuucuuuggcuuuuugagacaggguuucucuguguagcccugccuguccugaaacuuacuuuuuuagaccaggcuggccuugaccucagagauccuauugccucugcugggauuaaagcuaugugccacuaugaugagauaaauuuuuugagacaggucuuacucuggcaacuuuuggcuggaacuuacuuuauagacaggucucuaacucauagcgaucugucugccucuaccucccacaugcuuagagucugacuuuuuuaaaaaaguccuugcucagugauguuuuugucuucuuguccucagauguaggaugaugggcaggcucauggccacugcacccggccuuuuguguggugcugugaauugaacuccaauccuaaugcuuauguggcaaguacuuuauccauugagccaucuugccagccacuuaacuaauucuuagcucagauuuuuuucucuuuugcuuuugucuuacuauacuuuuauggcuagaugucuacuauauuacugaaucaaagugauaauagcaaguauccuucuuuaccuaacccucauuuuaaauagacggguuugagacaauuguaugagcuuuuauuccuuauuagauuagguacauuuucuuaauguaguucuaguuggaauaaaaaugaugaacuuaguagauguugaguuuuaucaagcauuugucagagccugguaggaugaccauguaucucucuuuuugagucaguuaauaugguaagcuagacugacuuugcuguugaauuccacaguuaaacugaacuugacaugaccuuuguacuuacacauuuuauuugcaucugugucuauggauuugauuaccuuuuuucuuaaguucugguguucguauugcuagccuaauaaugcuagaucuugagagaugguccuucauuuucuguccuuugauaguuuauauggcaauggaauuggugcuucuauaauacucacagaauuugucuguaaaacuuguagagcuugaaggaauuuuuaagugccuucuaaaaauaauuauuugucuaauuuaagauuuauuggcacauaguuauugagaauaacauuauaguuuaaaguuucaagcaucacuaguuauaccucccuccuuucuguguaaugugucuuuuuuuuucuuuuuuuuuuaaauuguuuuuauuucaucuauguugguguuuugccugcaugugucugugugagagagucaggucuccuggaacuguaguuagagacaguugugagcugcccugugggagauggaaauugaacuuggguuuucucaaagagcaagugggucucuuaaucacugagccaucucuccaacccuucucucucucucucucucucucucucucucucucucucucucucucucucucuuuaaugaagauauuugacaaguaccuauauguguauaguaauucugccuacacucacuaccucuuuuggaaaaauccuuuuuagaauuuuauaaguaccuuuaaaaauauuuugucuauuuuauuuguuuuaagguuuauuagcacauuauuguugagaauaacauuauuguauauuuuauuccuguuuuaguuuuuaugucaacuugauacaagcuagagucauuuuggaagaaggaaccucagcugagaaaauacccuuaccagaauggucugugggcaagccuaugaggcauuuucuugaugauugaugugagaggaccaagcucacugugggugccaccccugggccugggugcuauaagaaagcaagcugagcaagccaugagaagcaaggcaguaagaaguuucuccauggccucugcuucaguucugacuucagguuucugccuucaguuccuaacccugacuucccuuagugauggacuguuuccuggaaguguaagauaaaauaaaugcugucuuccucaaguugcuuuugguuaugauauuuaucacagcaguagaauccuuaauuaagauaaucccccuccuugccaccauguggucauggcuguggcaaguccauugguguuuggguaacuugccaguggcuacaccauugaaaacagugacuuccuucccuagcaccuauccccugcugguagcucucugggggaagugccaggaacuggugagcacuuucuucccuuggacaaguaacuauagcugcuaugaguuuguaagugcaaaaucaugcuuagagagacuuucacagcuuuuuuuuccaccaccaucugccuuuuucucaauguucccugaaccuugaaaggagcacuauagauguuuucuugagggcugagcauucaacacuuuuucacaguauccugaucagccacuguucacuacaaaaauaagcauuugaccaaagguggaauggagggcagaucaaucuaaagguauagccuuaaauauuuaggaugcaauuugaauaauaaauuguguucuaaaguguuuaugucauuuuauauuccuguuaggaguguaggagacuucaaguugcacuaaacucuuuuuuuuuuuuuuuuuuuuuuuuuugguuuuucgagacaggguuucucuguauagcccuggcuguccuggaacucacuuuguagaccagacuggccucgaacucagaaauccuccugccucuggcucccgagugcugggauuaaaggcgugugccaccacgccuggcacacugaacucuuuauaugaucaguauuugcaauaugagaccuugugacugauguguagcagcaaaugugugccaccugcuucugacacugauacaagcaucuugugauuacuugccagacauauaguaucuuugauaaagugucuauucaaauccuuugccuauuuuugaguugcucuuuuacuauguuuuaagagguuuuuuucauugcuauugguuauuaguuuguugguuuuugagacaggguucaauguguagcccuagcuagcuuuaagaucuaccuucuucuuccuccuggaaccuggucuuaaacuugugugccacuaugaauaauagcuccaauuauguguucuucaucaaaaaugaauuuuggagauaucuucucccaaaauuuuggcugaauuaaaaaaacaaaaagaaccaaaaaccuuacauguguguauauguguguguacacacaccuaagaguacacuugccauagcacaaggacaacccaugggagucagggagucaguucucuucaccagcuaggucguggaagugaacucgguugucaggcuuagcaaguaccuguaccugcugaucaucuuaccagccccuguauuuaucuuugaauuuucuugacaugucuuaaagagcaaaagcuuuuuauuuuaaugacuuuuaauuuauugauuuauuuuauguuuuugauuuuauaucuaaaauucuuaccuaacccaaggccacagaaucuucucuccuuggaaguuuuauaauucuagaauuuacauuagugaucuuuacauuuuagccuucguuacaauacaaccagcaugugauguauuuagggucacuucuuugacauuuuaguuugguguguuaacuucuagccuucccuguauucgugggagggcuauauucaucuauaauuuagaagccuccagguuuucuuguuaggguguuacuuuauuuuaauugucauaggaguggagcccagggccuauguguaugccagguaaguguuguaccacugagcuacaccucaagcuccagaaacauaaaguuuuuaaguucaccauaaguguaugccccacugaucaacaggaucagucaguuaaauuggugguaguuuuuagugacuucagaugcaaacacugauucuccuuguugggcuguaauggugcauggguuggaucuguguuuguccacuccauugugauauaucauuuagguuguuuuucaaaaucucuuagauauaaauggugcuguaaagaacuucuuuguaugcuuccuugggcucacauguagaaauauuucucuagacuaaaaauagaauugguaaauucagagcuaugagagucaaauuggaucuucugaguuuuuauuauugauauuucuuuaaaauaauuauguagcuuuacaugcaauaaguagauagaccagaaguuaccauauugagcauugcgguccauuuccuucacauccauuguccucuuuauauauuggcauuuuuuuugcaucucuuuauuauccagaaaugauauuaauagaaaaauauaaacauuuauauauaaauauauauuauacuuacauucaggagaaucaaaaggaaaggaguuuaguuuuaaugcaugugucauguuagucagguguagauaccacacagcugaugggauaggagagcucagcugcaugcacauccuuacauaagcugugacuuaagggcaauaagaaaaagaaauggauacuguagagcuaagaaaacugauguuagaaaaagugagacuagacuugugauaugagaacugagaggaccagaggaguugucagaagggagaaaaugaggaagcuugguguccuugcauaagaguuguaauuuauguauuccaaaauaaugccugugcugugucuuggcacaaagaaauacuacucuuucauagggaguaccgguauccugaauuuucacugcauuugagguauaugguuagugcccaauccuuuaaaaagauuugggaaauuguaccuuuuguacuugucauuuagaaaauuagaaauuaggaacugaaacuacuuugcuaacaaaaauaucagaaauggagcagcagcugcugcugcugcugguggugguuaaggacaucuuccuugauccuaagauaauacuauacuugauccccuccaagaaauaagaauaagaaugcugcaaauagauuauaguuuguuucuuaacuacuucauauaaaccuuucaaugaagcaaggaggcauugagcucaguuuuuacaaguaagccaagauuuagaauaaucaaugaaugggcccaaagcuuccuacacgggacccaugacacuuuggaugguuuugauagacuaaucucaccaggauaguucuguguagcuuuguagguaaagaaacagccuaguuuuuaaaagucuucagaggcaacucuuuaauaguugagagaacagaauacuuuuauaccuuauccuaauaaauuucuugcuucuuagaugggcuacaagacaagcuuuuuuuaaaaaaaaaacaaaaaacaucuauuuuagacuugugaaaaguaagauuguucaaaguaccaaacuuuagcacuauauguggucuuggaggguaaccuuuauuggaaguucuuuaauuagaagaaaaucagauauaagauggcuaccacuugcauuccauuaccuaccuccuccaccccaauuaugguugcuuuuauccucugugaguuuauuaucuacaggucuagcccuuuuccacauaaaagguaaggcuugacguauaaugaguacuuaaauuuugcuuguugggcuaggcauaguaauguacuucuagcacuuaagagcagcuaaguuugaggccagcacaaucuuacauaguuucagaccaaccaaaaagaacuguguacugagaccugucucaaacaguaagauagaauuugcuuauuggaugaauagauuuuuuuugccuuuuuaaaaaaaaaaagacuuuauuuauguauguaaguacacuguugcuaucuucagacacaccagaagagggaauuggaucccauuacagaugguugugagcuaccaugugguugcugggaauugaacucagaaccucuagaagagcagccagugcucuuaacugcugaaccaucucaccagcccuggccuuuuaaaauguacauuuauucaauugugccuacaguguguguacuacuuuguguuuccauaaugccauuuaacagaauauucuaucuacagcuugcuauauagacugcaagaaccuaauuuucauaacugucuuacauuguauaaagugaacauagcauaccuuaucaacccauuacauagugugagggauuuauaguuauucuaaccuuucucuguuauaaauuguaagagauaacucuuuuuuuuuuuuuuuacuuuuuuuuuccauuuuuuauuagguauuuagcucauuuacauuuccaaugcuauaccaaaagucccccauacccacccacccccacuccccuacccacccacucccccuuuuuggcccugguguuccccuguacuggggcauauaaaguuuguguguccaaugggccucucuuuccagugauggccuacuaggccaucuuuugauacauaugcagcuagagucaagagcuccgggguacugcuuaguucauaauguuguuccaccuauaggguugcaguucccuuuagcuccuuggcuacuuucucuagcuccuccauugggagcccugugauccauccauuagcugacuaugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuugucuuuguaacuccuuccauggguguuuuguucccaauucuaaggaggggcauaguguccacacuucagucuucauucuucuugaguuucauguguuuagcaaauuguaucuuauaucuuggguauccuaagauuggggcuaauauccacuuaucagugaguacauauugugugaguuccuuugugaauguguuaccucacucaggaugaugcccuccagguccauccauuugccuaggaauuucauaaauucguucuuuuuaauagcugaguaguacuccauuguauagauguaccacauuuucuguauccauuccucuguggaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagggugguuguacaagccugcaaucccaccaacaauggaggaguguuccuccuacuuaaagaguauuagguuauguggagguggacagauagacaggaagauugagauaaauguugcauaaaaugaggcagagccacacuagagagccagucuaauggcuugaguaucugaugggcugccacuuuucauggaacuauagguaucuggcugguggugaugggcucuuucccaccagacccuuaaugaggagacccuuucuauuucuuagaaagauaauucaggauaaagccauuugugugugguugaucacaucaguaggcucaugaggucaaagcaugaagagauuuuugugcagagcccucuggucuucagaaguuuggucuuguagcuuuuugcuucuccauaucccucuuuccuuucacagacacuuauuggcuauugccagugaguucuuggaacuguaacuaguuguugauggaaggacuuucaauccacuuuuucuaaaaagagccuucaucuuccugaaauguucuuuugaaauaguaucugaguccuaaaaucugaggaaugcaugggcguuuaacuuacauugcuuuaaaucaguacacauacaaguggaaaagggguuuuguuuguuuuguuucccugaggccaagcuggcucuagaacauacuauguagccaaggaugcccuagaacuuuugauaucccuauguuuaccucuccaagugcugggaccaugagccuuuguuaccaugccugguuuauguagugcugaggaucuaacuaacugcaugcuaggcaagcacucucuggacugaucuacuucccaaguccaacuugagcuuaaguuuuaaaauuuacuguauccauuuuuguauccagcccguguuaaaauaaaacaaaaauggcacacugaaccuccuucuuucuuccuucuuauacuuuugcuuuguuuugaugacugugaacauucaucuuguacuaauuauugaaacaaugugugccuggaucaaauaggagacuacccucaggccucagcagauauuuguguuuccaagccagagaaucugaauuguuaguuuuuuuguaaaacugcaucucuaaauucacuggugccucaggagcuuucuuuccucaguggccuuggaagaagagauggcugaaacuauaagccaucuugugcaccucuggcauccuucauacacugacacauuuguugcccaucuuccugcccagacuuuagacugacugcagcucugcucuguuugugcacugaauuagguuaguuggguacuuauaaaggcagaacccacaaagcuauucagaugcuguaauuaggguuuucuagagucacagaacuuauggaaugaaugaaugagugugugugugugugugugugugugugugagugagugagagagagagagagagagagagagagagagagagagagagagauggaauuuauuggaaugacuuacaggcugcaaucugacuaaccaaacaauggcuagcugugaaugggaaguccaagaaucuagugguugcucagugccaugaggcucaguguuucagcuggucuucuguauaagcuggaauccugaagaaguagcuuccaacagaugugcuggcaaguaaguauaagcaggcaaagaacaaacccuuccuucuuccacugucuuuauuguaggccuccagcagaagguauggcccagauuaaaggugugccucaaaaacuggauuaaaggcauauguuucuuccagccucaagaucuggaucaaaaguuugugucuuccagcuuugagaucugggucauaacugugcccuccauuucuggauuguaguucguuccagauauaguugacaacugagaguagcuauuacaggugcuuauaaagccagaacccacaaggcuaugguauuuccagccauuguccaauugggagcaaguauauauccugauguacuuccugccuauguaccugcaacuacacacaggaugugcaguuugggcaaaugggcuuauagcuuaaccuuagcucuuaaagacaguaaacaaguccauucuguuguucuuggagugguuuuugaaugcagugcagaccauauguuguugccuauguuucagagauuccauaacuauagaaauauuagcuuuggcaugugaaguugaauauacuguaugcagacuguccauguucuccaaaucucucuaugccauguaguuuuaaaauugcuucuaguuacuuauuucccauaguaacauucugcaaauucacuaaagaaaggugaucugaaaagggaaggguagugagaaaagaguuuaacaaagccacagaagucuagguaaagggaagccuuguuaaaauaacacaucuucccagaaauaggccaucaugguagucaacagacugcuucagcagcuagcuggcagaacagcagaaacacuuugauuuugcuuccuugguuacagugaaugauaguaaacuugaccuucagcaaagcagggucacagaaagggcaucuuuaaacagccuugucugcuauggcaaauggaaucugcacagcagaguuugaaggcuauccaccaaccccuggcuaauuugguuacuauuuggcuuaggaaguugcugagggaaaaaaauguaaauaaagcugcuggaaacaauuggcuggugaguguaaaugugugugugugugugagugugugagagugugugugugugcgugugugugcgugcacuagcgcuaguggacuggggaagaguagaagaaagcagaccaguggggcagcagguagcacaggaaaucuucucuaguuguacuuacuuguggugguggugguggaggggggaugggcagcucuaagcaguguacuuuaguagaaacuuguuuccaaagcuguuaguaaaaugcacaguauuuagaacccaguuguguauuuggaggaaaucauaucuauuaugcuuaaguacuagcaggcuuuuuuucuuuuuagggacuagugugagagugugauaaguacauugcuuguuuuuggcagguuaucugccuaugaacaaaagauuauguaccagauugcuauuaucacaugguuuuacauaauugugagauauaguuguuggcuuuguuuuuuucaguuuugagacaaggucuccuuuggcacccagggugaacugggacucaugauccuuccaccuuauagauuuguguguguguucaucuauauuguuuaaauuugagccuuuaaaggcuucaagugcagaacuuguaggucaucagcuggacuaguaacuuuccaguccuuuguguuacacaaguuguugucuugguuaguuuuugucaaguugagaaggaaccucaguuaaggaaaugccucuauauauggucuguaggcaagccagaggggcauauucuugauuaaugauugcuauggguggguccagcccauugugggcaggugguucugggguauauaagaauacagacugagauagccuugaagaacuagccagcauuucuucaugguauggucucugccuccagguuccugucuugucucuuggugauauagugugagguaaaauaaacuauuucuugucuagguugcuuuuggucaugguguguaucauagcaguagaagccccaaauuaaaacaaagguagacucuacaguccaggauacagaggguaucagaacugauacagaggguaucaguuccccucugaugaaacccgcuacacaggugaugcaaacuucaacacagagggguuacucacugcccagugacccaaauuccauggucauuugaaacagauaagaagaauaugguucuuuuuagccuaggcugccuguaguccuuuaggcauuugcauuguucauuauuucccccuggauguuaagaauucagaaguuccugauugagauuuguagcauauuagguuugccgauuuuucuguacuauguuugaacuguuuugcuuuaugaaaauguugcaaccuaaauuuagaaguuuuguuaucugcacauugacuccauguugugcagauauuccucaaccuaaauguuuguuuuucagcagaugacugugugggaggcagugcugugcagugauggaagaaugugagaaaaucugaacuuacauuuugagaacccauccauguccuugguuuauguaauaagcuucuaagggaggcacugagcuguaccuacaugaugucuaauuagcagacagaagaucuaagcaaaguccaaauucaaggcugcaaaacagagacuucuuauucuuucccuucguucacuaagcauucacugugugcucagaagagaaauagucauguauuccuguucuuaggucacugaaccaauaggguaguacccugugaagagugccaauacccaggacugugaagccuauaggagacaagccaguuugagagacauuaaaggcaggccacagaaacagggcuuucauuagacuaugaagauaggaaagaugacccguguauuggaaauacauauauaacuucauuucuuucuaaaugaaguucaacccuuuuagucuaagcugcaaaccaugaaaaggucuguguucaaauacaccuauacaccuuuauaaccaacuuugcacgcaguuuccuuggauccuuccuucauuuauauguuguuugauacagggucucucucucuuaguugggauuucuauuccugcacaaacaugaccaagaagcaaguuggggaggaaaggguguauucagcuuacacuuucacauugcuguucaucaccauaggaagucaggacaggaacucacacaggguaggaacuuggaggcagaaguggaugcagaagccauggaagaaugcugcuuacuggcuugcuuccccuggcuugcucagcuugcuuucuuauauaacccaagacuacuagcccagggaugguaccauccacuaggggcccucccccuugaucauuaauugagaaaaugucuuacagcuggaucucaaggaggcauuuccucaggggaggcuccuuucacugugauagcuccagcuugugucaaguugacacacaaaaccagccacuacagucuuccaccacaccccaagaugggguuuuucuguauagaacagacuggccuuagacucagagauccacuugccucugccuccugagugcugcaauuaaaggcauaugcuuuuacaaagcucagauuucuuacuccaaucucucuacccacagcauccuuagugcugggauuauaggugacugccgccacacccaaauaagcauugcuauugcuucggauuggaaccuagggccggcccuuucauaaaagacaagugucuaccauugaguaguaauuuucuuguuaaagcacaaguacucuaccccagguauaacacauaaacccgaauguugccuggcaguuguacuugagcauuaaauuaaucuguccucugcaagcugagaaguugaaggaggcaguagauagcaacggcuaaggcacagacucaacuggcacugagauugcacgcagggagagacagaaagcagaggcuuagacuaaguggaagaauagcugguguuucuauguuuugucaucaggcagaccuuauauuacugugcugaauguuuugcaauauacauauggaaagauaauguauuuccagauuuauuuugaaugcuaguuucuaaauucagacacuugcaagcauaucuuagagguccuauuaugauaucacuuugcuuuuaaguaagaccaucuuuaugcugcuucugauaacauugcaauguuugaucucaauugucaacuuacuaggauugaaagauggaagcuguaucgguagcauuucgugagacaguuagauaaugaaggcauugaccagacaaauggguucaucgcuugauggaauuuuaaaauaaugauguuggugggaaguggugaaguguaggagguggugguuuguugcaggaguuggucuugggaguguguuuuugaggacuguauuucuguggccccuucuuuucuguuucuugcuugccaagugagagcagcucugcucugccucauugccucugugaugacuaaaacagugaaauagaaauaauuucuccauuuaucuuacuuuucuauuaucuguuaaagcagcacaaaaacauagcauagcuacuauauuccaucucuaaggccaugggagucuagacuacuaacuagccuuaucacuuccagaauugagcaucccuaccuaccgacucccaagggugcuugaagcuauuuacguaaccuaaauuuaauacugaauccauugccaguaugcuuccccagccaacccagguagaguccuuuggucuucuuuuauaaauaagauugcauuuaggguuuuugugugugcuaggcuggcacuguaucauugugcuauaucuguagcccuaugcuucugaaauaaggaaucaugaaugugacaaguauaugccuacacagguaaagaagccagacugcaaagcuuaaaaacagcacacucauagcccagcucagguucaaguauaacauaggcccaaguaguugcuguaguuuugugguuugaaaauuuuuuccuggguuucuauaaaauauuuuugaauacacuugguuauuuaaaagacaaauuuguuaguguaauuuauauauaaaauuuaauuguuagucuaauauauauauaaaucuaaauuauauugauuguaaaauucaaugaauuaucacagagggaauguuuccaugugacuaccacccagguugagaauguaggggauguggaauguagcuccuuugguagagugcuugccuaauuuauacaaagcacccaucuguaaucccaggacgugggagguagaagcaggaagaucagacauucaaaaauuauccuuggcuacauacugugcuugaagcuagccuggcauacaugauauccugucaccuaagacagaaagggagggauggcuggucgaagaaugagagaggaagaagagaauuuccuaaauuccagaaauuuagacauuucuauuuuucauuuucauucacuccuccuuccuccucagagcugaccucuguccuguuucuuacacuaguaauuauauagaguuuuuguuuugggcuuuuuuuuuuuuuuuuuuuuuuuaaagacagaaucuugcucuauagcccagaccugcuucaaacucugaaucuuucugucuuggccucacaaguguugagauuacagguauacaaaccuaaccucaaguggaaaauuuuguucacucauuauuuuuuaaaaaauuaaacaugauucacaauaacaauauaauuuacauauuuuuaucucuacuuucuaauuuuauugacccgcaaagaaaccugaaauuccuuaaccuguucuauauagucuggagaaugauauauaauagccauauuuuugguuuugaaugaauauguaaguaaaagaauaaauggcaagaguuagacauuuucaaaacuggugcucaaaacaucuagcagaaaaugacuagaguaguugaggcauuugucuggaguuccuaguaaaagaacaaauaguagcagaaagauagugucaaaccaguggcuuacaaacauguaguaaaaacuaacuuaggaggcuguuaaggcagccagcuggaguuccccucauugguuguaggcagaacaaugugucucucuggggugaggcuuccaagcacaagaaaacauagccacaaauagguggcaucaaauuggguacucacuacauccagcagaaauagccuggggaaauugaggcagucagcugaauucccuuucagggcugaauguccccuuggccaaacucucugacuugucuuucuucuaauuguauuuucauuauucaucaucuuuuggugacacuugggugaucccauaacaugguugucuuaaauacuacacugaaaugcagacaucucuucccagaagugagagugguagaucuccacauuguuuugauuacuauagguuuuagaauguaugaaauauagagauaugaguccacuacauauucauuuucuuuuacaggauuguuuuguucuggauuccuugcauuuuacauggauuuuuaggaccagcagaccaguacauggggagaaaagaacaccuggguuuuuagcaggaugacauugaaucugucaguucaggaagcagugccuauuagcauuguauucuucuggucugugaacacagauuacuuaggcuguuuuaauccuuucagugguauuuuuaaauuuuuuaaaauuuguuuuguuuguuaucuuuuucuuuucuugcccuuuuuuuuuuuuucuuuuuuuuuucgggggagggugcuaagaggagaacaagcguucauucuaguccaagcuggcuuauguaucucugguuggccucaaacagcaauccacuggcuucaaguuucugggauuacaugugugagccaucacacuuggauuguuuauacuuacuuuguuaaauuuacucccauguuuuguucuuuuuuuaugcuauaucaucagugagauuauuuucuuaauuuuguuuucagauugcuauugccaguguaccugcaaccuuggaacucugacuaguuguaagggauuuuuuugcagguucuguaagauucuuauguaauaacauuuaauaugcauauuaaauuuuuuuacagucaugguauauaucuguuucccucauguuuucuuucuuccccuuuugcucuccccccaccccacuuuaguuuucuuuuuucucuacccaguuccccagcuagcaguuccaguacauucacacagcgguaaaaacauaccuggucuuguuuuucaucuugggggaagcuuuuguccucuguccuuuaucagauugagugcuuuccucguuucauuggguuuuuguucuuuuuguuuacuuguuuguuuuuuuauuuuaaaucaugaaaggguguuagauuuugucaagugcuuucagucuguuuuguccauugcagugaucuuguagcucaugcugaacugugauuuucaugcacugaaccagacuugcauuccuuaggaaagcugcacuuagacaugcuccugaauucaguuugcuuucuuuuguugaguuuuuagauccauauuuauaagauaauuuucaugacaucuucuaagguauugagcaauauuggccucacagaacaaauuagggaaauauauuuuagggugugggaaacaugccaccuuuguaugauauuuuucaugauauacuuuuaaucuaggaaaauacugucuucuuacuucagguacccaggugaccacucagcacguugauccucgccuuugguagguauuguuugagacccuuguguucauggugaacuuugcccaacucgguucugccugaaucuaagaggcugccaaacccuuccauaaaugcugcucccaauaaucuucagggcugugcuguuucuauuugucauccauccuuugcaguguugugaaagccuuucuauuaaaaguuaucacaaagaaagaaucuuacagguggcuuuggaaacaguggaaaaacuucaaagaacaucucuuuuagaaauuauucugauagcuuuuaaaaaaggucauggaaagcagaacugauuugguuauccuuguguuuucaacauuagaagcagcuauuuuaagaugguguuuucuuaggaccaucaugggcaguaucucacuauuuccuuuuuuguccuguguugauaccucaguagucaaguuggucauucaaggacacagcaagagcaagaggcaugcuccugcuaggcaugguugugcacaccuguaauccugcuacuugggagguagaaacaggagggucaguaguucaauaguuagaggccaggcuggaguuuauaagaccuuuccuuugagaaagaagaaagaaagaaagaaagaaagaaagagagagagagagagagagagagagagagagagagagagagagagagagaagaaagaaagaaagagagagagagagagagagaguaaggaaaaggguaguucuuagaaaaucacugagcgccuuccuaaaccccguguucucauccacagguaccacguacacagaccucuuggccggaaucuccagggaugaccagccccuccccgcgcauccagauaauuuccaccgacucugcgguagccucaccucagcgcauucagguaaucaugucaguuccacuggguuucuucacucugccccaaaccaaaccugccuaagagauucacuauagaguauuuaccucuugacaucaaguacagugugagcucauucauuucgaaagcagcagguaaaaguuuacguuacuuuuaaagcaaaaguaugaauuauugcuucaaaauacuggaugacauaccauuuuauuauuuacuugcuuccaaauugaggcaguauauauuuuauuagacucagggaccccuugcuuguagucacauccaaugcccucacauaauagauuuuucagucagggcaauuaacaauuuuaauuaaugccucacuuuucuauuuggaaaauauacauaauaguagauuuuuugcccuaaaucagcaacauuaaugcuuuuaaaaugcuuagaaaggcaucuuauacauaaucauauuuaauuaauauguauuaucgugcauaguaacuauuacuauuauuauuauuauuaacuauuaagcaggggcaggacugugaaucugccuuuaauccacugaauauuuuuucucuucuuuugaacaaaaagacuuuggagauuauagcaagaagcugggagaaagcgauaaugcauugcuauuugauuacccagcuaaaucagaacauaugaacagggaugaaccaacagaaaaaaacaucugcagguaaagcaccugccaagaaaccauggugacuugagcucagucccugaacuaacacaggaaggaaggaagaacagauucuuaaaaguuguccucuuauuucuacauggacaccauggcaugugugcacccucacacacacacacacacacacacacacacacacacacacacacacacacacuguauuaacucacaaugauaaauaagauaaaacauuuuuaagauuuuguuuuuaaaaguaaaauaauuucucuguuuucagaguuacuacagauggccucagugagauccucauuccuagucaugcucugucagugagcacugcauccccuggagccugacaagagaaugcaucuuuaguauuuuaguguaugagagcaaugcuuagaaccuaaauaguggcuucucuaguaaggcuaagacugaaagaugucaaauuagacaauguuuagccugaauuaaacagaccuagaucuagucuuaugaccuagggagaauuuccaaaaccuucuguacgguuucacaguggauauauaugagugcagaaggaugaaauguggaaaggucugcagcccugcagauggguaccaggaaaugcuagcaguugugcuguaagagguuuugcuugcuuuugugcuucuguuuugcaauaggcucuccuguagcugagguuggccuugaacucccgauucuucugccuccacauccccaguacuggaauuauuauaggcucgugccaacauaccugguuuugugcuuauagcuuuuaauguccuauuuuuauacugcuucaaauuuacagaaaauaacacguaaaauuguuauaaccuuuacucaaauucacuaauuguuugcuauccaauucugaaugugauauauacguguguguguguauauauauguguguauacauauauauauguauauguguguguauacauauauauauguauauauauacuuuggauucauuuucucauuaacggcaggcauuuauuuucauuggaucagucauacagguuucuuaagaacgauggcauucucuuacauagucauaauaauaagaaauauuaguacuaaaacaugccguuguaggauacauaaucuucauuccacaauuuccagaguuuuuuuuuauaaguguuuguuuuuuuuuuccccccugggaucugcuagaauucauuauuaauuauaacaauaguaauuaggugccaggcaacccaaaacaccaucccuugucaugcaggcuagcauagauguccagaagccuugcugguguuuuuuuguaugguauggcccuaacuggcacaaagauuuuuuagggaagaagaggaggaggagggagaggaagaggaggaauauagucccucaguggaggagaggcugaggcugagaguugcugcuuuggggauagagauauagggcaagagcuguggagauaauggaaacauuaggaaaacauuagguucaaguuuuuacuuuuuuuuuuuuucucuuuuuuuuuucgagacaggguuucucuguguagcccuggcuguccuggcacucacucuguugaaaagaaagguuaaguuaaaaggcaaaaaaaaaaagguacucuauuugguuccauuuuggaggugauugugagauuuuucugccuuguuuucugccucagucugccuuuagugguagacugagaauucugugugcuuugagguucuccuaggaugguccuccaucucuuccuuuuucaguuguugcuucucaagaaagcauuauuguaaucauugagcaacuuuauuaaguguuuuuuucugaaauacauuuccguauauaucauucaacuauauuacauugaaauucauguacaauuuuguuagaaaggacuuugugcaauaccuuuuuuuauuugaaaguuugaaaucuuccuuguaguuccuagaaaaacuguggcucuuacagccauucuguaccugcuucucacuugcuaguagcauuguguuuugugugcuuucugcuguuucuuucucuuucugauaggauagugaccccucuuagguacucagaguuguugcuugccuguggggguuggauagguaauaugugaaugcuguacuaaaguccaaccaaccaagguacagaaggcacaggguagaaauaggaccuucucaguagaacucugugagugucugugucugucucugucuaugugucuguccuguccacguuggccucaaacaucugugugccuccugagugauguaauuauaggucugugccaccacacucagauuuugugguguuugaggaucaaauguggagcaugugcaugucaggcaagcacucuuaacagagccacauuucuagcccuuccuucuuuaaaaaaaaaguucaaggaauuuuguuuuuaauuuuacguuauaauuugagacaagaccuuucauaaaaucuggaacuugcaauuuugacuagcuuagcuggccaguaagccuugggccccacucccuaacucucuggugucgugguuauagguauucuuugcccagcuuuuacauagguauuggggaucugaccucagguccccaugcuuacaccggaagcacuucacugucugagccaucuggucauggugucucuuuacaauaauaaaauccuaagacacugacuuccuuugaugauugauggacugucaugaaaguauaagccauuuccuucccaaguugcuuuuggucaugguguguucuaucacuauaaaagaacccuaacuaagacaauaucaaacuauacuuaaaaaauuaaaaauuaaaaaaaaaaaagaccaaggggcagagagaggauagacaugauguugaucuucucuaagcccgccuacacagugacacacuuccuccaacaaggccacaccuccuaauagugccacucccacggaccaagcauauucaaacccaccacaggcaaagaucaaggaggaacacuccucacuggcuugcuucccaugaccuuguucaaccugcuuuccugacagccaagaccaccuacccagagguggcuagacccuuucacaucacuaaucaagaaaagauaccauaggcuugucuacaagccaaucuuauagagacauuuucucaauuaagauuuucaucuuugagucuuccacuagcagccuuuggaugaagacauagaacucucagcucugccugugccaugccugccuuuuuacugccaugcucccaccuugaugguaauggacugaaccucugaaccuguaagccagccccaauuaaauguuguuuuuuauaagacuugccuuggucauggugucuguucacagcaguaaaacccuaacuaagacagaaguugguaccagggacugggguauugcugauaggccuggccaugcuuuuauuugaaagaauguguauuuuugaacuuuggauuuggaacucaguggaaugcuuuaaauggggcuuaaugggucauccuaguaggaauauggaagacuuuguugcugggaguaauuugaacuguguugaccuggcccaagagauuucaaaggagaagaauuucaguauguggcauaaagacuguuuugugguauuuuggugaagaauguggcuacuuuuugcccuugucugaaaagucugucugaggcuaaggugaggagacuuggauuauauaugguuugaguauuaaaggcauaccaggaagugaaauggagcaaaauccuguguucuaggaaauaacagauuaagggagugggaccuuggggcaagaguccuacccagcugaauuuagauccaggcaugguggcacacaccuuuaaucccaugagacaggcaugcugaucucugcauucaaggucaaucuacugagcaagaaccaggauagccaagcuuagucagugaaggauuuagaaaacauaaagccagugauaauguaauaggacaaggggaucauguucuagauccuguaagcagcagaacucgacagcuucagccauguggcucuggcucuagaguuaagaauggaaggaacuacugggacaauugaugcugguuagcuggagcuaagacauuagcaaugauuaagaagagaacagcaucacugaguugaaacuggggguuguuuucugggagcacaaagaagcuguguuccagagauagccaaggguguaccucaugcugcagcuggacuugguaaugucuaagagucaccuaggugguacugguuuugaaggcaugaagguguuaugaagaacaguugaggcuuugcacugugagaggucauggaaggccauuggugaagguguagccucagcuguaguugauggcccuggacugaaggggucaggcaaaggauuugaugcuuggcaccaugaagagagccuaugagaggcuauuggugaagccuaguuggaguggaacaccccaguguauuagagaucaguaccaugggaugaucaccaagaucagcagccauaguggaguggaucaaccugagcuuagagugcaacagagggcagagcuggagaagugaugccagcccuuaggaagaguccaaaauaucaaguggaaucucagacacugaaacaagaagcuguaacauugaaauuaccuuggagacucaaggauguuaaagaugccagagccaugagauacaugcugaggaaagcugcuaacagggaguggaacuagcccaggagaaagcaguuuguugcagucaauaaacaugaaaaaggaguggagaucugaagacugcuuugacaucagccauggagaugcagaguuuggaguuugcccagcugguuuccugccuugcuuugaagauuacaguuaauugguuggaugaaucucagaagagcccuugaacuuuggacuuuuaacaauguugagacugcuauagacuaugaggacuuugaaaguuggaaugcauuugcauuaugcuauguuuaaguauggccuccauagacucauguuuuugaacaagucuaugagggccagugaguggaaugugaugguuuguauauucuuggaccagggaguggcaucauuugaagguguagccuuguuggaaaggugugaccugguuggaguaggugugucacuguggguguggacuuaagacucucaccccaguugccuggaagucagucuuccacuggcagccuuuggaugaagacagaacucucagcucugccugcgcggugacacugaugauaauggacugaaccucugaaccuguaagccagccccaaguaaauguuguuuuuuuauaagacuugccuuggucauggugucuguucacagcaggaaaacccuaagacaaaugagcaagcacagauuuucgagggcuuaaucagaucucaugaguuuaauaaauggaguuguguaauucaggauacaaaauaauaaagacacugugaacacagggaaaaaaaagauuuucaucuuccuagauaagucuagguuugaguuaaguuguuagaaagccaacuggcauacacagugcaaaauagaugccacuauuucuauugcgcaauuaguugauauuccauuuugucacacuguuccuaaaggaggcuuacugauugauguuuucaccaaucuauccuggaagcaucuguuucuccauauuuaauauuauguuguacuuuuaacugucaguuugcuaaaugauacgucggugcuguguagcuuuuauauuuauguaaauguacauaauaaacuauuguuuuuguguaauuuucacauuuuaugaacaaaaaaguaguuuuccucauccuucccuguauuuacuccccuuaauuuucaaccaacagaucuuuugaaaaugauaccuaauuuuguuaaaauuauuuaaauuuguuacaaaguauuauaugguaaggaauaacuacugaaguauccaugguccuucagcugaguaucugccuuauaggaaagauuacuauguauuuaggaagagguauggaaaccaucuguaaaguggggaauaauacugguuuaaucaaggcucuggugguaguuuccuaugguacuucauuucccuaauggaaaauguugggauucugcagaauuagaccuuggaguguuuacucuagcuuuuuguauuagcucuagcugaguagauggcuuuaggugccaaauaacuagccaagacuucugcuguaagccccacuuagccuaagguaagaucgcucuuaugacuuugucuucagccuauguuuuauucaaaaguauauuguuaggauuucuguuucagucucacugaguuugagaacauacuucauaugcuuucuacucugcaaacuuuuacaaugcauuauaagagccagaauguaguuucuguuagugacuauccugagcaguuuugagaauugagguauugugggugguagagggaauaucauauaaaugccguuuauaucaagcugaucauacuacuuagccugcuguuccuuacuagcuuugaugccugcuugcuagugcuuacaggaaggcauugaccucuccaacauagcuauggaguucuuuguuccuuccucuaguucuaucugguuuugccuuguuuuauuugcuugacugguuuaggguuuugauccuaaugcuguaaccuaggguuuugcacaugcuaaccccagauuccuuauauauuuugcuucuugguuuugggcacaugaauuuggauuacuacaccuuucuuugagaaucaauucucauuauguaauaccuuucucguagggcccaauuguuuccuuguuuugaaguuuauuuuguuugaaauuaauguaguuacuccaucuuuuuguuacuguuuuucuguuuugcuuuuuauuuuuauguacaagguacaucuuuugucuuuucaucuuaacauuguuucauauauaugaaauauguuauaauaauugcuguauuuuuacuggcguaugaaaaaauucacacuuaugugauuaucaauaauuuaagauuauuaucacccuuucauguaauuucuguguuaauugccugaaguuccucuucuugauuaugauagauauuuaugugcuuucaguuguugcucuaguguuugcauuuuacauuucaauacuuuaagaccaccuacaaaugauauauaauuguuagugaaauauacauuacaaaaaaagaaaaacauuuuaagugcacuuuaguaacauuguagucugugguguuguaucaccucaccuuauuaguuuaguuccacuauacuguauuuaaaauggcaguuucuuuaaucccagcacuugggaggcagagacaggcggauuucugaguucgaggccagccuggucuacaaagugaguuccaggacagccagggcuacacagagaaacaccaucucgaaaaacaaaacaaaacaacaacaaaaaaagcaguuuucuacccauuuuucuuucuuucaccuuauucccuggaauaaguaugcagaaaaacauauaauaugaguugugcucaucucuuuuacuaauguguaauguguccaucagcuuugaauggguagaaagucacagagaacuggaucucuccucuguccuccccacucgaguugucucuuacuggugagcagagagcauggacauuuguucagguagggaaaucugggcuugccucuuacuauaagcuuccuaagacugcaggauaagcuuccucaaguguugccacuuaauaguuuccggccagacauaugaauaaaauugaggugcugcggggucuaagaaaaccucuucuuagccucccugcgugcuuguaccuauuucaaagcuugcuucuguuguuucauggucuuuuguggacgcuagucaaggauaaugugacuugcgaacacaccaagcucaaggucaugcucuguguuuucuuaguguuccucauagaauaaaugauaugcacauaaaagcccaaugugguguugcacaccuguagucccagcccuucagagucugagggaaaagaauuaugaguucaaggaagaaaagacuuucaguuuucaaggaauuggggucaggccuucugcugugucacuacauuccacagucuuaauaucuucucuccaagugcuaggccucuuuuggccugaccacacaacaguaaaguuagauguagccucaaagagaucucagacucagaaaauggaguggguuggugaagaaucacaauggagagccaagugaauucagccacccaagacagacuccuuacaggaccuucccuaaaaaacuaucacuucuuuaaagcaaccaucuccagauuuuugaagaguuaaugcugucuuuuuugacuauugagaggauggggugcuuuuuauuguuuuguuuuguuuuguuugagacaggguuucuguauuuagcccuggcuauucuggaacuagcuuuauagaccaggcuggccuugaacucaggaucgcccaacucccccucccaagugcuaggauuaaaggcaugucccaccaguauccacuccacccccucuuaaaaaaugucuaagccuaucuauuuuuaugauuaucuucaaaaagggccuuuuaauucuaaaaauacuaaagaaaggauccuagaauaaaaguaauuuuugaaaaaaauaauuucugaaaagcucacuauauauuuaucuuacuuauuguuuugauaagauaccagucaaaguaauuauggcagcagaaacagaaggccauauugcauccaguccagaagcagaacagauugauugcuggugcuuagcucauuuucucccuuuuauucuauucaguccagaguuccauuucauggaauggcaccacuugcauucagggugggucuucccugcauuguccaauuuuucuggaaagacucacauaggcagcuagauguguuuccuuagugcuucuaaaucccgucaaguugacaguagagauuagccaucacaacuggugcaguauaucuuagaccagcauccauucuagugaucaccuccuaagcacugucugcaagugcagacaggucuaaacaggucuaaagacacaccaagcaaaggggcuucuauguuauaucuuguagauuguaacagaccagcagacaggacaaaagauccagauagucaccgcaguggaugccucuggauccucuaaacagcaguucauccuaaccagcccagauggagcuggaacugggaaggugauccuggcuucuccggaaacauccagugccaagcagcucauauucaccaccucggacaaccuugucccuggcaggauccagguaaggcccauugacaggugguuguuuccagacgagguacugaaccacuucucagcucaguuuugccuugccuuugggaauuuacaagcauggugggauugcugccuuagcuaaauuaaaaaccaguaaauugaacggccacacccagaagacaagcaggaacaguaagaagggauaaaagcuaauccaaggaaaagacacuggcauaggcaagguuaugaggccacuggagaauuguucuuaaagggccgcaugguggaaaccauuagccucagauaucuuuaaggcacccucuggagcugaccacucuuaccucagucucauguagguggccaaccuagguccaguucuucauuuugauaugacauauuuuccagaaacuauucuguacuucugucuccugcucugucuuaccuauuucuauucugagagggaggagcaagaugagcaagaugggauugggagcagccacauucaaucaauaagggcagccacaauaaacaaauaaacaaacaaauaaauaaagaugcugaggggaaagcagggccaauuguaagguuggaggcucuaugccagcgccucagaguagucaggaacaaguauguuuugacauagucuauguuaaauuuuuuuugacuuauuuuugagacagggucuuuauauagcccugccugucuuggaacucauuauguagaccauguuggccucgaagucacagagaucugccuguuucugccucccgaaugcugggauuaaagguauaugccaccauaucuggcuugauuuuuguuuuuuaauuugugaauuguccauaauguaaaauuuaccaucuuaaucauuauuguagccccaucuguaaaucuuuucaucuucccaaacugaaacacuguaccuauuugggcucucacacauaagccacggugaaaagaugggagaagucaguguucuauucccuuucccucaagcccugcucaauuuccugcucgcaccucacccacucccagcccaugggaguguuuguguguucaagugcauauuuuuaguaaguuuagaugcuuguagaaacuugagagguguucagucaccuagaguuagaguuguaagcaguugugaacuccccaaauuugagugcugagaacugaauuugagucuuccacaagaacauuaugaacucuuaacuucaaagacaucucuucagacucuauaucuguuuaaaauauuuuugaugcauuuauauauuuaugacauuuuauauuacauauauggcaaauuuauauuuuguauuuuacauaugaaugcauacaugguacagcauauguguggaggccagggggcaucuuacaagaguuggcuccucgcauguggguucaugggauugaacucagauugucaggguuagcagcgggugccucuucccacugagacuuuuugcuggcucuacaucuuauuuuuugauaugucucucaaaacuaauuuggagaggcugccugccugaccaguaagccuggugauccaaggucuuacuggccuugugcuuacacagcaaggucuuuacugacugacccauccgccagcccuuguuuuuauccuuucaucuauugguugauaccugguuagucccacuguuuggcuauuacugauguguggagcauucuuucuacuauagagagaaacuucagaaccuccuuuuucccuugaugagcuagacuuagacagccaguguguucugcuuucagaaaguucucugagagagcuagcaguacagcuaaccagcauuaucuaucuuauucuccuucuccuaaaguguguucugaucuuuugauguucaacuauccauuuuguuaaaaagcacagguuugugaaagacuggcuucugauguugucauuucacaggugguuuuuaccugauuucuguauacggcccaaucgugugagauucguuugaaggucuauugugugcucaaauuaaguacauuuuaaaaauaaccauucuuuaaaauuucuuagcuugauaucaguuguuuucuccuagauggauagcacuguuuguaaucuagagaguuaccuacaagugagaggaaauagcaggcuucuguugucagcuguacuaguucaucucuccauuaccaggugcuucaacaaacaguccaaucaggaaagucugggugugacaaacaugccagguuguauauuuccauguuguucgaugggaugagaaacauagcugaagaaccuuaccuauucuuuaccuuagagaaucuauaugugaucccuauguggccuccaguuuuggugauagucacaggauagaguaaucauugacaugugcaggccaguggggaagcagaauuaccuggcuguugaaugaagaagcuguugguuaaaguaauccuaguucuaccuagaguucuuuuaguuuagaugccuaagacagggggaugcacaacuagauguuacuuuacuuaguuaucuagcuuuuaauuggcacuguuuguuugccaacaucuuagaucgucacggauucugcuucuguggagcguuugcuggggaaggcagacguccagcggccccaggugguggaguacuguguggucuguggcgacaaagccucugguaugugacuccggcuucuggcacguaucaaggagcaacaugaccuuuuauaggguaggaaagugguuaguugagaaagaacauuuuauguagguuucaaacaugaaccucacauaauaagcaaaguaguugucagauuauucaaauugauaggaaaagucaagaaacucugagauuuguuuccaauuguuuauaugcuauuaaguaaaaaaauuuuucucaucuuguuuauaucacccaagguguguuauguauauaauucccccgauccaaauugucucacuuuucuuuuuauccuuuuacuaaacccugugugauaagcuucuaugauggaguaggaaccaugcugugccccuuggaaaaguguacgcagacgugcaugcaugccucucucucucucucucucucugugugugaguguguguguguguguguguguguguguguacucuuaguggagacccaaggccucuggugaguuauuuaaaucuguguuucugguguccuucaaggagagcccaaaggcuuccgcaguuagugcucugauggagacaggaggcuugcuagcacuggggagccauagaagguaagcaaagcaguaaggcaggcagugggaaugaagaagcucagcucagggaucuggggcauagaccugaguucugaagcagcuuuuuuccacucacaggaagucuggaggguuuguuguccuggauuucauuuuguccuuuugaaaaagggguuugaccaaaucuaggaggaugcuucagaaggaagcaucuucagaagcuuuguuuuuuuuuuuuuuuuuccuuuaagcugguuuuaccauuucucugccauugguaccugcuucugauccuaccuugucuugguaaagccaguccauccuaccacuuaaaggcccaucuuccccuggaagcagguagacagcgcugucacugguucugauuguguuucuccaggcuguccagacaucuuguacauuuuccuauaaucgaaauggacuuucucauuggaguguuugagcaaaaucuaugucugcuaaacaaggagacacacugcagauguucgaauacaugaaguagggacagaaacagccaaaaacugccugguuuccuuguugcucaggguucuucugagcuucaaggaaaggccucaucacauagccuuauagugccacuguuuccagcucuuagaagucacccagauagcaaauuuaaggagacauuacaaaaaaaggucaaggcaguauugacauggggucaauucaguaccauagugcuucaaaggaaaaugagauccuccaaauuaaucucuagucagugugaacagugaugcugugaaguuuccuaacaguugagcuguguaggcuuggguucuggaagcaagagaaguccagaaaguauaagguuaugauauacaguagcacuuuaucagcuaagaaggaugagcugaggucauuagcuaaauaaagaccgaguaagugagcagagaaaugagcugugauuuguagccauguuccuggaagggccucaagggggugcuuagagacaaggacuuugacucagaaaguaagcaagaauauaggaaugauagacuguuuagucuggcaguaagaguagacaccaagcugcuucuauagccaaguaugcagacuggaggagaguugccugaacugcucuguguguugggaugguugugugccaagagcagucacaucauauaugagcuuuggguuuccaucaugaccuuacaagguuucuguagagauauggacauaugagguagacauaguguugggcugucauuaaccccuguggugacagcaccugacagugcacccagugagaacagggcugggacaguucaccucugcucaugaggagccaaaucaugugcucauucacuucccuucaggccggcacuauggggcugucaguugugaagguugcaaagguuucuucaaaaggagcgugaggaagaaucugaccuacagcugucggagcagccaagacugcaucaucaacaagcaccaccguaaccgcugccaguucugccggcugaagaagugccuggagaugggcaugaaaauggagugugaguagcagggccccaucaagcuaguaaaugccugcuaaauaggugugguuuaccuuugacuuuaaagggggugggaaguaggggagggggugguggaaauacucagaaaagcuucauugugcuuuaccuaaauucugggcagccagguaguccagagcugacacuacuggguuuugacaguauacaugguauauacgaaagucccuuucccaaucaaucagaaaacaggacaggaggaauggagauuagguaacgacagcuucagaguaaagcugagaccaaggcuaaagaguuaccagaaacaguuccuuucucaaucccugggccucgucugugacccauccaaguggaagcagccacaaaaggguugaaacccuccucucaguaguauucugaaacuagucuuucauucacaaggaccauucauugaaucaguuucuaacggugaaaucuuaagaaccaggucccaaaauaggcaacacagaaaagucacugugagcaagcugugcuuaaguguacaguaaggauggaaaggaacagagucaggccuacaacaggcuaauagugccucauggcuccuaggaagacuagagccaguggauuucauuauuguuuccuauucuaggacuaggacaauacaaaauucacuggggaacaagaaguaugcuugcaaccuguacaaccacagucaguauaauauauacaugucuagcuuaggguaggucugcacugucauacuuacagguuguccuuaguuguaagcagugaugggacuaaacuuggucaaucacaagcauaguugcaaacucacaguccaacugcauuucaacuuaguaguaaggcaucuggacccaaggcuuggucucuugcuuuuaagaacaguuugugcagaacucgggaggcagaggcaggcggauuucugagcucgagaacagccuggucuacagagugaguuccaggacagccagggauacacagagaaacccugucucgaaaaacaaaacaaaacaagaacaguuugugggcuggggagauggcucgauguguaaagugucuacuguauuagcaugaagaugugaauucagauuucaggcaccuguguaagagcugggugguguuacuaauguguguaguuguagcacuaggggugaagacagguagaucagcagagcuugcuggccaugccaaccuagccaaucagugaucuccaugaucacugaaagacccuaaaucaaaacaaaggagaaaaacaguaauagaaaauccucaauguugaucucuggccucuguauauacauaaacuguacaccccacccccccaagaucuagauuuucuucaguugcuugugacaaacauauaucauuuaaaauuuuauuuuaguuuuaauuauguauguguaugugucuauguauacuguguacauaugaauguaugcaccuaucaagggccuuagaucucccuagugcuguaguugcaggcaguuguaagcugucuaaagugagugcugggaacugaacucugguccccuuuaagaguaauauauucuuaacuucugagcuuucuccagccccuauaugcccaugcuuaagcuugguugcugggaaagaaauugcuguauguagcuaacagccuccaguuugcugaagcucuucagacugaaugaaguuggacucuagcaauuuguggcaugguauaaucuauaugaaggauccacuugaagauugacauuucuuauccugggcugagcccagcugguuagugacagaaguuuaaaaacaaaacaaaacaaaacaaaaaaaaaacccaaacaguagaauauauuggccuccuuaggucacaucagaguggcaguuucugagcaagcaucaccugccaucuugagccuuuguaugccuuugcuuugggguuguugauuuugacucuuugcauugauuggaaagcccauggugaccaaaugccagaguuacagauuugcuaagaaacaacuucagcauguuacaguguuuauucauuugauucuuuuucucuaaaugugaauauguugucauuuaagcuguacagagugaacggaagcccuuugaugugcaacgggagaaaccaagcaauugugcugcuuccacugagaagaucuauauccggaaagaccugagaaguccucugauagccacucccacauuuguggcagacaaagauggagcaaggucagucuccuguucccacaaaguaguacuguguucagccuccacacuggccugaagaagcacagauauuccuggaaagggcacacacguggcucucaccugcuucccauagcucuggcaugucucauucugucuuuugauccacuuaagguugcugagagucacuucaggacacaacugauccuaaggguuagacuuuauucauuagcugucuauagcucaaaauaaaggccuuuuuuuuuuuuuuuuuuuuuuuuuuuacaauauagaagaaaauaccagaugccacaaacuaacuuguucauucuuuuuaacacacuguguugaacugguuuuaaagagaacugaaauaaggagccagaaauccaaaauguauuacacaaaagcuggaguugagggucucuggacaauucuuugaguaucaguuaaacuuugggaagaauggccacaguuaguauagaaggccuaggguuaggcaucuguguucugugcucccucagccugaugccuagcuuuguaacgagcucaugagcgagagcagacaaguggccacucacccugggcugaauguuacagcuuuucucuuguagacugccuggcauauauggaagccaacugaauguagcaugaacauaaugugcagaaaauguuagauacuacucuggguuucuuugugucuuaaauagacaaacaggucuucuugauccagggaugcuugugaacauccaacagccuuugauacgugaggaugguacaguucuccuggccgcggauuccaagguaacacucucuccuguguugcagugcaggcugcuuuuccaacuauaccugcucucuuggccaucagacaugaugcugaaagcauagccuccuguagcuacauuaauuucucaugauaauagucauccuaggacuuguucuaaagaugcuugugguuuucagauacuccacucagggcugaauggcaauagucacuaucacauggcagcuuuguggacauucaaugguucuucacauggcaucuuuguagacauucuaugguucuguucccuauuaauguaauccccuuauucuacauauuggcaggcucccauuaugcugggaagguagcuauuuuuucuaaagcagccuuuuguaaaagcuccaguucuuucccauuagauaauuuguaauaggcuaacaaaugagccauaaauaacgaacuuauagacugagaugucuguugguccaagaggucaucucccauugugccaucugcacaguauguugugguucuaccguaauuuauuaaucaguucugugcuuaaacuuugcuacuggggcuggguggaguggugugcuacuuuaucuguucugucauuuuaucacaauguuauugcaucacauauguggaucuguguauguggcuguaaccaaaauacaaaaacacaaaagccugauccauucugauccaguugauauacaaaaagaucuuccuagcaugacuccauucacaccuagaagcuggccuuagauaaacaugauaccuucuucauuucauugcccuuaagucauucuccuguguaugcucauuuuuuaguguuacuauauuacuauuauuuuuuuaauaggcugaaacaagccaaggagcucuagguacacuggcaaauguagugaccucuuuggccaaccugagugaaucuuugaacaacggugaugcuucagaaaugcagccagaggaccagucugcaagugagauuacucgguaugagccccucugauacucuacauuccuggcacuguguuguaaggauagaugccaacauuuggcacuuaugcuauaaaugaguuuuauauuuuuauuuuugguccuggaaauugaccucugccucugcuuguguauaagacaagcgcugugccagugaacuacauacuucaaaaauacuccaacuugugucuaauuaaagaacuauaaaguugucaaaacaaccccacauaucuguugucuuccacauuuaacuaugggaauuuacaaugaaggagaacccacuuauaucaugugacaauaaggcagucagagcugcaguuggcuccuuaaaccggggucuucaucaaacaaauguucuuugacucgagcacuguguaaugaaccugcacaaaacagcauaccucuuucuguuucuguuucucuuugcucacaccuguuuucugagugguacaugcuagcuaauggaaagcaauaguugguuccagguggcauuggcuagcugcucaggguguuucuucccugcugcuuggcccuuguguuuuacucuucugugcucuauucuggccuuagugucaggccagauggggacuuacugggagcuacacaguccuccuguuaauuuguaauccgaugcaauauugagaccucgguguagaggaaagcacaugagaucuaaguagaauuagcuagggcuuucuuacuguuuauuugccauugaugaugucuguuucauuuuugcucguagggcauuugacaccuuagcgaaagcacuuaauaccacagauagugcuucaccuccaagccuggcagaugggauagaugcuaguggaggagggaguauccaugucaucagcagagaucagucaacacccaucauugaaguugaaggcccucuccuuucagacacacaugucacauucaaggugaguacguuagcacaugcuaucuacuuccccuguuugcuagagccaggugcuuuaccuauacaguuucaaaagucagaccuugcaaugaguucauuuuguaauuguggcagaaucuugaauuccaaagcauauucuuguugaaaaugacccuccaauaaguguggcacaucacagccaagauagacugccauggugcuagccacugaggaucaggggcugguugcucugccuuuuccuaugacagcaacacaggcucggccaggcaccuguuggccucucuacuauguagaauacuaguagguucucagucuuucccaugcucuuucugugucugcucucccgacagggcaucagaaggcucuccaaucuauagucuccagaaugaaucucuugucuuaguacacucuguacuggagauaucuagacagucauuuggguagauagggucccugacuauaguuguccaagguuuguuucucagguugcuuccaagacacuaguccuuuugaggacaucauagcauauggaaccuuggcaggcuguucuuccauuaagauguuacguugcccagcaccuuuucauuaccaucuugaagcuacccuuaaaaacacuuggccagugaauuagggcuaauaacaacagcauagcugaggucagaguuguugaaaacaucuuuguauaggugagcuggaaaguguccuauaggcuccugaaccccaauccagacugcuggacuccagucacugagcaagaaaccaugggagcuggugaaagccuuggcuacauggucacauauuccacuagugacaggcuuuuggaaguucuuugagaucugagacaguuaccauuguugaaacaggagauaaguugacaagagcaccugucccuccuuuagcucuugugucacaacaccuuuuauuuuccagcuuacaaugcccaguccuaugccagaguaccucaauguacauuacaucugugagucugcaucccgccugcuuuuccucuccaugcacugggcaaggucaaucccagccuuccaggcacuuggguaaguggcuuuuauuccuggauguccuugaguagugggauuuguucuuccauuaauggcccacaaguucccugagguccuuuacagugucauuguuccaauuuaccuuauucagugacccaaaguuguauuaaauauagucagcagacugaaagaaacaauaguucuuguugccaaggauuuguugcuaggagaugugucuggccuuugauaggaugagugucaagagcaaugguuuguguguauacauugccuugccucacuguugagcagccagugaggaccacuggcuugugucaucucugcaggaagccccuccugcuugcuuguucaugaauaucacuguuuggugauccuguuucccugucagucccaaugccagcucugcuacuaugcuaaguaacuaauguccaauuggacuaggccaccauuguggcaugcagucuggcuagaacauaaacaaccacgugauacugggaauguaaugaauggaugcaugcugcaggguaaccaccauaggugauacaugggaaacauuagauuguccacugguucauaccaguggccuaggguaagcagauugggauugagaaucauuaagaacagcauuugacagcuauaaggcugugggaacauugucucacuucuaugaaucuucaguuuucuucucuguaaaaauccuugccagaaguaaaaucuuacaaagcucuuaaucuagagcugaagacugaaggggaucugcagauagaaaugugcuccugggcugggugauguggcauauguccccaaauguaauagugacaguaauuuaccauuauuaaaggagagaugguuuaguuugucauucuuagggcaacucgacaggcaguaacuguugaaugaacaucugcaaauucuugacugccugcccuugcugccauuuggaagauaguugacaucucaggguuaucaguacuguuauaugaagguguccugaugugcagcuaaacagugguggucuuaguucccugggugggguuuuuguuuuuguguuuuaaucugagcauuuugaaaccuccuccagaucaguaagcaccaaaaucaguaagagacucugauguugaccucuggccugaaugcaaaugugcgcaugcacauacacccauacaaucauguacauauaaucacauacauauaaaggauguuuuuuaaaacuguuugucacagcuugcauaaagagaucagaggaauauuuggggauaucaguucucuccaccauguggauuuuuccuaagggacuuuacuuaaacuuaaaaccuucauggacuuacucaaggacuugggucauuuuucugggaaugaccugaacguauaauaaaccauuuucacacccuugcuaggugguggauagugcuagggcuuuaaguccauaaagcucacaugccuagagucagccacaugaaacacacucagccuuauccuuguguucccagacaggacuguaauaccagccuggugagggccugcuggaaugagcucuucacucuuggccuggcccagugugcccaggucaugagucucuccaccauccuggcagccauugucaaccaccuacagaacagcauccaggaagguagguccuagggcuaugggaguggaauauaucuuuauccaaucugugccuggaucaaagcccagccugugucaaguugacccagcugaucuuuuuuuuuuuuuuuaaagauugauugauugauugauugauugauuguaaguacacuguagcugucuucagauacuccagaagagggcaucagaucuuaguacagaugguugugagccaccauguggaugcugggauuugaacucaggaaggaccuucggaagagcagucagugcucuuaaccgcugagccaucucuccagccccgacccagcugaucuuugugaauggacaaacaucuguccuguaguaagaucuguaauggcaucuaauaaauuugauagucaaguggaguagcagcuguggcaauagaaaauucauuuuagcccugcagaagcuagccccugugaacugaggcaugaguugccaugaaggaauuaacccuuggcaacuacaggcugaauuaggugcauuacugagguaauuuaagauuuuuuucuuauuuauauuauguauauaaguacacuguaggucuucagacacaccagaagagggcaucauaauaucccacuacagaaacaccaugugguugcugggaauugaacucgggaucccuagaagaguagccagugcuuuuaaccaccauuucuccagcccuugaguacccuuuaaaaaaagauuucuuguauauaugugccugugccauguguguacaauguccagaaauuaaaagagggcaucaaaucucccagaacugauguuacagaugauugugaaacacuguugugugguccugggaacugaaaccggguccucuguaagagcauugagugcucuuaacuccugaaccaucucuccaggaacaagcaccucuugauacuccacuuucaucuggaaaugcagcccuugacaagcuugaaaugacuugguucucuuuagaaagugaacuuagccuccauuugucugugaugcuccuuaaaagacugaucuuguucuuaguuuaccucagagguucugugauuuuuuuuuuuuuuccuagauaagcuuucuggugaccggauaaagcaagugauggagcacaucuggaagcugcaggaguucuguaacagcauggcgaaacuggauauagacggcuaugaguacgcauaccuuaaagcuauaguucucuuuagucccgguaagauaugugguggggacuugugacacuuugcacugugucuacugauguuucugaacauggccauauugucaucaguuguguaggaaagcccuuuaauauuuuauauaaccuagaguguuauuaauaagugcuuugguaucaaacaucaauaauucuugcucuuuagcccuaaagaaauguuccuggggauucauguucugaauacauuuaauuugcaccucaaccaagccauuguccaaauaggaccaccauccagugcuauuuuucuuguuugggcucucccauuuccagguucucuaguuguguauaauccagguagauuggaauucaccuuuacugacucuggauaacaauaggccugacuauguauagcagcugaagaggcagagaauuccugguggaacgaaaaaggcaccuggacuggccucacauucuucuucucuaacuguucuccaaaccucuggagaagucaucugggcuuaccacugaccucaacagcaagagcugaauguagcauaacuguuuucuucuuccucagacuccuaccauaacaaagcuaucuauugaaaaggagucauuauguaauuaaacaucugaaaagagacuauuucucauauauauuuagaaaucucucuuuccuagaguaguauaaagcaggaagucuagagccaauucaggggugcuguuuagguaaggcuguuaggcucuaccugggagccacccaccuuccuaggacucuuacagccuuggaaaaauacagaggcaaagccaguauugugacagcuucccaauucauugagccaaccuucaaguucaguugcuuauauuugauacguaucaaucaacagacuaaaaagaaagauuaagauuucuauaauacuuuccaaauucagaaagaaacuugggguuuacuuuucuguuuucagaucauccagguuugacaggcacaagccagauugagaaauuucaggagaaggcacagauggaauuacaggacuaugugcagaaaaccuacucugaagauacuuacaggugaggcacaaggccaugccccacacaaaagaauggguggggcgggauggggugugguagggcauguggcugggucagauucuggcaguguagagagccuccuuuagaucacuaacaucuccagguauaagaaagaaagagcacaaacauaagagaaugccaggcuggaugcuucugacugcuggugacagucagaaaaggaauacucuucuggaacuaacuccucacacauuagagaggugcuuagcacucauggggagaggcagcauuaaaguccuuaacaaaaaugaaaucuggcccaaauuaagaagugaguuacguaaggcaauuuugcccuuagauaaaacugaugggggaaaaaguccuuuuauauaggugagaauuaauugguaauaucuuaacaauaggauguauauuagccuaauacauauuuugacaguauaguugaucugccaaaaaauagaauguauggcaagcuuuuccaggcccaauuuucuaacucucccuuuccucccaaaguaaacaaaaguaacaauccagaaagacgguuagccugcuuuccccagacuuggauccucugagcagaauuagaauuaggcucccugaacugccaggacuacuucuuccugccguguacuucucaaaggaaaugcuauugugccaguggcucugguggguuucucuguguaaagucaagacaguuuuuuguacaucuccuuagcacagaugcaguuucccaaaaccaacuuccacuaggaucauugaagaccuugagucacaugauacgagaacggggcugugugugugugugugucuguguguguauguauguauguauguaucaauguauguaucauacccacaauucuggucugguguguaaggagguuguucucuucugaggccacaguguuuccauggugucuauggucaauagauggccuuggagucugaaagcagagccccucacucuugaaccauaauucugcagcauuagaaagcagauguuucauuuuuaagccugagucaauccuauccaagacagagacccagggcaggaaaggugaagaaggcacuuaugagauucagggccaaaaugaggaaagcuauccuacaugaaucaaaaacucauuucagcauuucuucagucuuuaauagauagcauauuguguuguauuuuucuuuuuauauacuuucuagagcgguguguguaugugugcaugugauauguaagaggcacaggugcuucauuggaggucagaggacaauccuugggaguuuucucccucuguccuggagcuugaacauauggucagguucuuuggaacacucauuuaccuacugagccaucucacagucccuguaacucacuuuucaggcuuuugugucuuuuuuuauauuaauucuccugaaguauccuagcuuaccuccucauucauccucugagggccggccaguguuccacgaaacccagccugauuugccuugcugacuuccugagacuacuugaucuguuucaccccucagaucaaaaaagaaaaacuagagugauuagggucucacuaugcagccguggcuaaccugaauuuacuaugcaaacuagccuggucugacacucacagaaauccaccuacuugccucccaaguguugggguuagagacaugcaccaucacacauggcaccuacuuucuuuuugugugucuguguuggugcacacaacuugggggucuaggaaccaaauucaggucaaaauccggcuuagcagccaguacccucauguuguuauccccaccauaaaauuauuuuuguuuacuuuauaacuguaauuuugcuacuguuaugaaucauaauguaaauaucuauguucuccagugguccuaggugaccccugugaaaggguuguaacucacagguagagaaacacugaguuagagauggugcgacaauuagagcacuuaaugcucuuucagaggucaggguuaaguuccaagagauccaacauccucuucugaccucuguagucacacuuguucauaauauaugcaaguaaaacauucauacacaaauaauaauuuauaauuaauuuuuucuaauaauuucuaaauaauuuuuuuucauaaacaagguagguauugcagaaaacuuggaacauucuaggaagccaaagagggaaagaaaauuacuucaucaaaaacauccccucaaggauauuuuuuaaccuuuuuuuacuuggcucucaugccaagaagagcaaaccaugagcacguagcuaacauucuuccaaagugcuuuugcacaaauaugcacauguaauacaacagcugugcucuuuuaaauagucacugcacaaucuggaucucucugcuuucaguaacuauagauuguuaugccucacuguauagcacaagcuggccucccucccacuuuacucuucuugccucagcuuccugagugaggugauugcagauaugcaucgcuauaguauccuuccuuuauugaguuuguagcaguucauuauaggaauacaauacucuguacuuuaaccuauuauuuguugguaaauuucaaaauugugugugugcagguaagaagaguagcuuuaaacaguuuaaggacuucauaguuacuauuagaaaugguuuuugcauuuauguuguauguguaugggcaugcauauguguaaucuuucuuucuuuuuuuuuuuuuuuuuuuugguuuuuuugagacaggguuucucuguguagcccuggcuauccaggaacucacucuguagaccaggcuggccucgaacucagaaauccaccugccucugccucccgagugcugggauugaaggugugcauaugugcaauuauaacccaaguguaggaguuaguucucuccuuccacaauauggauucuggagaucaagcucagggugucagguacuguagucaguggccuuuaucuacugagcaucucaccaauccuauacacauacacaccuuuuauacuuuuuuuaccuucaugcuaaacuuuuguuguauuuuuuaauuucaacaacaaaaucagauugauauaguaggucuguuugguuuaguuguacauggagccaaaaggaccuccaagaauuggccacaggcaaccagacaccucauuucucuaaugccugcucucucuuccagauuggccaggauucuuguccgccuaccagcacucaggcucaugagcuccaacauaacagaagaacuuuuuuuuacuggucucauuggcaauguuucaauagacagcauaauuccuuacauccucaagauggagacagcagaauauaauggccagaucacuggagccagucuauagugcacaaccaacagcugccaacagugggaugccuccuagaacugugcaggugcaagggaagggaaguguagcagugucuuggugugcacaggugucuccagugugucagccacuucuuccuguucaucccagacaauagcaacuaaagaugaacucuucccugcccuaagaaauguuuuaacaccuuuuggugaugcagauuuuggaacaaucuuuuaauucaauuuguauuuuaaaauucucaaagggcaaaaaacaauacugaaguuuuauaaugucagagacuaguauuaaaagaaccuaagaacaguauguguaaauacauuaaaaaaaaaaaguccuuggaauuaauagcuacuaauuaccaggguaauguuagcacuuucuaagcacuucuuaucaaaucugcaauguuaacaucuuaccuguggacagggcaaauggaaaacugugucucuuuugucaaaaugcuaaugauuucugugaaaauucacuaggguacaggagacaaucguucacauuuguaagagggcagcacuucuagcugugugcagugguggugcuacgcuaaauuccugugaguaaaauguggauuccuggcauugugugcaggggauauaacuugcagugacccaauaagagcugcuaugccagcagagauagccugucaggguccuuacccucaugguuggucccaaucccugaugccuuucugcagacucuuccagaacaugggcuccacuaauuuucagaauuagauugcagcuugucagaaugccugugauaaggguccuguaauucuuccagugacugaaaguacaccuggaucccucuaccaacuuguaggaacuggagccuuugaccagagugcaaggugguugacugcacccuuugacaugaccuguuguccagguugaguguggcuucugcagugagaguuccuauuccuggugcauguggagaggggccaguaucugaucauucagaaccugcagcuggguggggguuguguauccucgcugucuggugagggacuggccuuagauugugaaacaaaaggcaucaagagaaauacuuucugaucuuuuaaguauuagugauuuuaguguacugggacacgauguucuucaguucucccagguaugugcuaguccaacaaagcucucuggggcauuugagauaacaaaaguagaucaucuucucucugaaagagaauccaaaaauaauccucagucagggcacauagugcaggccuguaaccccagcacuugggaggcugaggcacaagaauuauacuuugaaggccaaucugcgcaacuuaaugaggaaacuccugaguuuuaaaggaguuuaagggagugggguaggguggugacuuaagugguaaugugcuugccuagcaugcacaaggucuuggguuccauccccaguaccaaaagaaaaaagaaaaaccuucauucacaaauucccuuacguuauaaugacuauaguuuccaacaagaaagaauacagaauucaguuccaaggaaguuagaucugacuuaaagcucuuugcauuccuauggacaggagacugggaaaaaaaaaaguggaaauauacuugguauuugcauuuagauuagcagaacuuaagcaaaauaccuccuguaagguuaaguuuguaccuguuuaugggcagguacagccauggggcucaaggcuagauaggcuguuuccuuuugaggaguuaaugacacuuuauucacugcuagugggauuuaaguacagaaguaucucuaacuucuaaauucccagcuagauuuggaagccaguguuggagaacagcagggauugccaguauaaaaugauggaaaggacauaauuuugccagcuuaaagcuuuuuuuuuuuuuauguauguauucaaaauuaagacaaaagcucuggacaccaguauaguucgagucuauuuuaaucucuguagagauuccuguaguacauuaaucaguacaccuuacagugcuggcuuugcuucccuuaggguuuuagaaugugagccacucagacagggccuggacagccuggcucccauuugguauuuagaccacauaguuggauaagaaguaccagccucuaagaugacacugaagggggaaaaauuuuuuuuuuuuuaauauagaaaagaguuggugauucuaacucugguccuuuguaaguuccgucauuaguaauggccaauugacagggccacuuugggccaaacuccuucacugguuguccagaucguuguggccuuaccuuuaacaauuguauccauacaauguucucauuaacugaaaucauuucaaacuuugaaugaugcuccauuccauggcuugucgaaugaccuaugaaggucagccccaguugcuucugggcuucagcuuucagggcuuuccacccuugauuuaugagucugugauacuccaagccuuaugaagcagggcugaccugucuagacaccccucucagggagguggacagacacacugaccuggcuacuuuugcagauaggcuaggguggagagauacacaccaacccuggcuaacuaggcucuuuuccagaaaggucuuaaauguugauaguuccauguuaaaauuugggauaaaauaugacaggagauguagacagagaccaaauuccuuaagcaagucauccuaguuacuccucaaauguuacaaugugucgcuguccuuccaguuugcaguguguguugaagaggcucuucacugccucuucucuuucugaggcugcaguugggguuguggugucuugaguuucuauaaugaaauucaagugagucacuuaugcccuuggaaugguuuucuaguuugucagugucaguauuagauguggaugguguucugagguagucauggcaucaaucaggguggucaguauggcuuucaaauggagcagcagcauccacacuauauaaaauuguuuugaaggguaguacugcucaugcaguucucuggucaguaucccuaagagcuggaccuauugucugggaccugaugucaugggggucuggaagacuguugcugcuuuccaguggcugggugcagcggggcuguuggugcugcugaaauucuagauccaggccuugaaaagcaucacuugacagcugcuuuuuuuucccagggggaagguccugguaagacagaugcccaccucuuuccuuugccuaucuccaauuacggagaaccaaucuccagauuacgguucuuugcaaaaagucuuaacucuuaugucaauuucuaaagacaacuccaaaaugagaugagguugaccuagguguuuuguacaagguucuggaccuccucauugagugccucccaucaguguguacuuucugugcacaaccugucccuucagccacacugugcauguccagaguuacaggccuagaugacugaaugaauguacauguguucauauuaucuucuuuguacaguguauauaauguguguacauagguguacauuauguauacagacauguagccacauauucaaacuucuauguugucaagaguugaugcuagcguugcuaaugugaauagauauugggguugcaagguucccuuaacaggaacguugugcaggugaguuucuuaccaacuucauuuuccuuagacagggagcugccugggccagguggcacuaauuccugcacaaggaagccucgagccagaaaaguccagauaggagggcaguucucuaaauuuacaagggcccagaagcugcaagagauguuagccuaauauccuaaacuaaggauaaacuuccuuuucacaaaccaguuuagcauaacuggaaggagcuuggugacugagacccuuggucuucuucaaaggcuccaaagcuggagcuucguguggcucagacaugggcauuugggauccaggggcugcagcagucucccuuguuuacccugggcucugucagcaagacaugggggcucucuggugguaaaaacaaaauaccagucuaccaaacauucuaugaaaacagugcagauagcuaaaaacugcaaucaguaaauuauccuaacuuagcuacauucuguagaaguuguauuuaauaguacgaaagcuaaggcugacauuuuccucaucuagcgggucuuugcugauauucguccccuaugauugggauuuuugggcugagauguggacuugggagacagggcccagcuuggcagagacugcucguggccacagugagcaggcaucuggcuuggaugaagccaagugcaaaaauuugccugacccacagguugcucuuuguguuuuugaaguaaauuacuggaguguuuuaagaaauaauuguuaagacuauaguccucagugccuuuggugagacgugggucuuuuggcuucagcuucccacucgugucccuggccucacccuuugugguuguucaaucuugccugugucauugccuguugugacaaucacacuauuaaaaguggcuuuccaaguaaaacacagggaagcuugguagucccuaaaugaauccuuccauuuucucuuugggggcuauugucuuagcagcaaccuaacaguaaacuuaaaaguggcuuaggaaggggaaaccaucagacauuucuaaugcucagcaauaugcacuuuuaguuaauuuucaauauugauauuuauacauggaauguaggaaaaugcucaauauuaccacucuuaaguuuuaguguuuggguaacauuugguguagacugcacauuaaaaauagccuuucuucaggaaaguaccaucaguugucaucccaacagccuacucauucauggacgcuaaugcugcugcacacacagcucaagugcuggaauauuuuucuagucuguuuucccaauuaacuuguaaaucaguguucaacuaguuuuauaacugaaaagcugcacauuuuugucauaguaccaacuaguuuguaccuguaguuugaauuucucuguuaagauaaaaccuuaucaccccccacccucaacucccuuuuuagaggacaucuacuaaaagaaaguccaguguggcauuuucuuggguaaugacugguuguguaauuucugcccuucacacuguagaaaacaccauggaugccauuaccuucugauuccagguuaaaaaccugcagagagcugccauuuuguacagcuuuucuccccauguaaaugagcuaugugauggcauuuaaaacccgcauguucuuuuuaaacugaauuuucuaucuaaucaaugucuucaguccugaaggagaaucugcauuguugucuguauagagaguugcugugcaugguuacgagcgccuuuuacuaaaugcuguucaauguggcuuuguuguuguggcuuaauacuaccuacaugagguuuauacuauuaaaguaaauucaagacuaguaugugugcugcucaucuuuuuuuccucaaaacagucacauguggccugaaccccucccgggagccagcaguggguagagaauaguccaucaacaccgucaucagguggaaagacaucuggugggaacucagacugaauucuccaugucauccagcauggacauaaggacucuacauagacauucccagagcaugguggugagacagguguggagucagaugucagacccauacacuagguagcuauuuguugugggcaaaaaaauguguccucagaugcaguaguugaaugaaacugcucuuaaugucuucuacauuuuacaauugaggcuugaauaaugucauuacagagcucacaguugccgguggcaccucagugugaaagcugucacuucagaggaccaucaagucaacucaagucuguguggucaguuucauguguguaaaaccugucacuacuaaagugauagauuuuaaagagaugacuucucccaauaucaaugguuuccucagaccugcaucugcuccaggccacagaaguuaucaguugcccacauguugcccuguagccuugccacagcuuuggcagaaacaagggucaggaccaaagugaagcucaagaauuuguccccuugggaccugaacuuuauucuuuuuuucaagguccaugcuuaggauuugggcccuggccguaucugccauggagggaagcagucuauucccugauaccagccauuaagacaccaugggaacaaaaacucaaaagaaugaccuguggggggcuguaccaaauucuauugaagcacucuuaucccuuacacaucagagcuacaagcauuccauugcagccccuaccuggucugcugcaaaaucacaaaccagaaccagaguagacaauggaaaggcacuauauugcagauagaaggauucuaguugcacugccucccugagaccccugcaccaggggccaggagaaugggagugaacuggguaugugggggggcgggggggaggagggcaguugcccuguuuuguugcaucuaaagagucuugggcauuuuuaacaaccacugcuuuauuuugccucauaaacucauaccuauauggccaaaugccaagaagucugugguaaacauuaggugacccuggaagauucuguuguccacugaagaauggagucuacauagcuaaaauggcacugauaacuggaaaauauaccuagaaaggcauccgggagugugugugucuugucugucucucaccuaguaagcaagaauugagagucaaauuaccacccagguggcaucuucauucucaaagccagaaaaauccaugcuuacgguuaacacaaugccacuggcacuccuccaccacauggacuugauggcaaggaaguggacaagagauuuggugacuucagcucacaucugcugaacugaaaggccaggccugaaaugauccuacugcccaaggucucguuacuaacuggggcuggagaaucuccccucucucaggaagcaagaauugcaggcuuuaguacacugcccacauguuugcuuuggacugcuaaguaagaacauggacucucccagcuacauuuggcucaccaauaacaacagcccucaacagcuuccagaguagaaacuggagggagauuaagugaaagcagcagggccaguuccaggacugagacaaucacugacugccuugcaccuccucaucccaaacucucugaugcugauggucuuuagaccagcaaggccacacuuacuauguauaggaagacuaaaucuuuuauugacaucuguucagcagcuggcaacccuggccuucaucccauguccuuuaaacagaugugcaagcuggccuuuccauugcagaguuccaucauuuaugguaccaauguaauccaucuccaccagucaaaugccaccaguccaucccagauggccuugcuuagaccuaaguacuggcuuucagagcagcuuuguacuucccugucaucuccuuggguaagggcaccaagccagggcagggcaccuggccuucuacuucgcacaugcacucccgcaggcaguacuuccgggggccaaaguugccuggaugaaagcgcugcugcuuuuccagcuccuccucccugagggucuccc

SEQ ID NO: 3236 - RNA, 3620 nt, Mus musculus
uacuuguuuguuuuuuuauuuuaaaucaugaaaggguguuagauuuugucaagugcuuucagucuguuuuguccauugcagugaucuuguagcucaugcugaacugugauuuucaugcacugaaccagacuugcauuccuuaggaaagcugcacuuagacaugcuccugaauucaguuugcuuucuuuuguugaguuuuuagauccauauuuauaagauaauuuucaugacaucuucuaagguauugagcaauauuggccucacagaacaaauuagggaaauauauuuuagggugugggaaacaugccaccuuuguaugauauuuuucaugauauacuuuuaaucuaggaaaauacugucuucuuacuucagguacccaggugaccacucagcacguugauccucgccuuugguagguauuguuugagacccuuguguucauggugaacuuugcccaacucgguucugccugaaucuaagaggcugccaaacccuuccauaaaugcugcucccaauaaucuucagggcugugcuguuucuauuugucauccauccuuugcaguguugugaaagccuuucuauuaaaaguuaucacaaagaaagaaucuuacagguggcuuuggaaacaguggaaaaacuucaaagaacaucucuuuuagaaauuauucugauagcuuuuaaaaaaggucauggaaagcagaacugauuugguuauccuuguguuuucaacauuagaagcagcuauuuuaagaugguguuuucuuaggaccaucaugggcaguaucucacuauuuccuuuuuuguccuguguugauaccucaguagucaaguuggucauucaaggacacagcaagagcaagaggcaugcuccugcuaggcaugguugugcacaccuguaauccugcuacuugggagguagaaacaggagggucaguaguucaauaguuagaggccaggcuggaguuuauaagaccuuuccuuugagaaagaagaaagaaagaaagaaagaaagaaagagagagagagagagagagagagagagagagagagagagagagagagagaagaaagaaagaaagagagagagagagagagagaguaaggaaaaggguaguucuuagaaaaucacugagcgccuuccuaaaccccguguucucauccacagguaccacguacacagaccucuuggccggaaucuccagggaugaccagccccuccccgcgcauccagauaauuuccaccgacucugcgguagccucaccucagcgcauucagguaaucaugucaguuccacuggguuucuucacucugccccaaaccaaaccugccuaagagauucacuauagaguauuuaccucuugacaucaaguacagugugagcucauucauuucgaaagcagcagguaaaaguuuacguuacuuuuaaagcaaaaguaugaauuauugcuucaaaauacuggaugacauaccauuuuauuauuuacuugcuuccaaauugaggcaguauauauuuuauuagacucagggaccccuugcuuguagucacauccaaugcccucacauaauagauuuuucagucagggcaauuaacaauuuuaauuaaugccucacuuuucuauuuggaaaauauacauaauaguagauuuuuugcccuaaaucagcaacauuaaugcuuuuaaaaugcuuagaaaggcaucuuauacauaaucauauuuaauuaauauguauuaucgugcauaguaacuauuacuauuauuauuauuauuaacuauuaagcaggggcaggacugugaaucugccuuuaauccacugaauauuuuuucucuucuuuugaacaaaaagacuuuggagauuauagcaagaagcugggagaaagcgauaaugcauugcuauuugauuacccagcuaaaucagaacauaugaacagggaugaaccaacagaaaaaaacaucugcagguaaagcaccugccaagaaaccauggugacuugagcucagucccugaacuaacacaggaaggaaggaagaacagauucuuaaaaguuguccucuuauuucuacauggacaccauggcaugugugcacccucacacacacacacacacacacacacacacacacacacacacacacacacacuguauuaacucacaaugauaaauaagauaaaacauuuuuaagauuuuguuuuuaaaaguaaaauaauuucucuguuuucagaguuacuacagauggccucagugagauccucauuccuagucaugcucugucagugagcacugcauccccuggagccugacaagagaaugcaucuuuaguauuuuaguguaugagagcaaugcuuagaaccuaaauaguggcuucucuaguaaggcuaagacugaaagaugucaaauuagacaauguuuagccugaauuaaacagaccuagaucuagucuuaugaccuagggagaauuuccaaaaccuucuguacgguuucacaguggauauauaugagugcagaaggaugaaauguggaaaggucugcagcccugcagauggguaccaggaaaugcuagcaguugugcuguaagagguuuugcuugcuuuugugcuucuguuuugcaauaggcucuccuguagcugagguuggccuugaacucccgauucuucugccuccacauccccaguacuggaauuauuauaggcucgugccaacauaccugguuuugugcuuauagcuuuuaauguccuauuuuuauacugcuucaaauuuacagaaaauaacacguaaaauuguuauaaccuuuacucaaauucacuaauuguuugcuauccaauucugaaugugauauauacguguguguguguauauauauguguguauacauauauauauguauauguguguguauacauauauauauguauauauauacuuuggauucauuuucucauuaacggcaggcauuuauuuucauuggaucagucauacagguuucuuaagaacgauggcauucucuuacauagucauaauaauaagaaauauuaguacuaaaacaugccguuguaggauacauaaucuucauuccacaauuuccagaguuuuuuuuuauaaguguuuguuuuuuuuuuccccccugggaucugcuagaauucauuauuaauuauaacaauaguaauuaggugccaggcaacccaaaacaccaucccuugucaugcaggcuagcauagauguccagaagccuugcugguguuuuuuuguaugguauggcccuaacuggcacaaagauuuuuuagggaagaagaggaggaggagggagaggaagaggaggaauauagucccucaguggaggagaggcugaggcugagaguugcugcuuuggggauagagauauagggcaagagcuguggagauaauggaaacauuaggaaaacauuagguucaaguuuuuacuuuuuuuuuuuuucucuuuuuuuuuucgagacaggguuucucuguguagcccuggcuguccuggcacucacucuguugaaaagaaagguuaaguuaaaaggcaaaaaaaaaaagguacucuauuugguuccauuuuggaggugauugugagauuuuucugccuuguuuucugccucagucugc

SEQ ID NO: 3237 - RNA, 1867 nt, Mus musculus
uuuuuuuuuuuuuuuuuuacaauauagaagaaaauaccagaugccacaaacuaacuuguucauucuuuuuaacacacuguguugaacugguuuuaaagagaacugaaauaaggagccagaaauccaaaauguauuacacaaaagcuggaguugagggucucuggacaauucuuugaguaucaguuaaacuuugggaagaauggccacaguuaguauagaaggccuaggguuaggcaucuguguucugugcucccucagccugaugccuagcuuuguaacgagcucaugagcgagagcagacaaguggccacucacccugggcugaauguuacagcuuuucucuuguagacugccuggcauauauggaagccaacugaauguagcaugaacauaaugugcagaaaauguuagauacuacucuggguuucuuugugucuuaaauagacaaacaggucuucuugauccagggaugcuugugaacauccaacagccuuugauacgugaggaugguacaguucuccuggccgcggauuccaagguaacacucucuccuguguugcagugcaggcugcuuuuccaacuauaccugcucucuuggccaucagacaugaugcugaaagcauagccuccuguagcuacauuaauuucucaugauaauagucauccuaggacuuguucuaaagaugcuugugguuuucagauacuccacucagggcugaauggcaauagucacuaucacauggcagcuuuguggacauucaaugguucuucacauggcaucuuuguagacauucuaugguucuguucccuauuaauguaauccccuuauucuacauauuggcaggcucccauuaugcugggaagguagcuauuuuuucuaaagcagccuuuuguaaaagcuccaguucuuucccauuagauaauuuguaauaggcuaacaaaugagccauaaauaacgaacuuauagacugagaugucuguugguccaagaggucaucucccauugugccaucugcacaguauguugugguucuaccguaauuuauuaaucaguucugugcuuaaacuuugcuacuggggcuggguggaguggugugcuacuuuaucuguucugucauuuuaucacaauguuauugcaucacauauguggaucuguguauguggcuguaaccaaaauacaaaaacacaaaagccugauccauucugauccaguugauauacaaaaagaucuuccuagcaugacuccauucacaccuagaagcuggccuuagauaaacaugauaccuucuucauuucauugcccuuaagucauucuccuguguaugcucauuuuuuaguguuacuauauuacuauuauuuuuuuaauaggcugaaacaagccaaggagcucuagguacacuggcaaauguagugaccucuuuggccaaccugagugaaucuuugaacaacggugaugcuucagaaaugcagccagaggaccagucugcaagugagauuacucgguaugagccccucugauacucuacauuccuggcacuguguuguaaggauagaugccaacauuuggcacuuaugcuauaaaugaguuuuauauuuuuauuuuugguccuggaaauugaccucugccucugcuuguguauaagacaagcgcugugccagugaacuacauacuucaaaaauacuccaacuugugucuaauuaaagaacuauaaaguugucaaaacaaccccacauaucuguugucuuccacauuuaacuaugggaauuuacaaugaaggagaacccacuuauaucaugugacaauaaggcagucagagcugcaguuggcuccuuaaaccggggucuucaucaaacaaauguucuuuga

SEQ ID NO: 3238 - RNA, 1505 nt, Mus musculus
ugugugucuguguuggugcacacaacuugggggucuaggaaccaaauucaggucaaaauccggcuuagcagccaguacccucauguuguuauccccaccauaaaauuauuuuuguuuacuuuauaacuguaauuuugcuacuguuaugaaucauaauguaaauaucuauguucuccagugguccuaggugaccccugugaaaggguuguaacucacagguagagaaacacugaguuagagauggugcgacaauuagagcacuuaaugcucuuucagaggucaggguuaaguuccaagagauccaacauccucuucugaccucuguagucacacuuguucauaauauaugcaaguaaaacauucauacacaaauaauaauuuauaauuaauuuuuucuaauaauuucuaaauaauuuuuuuucauaaacaagguagguauugcagaaaacuuggaacauucuaggaagccaaagagggaaagaaaauuacuucaucaaaaacauccccucaaggauauuuuuuaaccuuuuuuuacuuggcucucaugccaagaagagcaaaccaugagcacguagcuaacauucuuccaaagugcuuuugcacaaauaugcacauguaauacaacagcugugcucuuuuaaauagucacugcacaaucuggaucucucugcuuucaguaacuauagauuguuaugccucacuguauagcacaagcuggccucccucccacuuuacucuucuugccucagcuuccugagugaggugauugcagauaugcaucgcuauaguauccuuccuuuauugaguuuguagcaguucauuauaggaauacaauacucuguacuuuaaccuauuauuuguugguaaauuucaaaauugugugugugcagguaagaagaguagcuuuaaacaguuuaaggacuucauaguuacuauuagaaaugguuuuugcauuuauguuguauguguaugggcaugcauauguguaaucuuucuuucuuuuuuuuuuuuuuuuuuuugguuuuuuugagacaggguuucucuguguagcccuggcuauccaggaacucacucuguagaccaggcuggccucgaacucagaaauccaccugccucugccucccgagugcugggauugaaggugugcauaugugcaauuauaacccaaguguaggaguuaguucucuccuuccacaauauggauucuggagaucaagcucagggugucagguacuguagucaguggccuuuaucuacugagcaucucaccaauccuauacacauacacaccuuuuauacuuuuuuuaccuucaugcuaaacuuuuguuguauuuuuuaauuucaacaacaaaaucagauugauauaguaggucuguuugguuuaguuguacauggagccaaaaggaccuccaagaauuggccacaggcaaccagacaccucauuucucuaaugccugcucucucuuccagauuggccaggauucuuguccgccuaccagcacuca

SEQ ID NO: 3239 - RNA, 2590 nt, Mus musculus
augaccuggauauauuuuauugucauugagauuaacaagagcaggguuauauacaagaugugaccccccccaacauaucugaauaucccccaaacugcuuagggcccccaaccuuggaggaugcgcugaaguuauaccaggucagucuugccauauggggcagaugacagaaguuggauuuuaacacccaaacuuuucaauccuacccuuucugaggaggucccuuaggaggcguggaagaaccgucuuggccaguguggaaggggugagagacuguggggcugucagagaagaggggcccccaccuccuugcuugaagggauaaguaggguuuuaacuuccugauuggcucuuugaaguuccugaaguggguaagggagggguuuggguggaugcuauguacagagggcccaggguuagcaucuaagaagaaaaccagugaagggacugggauaggauacacagggcuuacaucagccuagaccuaaagccugacucuaaccuuacuccuccagagguucccugacccaggcuuccaguugugggguuugcuuugccagggucuccuggccccuacucaggucaccuagaagcuggagcaggccuguuuggccacaaauccccuggggcccacaagggugacccacugcccuuuugccaggaugcugacguuucucaggcauuaagccacccuccucucccucuguuucuucccagcuucuuuggagcucaggaucuaugaaccuccggccuggaugcugccucuuggugacaucagacuccauccaggggaaggaucgccugccagggugcugccgcuugacuuggggggcaucugagaaccaggaauccagaaagaaaucugguagccaggacgggggcagccagucacugucccccucaucugaccaugaauccuugucuugguuggcacgucggccagggugcugucguuuguggggucuccaggcucccacuucucccaaaucuccccucucuucggcuucaacgucuuccuccuucuccucccuuuugcccggaugcuggcguuuugugauccaggaaucuggagaaguaaaaggcagugugggagagccuggucccgucaucaggaacccuugcuugcaggccauggaccacuucagacuucuacuuugucauagcucuuagagcagcuccucccucccauugucuguucugcuucccagcucuuacagacaccccucacaccaauggugaagggcacugcugcuggcuuccagcccccagcucucuucuuucuugcugggugacaauaaaccacuucuuacuuguauucucugaaucucaguuuccaggacaaaauggcaacauguccuuauagacagggccuuagacacaagugcuugguaaacaauaauuaaagcuguuagggauagggaccauugugaaauugugacuacugaaaaucuaccuucugauuauuucuaacacuguggucccaagggcugguaaccuccccacccuauggagaaacugucuagaagguuauacgcuucuuaaaucuggaacaggggcacugacuggugcucccccaacccucuccacauggcucccuucccccuauacucaccuaaggcagcaccaagguccccucgcacacgcuggaggucuuuccucaagaaucgacguucuggccggaccuggacuuucuccaggccuggaaggucaggagucacagcaccuuccuccugggcugcuuccagcaaggcgcaggauuuggggauaccaguuagcacgaagaucaaagccagagccaucaucagccaaggucccugcaucuuggagucuagggucaaaggcaguggguguaaggguaaaugcaccgccugcucugagguuguccccuucccuuccccagaacaaggucaucugccaccuugugccaggugcagcugagccucugguagcuuuccugguaucagggugccaaggugccuauccaaacuaggaggcgauggaaaccccacugucuccgccaucccuaacugucucccaaaguugggggagucagcgcugcaucugacaccccuaccccgguguacccauuaagguugcagugcugacaggagaagcuaaagucauagcggccaaaacugucuccaaggcuccaucuacauucuaaccccagcccuucaccgcaaucuccuuacuccagagcugaaauucuugcucacauacacgaacuccccauguaacccuuugcucccuugucuaggcuagaagaagacucucacuggacgcccacauccuaauuccaaagugaagguucuauuucuaacguuaguguacaaauucgaacucuaggguggguccgaccguccugguguggaccugcugaccgaccucuuccacccagaacucccagugcccuggccagugugcuacaggaagguggcgaggcagguggaggggacaccuguuugggaucccaggucagaggcauuaccugcaagguggagacucugcagagcuuuccaagaugcugagccgaagagugcaaacuggcuggguagagucugcaaggcuccagaauccagagucgacugcg

SEQ ID NO: 3240 - RNA, 888 nt, Mus musculus
caggagagguacuggugaagaugcagccucuguagcaguugaaaguccaggaauagaggggucaaacagagaagcugaggccugacaccagggagucagcuauugguaaaagcgcagcacagcugucauagaagaugccagaauuuuggggaugccaguaccauggggugaccacaaaacccagcagcagccaugaagcgaaaccagcugaagccuaagacucccugugugcugcagagggcaaagcuggagacguugcccaagcucuuuggaagagcccagaaaauugugaguaggucccagauauuggacauugaguuauuuaugcuuuuggagugugguuuuguuugauuaugacuucccucuugaaguaagaaaguauugacuuauuuuuuuuauuuuacaagagcccacaguuggaaaaaaguucgaacuuuuaaagagauuuggggauuucgcaaagucuuuuggauuuuaaaacuguggggcuuuuacauuuugaaauguuuauauuguaacguugaucucugcuagggugaauggggacguagagggcaugguacugaacccaaacucaccacuccuuaaaacgccuuuagaagaucuccucggccuaccugagcagcaccgucuuugaugguuuccucuuugggaggcucuuggaucccucugaccaauaucucaagaugaugauucucaugccugcugccgggguuuuguuagaugaucuguggcucuaagaaugacgacuacauuuuguguuauuuacuugccacuuuuauuuccucuuuuagaacauucuguucaaaugcaaagcccauuuuaaauugggucagcuguuuucuuaacuguuuuuaauauguauucuggauaugugucucuauauaa

SEQ ID NO: 3241 - RNA, 30699 nt, Mus musculus
aggauucugauuuuauuuuuauuuacuuggaugcucugguauaaugucuuaagaauuuacauuuuggcauaccucagugaauccuguuucuagccauaaaguccuuuuuuauggugcuuuaccauuauaacuacagugaaguuaacaagacugcaaaagaaaaaaagaaggcuuuugagguuuugaggugcuaaggucuugcuuccaacagaaagcaacuuagacugacaagaggccaaagugguaaugucuccuucagcagguugcuuuugcucccagggacucccacacauagacacugccuuaucauaaaguaacuacugcucugugacacagccaaggucaaguggagacagcugacgucugcgcugccuugccugugcaggagcaguauuugagaaagaaaccccaggucauuguugcuacaaguuucagagucuuuacaaugaagcuucuuugaauuuaagauucaaacgacccuuucagaaagaccacagguucuggcucagaucuaugagucgugcuuauuacacuggcugccaugucucugucagggguaucaccucuaauuugagaccauaguaaguucccagccagccagaacuacaaaguaacaccccugucucaaaaaaaaaaccaaaacaaaaagaaaaaaaaaaacaugauugagaaaaauauccugcaaaaaugucuuuucuggagguuuaaaaauaauguccuuggauucuugguguuuauuugggaaacaguguucuucagcucuguugaacuauugagccaguccuagggcacgcuggguagcaaaugcacuugucccaugacaaaugggacaaacuggaaagagaacucuuuguugucaaggugaagucagaaaugucuugcaagucaggaucguucuagacugagcuaauccaucuagaagaagacagugcuguagcuaucgaugccacauccgcaggaccauuuggugacauuuaauuuuugcagugccccguauuucuguuugcugaucauccuggagaugguuuuucuuugcagaaagugcuuguuugguugcuuccaugacaacccgauaagcagucucuuagccucugaggccugugcuuacguuacggaccugagugaugagaguuuaugagcuugcaagggagcuaugcucuucuuucagccuggcaaacuuaagucuaccucauuuucagaucacaaugugcgguuccuauagguagaaagagaagauguuugacaucaguguuucacaaccucauuauaucacuagaaaaaaaacaagagauuauaaauaucacaaccauauugcuaaaaauaguuuuaagcagccacaucuacauauuucugaguauuucgagugguacagauuucuauguguuuauauaauaaaguauauuuauuuuuucauguuauuuaauuucauaagcaauguucaaaaacuagcauguguaagcugacuauggaggcaauaggcuacaugaauuagaaaugaauguauguuucuuuugauuaaaaauauacauauauauauauauauauauauauauauauauauauauauuaauuuuguaaacucugucuuguugcccacuccuaaauucugagcagccguguauuaaacuucgugucguugacuaggcuaaagugugcauuuugaaagguuacuuuaaaagaauuccgaaucagaagugaugaugaguuugauaaacaaaaauuugugaggccuaacauuguguucgguagcucucucuuuucuaacaauguugucuuuauuuauugaguuacaacuaugaaauuggaaugcucuguuuacugaauuugaaaauaaugguauaacauacccagaagaccaaaaaaaaaaaaaaaugacuagaagagaugacucugagacaaaccacuaauguguacacacaggauuacaucugggucucugcccagacagcugcagaaggcuuccguuuuggcacuucuuuuguuugcuuaccuucaaucugcuucagaaaguauuuauuacuaaagaaagauaaauauaauagcaaugaagguggaaguuccaagacagccuucccuuugcaaaaguguauauccaggugaugaugccucaccccaaccccauuucauccuucuguauguaguucuuacacacgacacauccaagauaagagagaggagauccuuguaugagauagagguuuacaaagaugggacaugaaauagcauugcaaaguaggugaugauaaccauagcucaccuuacugagcagucugcugauggcagcccuuuugcuauccugugagggggaccgcuguuacgccacauugcaugcugcuaucaucugcuuuaguggcaagaccucuccugucaugugccuacacuaugaaucccauuuugagaggcauaaagcagguuauguucaaugaauuaugagacuuuugguaggagauuccuaaaauucaaauuaucauccaaccugaacaauacugagcugauucugacauugagcccaacaagagaaaauccuaaauuauuggugcuauuggcaauuucucauaaccagcaguuacagaaaggccauguaacugccuuaggguaggcaggcauugccaaaacagcccucucugucauguuaaagauacguguuuggucacuauugggugaucacguaagaucucaacguugaaaaaaguauaauuaaauauaaaacuguaagugauauguuuacuaaaauaagcauauugcuuuagcacuucuaaaagugaaauauucacacuaccuauuuuguuuugaggcagcaucuugcuaucaucgucaagguuggccuugaccuucugauugucuugcucaaccugagcuggcuacauuuuuuuuucuuaucaaaauaccaugacauaugaaaucacauauucacuaaauccaauauagauuaacacuguuuauaaaacaucccugucagggguguuuagggccaucagaauacaugucugcaucugccuauugaagagaagacagccgacuaaauuuguuuuguuuauggugacuguaugccuacauacuguaugucaugucuucgagcuauuucaucacaucuuuugucagcugguucagaguggcuuagcagacuucuguucuauguauguagggcugaagaugggagguugaggucccaggggagacuacuuccucugccugacucaggaguugucccucuauugaggaaagggaugaaaacccuggaauguggaggggggcagcagggguugcacccaagaguaauuggcugggagggaggguccuggacauuagcaagggcuuaucuggaagguuugucuuggaggagaauggaaaggaguaaacaacuugaccuuguucccuuccaaauaaaagccacccauuucccagcaaauacuuccaaggugccuacuaugggcuggguccuguuauagguacaacagacacagcaaggagcaaaucagagcugugcacugcaaaugacaaagggaaauuuuagccggaaauggagaaagccaaacucacauaaucaaagaccagacacaccuuuugcuggcagcuccaccaauuaaaacucaaaaggacgaucugcuacaagacccacagccucacugguccugaugauguucacucaauaaauaaaagucaccaaucugaguacaugugaaguuguccaaucauuuuuaaaaaaaugauuuaaaaaaaauguuuuuauuuguucauuuauuuguuuaauuuuaaaucccuguccuagaaucuauacacauuuuaucccaacacugugggaacagaaacuuuaaaaaaaauguuuuuauuuguucauuuauuuguuuaauuuuaaaucccuguccuagaaucuauacacauuuuaucccaaaugugguugauuggucuaaggcccacagccaauggaggacugggcucucugccuccuccuugcugggacccagaggcucguccuggggaaguugugauccgagggcacauuuccccuuguuauuuaauagaggccaauaaaaaagaccuggaauguguggaacgagcacugucuucucugcgccuuacaguucccuugaagugggauuauuguugugaacagcuuuaaaaccaaaacuucccuuccuagacguuuauaaaauagaaauuggcagcuaaaauaaacaugugccguugguagugaagaagauaacacacauccaccauuccugucuagaucuacagccccucugugaaagacuucaugccuugauccaagccugacagcauccugcagggaaggaaauauucuguacuccuguuuuccaauguggaagucacuaguaacauguuaccagcacuaaacacauaaaguggaccugguggcacagaccuguaaucccagcaaccaggccguuugaggaaguagaaucccaaaccuuggccuggucuaccaaauaaaucagccugggcagcuuucccacacccugccccaaaaguuuuuuucaaaggguuaaaaagcaguaagcgguauauauagcucagugguaaggcauuacuagcagggaccagaccugaaacucuguucccauaccacucagaucaaaacccuaaacacuaaaaauauaaguaagggguaagaaguuacauuucuaaagguauuaauuuauaaaccuauuaaccauagucacccuaaauuuuacacaccuuucuguagcggugacuaccagauggacaaccuggcagcaguauauauuuaacaauuauaguaacaaacauaguuauaaacuagccaaaaaccaaauuuaacaaaguaaacuugaagacaacuccugugucagcacugagaggucccuguguagaauaucccccaacaaauagcauucucuugcccuucuaguguuuugugcuuuguuuuacaaaaugucagcaggccacagcugggcaugagagaaaagcaggauaguauaaaagcagacuaucagaaccagcuguccugggaaggacuaacuccagcguuucauuguaaaagcagcuguuaaaacaaacuccucuccuucgucucagaguucaaguucauaguggcaguaaguucacuuaaggagagagauguuuacauaugcuguggguuggaaggccaagacuggauuaaugccuuuaaggagagggugaaaauggagaucaccagguagccaccuuguaggaucuggaauuccaagagaccauugucucucugaagggaaagcuuuagggagacagcuuuucauagucacugaacccaguaggugacacugagcagauuagcuuugcaggaauccauuucaaagacacuucagaagacuccagagcugugguggccucuccuucuucaccuucuuuuuuguccuuggccuuugcaaaccccaucauccucugcagaguuaagaaaaccuggguggguccauuuagucaugccucaaacugaagaacuaccccucccccccugccgccacccaaccccaccccaccaacaugcgugugugcacacgcgcgcacgcgcgcgcgcgcgcacacacacacacgauugaaauacaugccaaaguauucccugcaaauugacccaugaagcuacccacucucuuucugaagguaggcuaugaucaagaaguacuuaccagucuuauacuccuucucggaucaccuaagcuuaagaacaagacuuaaguaauuuuccccuaagccauuucaaaaccaucucagaccuaaauaaacaaaucaaauaaaagagucaaacccccagucauucacaaaugaccugauaucuugauuggucaggaaaagacgaaaugauccuggccugugucuaggcaaggggaagcugacacuggaaguugggaggcucuaaaugaagagacuagggaguguuaauauuggugguugaggcacucuagauaaggaggugaccgggaugaugcaauuuuuauguauauuugaaauuuuacaaaauaugucauucuuauuaaauaaacauguucagauugcauuuuccuucacagggaaaaaaagaguagaucuggguuuauuucaagccucugaaauuuuggauaagcuuuagggagcuguuucuaaugccacuuuggcccuguaaugacagcaauaggggguguugcccucucccacccaggauagaaucuaccuaucuuacuuaguuuucucuuuccuguucucucucugccugcaugguucccccugcccuguguaauugaaauaaaaggccucuggguaucugaaaauugugccuuuuaugccucuccucccuaaggaaaccccagcuuucuuucaauucagucccugcuugcaaauucuaaucaauaacacugcccugccuuuaauccaucccuaccaaagucuaaacuuggaaaacaaaagacuuuuuuccaaaacugugugcuguuuguuuucuuugaacuuaaauuacaagcccucacccagccagcuuaccuauuucugcaguucuguaugcaagccacugaugaagccaugcucccuucuuccugguuguuucugaaucagcucugaccuagcuaagaaucccuuagguggccagugaccagcuggugucagggaggagcacuguccccuagagccuguugcugugauugaaauccugugaaauguguaaaggacuucaugucccacauggcacacucuucauagagccaggcuccuacacuuaucaacccaagucccuaacuuugcagaauugaaauccacauaagccuaccccauccauuugucaacaagguuguguucccugacuccucaacauccauucaaauccagccaguucugggaaccugaaggacuuuccuggaaccuugggauaaauuaguguuucucauuugugggcaauuuuuaaucccuuaaugaaccuuuaaucagucuggagauacuccugguagugacuuccuggaguggaggugggaguggcgguucuccaggcaucagacaguuaaaaggggaacgcuauuagucauccagcaaagacaaggauagcccaacagaauuuuaccucacccagugccccaaaagaugcuaaaguugaaaggucuaguuaaaacagagucauuccuguugaaaauggugugacgaugcuguuaaauacaauucugagacccuaggacaccuuccguaucugucaacucccaacgaggucugcaaagauaagcugaaagcagagggcucuagaaaguagauugucuagccagacugugaauucacaaaccaaccaggagugucgcuuaccccagaggcggggagcacuuggugggggugggguagugaaaauguguacugacaccgccagguauggagagauaaaugccacaagcacauucuggcuugaguggugaccucuauaaacaaaauagugaugguguagauaggaauagugcuccacaucucaguacaugggauagaguuccuauuugauucuccuuaaugagauguuucaucaaugguagaacucugcccccgguguaagaguccaacagccccuagcaacaggugggcccgagugucacguuugaauagguugguucuguuugacaaauucauucagaaguaaaaugaauucuggugagcauuugucugggaaaugggaagcacaauucugauuaggaacuaagauuguaguacaaucucuauaccauaaacaagcaugaaucacaccuucugaaacaugaugcuuaagaccauugaacuccauucugcgucauucaacuccauucugcguagcauccuucugggcauuguagcaugcuucccagcuuccucggcuaauaccuacccagugccuauagcauacccauacacugugauaauggaaaaugucuucagacaucaccaaauaacaggcugggugaggaugacaaaacaagaugcccuuuaaguuuauugauuucucccugcagaauuuggcuuuucauaguuuuaugagcauagggucggugacccucaacauuucugaaauauauuugauaccaaaucuuuacuuuuaggucaggaaagucuuugagguuacacaauuauucucuuucuuuuuuucugggaagagaaggguuguuuugcauauuuuucacugauuugugaccuugggauguugguucuuucucugcugaauuuuuuuuaacccauuggaggaaacuauucauagaaccugcccuuccagauguauugauuuggcccuccuguacacacauuucugggaaagaaaguuugaguuccacuccuccagaccaacauuuuuuuuucucucuuugcaaaucaucacugcauuagcagauggcaaauuguauaucuaucuaccagucccaggcccuacaccacagauacugacaaauacucagaauggacagucugagaucauacaggcagagaacuuuguagaugauacacuucuuggauucaaaaggaaaaaaaaucaaucuuauuucuucucuuuuaauaaacucauaaacaugaccaaaacucuagacucucagauuguucacuacauaguucauacuuaauaauuguacaaacgcauuauaaaaauaucggaggggguggagcgauggcucuaugguuaagagcacuugaugcuuucagagaaccugaguuugguucccagcacccaagucauguagcucacaacuuccuguaacuccagccuugggagauccaacucccaugucgucuccauggucaccugcaaacggguggcacacauuuacauaaacauacauacacauaagcaaacaucuaaaaauaaaucuucaugaaaauaauaucucuuuauuucucucucuuucucucucucucucucucucucucucucucucucucucucucucacacacacacacacacacacacacacacacaaacauuucccuauguuuuaaguuaauuuguacuuuugugcugagccacaauucaccucuauucucggcuacauggggcccaaauucuguguaugaaaacccuacccaaagggugccguagcugugacgcuagaauacucuguugguagggaaagcaaaugaaauaaacccaagagacugccauuagccaaaaaaucucauagugggacuuagcauuuagcauguagugaagcaauacacccccucaaccccccaaguuuaaagucaaugauggaagacuacagaaaaccuugcugaaagugacauucguacuuggcucuccaugagauaauguguacuguuuucuauaauuaaauugaaucuuaaguuaucaaugaacuaucucaaaagcucuuuaaauuaaagcuaaggcagaucaguggguaaaaugccuagcguguauagagcccugcacuccaauccuaauauacaugaacuggccagaguggcacauuccuacaaucucaacagucacaaaguagacacaggagggucaagggcuuaagguuauccucagcuacacaggaaguuaaaggccagucuaggagaugaauucaugugaucaugucucaaaucaaucaaucagucaaucaaucaaucaaucaaucaauaaauuuguuuuaaacauuagaauuucuaccuuugauacauauaaccuugccaauaauucuagguuagaaaucuaacaugugcggauuuucccuaaaaaccacaagcuugccucaguaccguccugaacagucuccaguuggugucucacugacugccuuacacuucuguacuugacacacuaagugcccaucuauaguuggcuagguguuuuugacugggaugcaaaaagaauagcuaagacauccaauuuuuuggcccugugcuaugggccaugcuccagaucauauguguuauacacacuacuaauaaucuucauguaauccugcagaaugcauucguuauguccauugugcagguagggaaacugaggcaucagaaaguuaaggauuuuuuuuuauuucaauuucaugugucagaaagcuuuggaugcauauccgauagaguccaaagcuucgagcuuugagcugacuccaaucuucugaaaguuccauuagaacaccaccagucacucagaugaaacgguucugcccuuccucugcuuuugaaaauuccuuaaggcuggguccuugaaaucucaauguuccccaagaguguuuuagccaggaccuacauuucuucauacuuauacuaguuggagaagcuaaacauuugcauugucugaacuggauuuuuuuuacacugcacucaguuugauaaagcuaucuaggcaccguggaaauugaauuguucacucagcacucuuugagcacugaguuugaaauggcuuggcuuuccccuggcuguuagcagcaccuguaggguggaguuuccaaugucuguccuaugggccuguucuuucuggacuuggcccaauccuagcaucuggagagguaggacuuugccaaauagauaggcacacuagugguggcuuaucaggagcugguagacacaaaccuuagauucacaccacacaauugaguuacaaaaucuugggcuccccauuggcuuccuagucuuguguaagccuauuucuguuuauaaugaaaaggugcuuuuuaaaaggucauuguuaaacagggacauacugucuuggauauguaugggaguuugcagguuuuuuucacauagguuuuuagucagaauggaaauagaaauuaccuggcccugauagacuuucuugccugauugacuggcuuccuuccuucucuuccuccucauccuccucucccuucuuucccuccuccuccuuauggagacagucuuauguaucccaggcaagccuugaguucucacuguaccaaaagucccguuaccagcaugcuuuuaugugaugcuguguaucaagcaugggauuucauacauacuaggagaguucucugccaaagaaacuccacccgcagccucuugcuuauuacauaucuuugcauuauauaaauuucuaccuggaaaacaaaagucaaccuaaaguggcauuucuaaguagaaguuauggaacacugagcaugcauggugaucagccaucagcaguuagagaugaacucuuucuuaguucuuuuccuccuuccuuccuucucucccuccuuccuuucuuccuuucugucuuucuucuugauuaucauuguuauuguuugaugcaggccuugaauucacaauguagcucaggcuggccuugaauucacaaugaucacccugucugggcuuccuaaaugcugggaucauaggcaugugccaccacauccagcuagagcugaacuuuccaugucugccuagcauuuggggguagcauagcauucuggguuucuaguuucugccuuuuacgauuuguuugauguuucaaccucagauaagcauccuuauaguucucuuauacaguauccagcuauauaauugugaauuagcauuaaaguacaagguuaauuagucaguugggguuaauggacacaggagauuggagagaaauacuguuauuuauuuguccuuaaaauaagcugagcauugugggaaauguggacuuguuacuucacuguucuuguaggauaaauggguauagcaguacuauagcauguauucauugguguguuguauaauuacuuguauguuuuccauacaucagauguguuuuuagucuauagagauugaauagagcacacauucucugucucugucucugucucugucucugucucucucucucucucucucucucucucucucucucucucucucucucucuuucaaagcauaugaacuguguauucuuuggaguaagggaagcuaucaauaacaacaaaauaaagaaggaaguagagauuugaaagaaggugauaaaacuguauagguaaaacuagauucacggggagaaauagggcuucccauggaagagugaauggaaacauggguuugaaggagauuugaggaagucucuaacaaucuucauuugaacaaagauaaggggacauacaaaagaaaaccaaacagcauccagaaacaggauguuucuggaggcaggagugugcugcauuuagggauccugaaaggcaggaggaacugaaauagaggaggaggagacaggauacaggcguuacagagggaaugagagacauggagacaaguuguaguguuggcagagagaggcaaggguuagauuacugagagagagagagauaagaagccccuagggugggauggggcagguugaacaggaacacgaguuuauuuugaaagagugacucugacuucugaauucagggaaggaagcaggggguacccccuuucuaggaagacauugugauaauuacaaugagagcaacaguggguuggagaacuaugcucacaggaaagaugaugaggcacagaggguuccugagaaauucuugaggaggagcuaaaggaugagcugagagauuggauauaggauacaacggaaauaauggggucagugacuccagguuuuauggacuaggaaaacggaaggauggcauuccuauuguuuaaaauagaacugccuauaggaggaacagauguguggaaagaaaagagaacuucuguugggaaccuauucaucugagaugcacacuggcugcaauuucacaucccugcuuaacgcaaauacaaguagaucuuggcagucuuuaguuagacaacagagggaaacauggcacuuaccaaaccauauucuucuucauuggucucuggauacucucuucuguaaaucuuagagcaguacaggaauaauuuaaauuuguaaaacaugacaaaaccauuaaacauaauucuaguccuucucuuagucacaccauuaauucuguguacaugucuguuuucauuucuucuccucucaucccuucucgguggcaauuuuuaaucuuuuuuuuuaacugaaaugugggcagaaggagaagauuaaaaaaagagagaugaaggauuugaaugaaacauguugagagggauggagggcaguuugaucucucagcagagugaugugaacuugggugagcaucugauucaaugaccuuuugcccaucuguucagacauggaucucugaaaacaggcucaaauauuuaugcauacuggauuaguauuagaacccaaaugucacuugcuuaccuaaacuauuuccuacaaaguaggggauuuuucaguucucccuuaauaucuugggguuguauagggguuccaggacacccccccccuuugcuggaaccuucaggcucuguagauugagaaguucagcucuuugguuaaaaaauaguguagcauuuuuauacaaccuauccaugucuuccuuaauacuauaaaucaauguaaaugcauaacaaauauuucuguguuguuuagagaacaauaagaaaaaagucucuauauguuauaugcaugcgugauuuuuuuuuucccuccagauauuuuugauccaagguugguugcauuuguggacuuagaguccagggauauugggggucaccagugagcucuauuuugcagcugcuuuguauaaauaaagauucucccauuauaccaagguuauggagaaagggcuagacagaccaagaaagcgguguggauuggagaagacaaggaaaggcacacaucuucuaugucuuuuagaugaccgauugguacuuggccucagagggaugcagcucagcaggcacacacuagagucuagagacaaauugaugaauugcuuuccuacagaagcauuccuaguugugacugaagcuccccagaccuuggauacuaacauaggucacuccaaguuggacugccaaaacuugacagcugcuaacugacaaacaucuccagauugccuugaugccuccagcccagaccuuugaucacaguccacuuuugaguuucaagaaauuuuggugaccgcucccuuauagcuugcccaucaguuaguaagucacuuccuauuguuccuccuuccaggcacauguguguguguguguguguguguguguguguguguguguggcacacaggagcaugggugugcagauucaaauauguguggguaugugugagugcacauguuccugcacagucuucugccauuguccuguaccugcuuuacugaguugagggucugucagcugaacucagaauuuuccaauacagcaaguauuggcuagccagcuugcccuagggacccucugacuccccuuucugguuuuuuuuaauuagguauuuucuucauuuauauuuccaaugcuauuccaaaagucccucaucccaucccaucacucuccuacccacccacucccacuucuuggcccugccauucuucuguacuggggcauauaaaguuuugcaagaccaauggccucucuucccaaugauggccgauuaggccaucuucugauacauaugcagcuagagacaugagcucuggggguacugguuaguucauaauguuguuccaucuauaggguugcagaccccuuuagcuccuuggguacguucucuagcuccuccacugggggcccuguguuccauccuauagaugacugugagcauccacuucuguauuugcuaggccccggcauagccucacaagagacaacuauaucuggguccuuucagcaaaaucuugcuaguguaugcaauggugucagcauuuggaggcugauuaugggauggauccccaggugcagcagucucuagaugguccauccuuuugucucagcuccaaacuuuaucucuguaacuccuuccaucgguguuuuguucccaauucuaagaaggggcaaaguauccacacuuuggucuucauucuucuugagauucauguguuucgcaaacuguaucuuauaucuuggguauucuaaguuucugggcuacuauccacuuaucaguaaguauauaucaugugaguacuuuugugauuggguuaccucacucaggaugaugcccuccaggcugucuccccuuucugagcucuagaauuacagguaggccacuagacccaacuagcauuuacaugcaugcuagggauucaaauaccaguucucacauuuguaacacaaguguguuuuaacuacugagccauuucccuaguccauuucuagacacuucuuuacuuaccuuugaaacaugaagauuaaggauuuuggagccugugucuuacccacaacccucuucuucuuccagcugcuuacguaaacacuuuuauggcaggcagaguaggcccuuacaccauucucaugccuuuccugaaaaacacaaacaguuuauaaauagccuacuggguagccuuuagaaggauagacaagcuacagaacugggcaguggccuugggcagucacaggguacauuaaggagaaucaggccuggugaugagauaugccucauacugcauaagcauuauuuagccagcauggaauucaucagauaccaaauuugcagauuuucauggguuuugugucucucuugaugagaagaaaaacuguaacaaucacauucuugcagaaucaaauggauagcaguuuggauuuucacagauugucugaguucauguacugguguuauuagugcuaaaauacaugucucuaucuaauuaugaacgauuuacacugugagggaaggugagagaggggaagccagagagcccugugccuccuaauucuugaggggcuuguugagucgaaggcacuagcccuugacuucaauacugacaaauguuuugaaguauagcccaauaguugacauaugaaucagaguucuuuuccuuagaucuuuuagcauuuagcaugcucagagcaaugggguaggaugaggcuaagaacagaaauauggcccagugcccuauccagcugggaugauugugaccaccauaucagcuuucugcugugcgguugccuggcaaccucaggcuucugggauccuuuucauacuaauaaauaccagggugguccuagacauaaauagccaucaagcaagcucauugacacugacuuuacacccugaaaucacagcccuuauuuccuauugaaauucucacuuuuccuguuccauaguuugguucuugaccaagggaagugaccacuugcacgugagcagaacacagaagggggugaauauguauuuagugguaguuguuacugaugcuaauguacuuaggaaacuugacguagccacaucggaaagcccagggacgaacagauguugacagauguugauagaggugaaaaggauaagcaagaguguugagcagaaaagacacauggcacucaaguauggugcccaucuuuucuuacuuuggugaaaagaguccguauuaaauaggggauagcauagagaagagcaaagaguauuagguguccucagcacgcaugucugcucugcagauuucucugcacucuuuagaaaagaaagugcuucacuggcacgugcugucacccaacuggaacuuugucaaagucccaucuucaccagucagcauuuccuagaauguucauuguagggucccuaaguugacaaauauuaucuuuaaaaaaugcuaccucucuugggaggcagaggcaggcaaauuucugaguucgaggccagccuggucuacagagugaguuccaggacagccagggcuauacagagaaacccugucucgaaaaaaacaaaacaaaacaaaacaaagcuaccucuuuguuggccuauuugaagauauacuagaagauuccauuggauagaaaaccauugugcugauagaaucuccauguuauuuuuuauguuguuggcccaaaauaugaaguuuuguaugcauauuuccuuuaguugccacauaacugcauugcuccgauugucucaucuuaacagagaacaaaucuaagccaagagaaguuauguguuccccaacagcucaguguuaagauagcaguuaugauuuaaacccccagcagcauguuggagcaaagugaaucacuuacaaacagcuguuccuuuuuuuaccuuccaugaacagcugccucuuggacucucuuuacuggcuucaugggcucucucuuacuggaagucccucaaagucauaagagcauaauaucugcuugaauucacucuuuucugcccauuaggcuagcuguagaugacauguccaacugguaaagccaagaguggaugccugguuagccaugggucuggacagcaugcagaauccuuagaaccuccagugugacuggcaccaaaugguuuccucuuauggugaucaaaacuauaugugugccuuucuuucugcgugaccuuaaccgugucaucuagugucuucucaagccuugagccugaaguuaauagguggacuggauaaucuuugugauggcucacaauucaauuauuugagaaauugaccuauaacuuauagccugcagccuuccauucauaacugugccaagagccauucaucagucaacagaaaugauaauucacugcagggcauuaggcaggcaccuaaggguuaauauaccucaaaaaugacaaagagagaagcagaguacauuuucagcuaaggggcaaugugggcuuuuauuuauaugauuguaucuauucuuuacaaugccuucccuuuccaaaguguggaagaggcuguaaaaaagcauugauaucagaacuauuagcacugccuagccacucuuccuguuagaaggaugaaugauaugaggacucugaaagagucuugaaggcauuucucugugacccuugcuucuagguauucucauagggagguagacugaauauuacccagcuuacccagcucuuuaucuagucuaaggauuaacaugcugaucauggaguuguacuuaaaaccuaacucuacugcuucgcaguuuuguggcccuggguaaguaaugucacucuuaggcccucagcuccuuccuuuauguaaagggccccuaauaauacguaagccacuguuucuuugggauuaaaggagaaaugcuaauguauuuuaguccagugccugguucauauuaacaauuaauuaagagaugccuaaucuaguggagaugccuaaucuagugguuaguaauuauggucaaaguuccucuuuggguaaccucuuuugaaucuucacuuaugucagauuaguucagcacuagaacugagagauucugaggggcucuuucuuuauauaguauguaguuuaugaugcuauucuaugauggcuguagcuuauguguguuuguuucauaaauauguuuugacuagcuauaguguacagagaaauaaauaaauauaugcuaacuggagcuacaucuacugucuuuuuccaucauccacauaguucucuaggccuaccauucaucaguauuuuaaacuggaaccccaauucuauagccuugucuuuacauuguuuuucaugggccuuuugccuuccccaguguugugacacuuuugcccuguucauuucaugucucucuguauuggcaaagacaggccugagccuugcaaauggccuugcauccucucugauggcauacuuuacgggugacauuuaacuuuauuuuguuaaaggcaaaaugaaagaagaauccagaaaagcuucuugcuugaaauuaaugauuuagguaucauuugcaaauucuguagaaucagaagagaaagacuuugagaaguaauaaauacagugucuaaauagagcuccauccaucuaccucaguaugauguuagccaucugacugccagagucauuuagaagaaucucucuuuuuugcuaauaggccccaguacaugacauucucuuggacuuucaauccuuguuauuuucuaccugcaaguaaucaauccugggcuuagacguguaugcuaguugaucaggaucccucacuacacauuucacauagacacaaccucaucugucgagacuacacaucaucuaggcagacacuagacaagggcugucaucuuagaccacccaccaacgcacaucuuucagacaucugguacaguucgaccaguccuggccuacauucuuccagagcuagaagcuucaagucccaccaagaugcuuccuacuagccauauuccaugagcacaccugccccccuccucuucuuaccuccguauuccccucuucuuccuuccgaguucuuugugaugcacuugcuaagcccauacagaacuucgucaucauagagauguccauauccucagcagugccacagcccagagaacucauucccuucgcuauugaguccuucuccaucagacauauacaccaggguuguuugcagacuucuugauggcuaaggaaacaugacccuuagcauaagugaaaagacaaaugccaggauccuucaagaccagggccaccagaccacauccauccucacgucuagagcuacuucuccagagagcuuaagccuuuggggagaaacuaagagcacacugccuucaucuugaguuuccuucccaccagcugaguugaaaugcaggaauuucacauuuuuagacguuagugagugcaaagcgucagcacuucuaaccacagcccagcuucuagcaugcccuuugaauggccucacagaaacaaaagcuugaaaucucaggcauuccgacuggcugaccuugguguuucuaaguaucaagcaaugauaaugcuguuuggaggcuugcuuaaauuugggguggggguuggggcaaggaagaaucagucuccuagcuauguugagucauuucccaagagaaaaaaaaaagucagcauuccuggcaaacuaggaggcuauuucggcugcaaauguaaggaauuaaauguucccaggagcaagaacuuugagauacguagccaauaaauaacaaguacuagaugacauacuaagaugacauacuaaguauaaauaccguguguuggugacgcagguugauguaaaugucauuuuuugcccuggaaaaggugaaaugaucagacagaauuuuuccucggaauguaagagcuggaaccuguguuuauuugauuaucacagugacagcuccuuuacaaagucacacuagacccauuagugagccugguagauuugaguauuuuuaccaacagcugauuuucuucaaugguaauuuagaaaacauugaaugaagaguguuuugcugucagaugagauuucgugaggauuuccaaaucacuuugagaucuuaauaaucccagacaacuaacauguguggugaaucaugcuaaaguagcacuuuuuuuucuuucaccacuucuauucaaaucccauccaaaguaaaugcgcauggagaugaaggggggcagcuaaucuauauauugaaggcauaguauuuagaacuuaguuuguucaucacuggcucauuggcaaugacguuagugccaaaccucgcaugagucauugacagcaaaauucuugauuacuuuuguuuuuucacugcacugucauuguucccaguagaaguauaucuuacuuguauuggagcagcgugugugaaacacaacucaaggcuuugugguugcacuguuuuacagauagcacgacuuaucuccaguaacagcaccuaucucuauuaucaaaguguauugggagguugggauagcugaacuauacaagcuuuaaggaugauaaccucuuagggcagugucuggcacauagugaaugugagaacguugaagcuuuucuaauucugacucuauagaucauuaccaacguuuagacccugucuucugaugacccuggcagauuauuaacucucaugaagucucuuugcccgcuucacauugagguauagcuuguuuacaguuugcacacugaacugacuauuccuaaggauguauuugcacuaauuucacccauguuuauuugaugagcauuaaaaaacuagauuguuuuuaaacucuagccaagcaaauguuaccaccuacuauuaauaugcuuucugucagacuuauuuccuacaaauaaaaacacccuugacucccagugguauuuuuccugccaguggguaccaucuuuaaaauggaaacgaauauuaucaccaucuguucagcugcccaaaccagaaaucugauugucaucuuuugcccucuucccuucaugcuacagcuaacccauaagguacuaucauuuuuauuuuuuuucaaaaagguacaaucuuaaccuaccaacuuucuccacccaaaccuucuaucccagugguucacaaccuuccuaaugcugugacccuuucauacaguuccucauguugugaugaccccaaccauaaaaucauuuugguugcuacuucaaaacuauaauuuugcuacugcugugaaucauaauguaaauguaugauauaugugaaagggucagucgacccacaaaaggaucacaaccuacauguuaagagccucuguucuagccgggcaugguggcgcacgccuuuaaucccagcacucaggaggcagaggcaggcgaaucucugaguucgaggccagccuggucuacagagugaguuccaggacagccagggcuauacagagaaacccugucucgaaaaacaaaacaaaaaaaaaaaaaaaaaaaaaaaaaaaaaaaaccucuguucuauguauucauccaagccacugccaccacaguagcucuugccaacacaaguaugguggguuucuuugugguuuauuucauuuccagugacccuguauucauaucugguacuuggcuccauagucaaaguagaauuuucaaaacaaaaauuagacgauuccuugucccaaauuaagucuccucuaagauuucccauaaugugccaaauauaauucagucucauuuuuaugaccuucaagcuugccugguguggcugaguggaagacuucagggagcccucuuugaaucacuccagcuauuuguuucuuagaauucaacucagugaauacucauaugcaauauuuacuuuugucaucacuugagcaauauuaauucccauaacuggucucuaugcccccugaggucaaggacuaugucaauuuuguuaucacugugucucccgugugucauauaauuccuaucacauggcauguacacaauagaugcucgguucauuaagcaaaugaacuuaucccaaauuguuauuaugacuucauaguuucucauugaaguaacauuuuuaaaaugauuaauuuaucacuuaaaauagagauuaucuuugugcaagucauuagcuguucucagagacuggaauucuaagaacuuuauuggaaaaagccuuugaaaauuauacuaaguacucuacauguacccagacauuguagguuaauuguugcccuuuuuguuuagauacaggcauuccaacuaggcuucccccuuccaaauuauaaaauauuaagaguuucauaauggcuacuccaaaucauauauucaugaauauuucacaucuuaaaguaaaaaguuaaagccaaaugcacuaacauacauauuuuaaauucucuaccagcucugguugaaaauuuuauaaugguuugcuuuuuaacagaaaagcauuuuuggcacauuuaugaauggcauaacuuugaggaugucugguaauaaugauaccacuaguauuagacuccuuguuuuacauggaguuguuugucuauuaggcaucaaagggcacuuugguaauuuaagccaaaaaauaacaaaagcuauuggacgggguggagauaagaaacaugaaaucaagagaaauguaaugugaaaucuauuuucauuaagacuuugccuuuuauucuccauucuuaaauuuacucccccucuagaaagcaagacaauuauauugggaaauaaaaugucuuuaaagaucugagccaucaguuuaugauggcugaguaaagucucguaauugcuaacgaagccuuggauguugaaugucucagugcguccguuggggccagccucuugccuguucuacaagaagcugucacaucaaauucuuguccaggcuccgugggcacuuugauuccuaaaccuuucugagaaaccuaaucugaaaucaaagucaaguuuccuagauguggucagacagggucacauuuaaaacaguccagugaacccgcagaucaaaguugaaagguaaugccuucccccugaaguuggcacagacucacccaccagcuaaccuuuucagggcuuuuuuuuuuccuugccucuuucaccucuuuccaaugggcugggaaaacgagagcuuuuuuucauuaaagagagagauggagaguuuccuuaaauacgaucuugaaaaaguugagcacaaucauaugaaaaugcccuuuauaccagugagucaggagauaguucauugaagauguguuuuuacuggcuugcagcaggacuucccucaguaaaaaggccauaguaauuucagaaucaagaggcaguuuucagauuaaauugucaggaucuuuccgugcaucucgauggaacagcaugccacacaggggugcugccaucaugcuucaaugcaugggcuuuuuuuuuuuuuucuauugccaccuuucuucccugugagguuuuuagcuauucuccagaauggcacuggaaaaaagcggguaaugguaacucucauuagacuugaucuuaucgucacauuacacauuuucuuucuuccuuuuuuuuuuuuuaaaucaaagucacugugauuuaaaaaacaaaacaacaacaaccuugccauugcuuuauauugcaguguucugucucuuguggucgagggcauaaacaucgaaauguuuacugcuuggcaaaagauggaagccauuuagagagugauaacuguaagcaccuuccuaagccacaugggcacagaaggugccgaggaggacggugccccagauggaaggcuggcgcauggagucaggugagcaacgcuucucucccaacugcuuccuucuguccagccccagggccugacaccagcguauucucuugugucucugcacuguucucauuuuacaaaccgggaggaaucuucaccaggcaggcuggguggccuuggacaaaugaccuagucaacagaguguuggugcaguugugaggcugagucucauauggugauaggcggcagacauucuaauacagaguaaaccucuguaucuggcugcuggccuuacggucauccuuugccacuuacaaaggcguagcuuagcgugcauggagaugagcuguuguuaccugauggcaaccgaagcuaaguuuacaauggagauucuuuccuaucacauagaauaccuaacagagaugacuuagggaaaagggaguguauuuugaauuuccauuucaggggauacugguuuggcaccgcagggaaggcuuggcaccugguacagcauggucugugggucagggguuuuggggcacagcuguucaaaucuugcaggucaggaaggagagagacagagcuaaaaccaagcaggaccaacccucaaaggcaacccccaaugaccugucuccacuaguuauaacuccuaccccacaucugcuaacuagguugaaccugcaggacaauucaccuccgagcaauaacaauugucaauaugaaauacuggccaauaucucucugcccguuugcuuguucacaacugagauggggaacauguaggagaucucucuguucuuucauagcugugaaacacugggugguuuguuucaccuucuugggccuaugucaugcuguucuuagggggauuuaauguaguaaugaaugccaagugcuuugcuggugggagggaguugggggaguugaauucaguagagucucaaguaauauuuuguuuggaugugggugauguaugcuuuagauaggaaagaagaacccaggacuccaauaacaaacuagucaguugccuagaaccccacugcuuauauacuccuucgcugugauuuaaggcucuuguuugaaaguagagagguucgacuucuuuuuaaagcauuccauucuugaagcugagcugaucggauucagcaggagguagccugucuucucauucucccaggcugcggugagucaugucaaugacucccaaggaucagugaaagcaaggcugaggguucauggccuccggaagaauucuuucagcucuggaugcagccauguuaacaccaggagagcugaguauucuccacuuuaauauuccagaggaaaaucccucuagaaucugaaugcugcuuaaacguccucagcugacaucaguguucucaguguccacguuguacguuuuuguacagagcagggcaucauuccccagcacaauggccugccccucucgaggcuuguaucauaaagaaccaucugggauuugcuuguuggcuuuaauuuggcaaucaaagaaugugugcucugccuuccccuggcuucuguuggggaugguguucaaggcacucugucacacuugucaucuucucuaaugguuucuaagugaccauuaucaucucuuaacuuccaguccuuuuguuuuugaagcuauucaguucaugcaaagccugcagcuaacguuauuuaagaugccacgcuaauuagguuguccucuuguagacuuucaugcucuguuacucuuugcuaugguccuuggccuuuucuuaucuauuuaucuaaugugcuuccccccagaauaguaagcucagagcauguaagcgucauacaucuuaaagaccaauuuauucacugaagagaugcauaaaagagucguuugcucuuuacugggagacaugagcugaguuuuauuacaguauccaggagaagucuaaaauuacuuauggagcuaggauguuaggucuaaaaccuguuuuguuuguuuguuuguuuguuuguuuugcaaacauagaguauuaucaaaacaucucuguagaauaaaagcacagcuguucaaaaacagucacucagaauugauuugcagggauaaauugggaaaggagacaagacaugaaaaucccuugggccacugguugauggagaaagacagucugugucugcaugcuuaaggauuacuggcucacuaauuagcuggugguaaauaagaauauuccuaaggccaugauauugagcaaaagaaaugaaugcucacuugcuauaauaauuaaauuucauauuugacuauucuguuguccgauaguagcuauauuccagucaucucaucuuccagauauaaugaauaauugguaugcuuuuucaucuugucaacaugucuggugauucuaggaugcauugaauguuaccauaggacuuuaccauccuuaacaaucucuccccaaaauggaguguuuugugaugucaaguggguguuucauuuccagauccuuugaaaucuugaagcuguaaagaaaauuuacaaaaaaaaaaaaaaaaaaaaaaaaaacaaaacaaaaaaaaacaaaccaaaccaaaacucagaaaagucuuaaaggauuucuuuuccccucaaacauucaugugcaaucuguuuggaugauuuugaucaagagcuaagggaugcugaugaaauuuuaagacaaaaaacaccacuggguucucaauucagccugaugcuaugaaggcucaguaguccccuggggccaaagcccugugagauacaguuagcuaggauuaugcagaucuucuagaaaauccccucccccaagaugaucagaagaaaaacauauuggguugaaaggaauacuucuuuacucauugguccuaaguucuguccaucgguucauuccuugcuccuucaggcacugcccuuuuuuuuucaguucaccaccuguggguggggucaggacaggccuuacaaaccauggaacucccucuauugacuuuacuuccuuacugauguaacauguaauagaauucauacaagccaugaugucucagagucauaagauuucacuuuuacgugaucucugucgcaaacauggaaauggaacuggcuguuugcccucugaaucgcccgcuguccuugguguugaaggaaggcaaccugauuguggugcuuucugcaggaggcuuuucaaguguuuucuggagaaagugggaaagauguaccuugugcgcuuagagccauuaaggggaugguccuaggaguugcuuuaguacuuucuggucucuugguuauuuggguuuuauuugagccaugaauauugauggugcaugguuugaauauaaacuucuaacuccaacuuuuucuggcauaguauaaaacauugccucacgguaguucgguguuugaaaacugggagccagguuuuaaucuaauccauaaugacuuugccauauugccuugccaacuuugauuuugauucaaauuuuguucuuagcuaagguaauugucuuuguucuucacuguagcuauggaaugucaauuggaaagguuuauaaagaaauaaaaacuuauuuuauagaagaugcuuagcauacugcuaaucacucaacuggagguaauuuuguaucccaugagacaauuagcaaugccuggagauggagaugucauaucuuguacugagggacccauaacuggguuuaauaggacaaagcaaaaucauguccaaacuucuacagugcacaggacaucccugcaacaaagaagcacuuggcugagaccuuuguagagagcaugcaguagcacuuagugaaagucuagcaggugauauuauuuauugaccuuuuauugauauuauuauuuauaaaaauguauauagugacuauauaauuuagauuuauauaauuuaaauaauggcuauuuucaaguuaauucccacuuuaaaauaauggugacaccagaagcucagcauaauucuagaagaauuugugugacaaaaauccuuucucauuuuucagguauauauugauuccccaaacaugagaaauuucacugauuuuauuuuuuuaaucuauguaagucaagugucagguuccacuuaagccaguggacauucuagcauugcacagcagggagcugaaggagaugaagccccaguucagagcucagcauuugaccacgaaaagcauccccuaucacacccuuucaaacagauuggcccuaccaacaugauagaaggggugcguuaauaaagggagugcagccguucucugccuuggaacuaaacaaaucacugagcauaacuagaucuaggauggagcuggggacuuucuaaugcuggacuuuucuaggggauccuggauaagucugucagaauucaucaagcaaagcuggcuggcucugcacauaaauuguugucuuccaugaaccagugcaggagaacgaaauucaguuguagugugucuuguucugagcagagauuaccacaaaugcacuauccaaaagggcagguuuugcacuucacucuucauuuaagucaugguaauuguuuuuaaucaauaaaagccuuaguucaaaguugccuuugauguuaugauaaucagaagccugagcaacauauuguauaauaaaaguucccugugucuucaauuugucuuaugcagaauuaugaaacauuguaagaagugauuguuuaaauuguagacacuuacaacucuuaguuccuuaccuucacugcccaccagguacuucuuuuugguagugauagcaucaaaaagagguuggggaucuagggaaauagcucagcaggaaacuacaugcucugccagcaugaggauggagauuagauuccuggcgcccaacucauaaucugacaacacguccuuguagucccacuucugagggaggcaaaaccuggaagaucucuggugcuucuuggcuagccaauauagcugaaucugugauucuggguucagugagagagccuuucucaaaaaagagagugauuggggaagaaaccuaacauugaauacuagccaccauaugcaugccuauagauauguacuucaccaccauucgcuacauacacaaagggguuucauuuacuuaacaaccuaauuaguacuagacacucuaaaggucuuucccauuuuucuuuguugugagaacguuaugcgauuuuuuuuaaacuuaccagcuuugugucaaauuccaauguguucacauuacuauucucuuuguauuucuguuguacauuguucuagaaguauauucuuggauuuaagaccccaaauccaaauagccagaacucuuugauuguuguaaugacacuugaauauuucugucauuugcuggguaacuccaguccuuuuccagcgcagccaguauuauaacucacauagccccugugagcauuaaguggcuguuguuuggagacaaagccauucgugguauuuaagaguccuccccuuauccuucccagaacauaaugacuuuaaagucugguuucuugugggucacaaacucauucaauucaauuaauccaauuaaacccaaacaauggcaacgauguugggaugaagcauugucuuccgcgcccuuugaugugagcugugaggcucuucuccagcauagauuucucugaaacaauagcauuucucaagcugccuucuacgaaagagccuaagcugcagcagcauccacuuggguauacauaugucuuaacaaacuuuccgucuuucacggagcaccuugaauuucccuacaagcaaauuagacaagcgugcaguuguagagucugguuuuguuuuagaagaagaccuccuuuuggguacauggcaugaaugucagauaacuuuguuucucaacaccaggcaaauuaauagugacugauuuauguccaccccccaaauugcuaauaaccuuuaauaaccaagugcaguguuaugcaguucucucuaaucaaagguugccuuugguuucugacugccaaaaucuuaauaaagacaauaauucuuggcuugcccauaagugagauuaugcaaccaacaaugaggaaaccauuaaaaaauuaauuuaggggaaaguuaauugguguuuugcaacuuggucaacaaaauguuuccucgugauuaaugggauuuuuucaagagcugaaaacauuaagccugaggaaauuauuuuuccuuauuagcuuuuauucuucaucuauucauuugagauuaugaggaggcacagauaguuaagugaauuccaugauuuaaacaaacaaacaaacaacaagcgaggcaauguucugucuccaggaauagaaacuagaaaaauaagagggcaggagaaaguccuucugcuuauauggccuuaauugucaaugguuggcucucuauggguuacgcuauagaaccgcaucucccaauuuucccaagccauccaucuuccaggauggaagucaugcacaguguuucguuugucuguuucaauguggcaccauuacuucuggauggugguguuuccccacaaucucuccucccucugacauccccugagaguuuugguuccuccccacuuguggcuccugcacccugcccagcacuggcaguuaccagugcuuuuagaacuugccuuagugucccccuccuuggaaaugagaaagcauuuugacugcugugaaaaaucauuggauuaagaaagcauugcccuccucugugacccaccccuucccgcccuccagaagggagccgaagugccuacuuacauccugugucuucucagugcucuguguccuguggccaaggcgugcagcagaggcaugugggcugucagaucgggacacacaaagcagccagagagagugagugcagcuccuacagcagaccagagucggagcgugucugccaagccucaccauguccucucuacacuuggagggcagagcagug

SEQ ID NO: 3242 - RNA, 15057 nt, Mus musculus
ugcacucucucuuuuugaaaugguagauguggaacccauuacacacaagaagacuaggaaaagauucucaacccgaugauuaggaugcuggaccccuuugaucugacuacauuugaagaaucucacuuauuuaugagaggugagucuuggauuccucccgaaauaucccucccaaagcacagcccagacauucugguccaauuccacuggcaggcagaaucacauacccacagaggcucaccccggggagaauuacaucugccagaugccacgucuguugugaauuuguuuaaauacuugugugcaguuuaaaacagggugaaaaccugcacauggaguuguaacuggaguaaucagcuccagcagggcaagguaacucuggaagggaugcaggacagcaagccacugagucccaugugcuggaucuggagcugcucaagcacagugcaggccaagucacaacaucacgggcggcagcggcggcgguggcagcugcagcaguaaaaccccaccacuggaaugccccucuccagauaaggggggaaagaaugcaguuaagaaucuuaucauucaaaauaccuguccccagggacccgccugccaagcugcacacucuggcugcugacacgucugcaugggcuccggcuuggccucagggucacacauucuaucgcuuaaucgaucuucgccaaacugacaccagaccuggcggugcuuaugcccuuucccacaggugaccaagcacuggaaugaaaagcagaggccaucaggguugcuugugaucaaugugcuggagcccgugggggcuguucucgaaugagagcagguggccucuucccaccucuggccccuccccacuacugaacagcaaugagcaaacacccacugcucuccgcuuccuuucauccuguucucguucuccuuucccucuuucuuuuuauccuggcacagccuccugaagcccaggcuggccuccaguuccccaugagguugagggucacugaagauucugauccucucgccucuacuucccaccuccugucauuguaguggugcccacuaagucugggcuacacgcuguugggguuccaaccuagggcuuugugcgugugagguaaaugcuccuccaacugagccacauccucaacccccuuucuggguucuuacucguuuucauuaugaaauucucaugaguauuuaucacuaugcuucucauccauauuugcucccacuagcugcuccugccccauuccuuccacucuuucccccaucuccuucuuuucuuuuuccagaaucuuuuuucuuauucccuuuguauuauggccagauucaaacacagaaaagcagaguaccaugcucugagaaacaaacagaagucaggauuuuccauuacagagguucagugugaagaauuaaaaguccgaccaacuugacaccucuauaaccaagucacagugucucugugccucaauauucacaucuauaaaauggggguaacaauaauucugacucagagaaacuaaagugucuagcacguacaguauucauguaugacauucucaaaaagaaaaguaugucaaauauaauuaucauuauuauuugggcucacuuuggaaaaauuaaaaaaugccuaaaaaguacaaaagacaaaguaaaauaauugaauguuuucuucaauucuuuacucuuuccauuccagucuuuuuauccaagguuacuaaguguuaacgaaguguuggaacaguuaggcuguauguucaguauuuauucaaacacacguuuagucaggguuugcuauaaaaguuuccucuccuuuacuuuuuauuuuuuuagaagagggucucaugagucucaggcuaagccuuaaguucacuauaguacacacagccaaggguggucuugaauuccugaucucccaagaguaggaauaaagauauauaccaccacaccuggcuucaugaacaacuggacacuaaaguauuagcuaucuaaguauaauguaaaccugcuaucuucaaucauauuuuaaaaaaaaaaaucaaggauuuagugcuuaaucuacugggaaagcgccaaguuuguugaucacgugaccacaaaucagccauagguaaggacaugugucgauacuugaccauuccagcagcauuagggguauuuuguucagaucugacaccugaaauacacaguuuacauugcacucacauuggggggagauaaggguaugugugcguguguguguguguaggagcugugguuguagcaacuuugcuuccccacauuucugaccuguccaguuaauaagggaugucuauuccccaaccaccugcauccgcugaaggaggugaagugaggagccgucuugcugagauucucacugggcuguaacaauguugggcuacauuaacagacaagaugccuacuguaucccaagauccagauacggggcacagaugggguugccuugagcuucauaaagcaagggaugagaaguuauuauucucaaacacucagccugggcuucccccuaaccaagcgcucccaugugacuggauguguaagccagguggucuaaucucuuauuucaaagacgaggaagaugggaauccucuuuguuggauucaugucuaaacuauuuuaaccucacacuucauuaagccucaauuuccagccaacgauuuacagcucaaagugggggagggggagaaccacuccguuaaagucagcagcagaagcuacugggcuguaagauccagccaacuccuagugacucugaggcccuaggcagacuaaaggguuucaguaguaauggaaauggagaaucaaaugggagugagauggaagaaccauacaguagucuacaccuccgcccgacgcuggggaauccagagucaucugaguugagcuaggauccagggcuuccuuuucucaccucugaccagucuccuguuuuccaauggggacaggagaacucauugcagcucuguacuacgacuuucuccuggugugugcauuugcugucauccaggacaucauugcggguguugacacaaauugcucuucuucucuggguaccaccaucacagcuucuagaacacuaugaucauuaaaaauaaaaaauaaaagaaaauaaggcauuucugaauucuuuacaaagacugcuuaaaaucaaagcuauguuguuucuuucagcccuuaagaaauaaauguccuaccauacccaagucuaguuuuuucuucauguuauauucaagucagacauuacaaauuaaccuggggagccuuccuuucagagcuugacuuaaaaggcaucguaaaucaauugcagaucucucucuaugcaguuuaaauggguuucuuaacacagucccagaaggagcuaugaucacucaucagacuugguauucaggacucucagaugagaaccaacuuacuucgguccaggcugaauagcgccauccaccugugcugcacucuccugagcauuucuccugguuacucggucuggguugacugcuacagaaacugucauccaccuucuccgucuucccguccauccugcuguauuuggcacaguggaugucuaaaguacgguagcccaaaccacacugggcacugcauucgcucuugcuggcaacgugccaccuagacauaaauaaugguggaaaaccaacauuuguguuaaacacaagugucacauccaacuaguaagaaagcugaguucguucuuucuucauucaaauaugaugacagcucaaagucacagccaguuacaauccaaguucagaccaagguauccgugugauuuucauggcugucaauguacguggaagucacagaaccacagccagagaugcuacgucugugaagaaucucuugguacagcuagucugaaauucaagcagcagaaaggaaaacaaacaaacaaacaaacaaacuggaacucagcaaagcaaggacagcaauuuuuauaugaaguauuucacuuggcucuugggaaacucaucuguggaaugcuucuuuuugucuguccgugcuuguaaauacucagcgacuauucugauaauaauaaugcaggaaugaauaauauggggaauaauuaaaaauuuucaaguguacgugcuauacacuaggagcguuauuauuuauuauuauuauuauuauuauuauuauuauuguuuuguaauaaacacuaaauuuggggggauuggccaucagcucagcuucaggaucaauaagagacccugucucaaaggaauaaagcagagagugaugaaagcaggugcacacccuugcacauguguguauacacuacacacacacacacacacacauacggcuggaaauguuuuuguuuguuuguuuguuugcuugcuuuuuaguauagaauagaguuuauucagggcauggggaggggaguuaagagaguaguagaggcagagaaaggcagagagagggagagaguagagaaaugggggucagucaugaccacaugaagagagaggcaaagaugcaaaagcuggacacaauaucuggaacagcagauauugugugugugugugugugugugugugugugugaguguguauaugacugauaugacugugugucugaacauguaugucaguguguuuguguuuauauguaugaaccuguguaucuguguguaugcauguguguacgugugcauggguacauguggaagccacuaaagguauuguuucucugguuccuucuacuuauuguuuuaaucacaguguguguguguguguguguguguguguguguguguguauaccagguauagagguuacaguacaauccucaccuuccaccauguaguuccaaggacccgacucaggucaugaaguuugggacaugugucuuuaugcucugaacuauuuuacuagucuuaccuuauuuucugagacaggcacugucacugagaccuguccugucacuggaaacucagacuuugcuaggcugguuggccaagaaccuuccucugcccaguggguuccacuauauccccagcuacaccauugcacuugacauuuuaaaagugggcucagggccccgugcuugcagaagcacuuuacaacugaacugucucccaaacccucauuauacacuuuuaaaauuagauuugaauccaucagacuuugccaccuuuacaucccugauauuauucauaacgaagccuucugacacacaucaggugcacaguauauacuaaugacuacucuuauuuucuauaacacaacaggaacagagugcuugaauuuaaaacauaagcaaaaaauguuuaauucacaguuuuuaaaaucaggauuuugaaauguauguggaaaucuagaaaaagauaauuuucuucuaaccuccaggggaucuucucucccauuauuaauucccuucaucucagccacugggaggugugccacuucucaauguccuaauguucacucauacacaccugucuaggggaggaguugggaaaaaagaggaacucaagccaacacgcuuaucaaggaauuucuaaguaauguccaaaaguaggucagaguugaccacuggcaaggaaagugggcugugauuuuccauuacacugaaauagcgucagggagauuuuguucuaacacaguaaacgaggacuuauaaacucauccuuuaucucauccugucacaggccaguuggggcaaacugucacuuccuacaggaagugaggcaaaaaaaaaaaaaaaggugaacucguucuacaguggcaucuggaacuuccaucugcacuuugauuuuuggcuaccuucucaggccuccguggucacuucccugggggaaggcuauuuaccaucuggagaaaggagggagaugucuugacaagaaagcacuuugcaguucagcugccaaagucacuucccugucaucgcauaagacccaggggccaagcagagauccccaagaagaaucuauaaaaauaaucaaacucuaaauuaaaucuaguuugcucuauauucuuucuggaccgugaccuguucuucaguacaguguguucauaguucacuuugugggaaauaaaaugcuauuauuauauuucauuauuauauuucaggaaaguauuugcuagucagguguauguguguaucucaguacuuaggaggugggagcuagagagaugagggugcuuaaaaccagcuugagauacauagagagcuccugccucagaaaucugaggacuggggaaauacuucaaugguagagcccuugcccaguaggcaaaaagagcuguguucagccaccaacacugaaaaaguaaaauaaaaucuguguuuuaauaugcuaauaaguaagaacaagauaaauacguaacauguguguaggaguagauaaugggggcuggauuaaaugauuuugagaacuaccagaagaaauggacuucuauacuguaggucuuugaagcuucacaauguuuaccaguaucaugagccuccauaugaggaagacgauguuuuggagggcuucucaaauacacagguuaagaguugcuucgucugacugguggucccaugaacaugccugggagaaacuacguuggagugugaccaaccaguaaccauucccucucuguucgcucaguugugcucacagcugauuggccagauuucagcaugagucuugauuagacggacugucagguggacaaaagggacaguacaucuuccauaggcuugguuugugucuccgcauauuuuagcagggaccuuuaauuuccccaacagucagaaaaaagccagcagugagccagucgugagaucaccugagcacugacugaaagccacaguuguucgcugacuuuuaggcacaagcacacgucugccccuuugugugguucuaaagcuaacccugaacucuuucugcccucaguguuugacuuccuccacacucagaucugcuaccucuaugaggaggcagggaugaagaagcccccucuccuucuuaucuacaaucacaacugcuuuggccacucagcucugugcuuccggcucuuguccccacuuggccuccggcagaguuuccacaccaaaaaaaaaaguguuuaaaaguugauucuaaauggguaaauggggaauauagagaauaauaacacauugaccuugcuauugaucagaauagaaaauucaggcugaaguuuuaucugguauuaugacaagaauauaaacaaaaaucagucuguacuauuuaaucagcaaauguuggguaugaauggaagcucucaugcuuaugagcagagagccugagucgaucacuaggugggggggaucagguggaacaagguggggagaguagcgucuaacaccugugaaggauacacaauaaauuagccauuauuauuauuaugacuaugccauccuuggcauuugagucuccaagaaacuucuauuuuugccuccuucucuuaauuuucugcagagcugaagagcagaccccagcccucauccgugcuuguucaggcugcagccuaggccuuugguuuuugagagacagggucuuacaguuuagcuuaggcgaguuucagacucuccaucuuccugccccuauuucccuacuucccucacagaguuucagcucacuuuaaaaaucagccaaugagaaggcagcacccuugcgauagucugugcagcccaauguaacacucuuccgagcugagucuaccuuuccugcacugacuuuuaagaucugugugaauauuaugcuccauggugucuacugcaggagaaaccagagccaucgcaugcugaguugugacucaucuuaagauugcuuaaagagacaaguauuugguucuugaaguaacagugcagacauuaccuccucuuuaaaaaggcuauuugcuggauaagcuuggaauaggauuauugaauaccauuugguugauuucacacauucuguuucuugagaugcuucguacagacucacacucauugccacuguaagaguaggagguuucauguucaagguagcagaccuacagacacugcaugugccauucaggaugugacuagccccagucugagucagacaguggagucccaguguggaugaacagaugaggcaggacacacacugggagagauuaauuccucauauauggcauggcagaauggggugcaugucuaucauccuacagcauuaacaaaguaggaauagaggcagcuuuguuccggaacugaaguacacagccucucccauuggaugggccacauuuaagccucggcuguuacgccauccagugugaucugaagcaaucugcauagcagcagucaggguuaauauuuugauauauaaaauaaugauaaaaucuaugcugugguuguugugguuugaauaagaauggcccccauuggcucaucuauuugaaugucaucagggagcagcauuauuugagaaggaucaggagguguggccuuguuugaguugaguguggccuuuuuggaagaagugugucacugggaugcucaaaaagucaugucagccccaccgccacacacauacaccuaaagaucagaauauagcucuuagcacuaugccuaucuaccuaccuacagccaugcuuccugcugugaugauaauggacuaagccucugaaacuguaagcaagggccaauuaaaugcuuucuuuuauaagaguugccuuggucauggugucucuucauagcaauagcacaaugacuaagacaauagaaguaguaguaacugaaaaaaguauagguuuauuaauuguauuaauagaaucauaaaacccauccuauuacucuggggauauuauauauagcuguuaaaaauaguucucagcuuagugagacccuaucuuaaaauguagaaagaaaguugggguuaacucaaaggcagaacacuugccuaacauguauaauucucuaggucccaaguccacuucugugaaagcaacaacaacaacaaacacaacagacaaacacaaacccagaucuuaaagguggccuauuccaccauauuuacuugcagaaugguagaugucacgauggcuggauuuaaggcgauccgagaaugcaaucuuacucagcuuguuaaccuugcaucucaaggaaguugugcaagaauucagugacucuucaacuuaauuucccaugaaaggacuccuuaauucuaccuuaacuaguguaacucaauugacugaagcaaauagauuuauauggacacuaucuaaaauaaaguaguacugccaaacguuuccuuuccuuuccuuuucuuuuaacuaacuuuuuaacaucuuacuuugacagugacuucuguccauauguuuugagaagccacagagcaacccauuuagugauaacagccucagaaaaugugugguagaguggaaagugccugguuuugaagucagagccucaggucaggacuggaagaucuaugaugcacaugucacugcuggcccucugacuccuaggacagaacacuauuaauugaucguggcacuuucuucucucggacacacaagaggaccuuauaaucugcacuccuacaccaggcagcuaacacugcgaagaccuggcauggcgauguggaacuucaaagugcuuuacuccgcuucuugugaauggagagaccuuaucacacuccagugcuagucuaugccaauagucucccacaguaauugcagacuuggcaugcagguuguacaauacagcccucaugauguuggauguuuauacacagucaaccucccaggcaauagaaacacucuagaauuuuccacccucucaauauuucuuccaucagauaccauaccuuucuuaaacacagaauuccgugaauaccuagccagucauauuuagauuuuuucucauucccuccaugccucuacauuaaugcauaauauucucucucuauggcugugucugucucucugucucugugucugucucucugccucucuguuucugccucucucugucucugccucucuuucugcccccccucuuugucccccccucucucugugucuccuucucugucucucucagucugucugucucucugucugauuugugcauguguuuauguguuuuauauauguagacacugaaacuuucaugcacaaaagaauucugcacagugucugcucuggaugggaagggaacaccauggguauucccuuacauaaagucugacucgaugguaaggccaaaaccuaaucacuggguugugaagaucaaguuguuuuuguaccagugcucugcucuguuaacuauuuuuaauucuuaggagaacaagaaauccagagugauggaucucggcuaaacaguuucagaacuggcuggagcuugugugaggaaaacacuggcaaggcuaggaaaagacuggcaacucuugucuccaucgcaucccccacagaaucuccccucaagcccacugacuccggaagaaagauacaaggaaaacagaggccgcaccucaagucacagucugugccgcacgcuucagugacagguccuggcuggggcagccggucacaucuuugaucagaaacgguuagcugaucagacucccuggugcaaacaaguuuucgucuccgcuccccuaagcaaagaguaggcacauuauugcugaggaaauaaccugcucuaaauuaccaagaucaaggacugacucucccacacuuacuagcaaaggcuaggcaguauuuucaaucgaguuggccguaugaucucugccacacuuaacucaaccaggacaggacaaaaccagcuggccauagacagacugcuaacaacucggaguaucccggcuuuaauaaaacuguauuaauaaaaagaggguggggcugaauuugacccugcugcuauaguuugcugacguuaauuuaacaaaaagaaacaaaacuaauaaaaauuaugacccguaaagccacaugauagaaaauuaaaguggcaguauugauucugcguggcuucacacauacacucaaacuucuuagaagaaaaugcagugugaccugacaugaccugaaucuuauaaaauucaacuugacaacagaaacaaccagaaaggucugaguaaaagaagugagaagaugcaugcagcuagaaagguuuuuggauuguauauacauagcuguucuuaaaaaaaaaucaguaaacaaguagauaaaugaaacagagccccucaugccuacgccuccccccuccccauccucaaacccauagaagcuggaaacccuugagcauaccuuggcagggcuugcugcaugcuugccacggcccgugacuguuccaguaaaauugcugagguuuguccucaaugggaauauugaaugaguaccgcacaucuggguuauacagcuuucccacggacaacaccugcaauguguggagagauugggaagaagucugcuggccugcagugcuaagaggagagagccacuggccaccaucccaguguuuaccugaaggagaaguucuuccucgauacgguccguacaguucagucuuuccaccacauuguccgauccgcuguacucaaugacggcgcuccccacgcggaccucccuuuuggacauggagacaacaaagucuccauuuagcaggaauucaccuuuacuguuugauaaagcuguagaugggaaaagggaauugggugaggugcugccagugaccagcuguguugaaaauaguuagauagauagauagauagauagauagauagauagauagauagauaagaacagccugauuggcagaggcuggcagaagagaagacuucaggcuugucagccaggccaugauuccacagucuugguuuccaugugcuagcuaugugaccuugggccaucaauccuucuuggucucaguuucuuuauuuauaaauggagauaaagaaaaccaccuaccuauggugguuucuauguaaacuaagagaaauauuauauagaaguccucaguauucugaaguuaauuauacaacagcaacagucgcaggauuauagacagaggcugagguauuaaaaucugauacacacauaugccgcuguguguaucagacaacagcaacagcaacagcagaaaagcauuguauuuuagugggcuaaauucacuguuucucacucuggucucaaacuugcagcacugccccagccucugccuccugaguggugggguucagagcaguagccacaaugccugggauaaccagagauucucucuaaaaugacuacauuucaguuugucauugaacugaauccuaagaacgcaauaccuucaagcaccugauuugacuggacaauuuaugugaacauaucucugugcaucacucuacuuuccacuccaacagccagugcaugaucuaaauuaaaauguaauuugguuagguauaacacaggagagagauacuuucaugcuuuuuagauuaacuuucuaaagauggaaaucucagugagggauagcaagguggcucagcagggaaagagacccgcugccaagccuuacaaacugaguucaguccccaggagccacauggaaggagagaacuuguucccucgaguuguccucugaccuucauauacauacaguggcacgugcaugucacuuaaauuaaauacauaaaauguuaaaaaacauauguagcuuuuaaaaccuggcgagaucacuuuucuuuagcacuugccauacacuaccauggccucauuuuaagcccgucuucugcaccugcagcccauucccacauggccagccacuccacucguaagaggcagcuugcaguguacugcauaucacaccucugugaggcugcucugugaaugcaugccacacauuuguagauauggacguacaaaugagaaaagcacgauuuaccaaccaguaaguucauugaccaaggccagauagcuucugucuccacagcuugugagacacucaaauugcccaaagcagagagccagcaaacauuugucaagaagguaaauucgcucauucauucuuccucuuguuuacaaauagaaccaagauacgcucaggcuaagcucuuuaacagcuugguguguuuugcuaaacugcaggaaccuuuucguacaguuaaaaccacuucacagcucaccucuuugaacccuaagaccccaacccuuaguaggccagugaaagaugcuguuaagagugacugaagcugacaccccugagaagaggauaaaacacuuccauccugagacuuauuucccuagcuggugugaaccucagaaaaccacaucucacucacucuuggccccagaagcuggagaccugccagcugagugagaugcaggguuuccagugggucacagagaaaugugauuguucccuuggcgcccuagggugguuccaaagucagaucacuuguacaugauagcaugauguacugacgauaccgucauaagucauacacuagcuacuccaaacgggagaaugaagugccccaugccagaguuauaaauugaacaucaaucuggcuuuguuuuaaagaacauggucucuucuguguuaauccccaagucucuuccuguggcuucagcugcuucucuugcuucuaacagaacuaggggaaggccgcuccucacugccuguuucuuaugccaguuaguggugagugcacagccagacaagaucucaaauaauguaaaacccuucucaagauuugcuccuauaaaugguauguccacagacuuacacaaagguaucaaugaacuaaaacucuaguuuucucuuguacugcauggaugagugauuucccacagccagaauuaaauccagggcuaagcaucccagaggcaaguaaguaucacaaaaaugguuacaucuccugaagagagaggaacaaggcaggggcagugcaacaugguuuuaacccaacaagagggauccgcuuggaaggugaccuuugacuggcaggcuuucugcuucaguaccucagagaaacaaacucuuuccccaaauccagaguccccugcuccaccuccugcuaaugagauuagggaagcuaauuuccugaguugcugcuccuccgccaucagaacuaggcugcugcagagguucuacuagaaaagaauuccuccucaaaacacacagggaaagugggagacuugaccagucuucacacagcuauugggaauaaggaugaagguugcuuaguaacagaacgcaaugacugaauucagcagaacagggugguuggcuguaaaguaucuaaagggaucugcuaauacauagccccuugcuucaagcuaagggugaauaugcacacacucuagccugggugacaccagauccuccuuacgaaccagagcuucuuaaagagccauugugaggcucccucagaggucugucuucacacucagugggcugugacuugccaucaaugcuugcacacuccacauuugcuuucagagaggcuugccuugggcguagcaguggcuugcccauacggcccguuccugcugacccguccccuuuaacuuucuucucauucuuucacggggagauuaagaaaugcccaggaaagaaaaaaagauugucagcaggcucugcucaaccgccucgcacgugcugguugcaaucaacagaaccgaggcggacaguacuuggacagaaguuauuuucccaaggaaaauagaagagaaccuucuuccuuuggaacagagggacgaaaggauucaacaugguuuuuggcucucaagaaauuaauuuauaagggacacuucaugccauguucuuuaacuuaauuaggaugaacucagaacauaaaaaccacuacaagcucggauuuauaacuaaguauguggaggagggaaaugccugacauauuucaugcaguuguagaaugggaaaugugggauuccccaaaaguaacuugaaggugguuuccagaagccuguuaauuaucuuauuuuaauucaugcauguguguguauccaucccugugcauaugcauguuuauaugucugucugugucgcagaaccuaaggccaaauaaauguucaauuguaaacacaugguuca

SEQ ID NO: 3243 - RNA, 1472 nt, Mus musculus
cacuggcaaaaguucuuuaauguugucugggcauugaaauuuauguaagguccuuccuaaacauagagaagaagugcucuuggucuaugcaacaacaccaauuagauaugccauuucggauacagauagaaaaaaagagaaaaauaaacuuuauuaccuguucauuaugaaucacaacuaaguucacaauaacaauauuaauuaaauuuccaauacuugagucuuuauagauagaagcuaccugcaaccgagauaaauuuuucaaaguuaauggcggacucucuguguaaacaauaagcaauucacuucuuaggcuaggcuccaucacuuccuacguuucguguaacacauguggucuaugguucggaacguucacuguacaaguauugacuuacaguuuuguuguaaaauucauagauggcagguuuuugguuuuuuuuuuuuuacauaaaaaugaacucuagcgaaauucugagguauuuucccuugaagcugcaucaucauaugacuuaacaguuauuugucccaaagcaucacauauuaauauuccaucaagcacuucgcugccccuugaaguccugggucccacauaaaugcugauacacauuccucaugcucauuguccauuuauauguucaacagcacuguaaacugguuucucacuguuauuauuauuauugccauuauuauuauuaauuauuauuaacuauuuaugucagcuguguuagcuggugcuuaccauagaauagauucuggcagaaaacuggauuugcccuuaguucccacagcaaaacucugggcuaggcccuacaacuaucccuuugaaacaagaggucacggaggcucagacagauaaagcaaguagccuaaggcuauccaggagcaagcagcagagccagaaguuacagucuaggcuaucugauccaaaagccaggcccauagucaaaacccucugacaacccaaaacagugggauggauguggagcuggggcuugcgagaucugauuggguuuucccucugucuccuggguaugagagggcugaggccuaugagucauggagggauagagcugcggaaaggcaggaggagggaagauggcccacagcaaagagcaggaagcagaacaggauguggggagggaagaggacaacaugaagcaauagucauucccaagcaugguggcuuuucacgugcaccugggacauuccuucuaagaagacuguuguuguucagguaaagaagggcuaauccaucaaaggaaaaugagugacaucagaucucuaugcaccacuguguaacauuaauuaaaaaaaauacuacgguauagggaauacaugaguauauuccauuucugcuugaauggaacuuguaaaguaacuucuccgugccuccgagagccugacuccagaauugcugaggauggaaaacaugcaaauucucaugcugccucuguaaaaugauguaugaccca

SEQ ID NO: 3244 - RNA, 18477 nt, Mus musculus
caaagggcgcccggcgcgccucggagcgcacguuccgcgccuucuccugcccgcaggcuggacauuaugcggccgagccgccgagcccuaguccuccgccuccuucuccuccuccugcggcccgagcgccucagcucacggcaggcggcagcguugcucagcggagcgcagacgggacccucucugcaggaccucagcgacuccuaaagucaaaaaguuggcggcagggcgccgggguuccgcgcgcucuccaaggcugcugccucgcgucgccgccagccaccaaagccggcaggagggagggggugggagaagcggggggaggggugaggagcaccaugcaguuaguauccugggccacacugcuaacgcuccuggugccggaccugguugagaugaggagcccugacuccgcggcggccgugcgcaaggacaggcugcacccgaggcaagguaacauggcucugaacccugaagccccccccccacgcccccacacacuccaucgccaccuucuugaacacgcucuggggcgggcaccccgcaguagaggccucucuccuuuuccuagaaagaauuaccucuccuuucggaaccucucccuucucugggucauccuuagucaacuauuagggaaggaagcacugcaagaauuuuagggccacccccacccccaguccuuuuuaccugacuuuuuuuacccuccuuaucccuugacccaaaccaguccuaauuaauagcuuggaucaccagauagcacacauuuuauuuuauuuaggauauuuaucagaaucuguaauuauuuuauguuuuuauauuuguucauugucugacuucaaaugcuguagucucggccccucaccuaguucucggcuguuacuauuacaguaggcgcucaacaaauauuuauccagugguggagcgugaaggaauugacucgaaguggcugcgaaauaaauuaggacaaagccccccaucuucuuuuuaaauuaaagcuuucgggggaaaugacugauuagcucacuugccucuguuucucccugcagugaaauuauuagagagucugagcgaauaugagaucgcgucucccauccgagugaacccccucggggaacccuuucccacgaacgugcacuucaaaagaaggcggcgaagcauuaacucugccucugaccccuggccugccuucgccuccucuucgucuuccucuaccucuucccaggagcacuaccgccucucagccuucggccagcaguuucuauuuaaucucaccgcccauaccggauuuaucgcuccacuguucacugucacccuccuuggagagccagggguaaaccagaccaagcuguauuccgaggaggaaauggaacuuaggcacuguuucuacaaaggccaugucaauaccaaguccgagcacacugcggucaucagccugugcuccggaaugguaagugggcgcgugccccuucccuccuccccgccuccucgucugcuuuuuuaagacuuaauugcacccuagucugaaccuaccgagucuaugcucuggcguuaaauaucaacccuggcuuaguucucgggaauuggggguccaccagcauagugugugcucuuacacucgagaagagaagaguguacacaucugucccccagagggucguguaucauuuggagcugucuuagaucggauggauuggguuugcuguaagcagcccaacucugcagaguagguugcaugucgguuuacaaacucagagaaaguugcuggguugugguuucuuguagcaaacuuggccgcucuggggcugugcagcugagcgcagggcggacucaacuccucauuggcgcguccugagucaggguuguaaacugacaaucccuggacaccccuacuggagugcugggauaucucauguuguggacgcggcuauacuacaguguccccgcguucuuuccucucggagccuuuuaucacgugcaaggaauuuugaaacugaaccagauugacagggaagcggauccuguccggggaaaggaagggugggccaaauacucugagagccgagagugaaggcggagccugucucuaaggcgguguuuaggguuggaagguggcggcgggggagggguggugcacugcaguccgacucugcacccugcuggcguggugacuggaggcgcuagaguaaugggagagagccuggagagguagccuuaaaaagaacccuauucuagaaccuguggcuguuucaaaauauaggaauagaaauguauagcucauguuucucuaagaagguugggaggacggauaccacccagugcugucaaguaggcauuuaguacgagauccaaguugguaccuccaccucuucuuccugaccccuucauuacccuccauuacccuccauuggggcuaauaagguaucgguccccagcuccuacgacagucgagagucauguacaauucuggacccaacuagggugguccuucacuuucccaagcgacgugcguuucuaccacgcgcguaugacgcagaaacuuucccgcggcuggcucucccagcucacugcaccgcgccuuacgcacaauuggcuauuaaaagucugugccccuggcgcauuuacccucuccccuugacacacacacccuccuccuccucuuucuaaaugggggcuuggguacucacucgcaugcucggcugccacuuuugcuggcugguucuugcgucuuaaauuccaggucuggagguuauauccuucuucgaccuccaagagccugcucuuggaucccggcaggagcuccgcaaucccgaagacugggaggagggaaggugggguguggggaagggguugaaccccuuugcccaccagcuaagugcugggaauccuggcucccaaagagcuuccuugagauugauuggggguaggcggagaccgcgguuuagcaaggggaggggaugcugcguugagucaucgcggccucaaaccugggccuggacacaagaauggcuccagucuuugagagguaucaccuagguagaccuaggcugaagucuugaggcggaucccaaacaaucagugcaccccacuauuuaaaguuagggacccccaaguccuggaucuuagauacggcugcuuguguauuucguugguaaacagucuuuacuccuccucuuuccccgccuacacaccgguggaaucugaguagccccagcaguuguauaaauauuuuucugcguagguccuuaauuuccauuggugguuuuacaugguaacacagugcacguggucuucuugagaacggaaaaccggggcuccugaaaagacucucuggaguauacuauccccaauaacacggcauguaacuugcagcaugucucugagggggggggggucgcuaaggaaggggcuauauauauuuuuuaaauaagcgaaccagguuuuuaugucuuuagccacuaaucuagcucagagcuuccugccuucuuugucuccuggaauuauuuccucccaagacuccucuuuaucauuucuguagccucucuguauaaugauguuccucacuuugcccaggaaggccuccaggaaaucugcccucaacagagugauccgacucuguaugccccacacccacaccgccaacccaccccucccauuugcaguuuucugaaucccaucucacacauugcucgccucugcugagggaaugccugugccucaguuuuguuuuggguuuuuguuuuuuguuuguuuguuuuuuguucuucuuguucuuguucuuguucuuguucucguucuccuucuucuccuucuccuuccuuucuuuaggacaacgguaugagaaagaccuccaucuaccugcuucucucccaguuuauguuuucuuucucaaccccugccacacaccaguaucaggucaauaagcaggcuucaaagucucauugccacccuuuguucacguagcuuccacaccuccuuauauccuagugaacaauaucaaacacacagcugauaaucagagccuaacauuacauccucucacacauagccuaugcccaauuucaucuuaguucucucuucugaaauucuguauuucaaguaguuggcuuuauacuuucucuaaacucucuuaauuuccagugauacauacauauauauauauauauauauauauauauauauauauauauguauguauguauauccuuuccuccucuuccucuguguguguguacauuugcacgagaaucuaucucucccucucccauacuauaguuuagaggauacauagugugugugcguauguaauacauguauuuaaaaaaagauggucaccuaagucagcacaaaacaaguugggucucaaugauuauuucugaaccaacaacaaaacugauuuugucucuguauuguuaccauuuauugagcuuuugcuggaggcucugugauacaaugccccaguccucaaagcuaccuaucuugcuuaugagaauaucugggccuuccucucccaggccucaagaugcuaagugaccaaguuggaacuauacuccuuaagagaaugacuagauuuguuuuuccacacucugaaauaaaaucaggauucuggguccacgaaucagcacuaaccccaaccugcucugucccacugaaaagcaaaucacuuccugucugugccucccaggcuccuucuacugucccccauaggccucacaugcccugugcuuaugagauaccauacugacugcugacagagauaccuuggcgagcauaaaugugcuaaccugcugcuucucuggugaucugacaaugugucacagacuauacuaaaacugacuucugccugagucuauguucuggagucaugaggagaguuguguuaaaacgucagguucuagacaucacgccuagaaauucugagucuggaaauacagugugucacuuggaaucucaucagaaaaaaaagugcuuuucucucaggcugcucugauccuccuugcuuugggaaagcuuggcauuuugugugcauuuucuuggauuagacaccugggaggaaagugcauuaaaauucugguucuucagcuggccccagagauuuuggugcaguucagcagauagaggcacaggccagugaccuggcucucuagucgacucgggacgcuggugcacguacccacacuaguauucagggguggucuuuucucgcguccaggaaaugagagaaggcuucugguuauuuucagugugugaagaaacaacaguuuugugucuccucugacacuuggcacuuucaauguucauauaguauuaaaucacucgaguuugaggcauugugaaucauuugcaaaccuuguagauauucaaagaggggaccaggagaauggccuuuuacaagguguuccuucauagagcuugguaagagcaaauuggcccaagaccagugaguuacaacaaaacccacuggucaguucagaaccugagaaaguccucgaacuuggcugauggaauggcugguauaucccauugaacucucacagcugcccuuuaggaacgucaccuccaaauguccaguaaggaagcgguucaagaagguguggugcuggguacaaguagcggccugugacaacacugguuuacaggauaucucucugccuuaagggaacaggaacgguccucgugucagagcuacaggccucacuaccuuuaggucauuauggucuaccuguaccuagugaaggugaaggagaggguuuuuggcuugucucuuagcuaugcccugaugcuaacuuuccaggcagccugaacacuccacgggaucucuuuuagcugccuguggcauuaagagauuugaaauguaagcaccaagaaaaaccuagcuaugaaaagcaggugaggucagguugaguauuagcucagacuaugacagggaguggagaggagccaccugccucaggcuaccucagaagaguuucagcagaggaggagccaacaaacugcccugcuccucccuggaaucacucuuuggguuguuuuuguccuuucuguuggcugagucgugguaaauccaccucucuucucucuucacagaugggcacguuccgcucucacgauggagauuauuucauugaaccacugcagucuguggaugagcaagaggaugaagaggaacaaaacaaaccccacauuauuuauaggcacagcaccccucagagggaacccuccacaggaaagcaugccugugccaccucagguauuugccucuugguuaaauacagaugcggugcugacguggguucauugccaugcugcaaugaggcagcggcuuucuccauguuugcaggacaccacucuauacaauauggcuuaguccuucccccaguaagguaagguauagauggaaacuacugagagguuuagugacuuauucaagguugcacagcuaagaauuuaccaucaggauuccagcucaggaagcaaugacuccagcccaucugugggcaaagccaccaguucuuguugaugcgcagaacaaagcuggggucugaaccugugacuccagugagcaaucguguauguuuucuucaucgcuucuacucauuugguuucacuuuugguuucaugccauguuuuauaacuuaugcaagcuucacagggguuuucuuuauuuguuuuuuuuauguuaugauggagcucacaaaaccugcuguguguuuauugguuugacuaaugcccugugacuuucaggaaaucuaagaauggaucuggagcuucuuaguagguuucagucucacccuuacacucuaagucuagggcugaacuucauuuugggcagauugucacagauuugggggcuggucugcagguccaucauuaggaauguauuuuccugagcacuugaggaaaugggugcgugucuguggacuucagucugcgguguugcagcauuucuuaccgacuccuaggccuggcuguuuuucaccugcuuacagcuuaccacugaguagcauccuuaccgcugguuguucuuacguauuaaggcguuucuuacaaugguuuuuaaaaguccauugacuucuugcuuauggaagaaguuucuuuguuucuucauaagaacugccucaacacagugagcagcuauucaaaguuuucugguaucuccauacaagaccaagacaaccuuggagagucuugaaaugcuccgccaaggaauugucagcuucaucucugucuguagcaggauugcucagagugauguugccucguguccucauccccacuucaggcauuauuucuaaagugaauccuaaaagauaaggauagcugcugcucaucugaaaguagucagugggagaauuguaggucucugggcucauugcauccauguuguggucuuacugugacaggaaggugggguauaacugaaaucacuuuacuuagucucucuaaagggcagaagaagccauauggcacacaucuggagaggaucaugaguucaaggcuagccuggguuacuuugugacuuccaggaccaccuggucuauauacugagauguugucuaaaaacaaaagaggcaaaaagaaaagccaaaaguugauggucucagacacuugaguugugacaagccugccagcugccagcuaguuuaauaguuaagacaugccuuauuuuuauuuuuugacuaugguaagccagccuuauuuagauuucucaaaucuguauuagcaagcacauauuuaaacauguguuauaugugcuuauauaugcuauaaacauguuuauacauguuuaaucuauguuauuaacauguuuuacauguguuuauauauguuauaaaccuauuuuacacauaagauagaaggaauauacaugauuuuucuccuucugucuaauuaauguguuaaaaagacauggacaugauacuuguguuuaaugcccugaacagugguccaugugcuaauguucuuuucccuaacauggcuggagaauagcuuuugaaaagguagcuaggacauccuugcccuuuucuggauagucacuguacaaagcacaggaccuguacucuuccccugcacuucugcuauagacucagcaaggcaagacgcgcgcacucucuucugccuccuauccgggaaggaaacugaugcucacauggaggaaguagccugcccaagaccucacugacaguccagaguccagcccugcaaggauuugccuccucucacacccauuuuaacucugcagaagcgcgugugggacagugaagcaggagagacaaagucuuaacaguaucauucaagaaaauuggcaaguuuuuguucgguuuuguuuuaauggauuacaugacacaaguuaauagacuuuugauuucuucugggcuaaaggacacauuuucaggucguguuuaaaaagagagagaagaaagaaaaaacuuaacuguaggaaauuaaaggugaucaauagaaaauggcucagcgguccagaaaugcucacuuaggcucuaguuguugaguuauuggugucagaagaugcagccuuccaaaucaccaagaccgaguguuuguuuacuuucugguauuaauuugccagugacugaucugcugaacacuuccuucacccuaugugauaaaucagaaggcugguacuuugggguucuuuguuuuaagacaggggcuucugcauagcccuggauaacuuggaauucacuuauguagaucaggccagccuugaacucacagagauccaccuaucucucuaccugcagaacgcugugauuaaggguaugugucaacacccccuagagagccuggcaguuuugauuggcucugccaaagguuuucuguuggauuuugccauuuuuugucccaguugcuucuguaucucuuugaauuuagaugcaggagcaucaggacaguugaaaaaagcaaacuuugaaauguggcacaauucaccagcacccuuagcggcacugacagguggccuucgccuagaaagugaacauaguaugcuagugggaagcaauagcucuuggaagagaagaaaggagaugccuaguaaugucuguccacucagcuacauugauuucuccuuccaguccugagcagggauuggucaccuccccucuggggaauacgaaugcagauucccuuaaaacagagaaaccaauccaugucuuucaggcaaaugggauggagucauauugacaguuucacuaauauccaggcaacugggauauucaaguaaaucugaguguuacugcuagagcugaauagaaggcaugugucacucucugacacguguaguuuguaccuucaguacuucauuuucucaugccaauucguucuggucuuuucugguagggcaguagacuauuugaacuggaaucuucaguaggaaagucuaguucaauacucuaguuguauauggaagaggaaaucagagugugggguguaaacuuaggugccaauuuuaaggagugauaacgcugcacauccaauaccugauggaacuuuuucuugcccaagucugggaguggccucuggaagccauagacagagccaggcaucacucuuuagcugcgggauuaugggauucucagcagggcaggcuacucugccucuuguccugcugcacacagauaggauguaagccuugcucauuucugauucucgauguuggucucauucucagaacagagucugagauaguguauuaaagaugugugaaggagucuaaugugcugggaccauggacuuacaagggaagguauagccuuguaugcauuuauuuauugagccaucaaguacuuauugaauaacucuucuagguccugaugagaaaacuagaaaccaucgauuucacaugaccugaaucauauuauagaacaccaaauaaaaaagaaauaacaugaauuugcugaguuguguucagacugagcaugaaauaaugaagggcccaagacaggguuuagcagagaguacauauccacaggaagaaagaugagaaagaaaaaagaggaaaagaaaaaagaagaaaggucgugaaaauagggaagguaacauuguggucagggaaggggagcuggaaacaccaagcuccgauguaaucaccuguaguuuuucuguaagcacauugcuaauggguuauggaacuugcccaaagcuguuauacccaccaguggugagacugaaagcacguccugucucuuauugccucuucauccaguguaguaucuuguugcuggaaagcucuuggccuagugucugcccuuucugacuccuccauugaauguagacucuguucggauguaucgacauguuuugucuuuucauucuguuugugaauucacugagauucacaauggagaguagggugucaucuuccggugccaugucuuugagagagcagagacagguucaccgaucucuccauccaccugcuuuucagggaccccaguggcaggcuggaggagcccucagaagggcuauugcuauuuccauugcuugcuuccagguaaaaacacaaguccuauuucucugccucucucuuugucuguuuaugaguauguuuggggugugugcaguugugugcaaguguaugagaagguuagaguuugacaucaggugcuuucuuccacggcucuccuuaugacaugggaucucucaguaaaccuggagcugguucacuuggcuagacuggcugacaagaagcccccagaauccugcaucucugucuucccagugauggaauuacaagcuggcacacggagcagacuuccuaucauggguucaggaacagaacucagcuaacauuuugccaauuccccauucccaaguucuguuccugucugacccggaaccuuucacaggaggauuagcucucaucaaugagcuaaucaaucagacuugccaggugagaggguagaugagugacauagagaggcuauuugacugaaccuacaagauacacuuuucuguuacuaaaguuucuccuuuagccuccauugcaucaaggucagccucccccaccaccuuuagaacauuuaguguuaggugcuucauggcucaucagugccacaccuaaagaagcaguuggacaauagggugacagcauuucugaacuguuucaaugcugcuuauuguaggaaagaacuagaaacaaguaccccugggaggaaaacagaugaguacaauacuguacuaacacaagaaggauucccgcgcaaccauugcaaaugaggauauagauuuaaccuccugggaaguacaugggcaaagaaacagaugaugaccuagaugcacaaaaaaagucccagcuuuuaagaaggacaaaguuuaucugugcuuauguuuuuuaugcuauauccuggggcacaggacaaugggccauauuaauaguaguuuaccaauaacuguauauuuauaauuaacauaauuuuauaauaauauaauuauaacgguauguguaaguaaaacaaaucuuuagcagaugcacaaauguaugggaagugauuauuucuucuuuuaaagaacauagauaaccuuugcuuuuuaaguuuacacuuuuuuguuuuguuuauucuuuugcuauuacucuauaguacuuuccacagaauuuagcaagcguguccaaccuauagucuacuggccacgugaacuucaggguacauuguccaaaacaaaaagcuuauauaaaacauaaagacuggggaucaacgcagugcaggccaucauaugggguucucguaagcauagagaucguuuuugccgcauauuaucauaucaauacacucaucaccaucauaggaaguuauaucauccuuauucaacagcuaagguaaaaacacagcucagaggaguugagcagcuuaccauugucacacugaugguaggaagugggcguacagcuccacccucaacaaacaaguuuaguuuguucuguacaaagggccagacuucacugaaaacacacauaaaagcugccuucuagaaaauucuuuuuuguccccacuuugaugagauacguuguuccuacauagucuagcuucaccuugagcuucugguccuccuuccucagccucacauggcugagauugcagaugggugccaucaugcccgaguggcaaauccuuucugauugaauugucagagcauugggauuuuuuugguuugcaucuaauguccaauuuucaagcaaauuuccuaugacuuguguugagcaugcauccucuaugguucuaagacuuuauauagauuauacgagguuuuccuugucuuauauuuuugauugcuauauguuaauuauauauaguagcaauugguauagcguguaauacaacgauacccaucucccccuuacccucuguugccccucccucuuccacuggucccuuuccuuuccccagccucugccugcaugcccccaacuccguuuuguagugacccagugaguuuuauuaguguugcuuacagaggguaagugaaugguggcuuacaggggaaugaauaccuuaucaguggguccuccauugaaguaaauauuucucccucagcucuaccaaccauuaaccgaggaccaacccccaggugggggugggaccuagggagcuacgccucuggauuauguauuuuaauaauucaaacaccuuccguuuguuagugagaaaacugaaacacaggaguucauaaagaagagcaauccaaggucacaauaacucauaaguauagcauuuucccccaagcuuuagaucuggucuaguuaggagacuuuucugggccugguccuuugcggauucaauggcauucauaggaauuacaguuccuggacagauugucaacuggccugccuggagucugguuugauuaugaggaguuccacgcuccgacuucucaccaagacuguaaugacacccagugacuuugcaacucuaccaugccccuuguuggagugucugcuugugcuuguuacagauuaacuucugggaucccuguaauaauuuagcaucaaucuacugaugacacuagcauccccauagcagugaaaggugauguucaagaaucccucaggggacuuuccaugagaaaccccaaggcagcuggccagugccugguuaauggugguccauggugggcuagucagucucuugggcugaagccaacccgacucuccuuuaguacacauuuccugcagccccucuagucucuccccgugugaaauaagaacaggcaacuuccaaugcagaggcacccucggaucauuguguagaacucagcauaauucccaggguggggacuuugaauguaggaauaaaugauugaugaaugaggacuuaggauguaggaaugaaugauugagugugaggacuuacuuaggauguaggaaugaaugaugccuucuuuuguuuguucucacgguaucacuaucucaccuaggcuggacuccagcuuggcgcuucacucuuagcuuccaaagugcuaagauuauaggugugccccaacacaucugacaccaucuucuuguuguuuguuuguuuguuuuaaaagaccagcacauuauauuaugaacauauucaaguguacauaaaauagaggugauagcaaaaugaacacaccaucuauauuuaauagugaccaaggauuucccaccuacuuccuguugguuugcucuuuccugggauguuuuaaagugaacugaagacucaugacuuucuaucucuaauuaucugucuggacaacuaagggaaauauucuaaguagcugaaauacauuuccugugguaagcagaaucaguacugauucccccacagcacgugaauagcaccuacauuaagccguuccuccuuguuucccaauuccuuucugucugguuagacugggaucuccacaaagucugugcacugaguggggugguugcaucuuccaaagcacucguguuguuauuguugcugauguuaaaauugccaugucguuuuagauuugcucagccuggccaaguucguuugucucuuugucuguuuauuuuuugucuacuuguucuagucucugcuucauccuggucaauuugcugcuacaauaauuugaagacagaacuagcccucaaccauagagcagguaucacacagagcuucugauaguuuuggagugauuuggugaagcacaaaaggcagugugguugggcauuuuuguuauugcuguuguuguuguuguuguuguugguggugguggugguggugguggugguguguguguguguguguguguguguuuugcagguauauauguguauguguucaccuauguggcugccuguguucaugugugcucuuguguaggcaacccagagguuugugcaggugucuuccucaaucacucuccacuuaauuuauaaaggcaggauugcuuagcucaccaacucuguucaucuaauuuaacuuuaaagcuuguccuggggaucucuaccucccaaaaugcuggaauuacagagaugccuucauguccauccggcaucuacauggguacugggggucugaacuauaucuucacauuugcacgguaagacuuuuaccuacagagccaucucccuagcauugggcugggcuuuuuguuguuguuauuguuuugcuuugcuuuguuuuagagugguguguguguguguguguguguguguguguguguguguguguguguaugcuuugcuuauuuugcugucucuuggaguuuuccuccugauagaaacaguccacauucacagcacuucuucccacugucuucuaugcugcucagguggccccucaccugggauuucccagaacuagcuugaagauggaaauauaaaguggcaagauagacuuggaccggaggaggugucuuuucucgcagaugugagaaggacucuccucuucuaugccuuacuuagagcauuuugaguuucugaacccagagagagcugggaggugcaauucucuuacugccaccagggucagguauuuccuguauccuguccaucaggaucuugggaguuccugcuguaaaucacuuucugcugcuaagggccugguaauacagcugcuuucuaauguguccgugcucccagaagccacugggagucggcguggaugcauaucuuucuguaaaaggacccugagaauugucagagggcuucugcuggugggagcaggagcuccugggaguuaccaugaggauccuucccucagcccuuauccagggugggcuguuuccaaaggaagaccuuggagugucucuuggguuucauuauuugaggugauuagacaagcggcuuaaugaaagacuauuuauccaaccaaggagauuuaaauuccauaacuuaguauccuccaaguuuugguucuuuaagauaaucagaccauugccgaguugauauuguagucauucugggugaaccauuuccaggcaaauuuucccuugucucuuuuuaugauguuugagccagaugucugugugagugcucuguuugagugcaaauccuuaauacauagaaaguaccacagagagggaggcaagggagaugcugagucaggugcguaguggggcugguggauuucaggagagaacagacccaagugaaagcugaguuggggugugucuuccuuuuucacccauuaccuauucucugugauauuaaaagagaacggugaaaaauacagcuugugucuggagaagguucaaccugauuucaacacaggcuuagcaugccuuucuguucugacucuaaaagaccuuuuuauuuuccucuuguguucccagugucagugcuucuguuucauuuuaagguaaaacguaccugcuggaagagucaucuucucagcauacaggcgugugaguuugggcaacuacuaugauaacauaauauuaggcucucuucccaguaauucucuagaaacaggaucagcaagugcauugcauuugagaaucagccacucugcugccuuuacuggccaucuacccagacagucauucuuuuaacuauggaacaccauuccauucaauggauguaacgcuccuccauuauacaauuggugaacacuggguuuggguuuuugucuguugugaauaaagccauucuaaauacuuggaugcagaucucuguaugaauaugguuuucacuucauuucaguuguaugaaugccuuagagaggcuggcuuauaugaucaauguguauguaauguguaagaaacuaccaauuuacuaagcucugugucauuuugcaguagggugugaaaguuuguuuucuggguccuuaacaaggacuugccauuuuguguauuuuuacuuuuauuuuuuggcuaaucuaguaggcuggagcagagucuuucuguaguuguaauuugcauccucucaugacuccugauacugagcaucugugcuugggguuguuugacauuuguguaucuuuggugaaauaacuauuuuguccauuuguuaaaaaacaggaaugcuuuuuccccccucaccauuaaagguuaagagcucgcucuacauucuggauaugggacccuuaucagacacagccucugugaauguugucuccugggcugaggcuugucucuuccgaaagucccgucauuugcagacacaugcuucacagacagcuucucccuuccucugacagcguucagugcacuugcuucgggguccaccuuuccaugaaccuccauggcagccaaaggcaggggcuugucaggaacagguggaggggaauggaacaggagaggcguauuuaggguuuguuaguggaaagcaguuuccacuauggaaugggugugcuggugacuuuauuucugguuggcauccagcagcacgguuucaguguucauccacugcgcugugugcuaggaaugugggugacaucagcugcacacccgaggaugcuguucuguaccuuugaacaggugugcacauaggaagaucaaaggagccagggaagcaaggagacggaccugugcagaggacuuggcaguggaagugagccccacccaaggacugggcuguuuggggaggaggaaaaacaaacaugucacuccaucagaaagcuccugcucugggcucugcagauucuuccuauguacacugcuuucucucauucaagcucauccucacaucugaugucguauuagacacaaauggaagugauuuuuuuaaaacuaucauauguguuaaaaggucaaaaacaaaaacaaaauaaaacaucacuguaccuucuucaguauaauuugacauuagcuaaacaucaucucuuucauguuggucucuucuuugcaauuauuccauccuacccugcugaugguugguuuccuccacaucuucucugugggucuaguuuucauuacuauaaaaaaauggcuacguguggauagcauguacaggaaauagguuauaauuugggaagccacuaguuaggccuguggugagggaccaauagaaacugucaucacgacagaagagaaaguggcagacagagaucagaucacuagacuagaagcuguaggguaauuuggggcuuaaaaucacucuugugagaacuggcuuaggucuuacaaaaaaaaaaucggaauuccuguugaguggccuaagaaucuugaagauccgaccaccucacagucaaacuagacaagucucugacacaaggugucaaacuacguuuaacucauaauacagucucugauugacuguagccaagaaagacccuuggauuuuacugacuuuaaagcuaaggacuucauuuaccucuguccacuuuuaucuaauacaaagacguguguuccacuucucauuucuguacugagcagaucaaggccaggauaccauaggcaagaugaugucagcuuuagaugcucaagauaggccucauuuucaggccugugcccuuucugggaugcagcacaaggaaaagcugccucuggguagugcccagaaagggaacguuuaaagucaugaaccaacugaaguuugaauguaagugugaggauaauuaaaaauaaacuugugagauuguucaagaagcugcuucaaacccacagaggaacuuuuuuccacccuuuaauucauuuaagagauuaaauuguccaagcaagagcugaauauauaugaaauauaacucaagaauaacaacauagggucuggguguuggggggauggguuggucagugagugcucgccacacaagugugccuacaugagcuccaaucugcagcacucacccuaaaaagccagacucaguagccuguaucuguaaccccagaauagggagauggggacaauuugguggguuccaaauucagugggaaacaagauugaagaugaccucuuaaugauaguauucaagaagagggauguugcccucugcucucaacacauacacaaacauauguauaugugcagcuguaugcacaaaugaaugcacacaaacacacauaauacacacacacacacacacacacaaagga

SEQ ID NO: 3245 - RNA, 1060 nt, Mus musculus
gauggcagccaccacaggcucuggaggaaaagucccucgaaauuuccgacuguuggaagagcuggaagaaggccagaaaggaguaggcggcggcacaguuagcugggucuggaggaggaugaggacaugacacacuuacaagauggacaggcaugauaauugggccuccacgaacaauauaugaaaaccgaauacacagccuuaaacuagaaugcgggccuaagcacccagaagcacccccgucuguaugauuugcaacaagagucaauaugagcugugugagcaguucgaauggagugguggauccaagagccauggcagugcuggcaaaguggcagaacucgcacaguaucaaagucauccugcaagaacuguggugccagauaaugucaaaagagaacaugaagcugccacagccaccagaaggacaguguuacagcaauuagucacccggccuccucuccccauccaacucaagucuucauuuuccacaguagugaauuuucuagauacaucuguagaccucaaaguccuggagaggaagcuccacucagacuucauccugaggcacuguucugauacuaacuucucguccauuugaaauaccuaaguugugcuguguaacaucaucugucgaguguaaccgcugucugccugguugaacuucugggaucaagaagguguugaagucgguuuccugugggagugguggacacagcuaacacaacugugaacagacaucaucugucacacaaucaccugcaucuggcccuuggccugugucugcuuugcccgcccugcccuccgccacagcugugugguggcccuuagaauagaugggaaggcuucagguagcaguugugggauugacuacugcugggcuuggggcgcuuuggcugcaccccugcuucuuaagucuuaagugaugccccauccaagccaugguccccacuccuccacucccaccuuuggccaaaucuuagauuguaacccuccccucccucugaaauuggcugcgggugaggaauucagggcuucccgucuucccaccuuuaucaac

SEQ ID NO: 3246 - RNA, 104362 nt, Mus musculus
cccggaaguaguugcuccauaucccgccccaacauggcggcgcccagcucuuuaagucagcaccugcuuuugcccagcuugugauuuuuaaccuuggcggcguugggagaccauggacgcgccgggcuucacggccucgcugguggugaguaccggguaggggugggcugcugggugcaggcugcgugggagcuguggcggcuucucugcacugccgcuuucuuccggguuuaagcaguggucggucuguccucaggucacuggcugcuagaucuaggaccaagccuagagacgucugggaagucuguucucaaggcuugguggcuucugaugggcuuuuagagaugagguaugcuugacacauugucuuauuuacugaaggcuucaguaaauuaagacuucccuuguacaccauauucaccugaacuugggaauuaaacaugcaaauacacacuauucaggaaaacacuuacgacccauccauccaagauacuagcuugucuuuuugaaguuucuacacauuuaguuccuaguaaucugcucauuuuucuccacguuuaggcuuugaagaaauacugagcauaaguagugguguuguggagucgaugguuuauuggcuaauucugucgauuuaugagaaccagugcuuuuugaggggccuauaacagcaggucuagcaggagauaauagauuuagcagauguaagagagacugguuaacuuugauuuuauucuggaagagugaacagaagcagacaagaaauaccuucauuuuuaaaaugcuccugcuaagggcaaauagaagcccaggggcauuuguuuacagaacuagcuacugcucugauggaaggguuggagauagaguguugaacaagagaaaccugcccauaagaguuagauguaggagacaguacagaagugacugcucggguaagugacagguggacuagguucaggacauuaugggaagaggugauaacagguuaugggccaggcauccuaaauauaugagauucauuuguguuuggggagauggcucaguaguuauagcaucuguaguucaguucccagaacccugggaaauguugggugggucugguggcccauguguaauuccggugcucagaagguggagacaagggaucccuggagcaagcuggugagcuagacuaaccuuuagugaucucuagauccuuugcuucagugaagaaagaggagagacaaugagaaagacuucugacucaagguugggcugcacacacacacacacacacacacacacacacacacacacacauaugugcacgagcacaagcacauagcacaucgcacccaggcucauuucauuguauuuaauuuucauuuacuguuauuuacuucuccaaagcucugaaagcacaggugcucuuucccccauuuuguacaugaagaaauagaaaugaaaucguuuucuaagaagauccaaggcucucccaagaagugagcucaugccagcuagcucugucugauaacagaccugugcucugaggccauaauuuaaccugagagaauuucugaaggaauggaagaauacucaagcccaauucgacagccaccuuuucauucuuaagagcagccucguugaacagauugaauccuacagcccuccuguuaggaggcgaugaugaauuggcuuuuagagaagugucccaggguauaaguaccacugugauugggggaacgaacgccuagaaauguuaucaucuuaugguugauugggaaacccugcagugucagagaugcuggguuaguuguuagacaaguugaaggugacugaccugacuuguacuccgaagacucuugcauuaccacacaugauugguaguauaaaggaauauauaaauauaguuaugagaggaauagaggagguagccuuuuauucuuaacuggaagguuggggauagcucuaugaggaauagcauuugguugcugucaaaccagcagaugggauuuuuggcagggauaugugugucugugggguuuaaaggggggagaauuaggugguaagaaggccauuccagauuucgagaaaaaccuaagcuaaagcagagaaggagaaaguucuggacauguuugggaaccauaguaguucaucauaguuggagugaauggcgcuccacguuuugugcaaguguacagguugccaauggagaggagaagcaagggccgaugagggcacgcucucaguuauucuuuaccuagugccugucagcugcagccaguggauugaagaaguuuugaaggacuaggcauauucauguugaauggcuuugacuuaugcugcaguguuccuuauaaaccaagcaauaaaaagcaguaauaauacuccuacuuaucacaaagcccauuccagggagguauuuaaccucuagccaccuguguguaugugucuagacuuggguucacccauaguugcguguagucagaggugggaguguacaguauguauuauaucacuuacuugauaaauuuaagagcauaauguaugucucucugcagggagaggcacagauugacuuuggggggugguacuggugcuugcauucagagccucaugcaugccguucagguccuagguaguugauugguugugcacagcuuucgaguuuucugccccccaccccaucuugucuuguuuugaauuuacacuuuuucagcacaagucacccuaaaucuugaacuuggucaguugccugauaaccuuuuuagcaaaugaucaaacuuaaagaacaaaugaaucugauagugccucuuacaaucuagcuggugaugacuugugucugcacagaguacuugugaaauuguaugcauucccuaaagguuuugcuuaaguguuaaauauauuacguggcugagcagaugcuccgagagucucuguuugucaugcucauaaaguuaugagacaucuuaguaaaugacaucucaauuauagaagcgugaaguccacacacagaauaacuugugauugccguuuuacuaggccaaaucucuggucauuuuaucaucagaagauaagagcuaugaugaaaaagguuuagagaauugaugccugcacagcagcccuacauuuagagaagaauucauugauuaaaguuuagcaccagauagcuagcauuucucugaacugugggagauuaaagagaaaaccacagugcagcuuguuuuuaaagaaucggugcagaucacaguucucaucagauuuuuguucuguguucugaggaaaggaaggcagcauguuuacuugcugaacggcauuaaaauccuuuaaaagagugacaaggaugccagaugguggcucuguuccgacaucccuuugagccucuucuaggaugcauaaagccaacccugucuccacaaagagccgugcauccugucucuuucucuuccuucuuccuuuguggcuccagcucccaugaccuccucgaccccaugggccuggguuacauagagcagguacaugccaccacaaccgaccuggucauuuuguggcauuugcagcccuuuccugacugacacaucuuggagcucucuggugacaucauuuuaggucauagucuuuaaaguuucaugucuuuccggcugaucauguaguguuaguacaucugccaaugcacuuugacuuuuacuacuucacguguauuauuuaauuuaaacauaaagaaggaguaaaagaaaggcauugcucuguuccucgccagagcuuuguuuuuccaguuaacccuuggagugguucugugcugccaggcaaguagaguaaguuccucacacuaagcuuugcacagacugggaauuguguaagcucgaaggaaggagagauggaauuugaacuuugcuccuaagugugaauaguacccauucuucucccuccccaccucccuuccuuucuuugccaaggacguguacuuuuuaguuguaaacaucuguauuuuaaagagauguauguucguauguaucaauauuaaaaagauaaaaacuaccaagcacguacaaguuacuagguaggacugagauuguguggucugcccgucugcccaccugugaguggugccuucuuuggcacuguguuuguguguauauuuuucaaaacuucacacuccuuuuacuaaaguuuaauuaguauuaaaauauucugccuguaugucaccauagucacgagguacaguuuuuaauguucugcuuuuuaaagaaacuugggaaugagcaccaguuccuuuagaaaacauuuagucacuuaauaaaaguuaucuggaugagcagauauaauaaacauagaaaauaauacaugaauccuuagauaugugcuucuuaauagagaucuagauggaaaaggauuauuagcugucugaaaucuaagucucaagagaagccguuauugcagauuuaguacucagcaguucaaaagacaagauagagcauuuggucugaugaggccauagguuaaauuguugagggaaauaaaagugcuauuggacagccuauauauuguaugccaucuaucuauuucuguacauaauuuugaaaugaauucuuacuguguaguugaggcugguccugaauuccagguccccugacuuacccucuucagugcugagauuacaaauauaugcuggaauaucucuuucacuuuuuauuuacuuucacuuuuuauuaggauuaaaagaccuaagauaaaauuauauuacuucccaccuuuguccucucuucccuucccaugucccuuccugcccauaccccucccccaucaaaaugauggccucuuuugacuauuauuguuccauacacaugcuuaaauauauaaacacaaccugccgaaucccuuuguggcuguguguguaugauuucagggcugaccgcuuuguauucaauagccaguugugggacucaucccugggagagcuaaguauccucccucaguagucauuaguugccaagaguuuuuucccuguggguggggccccuuuagaaauuucccucuguguuaucaugucuguugauguuauuguucaggucuuauuuaggcagcccuauuguugagguaucauggauguagcuucccugucauuucuaggagacacaaucucaccgcagacuuccuaguccucuggcucuuacauucucucugccuccuccuccacaauguucccugagccugaggugcuggaguccuguuguagauguaucagcuggggccaagcuucccacaacacauugauuucugcauaugaccuguuguugguuagguuucuaguaccagggaugauguucuuccuguugaguggugucuuaaguccaacuagaugggagcugguuaccaccaagacacacacgagugccaguccugcaccuuuagggcuagcuugcucugguagucacuguuaaaauucagugcugccacagcuggguaggacuauugauggcuuccuuuucucagcagcuugcuuaguauuuucugauucuaaggguugggaagaauagauggaugguagggggcuugcagguuauguccaguucagaucuucagaguccugugugggaaguguguggcgucuuuagcaauagaagacuucgcccucugagaggcaaccaaggaagggaaagagccauggccuauauuguuuugggagucacuugucuacucugaccaauaacucaugccuacacguguggagagcguugccagcugaagaggcauaccuucauuuaacacacacacacacacacacacacacacacacacacacacacacacacauuuucacaauucuuauauguacuguguaugauuuuagguaaauauauacuagugugauuccauggugcuuuaucaaauguuguuggugucauuuucccuucucucccccuucuacuuuauauugacucccccuccuccauaaaacagagccucccuuccugcuuuucccauuucccucuuugugucacuggaauccaguucuccuuucucuagcccccuuccauggucccuuuuugcuuuccugguuucucacauuacuccagguuaugcacuuacugacgauuuugagguagaagugcaacugagcgaacauguggcaugugucuuucugaguuugggacaccuuacucauucucauguuuccugguuccauccauuuaccugagauuuuaauuaauuaauuaauuaauuaauuaauaauuuaucuauuaaacggcugaauaguauuccauuguguauauauguccaucacacuugaaagguggaggaagaagguucaggagcucagggucaucuuggauguauaacaaguucaagucuaauuuggucuccuguagagagaggaagggagggagccgugaagcucacuggucagugagcacagcugaguuccaaagcuucaggguuagugagauccuacucaaaaccaaagguggaaagcaaucaaggaaaaaugccugaugucucccucuggucuccacccaugcacaggaacaguacagauaccacauaaaacaaaaaaccuaacuaagucagaaaagaggacccaugcuugcuugacuaugccuagggaaccuuggaaagacgagaagaaacucauaaaagaacugcuugaaucuuuaggaugcuuuguacuuuuuaacuuuuucuuuuuuuuaaaauggcuuuaaacagugguugaauuauaagaacaaauuaagagugagcuuuaauuuuguuuaaaaaauuaauucauuaaaauucaucuaaaagguaaaaaaaaaccuguacaaguugcaaauuaguacaccugauaagcaucuuauuuucuuauaaaaugcaaguccuuugaguauugcaacaaaaaucauggacuggaagaugugagauguuuguuuaaagacuuccucaucgcuggggacacagcucaaugguggaauacuugcuagcaugggcagauggccacagcucugauccagcgugggaaaaaagaagauuccuuuaguauugauuucaguucccaauuugaaggauuuggagacuaggguaugagucaugcuuuuagggucacaugucaaauaaaugguagcuuucuuaguggaaccuagguucucuaacauggaauaagaagaauggaagugauuaauauuuggccuguggcuugaggcugagagcucaccuuucucuucucucuuccccaccuuuugcacaggcuggagggguagcaggcgucucuguggacuugauauuauuuccucuggacaccauuaagacaaggcugcagaguccccagggauuuaacaaggcugguggauuucgugggauauaugcuggggucccuucugcagcuguuggauccuuuccuaacgguaaggguguugauauucccagugcucagaagccaagguaauguuuucagaauaauaugaguauuuuaacacgcaaaauucauuaagccuuacagcugguuuucugaauuuaauuuuuuguucuuugauuauauuuaaacagaauguagagugcuguagaauccauuccaggacucaggauguuuauaccaaaaccaaacaagcaaacagcaacauaaaagauaaucuuuuaaaauugauuuugcuguuacagcccccaguuagaauuuuuaaacugucaccuuuucagcaugguuccuuagugcaguggcucucagccuuguggcacuggaauucuccggcagcuuuauaaaggcguguggcaagcaucccgggggacccagugugaagcuggcuggugaucccugcuuuggguugagagcgggugagacccagaggccuugcucauuuuacaucuuaaaugaggcacgugcuuugcugcuuuguccuggaugcccuguagccacuaccuguuguuugggcuuugaagucaucuccugacuuuaagugcucucauuugauaauuagggugauuuauuuuuauuuaauuugcuuuggaguauaucuauuuucaguuacuuaccugauuuuaauuguucgccagugggugcuuuguuuuuccuuuggauugaauccaggaccuugcacauguagagcaggcaguguucucuugagcagugcccaccucucaucucccagucucugacggucacuucuaaugcucaaacguaaacuaagccaacuagcaaaaauguuaaccuagcacgcauccaaagaaucauggcucuagcucugugaacgcugggguuuacugucucuguuuccagauaaggaaugaguauguuaaccuccugcauaagucccuaugcuuugagcauagccuucacauaaagaaagauuuguagugcaaagagaaaauggucuuccagccucuugcugucaggucacuuucuuccccagccccuaggagucacccuugggguuaccccgacucucugucuguccuaauucuuugaauauuagcuaaugagcuguuguuggacccuggcucuauauaaugcaccuuucuaaguaugggcaaaaggauaggguuauccuaaauagaaugacccagucaacaaggagcuuagugccagugaugcccguggcccaccugcagagacuguggcuauuagucuuagcuuuguccaggacacugaugcuuuaagaagaaccucaaggugauccuccucuguagacaaguuggaggaccuaucagcaggagcugcagaggugucugcucugugcucauagcuuuucauagucaccaguucuuguggcuuuugugguuucucucucucucucucucucucucucucucucucucucucucguauugccacaaggauucaggcaggugugaccucacuggugguguaugugggacaugugcuguuguuaugcucauaggacuguuuuaccuucuccagggcauuuacaugcagaauaugguuuuugaauuuaacacacacacacucacuccagcacgcacacauauguuugugugucugucugucucugggacgguuauguucaaauucuugccuuuuauauuguaaauuucaggagaagucgaagcacagucguuuugaaauggaguuuccuauaaauuuugcugagucacacuuuccucucugucuagucugagugcagagcccacugugucuguugauggcuauggguauuuuugagaacaaagucagcacagaugaagaacuuagagggagagggggaaccuuugacaaagaccaguuccuuuuuugaaaagagcauaauagaagaagcaccagccugggguuuugcucgugucgggugggucuuggccagcccaccuccucuucucugcuuugcucugaacuucucucagagcuguacugugcugucauuuccaacuaguaaagccuuuuuggauguaccuguuuggcaggggccagaauuuacauuucuacaucauaaaaguagcuauaaaugacaagcuuggggcuguugcugauggaauccuggagccuuuagccuccuccuuuguccuggggugggguggggcuuagggagugugugcaucugcaggacacacagcugagugcaguagagaccuaauagcuggaccuguagugaaagggcccuagugcgggaaccagugugaggaacuugaagacuggcuacuuacaguauuuguauuuguaauuacucaugugagcagcugguggcccuuacauacugggugacuuuggggaaugguuuucacugcugguuguuuuccuggguguuuaguucucucauguccuucagaagaggaauuuguugucucuuuauccucugugccuuaucucuuauggaagagguaaaaaaaaaaucuuuugauugauaguauacagaaaguuuuaaagccucaugugcaguucugguaacuuuagagcaauaaaggcaguuuucuauugaucccuuugcccaaaauagggucucacuauguaaccuuggcuagacuggaacuagcuauguagacccgacuggcuucaacuggcuucaaacucccagagaucagccugccccugccuccagugugcugggugugugugcugccaagccuggcacugacuuccauuuugaaugauauaguugauguuuguaaagaucaaggagugaaaaguagcgugguuauuuugcaucaacauuguagagcugacauuuaacuuaaguuaugugucuuaaccugcuuauaacucagugaggcugcuuguuuuaggacuauaaugauacucugagucugugaagcccacaguucauucgcagaaguuugcuaggaaauuuuaagucccucaucagugaagugugguggugccaggcucccgguuaagugcacuugggacagggucaggaacuacggaaaaggcgugugcuugccaauucuuaucucauaauuuaacgaugauggcccagcuuuugagagacaucccuuaggaggugagauauguaguuauucuuaugaagacuuuugcguuucagcugcugcauuuuuucucaccuaugaauaugugaaaucuuugcugcacacggacucuacuucacacuucaaacccgugaagcacaugcuggcugccucuacaggagaaguggugagcaauuggcuacauguauacagcaucucagaaauauaaauuaugccuguguaaauuauguuggucaguacagauaauuguuucauuuuuaaauuuuaaauuucuuuuagcugauagguagcuaauagauaaaaaucuaaaaauuguauauguaccuuuuaaagcaaugcuuuaaaacauauauauuuuguaauguuauuuauguuauuuuggugcugugguucaaguucagagcuuuuuacaugcuagacaaaaucguuaucacuguaucauauucuacuguguaaugcuuaaaucauaauauacauauuuaucuccucaaaauguauuauuuauuaugaauuuuauuuaauuaaacacaucaaacccccuuugagucaggguuugacuuuguaccuauuuggccuugaaauugugauccuucugccucagcuuucugaauacaaaaauugaagguauguuaaagccacaccaggcuuuaccaguucuuuuuauguggaugcugcauuuaguugugugugcuguguauacacacgugugccugugguccugugcccgguaugcagcaccaggagaggaugauguuagucuccugagcuaucacucccugucuuagucccuugagacagggucucccacugaaccuggagcuaggcaagccuugccugccauccagccccagccauccuccugucugcaucccgagcagugcugggcucacagugcuugccucucauccagcuuuugauguugacgcuagauccucaugcuggagcugucucccuagccucuacccguucuuguuuuguuuugcuuuuuguuuuuuguuuuuuuaaauaugaaagugguaaaaucucaauaaacaugaauugauuaaacaugaccguuaaaggauagccucaggauguuagaaaagucuguugugcacuauuggaugaggcagcccuaaagcgucuuuauacagcuagagcuaaagagauagaagaaggcauucguauaaguuugguugggguuguuuguguuaguguagcugaguuggaacaaauuuuccuagaauggcuuccacagcacaguuuuaaguagucacaaaaaauuuaaggcacagagaaguagcaguugugguuaugaacaggaguuggguacaggagcaggcacuguggcagacaccgcucugucacugucccuguuggccuacuaugucgaccuccggcccauagcuucuccgcuccccucuuuuuccuucagugucucuagauucugagucaaguauguguagcucuguggugagggcucuagaucgaguguguguucuuugacuugguaucauguuaagaaaccguuaccuaaugugaggucaaaauagacuuuuauuuucuuaaauacauauuuuauagucuuaacucuaauacuugggucuuugcugcauugugaguugaguuuugugugugguuugggcuuguggucuaacuuuauucuuuuuuaagucuacuuuuagugugugugcgugcgcaugugaacgccagugccaccgcaugcauguggaggucagaggcuuccaaggaucaaauguagguagucaagcugugucaugugaugugauggcuagcuagucuugguugucaacuugauguggcugggaauugccuccuucagauuggccugaugcaggaggacccagacuacugcaagacagacagacuauccugggcaguguuagaaaggcagcugaaugggagccugggagcaaggcaguaaggaguguuccuuuauggccucuguuucaguuccugcuucuaaguuccugcccuccugccuuagcuucucuuauugaugggcuauccguaagaugaaguaagcccuuucuugcccccagguugauuugguuuaguaaaacuaacuagaacaaacagcaagcauaauuaccuguugagccaucucacuggcccauaacuuuacucuuuacucuuuuggcauguaaguacccagguuucuaaugucuuuccgggaaagacacuuucucugcacugaguggccccggcauucuugucaauaggcaauugaccauaagcaugagauuuaguucuggguucugaguucuggcccacugucacuguguguccuugcacaugcacuacaugguuuguagucuuguaguaagucuggaaaucauugacaguuuuccuuucuagcuuuuucagcauuguuuugacuguuauaggacccuuccccauucccuuccuuucccuuccuuucccuccccaccccccccuccucuuccuuuuuugaaacggagucucauucuguagcucugguuauccuggaacuugauaugaaguauguagaccaggcuggccucaaacuacuuccaugugcugggacuaaaggcauucacaccuggcagauuuuugucuuuuauuugugugugugcauguguagaugugugcaggcacuuguggauaugagagucaagagagggcauuggacucuuccgagcuggcuugcuguguggcugcugggaucuuaccccugguccuccugauuguacaucaaacauuccuaaccgcugagccaucuccagcccugguauguugugugaauuucagaaucaacuuauacauuucugcaagauaucagagagguauuacaguggauucuauacauuaauuuggggaguuuugucauuuuaacaaucuauuaauuuaaaaucagaccacauuuaauuuaaaaacuccuucuaaccuuuuguucuaggcuuaaaccaauuuugauuauguuuugacaguagauucauucuauacaguuaauuuugaauauuuuaagggaugaaaaaauggugugaagguuuaagugccuuuagggauguaaaaauuuugcuuuuaugauagcuguugccuauuuuauuuauuuacuauuuuuacuuauuccuguguuuauguguaggugcauggauguuuuguaaguguuggcaagugcgggcauaucuguggaaaccacagucuaccuuaggucuuggcccuugagcuguuuuugagacagucucucacugggaccugggcuuuaccacgcuaggcugacuggccagcaacguccagagaucuggguguuuccuccacugaacacugggcauggcauuuuacauggcugcugggaccaaauucagguuccugugcucauggggcaaguauuucacugaguuauuugucuccccaguuccucuucuguuauuuaacuccccaccccagcaugaauccauagucuugcauguagcacccuaccacuaagcuauaccccuagccuugccauuauuuuguaauugcauguuguauugaucggcuucaauauaguuucauaaguuguauguuuggcuuauauuuucuaauauguuguugaaaggaagcagcaaaauagaagcuagccauucauuucauuucaccugagggcuuguugccugaaaacuagacuuuccuugggugccacacucccuugagcuuccugagagaauuuauagagaugauuguuauuacugcuguguugcugugacugcauauuaauauugauuaaucuggaaggaggaaaacuuuuggcucaugguuuuagaaagcuucuguucaucaugguguugaaggaauggcagggcagcucaguugaugguggcaggagccuguggacacuagauagcagagagcaaggcacauagaaccaagagcagaggccagaggcaaccuucauaggccaccuugguaguuuacugucgcccauggaucccauuauuucaaggugccacaccuucccugaauugugcuaccaacuggggaccacauagcauaauaaaguaggguaaauuaaagcuuugcauuuuuauauuagugcuacauuucuucauuuguagaaacuguuauaugaucugaugccucugauaucugaaauuaucauuuuuuaucaauuggagcuuuuaaauauaauuuucuuaugcauacuguuggccaugagaugggcuguuaggccuuagaauugagaaccaagccuucauaagagcaaggacacucacugcuucucuuaggguugcuugaugccuuagguagcaaggccuuaucucauuaccuguguaucauuuccaugacucccagaggcgcucaggaggagaacggaucagcagugcgugcauacaucagaugcuuggggcaugaaucauuucucuguguugacuuuugguugauuuaaagcucuuuuggggaguguggcuagagagacagcucagugguuaagcauauauucugcucuucccaaggaccugagucggauucccagagcccaccucaggcucagagccaccuuguaacuucaguuauagggucugacaucuuugcccucugugacaccuucugcaaaaacccacacacagagacacaauuaaaaauaauuuaaaaaauuggcaguacaacuuauuuuguuaaaaaaauuuccaaauuuuagaugggguagaugcucuccaggccccauccuuucugaagagcuauuugauaguugcuagggagugagaaucacccuuuccugaggauguggcaguggcagcuugccuuauccugguggauggucccaucccugugcauguguggguagcacuaucugaaccacaaguuagaagggcagcauguugaggagaaugugggagcugcagggaagagaugagccucaaggugguuaugaucauauuucauacacgguugaacuucucaagaacaaauacauauuuuaaaaaguuuuccaaauucugaguuuuauggaaguauucugauaugcuaauggucuaggaacuuaauucagaacuccccugaaguucagggucaguuugucaaccuguuuacugaguguagagauuaccuccuucccauuguaguaucuuguuuccauuucauagagcacaaacuuugagcuucaguuucauguaaaugugcuaaaaauaagagaaagcaacaaguggacauaggggaaaugcaauuucauguguaaaauaaaagggaugggagacucaggguuagcaggcaaugaucagagguacccaugcccaccguucccaggcagcuccuuugcuuugauccaggcuuguuaugcugcacauggguuccauagaaacaaugcuguaguuuguuggcauugaauagauccacaguuuccuuguuguagcgacgauaaaggcaacuuggaaagaaaagagcacugccaaaguaagcauucccaauagcuauagaggcuugauuaaauguuaaugguggaucaauacgacucuaaucacaaccuucugccuucugcuuguaauuuggaauacagagaaaucgaucaaauaagauuuaauguguaaccacgguaagaagagucccauuugugccacuuuuuuauuaggaaguuugcucuuccaaaucucuaaauccuuaccucaauuauuucccagccuagcuuucaucacacacagaacaagcccugugagaagcagaauccacaaugagggucaaggugcugcagcuuucucuuagcagugugggugccgugacccagcagugguaaugcucuguaacgacuuucagauuuuacuuuucuugaaucuuaugcuucucgaaacuugguuucugcuacuuuuagaaaugggagaacacugaaaauucuuuguauccaaaagcagccccacugugaaugaagugcaugcacaguaacauggaggcgccuuacacggguaccuguugguugugcuuucuaaacccaugcucacuuaugacagaaacauccacgacauaaguuaccuuuuuuuguacaugccauucuggcagcuucuaauagcauuucaccacaugggaccuagggagcacccaagugggaucaguugccuguguggcugcuugcaacugaaggucuuuggagaugguaagggcucugccagguaaaccccagauggcacugguacauacagacagacacgcuauuuuugaggguggaacaauaaucauauauauagacuuggcuuuucuguaaaaggauguugcgugacuguugcagccuccucuuaaaggcuuauuuaugcuauaggagagucuuguugcuaaagacacuuuauauucaggucucccuccucuggucacuaaaggcugcuggaccugcuauguaccagcccauucagacuuuagcuggauacaguguaguuaagguuuccacuagaugaucugcuuggcuaaguguacugaggacuugaaguauguuucucagacacaaagcucagagucugugcuaguguuugcuguguuuugccuagugggaauggauguaagcugauuuguuuauccuuaguaucguaaagugaauaugacauggcuuaccaguuaugaacacuugcuguucuaguagaggacuggcauuucauucccagcaccuguauuaggcugcucacagucaccuguaacuccagcgccaggggauccugguccccuucuuuggccuuugagggaaccugaaugcauacacaugugugagcacauaaauaaagagugaaggaacauaggauguuuuuuaugaccuuuaaaaugcacuguaugugguaguauacaccuuuaagcccagcaugugagaggcagagggagguggaucucuguaagcuagaugccagccagugcuacacagggagacccuggcucaaacuaaguaaguaaagaaagaaaagaaaggaagugaaaaggaaaacagaacaacgaaaacuacugagcaagggaauagaaggguuaaaaacaucguuuaaagauugauuuugcuuuauauguaaaauuguuuugccuguauauauguauaugugugugugugugugugugucugucugucugucugucugucuauuaguagcugugccuacagagcucagaagagaguguuggauggucuagaauugcauuuagaaaggcucugagccaccaaguagguguugggaacagagcccagguucucugaaagaacagcaacuacucuuaaccacugagccaucuuuacagcucccaguuaaaaccuuuugaaaauaauuuuauauuuugaauuauuuaugauagacauugacaauagucauagauauaugugaacuguccuguacauuuaaacuuuuuuuuuuuuuuugaguuaggaucucgcuugauagccagguugccuuaaacuucugauuucccugucccagucuccugagugcuggauuccaggcacacaccacaagccagauucccacaguuguaguauuuuucuaacuccugcucaguuguguaguggagucacagggcacaggucggugaguggacaguagggucuccucuccugggccacaggcagugcagcgauugaaucagaaggaacucucugugaugugacgccgcuggaggagcugcuuauggaacacaaauagguagaagugugaguguccccugggaccuuaggggaagugugaguguccccugggaccuuaggggaagugugaguguccccugggaccuuagguggaagugugaguauccccugggaccuuaggggaagugugaguguccccugggaccuuagguggaagugugaguguccccugggaccuuaggcaauuaggagcuaacacagaacugcucccuacaugaccucucaagucaagcaagugcucuuucucuuugaugcgaugugacuccacgccugugcucaaggcaccuucauccugcuuuccugugugccugggacccaguauuuuacacagugcauugcacauaugaauagcugacuuauuucuucuuagcaguucuacagcauaggauuauauaaaaaguuguuuaguaaaagcagcccaucucuguugcccuuuauauccuauagagggcucuauuccuuucuuagaccauuuguguguuuagugaugacuguuguucauuucaucuuaguuuccuccauuuuugcugccuuugccugacauuguggaucuagaucugagucuccuaugucuaggcugagguagagggacagaaagugggcaagagacagggaguacacucaaguggcccagauguuuuuaagaaaaggaaguccaugguagagugagauccuaaaggcaaggaaggugugauugguuuugucuggauugggauaggugaugggauguugauuuagacuuguguaucauauauauguguaugcauguuugagaauacacauaugaguccuggaugugugcaugcaugugaagacccaaaguuaacaucuggugccuuaucuguaguccuccauguuauucacuaaaggagagcagcuccuuacugagcagagagcucacuguuucaacuacuccagcuagucagccaaccagcuugccucagggaucccccgucucugguuccugaauguugagauuauagguggucacuaugccuacccagauauguggguucuggggaucugaauucugaguuuccccugcacagccaucuccccugcuccuaacuuacuuauacaaguagauguuauuguauguauuuaagauauauacauugauagccgggcaugguggcacacaccuuuaaucccagcacucgggaggcagaggcagguggauuucugaguucgaagccagucuggucuacagagugaguuccagaacaaccagggcuauacagagaaacccugucucaaaaaacaaaaaucaaaaaacaaaaacaaaaaaaaccaaaaacaaaacaacaacaaaagauauauacauuggaacuagggagauggcucagcaguuaagagcauugacugcucuuccagagguccugacuucaauucccagcaaccauaugauggcuuacaaccaucuguaauagaaccugauguccucuucugguaugucugaagagagcaacaguguacucauauacauaaaaaauacacacacacacacacacacacacacacacacacacacauugauguuauugaauaggcauagauaguaaaaugguuaugauagugaacaaguuuacauaucuuucaccuuacguaguuaauuuuuuucguuucuuuuccgguggcaagggaagcuaagauaucacuuaacaagaacgccaacuaccauacaguuuuauuaccuugcauuauacagugugaugauuuguugaguggaaguaagaaagaaucuuguagagaacuuggcauauacuuucaaguuccugaugacgagcguaaugacgaggccaucuaggugaggggggccugcagucuagagagucugccugguuugguuaggcacuuggucuucacucuucgacauucugcacagaaggcagcagugaccuuaguugugccuucuagaccauugucugccagcugucuggcuguggagagcauggugcacuagagaucaccagagccaggggaggggcuguggaggaagacggugaacuugagaggcucacgaggucucagcggagaaaagacugucuuccagaagaguggccagcacauuugcugacugauguguguugagugccugcuggauucuccagcagagcuuacugauucaaugcaguccacaccauuccaucuucucagcuguccucgcuaccacaggcccagugcacaggcaagacaaggaggcaggagacaaggcucgcccuggcuuggcaccgcugcgugaacuugcugaggaccugagggaucugaugaaggguucuugcugaugucccuucugacccuugcugguuuugcaucuggaaaauacuccuuuuucucugacaguguugcagcuuuagugcagauggcauugauuuaugguuccaaugucaucucucauugaucaugcuacuuagcuacuauacaagauguguuaauuuuggguuuucgaaauguaucaguuaaugggagaaaauuaggcugagcuuuauaguaacaacaugauguucagacaugaugaugaguuugaaggaacuguuuugagcugugaguguguaaugucauuauguugagaauaggaaaacagaguccuucucucuaagcacagcagcauuaaaggaaguuagguuuagcucuguaugugugagcccacgauuuguccaugauuuguuagagguaaacucauuuuuaggacagugccgacuugugaauguggccuuuccuccuagugcccaucuuccgguuggcuagaucacgggucuuggaaagguaaugaguuauaugccuggaucacugguuugccuugucuguagcugugugauuucuuauauucgugugugcuauauauagcugguaccaugacaggugcuaggaagcagaauaagaacuguugauucuauuucugaguagcacauaaaauaaaucacuggauucauuuauugaauggccaaggacuauuuuugaggacuugugauaugggggauaaucaauuuucaaauuauaggugagggucagaacugugacuuuuauacacacgcacgcacacucgcgcgcgcacacacacacacacacacacacacacacacacacacacucgcgugugcgcacacgcacuauuugauucauggagcuucuguucuucaucuagacaaacaugcuugccugcugcccuaucccaguucuuacagggaugaaacaaugcagugcuuacacagugcucagccuugcaccucacacacgagcuauaauaaaugcuauuucugguuucaugccauauaaauuucugugugacacauuuuuacagcuuugauacaagaauacagagaauuuaaacuaaaauauuugagcaaguugcugaagaugucuuagcucugcauggacaagagaacaccauggaagaugaugaacgaggccaggguuucugugcacugccaacucugcagagacuucugcuuuuuauguucuguauaaaaugacaggaguagagaugggaagggauaggacuuggguaauagacauuuggagcagguauccaucugaccuguuccugccugugcuacauucaaccuccaggcccagcaccaucuguccauuguauacccagacucagccuggugagccugccugacuagcccacuuguuccuuguuccguccucaggccuaacccuauuuauacaucccauguaccaauccaaucuggugaacccagccuguaccaucccuaagcuccaggcuuggcccaggacuuucauacugugugccaguccaguccccuguguccaccugacuuugucucuccugcaccauaucuggcccacaugcccagcacuguucacucaaccugugcucugcccagccuggugaguccacuugacccuagcccacuugcuccuuccccagucccauacccagcccaagaccugcagcagcuagcacccuggcccagcccacuuuguccacaucagccguauaaccaaugaaagaaacucacaugcccagguuucauuaaaaaauaaacaguauaaaaggucaagagagacacccccccccccaacacacacacacaaccaguccuguagaaacauucuccagugagaaugaccuaggugaauccuaaggaggagggaaaauaacauuuaaggaucugugaaaaagccauagggcaucauacuauuuuauauauaccuauauaauaugugcgugcaugcagguggguauauguguguguguguguaguuuaaaugaaguuaugccauuugggugauggcuccuuauaggagccauagacuguguaacaaaacuuuagucccaggcaugagaaaucuucuuuugaguuguuggucaggagagugcaaguaacucaacaauguagaauauuacuguuagucuuguugccuccagaucagucaaaguuaagacaguugcaaaagauacuguaugcuucagacacaggaccuagaggaauugagcugcaucugacccagaagccuccucuuugaggcuagcuauuauagugccagaaggagauauccagcuaccaaggaaaggaaacaauaaacuguccuacguagcugcgaugccugugaaccgcaacagugaccagcauggcaagcucucuccaauuuuagcaguaacuaacagcugucggauuggauuuaaggcccaggagggaaaugaagccugguuuuugaaagucggccaggugcccaaggcuagugaggucguagaucuuagaagagaacucacuuccaccacucgccaaccagugugauuccuaucuccauucuaacuucuuuuccuuauacccucuguggguacagagaggguuacacuucccccuccucagagaacacccccuccccccacaagcaggucaaugcagaggacagccuacuguagaaugcccagccccaacugauaauacauaguacagccauacacccaaggcucaggaaacauugggaaauggaguggaaaguauguaagagcuggaggaccagagaaucugcagcaagauugugucuucuagguaugacagggaagcuacacucaugaaaucgcaccaguaaggcugccuaaacaaugacagcaccaguugacaugucuaauguggaugggggucucacgggguuccacuacaggcaacucaugauuguggggagagggagagagagucuuuuccagggaugugccucuuaauagguuaguuuccaacacacacacacacacacacacacacacacacacacacacacacacacaaacauacacacacacacacacacaucaagcagacaacuccagacaacagaaaagcagccuugaauuugagaugaggugggggaagguguaagagaguggagagggggugaugauguaaacauaucauaugcauauuaaauaaaaaaucaaaaaguagaucauuuugaguuucuuuagaauaagaaaagcauguucuggaauguccuguuucgauuugagaggacaucaugccucccacuccugauaugugaaaccugagaguguuacuuggcagaagagacugagcagauaagacuggagaccgugagagcugggguuuccuaagacaucaggggggagcucagugcaguucgaagcaucuuacaccaggaaggaagggaagcagcagguccaggaccccaaggaugccaagcugcugguucaacgguggagagaggagccgcaagccaggggaugcaggugauccugugugcuacagaaagcugccugauagcuucucuccagcugaggaggccccuuccuauaauuccucccaaaauacucugucccagccuaccgucacguauaugguguguuagagaaacaguaguuauucauuaagagggaccuacagauugaugaguugggcucccauucccacaaaucacgacucacuucugugacggagacuagaagugggaagccuuugguuuguauguugauucuuacuacccagggccugcaguucaauaugauuucuguugagaaggcuguucacguagugugcagucugcguuaucagugggcaguguugguuuuucucaagagagagacuaguacccgcagagauuuaaauuuuucuuauggugcuuauagguuguauaugugagggggccauuuuaagaagaaagguuugcuaaacuguguugcaauaugagaaauguaaguaggauuucugaauugcuguucaccaacaaauacaguuccauauggaaccagaagauggcagaguugacacacaaaugaaccguggaguuguagaaguuuucuucacuuuaaauagugguauagaaaagauauguuagcuauaaauugaagccagcuuuuuuuuuuucauuuuuuuauuacauauuuucuuuauuuacauuucaaaugcuauccugaaaguucccuaugaagccugcuuucuaaagaguguuugggaaacucugaaaagaaagagucauagaaugcaaguaacuagacugcuucccaagucuucaguguuacagucuuuccccauguuccuuguagcagucugcccugaguuuguucuguaaagcgcaacaccgauuuuucuccagauacaguuagucccugcuuggcguaugcgggcuucuguugaauguauucccgaguugccauuugaaaccauaugaggaauuuacugauuuaaaguuagcugagucucucgaaugcuuguaaguauggcaaacuuugaagaugauuucuggaaguggugaucacaaagucuggguuugaccugugcuuccugggucucuaguaacuuccacagcagaaguccagagaauggugaugucauuguccucgguugugucuuagugugaugcggaagaucaccaacucacuuucauacauuaugguuuagagggguuuuuuuuguuuuuuaguuuuauguuuuauuuaauagaugguuggguugcccccugcaacaguaacaguaagcuaacauucagagagguuuuuauuucaaagaaagaaauuucaacaacucuugguaaccucauuaguauuuagccacaauuuagacuuaaguuuuauauuucugguauuaauucuagugaguccaacauucuguuucucuuuuaagguugaaaaaacaaugggggcacauuugucuuugucucuuucucucugucucucuguuucuuucuaugucucugucucuccccccuccucucucucuuucucucucucucucucucucucucucucucucacacacacacacacacacacacaccucuaccucuauaucucugcccuucucucugucuccucuccuguaggcuauauuauccuaucuuaaucuuccugucucuauuccugagguuuaggguugcguguauggacuaucaugcuuagcuccauacauauuuccuuucugggaaacuaccauuaucuuuagaaagaacacuaacaggugaagcauucucaggucuaaugaaaugucaccaucucauguccuggguucaucccauguauaugaggagauagcaugccacagagcgcgugccaggggaccuggggacugcauuauuugcauuuccugucacagaucuguagcacucagccaugcuuuguucuugugcaguggaaugcucuguuguccauuacauuguaauugaagaaagaucaaaaaaccaaaugggaggcauggaggggcagauggagauagaugaggcauuucuuuguagacugccuugggcccgaauugccaugccacagaagucagacgccaugcuggggccuuuguaccaggcaauggccaggaugguuuuucaucggagacccuuuuccaaguuuuucuuuuguuucuguauuuuuaagaaauaaaaauguaaucuaagagcacaaaggguucugaagcaugcaguuccauaaauauugaugcugagccucagaaguggucaguuccuucuuccccgauauugggguuacguuucguuguugaccuccugaauuggaaagcacacgguauuacugugcccuuuucuuucucuucucuuucauuucuuucuguguuuucauucuuugguuaguuguagacauugggagcuugucuuuagguuccuguugauguggacuucauuuugcaucucugauuucaggggguuucucaaaguucacacucuuaccugaagaagcaauuuuguacgcaguuucaagccucuaagaagcugucugaacugcucuguuguagaucauugcuaacuuaaaaagagacaaucuugucaaaccuagcauuaaucucauaucuguaaguguauuuuaauuggccugcuuuuuauuucucccuuacauggagucuuuggucuacagaacuuguucauuguaauugcaaauaauuuagaaaauauggauaagcaggaaaaaguuaccuguaauccuauugcauuuuuccuuauucuucauaugaaaaaagauaauugaaaaauaauguuagaucaguaaagauauuucuguggaaauguauaacuuuuugguguuuuucuuccuucuugguaguuugauuuuuuucuacaaaaauauagaguuuucuuuuucuucagcugguuagugagauugauauauauuuucucacucucaaggugcuuauggucaguagaaaaaaauuuuuuuaaauuauguuacuaaguaggacucgggaguuggcuuaguggauaagcuugcucaguaugaaagcaagaggaucugaguucaaauccccagcacccauguaaagccagacauggcuguaugcaucuguaaccccauuauugggagacagugaugaaaacaacccugggcucacaggccagcccaccuagcugaaauggcccccuucaggcucugugggagaggagacccugucucaaagcguaaaaguaacaagcauuugaggagcguaccacauacugacuucagaacucagcauguucaugcacacacacacacacacagagugaauaagucagguaagaguuuaugugggaauuaagaauaaugaaggacuuuuuguaacagagaagguauaauaaugggaaaguaaaaaaaaaaaaaaaaaagacuaagaggcugggagggauuguuccguggguaagaaugauuccugugaaacaggaggacccaugcucgaaccuccaacccccacauaaaagccacuuauagccauguaggccauuaaccuuguuggagggugcuggagacaggagcauuucagaagcuugcugucuggacgaaccagaaagcuucagguucagaaagagagagaaagccugucucaagaauaagaaagaccaccaccaccaccaccaccagaaccaauaagaugaaagucauagaggacccaaugucuccuuuggccucaugcaugcacauccauagguaagucauaugagcuugccuaaauguacauauauacuacacuauauaccauaccacacacaacaaauaaauaguaucuaauggauaucauaagaaacuucugcuucagccaggcagugguggugcgugccuuuaauuccagcacuugggaggcagaggcaggcgaauuucugaguucaaggccagccuggucuacaaagugaguuccaggacagccagggcuauauauacagagaaacccugucuugaaaaaccagccaaccaaccaaacaccaacccccccaaaaacaaacaaacaaacaaacaaacaaacaaacagaaaacccaaccaaaaaaacaaaugcaaaaacaaacaaacaaaaaaccuucugcuucagaacaacuaaagaaagucacucauauggucauaugcauguaauuauauaaacauauguuuauucacuagucaggaaaugaaaguggaaccauuaggugcagagugaagcugagggagggcaggggacugcuuacgagguuacucagaguaucacaguaguggucugaagcccccuguccaccucaugggcaaacucaucacuaaaugaguuugccgacauagcuaucacuuauggucacuguuguuacugucucugaucugaaguaaggaggucuagaaaggcuuauggagggaaggccacaggaagagccucaacuuggccugccugucugggugauacaaugaucucgagagcagcauggcugagaugccacugcuggucugccccacuacacugaccuggacucugacgccucaucccuagauacugcugcuaugcgugaggaugaagcugucuuaggagacccgcuggaagcacagcacagaaagaauguacccguaguuucacauuaaaaauuguggaaaacaacaggcugauucucaugcugcauccacacauccauaauauuaauauuuugguguguaaccaggguagaggaauucauaaugggauagucugccuccucacacugccugcuccggaucuggugugcauugcacuuauggcauaguucaguuguccuggcuccuuuguaggugccccagggccuggguggccucugccuugcauacagggcagugcacucuaaacccagauuggcucucugugugccccaucccgacccccagggaagccucucacugcaaccaggacacuucauuuccugccccuggauuucacugaccaguucuugucuuucuuggcccucaggagguggugcuccucagggcuccguuccuggucuugauuccucucuuggcuuuuucucugggugaugcguuguucuuuuggugccagaccucaucugaccucugguggcuucuguaguuccagccaugguauuuuucuuguuuacugaguguauuaggguucuccaaggaacagaacugaugauacaccuaugcauuaguaagggauuuauuugagcaauuuauagacugcagucugaguagucuuaacaaagcaagccugagacuuuauucugucuuuuucuuugaaucugacccuucuucucuaagccacauuuauuuccuggcaucuuucuuuuuuuuauuuuuuuauuggauauuuucuuuauuugcauuucaaauguuauccccuuuccugguuuccccccucccagaaaacccuuaucccauccuaccucccccugcuucuaugaguguguuccuccacccacccacccauuacuaccuccccacccucaguuccccuacacuggggcaucuaucaagccuucauaggaccaaggaccucuccucccauugaugcaugacaaggccauccucugcaacguaugcagcugggaccauguauacuccuugguugauggcuuagucccugggagcucuugggggacugguuaguugauauuguuguucuuccugugggguuccaucuccuucagaccuuucucuaacuccucuauuggggacccugugcucaguccaaggguuggcugcaaguauccaucucuauuuguaaggcucuggcagggccucucaggagacagucauaucaggcuccuuggcauccacaauagugucuggauuugguaacuguauaugggaugaauccccaggugggacagacucuggauggccuuuccuccagucucugcuccacacuuuaucuccauauuugcuccugugaguauuuuguucucuuaagaaggaccgaagcacccacgcuuuggucuuccuucuucuugagcuuccuguggucugugaauuguaucuugguuauuuggagcuuuggggcuaauauccacuuaucagugagugcauaccauguguguucuuuugugauugggcuaccucacucaggaugauauuuucuaguucuguccacuugccuaagaauuucaugaauucgucguauuuaauagcugaguaguacuccauuguauaaauguaccauauuuucuguaucuauucuccuguugaaggauaucuggguuuuuucuagcuucuggcuauuauaaauaagacugcuaugaacauaguggagcauguguccuuguuauauguuggagcaucuucuggguauaugcccagaagugguauagcuguguccucaaguaguauuauguccaguuuucugagaaaccuccagacugacuuccagagugguuguacaagcuugcaauaccaccagcaguggaggaguguuccucuuucuccacauccucuccagcaucugcugucaccugaguuuuugauuuuagccauucugacuugugugagguggaaucucaggguuguuuugauuugcauuucccugaugauuaaggauguugaacauuucuuuaggccauccgauauuccucaguugaaaauucuuuguuuaguucuggaucccauuuuuuaauaggauuauuugauuuucuggauucuaacuucuugaguccuuuguauauauuggacauuagcccucuaucagauguaggauugguaaagaucuuuuccaaccuguugguaccuggcaucuuucaucagacuuuuguggcagccuuuuagcucgucuccugccguguagcugguuuuuggaucuuacuuuucccccacaccguacuguuuacagcgccacagucuuggcacaggugaucgagucucugcuuaaacucucucacuuucuaaaguuguggcaugaagcucaaacucuguauuaugguggcugggccuccuugucugauuuccuggagcuccugaccgugacuuggugcauugauaauagguuauggcuugggcggcugccagccaagagacaguguugacacaggcuggcgaucccucaagcacucuuuguguucaugugccuuuuucgcuguacuuccucuuccugccuuuccauuugcaccuuucugcucauuuggaagauucuucaacugaaaguucucuaaguuuccucugggucuggaagucacauccacuaccccacuacccuagacucaauacccucuucuucaugguuccagaaguccuguguuugagacauugcuucuguccuccuuccucuucccccauuuguuuucuuucuucuucuauuucuucuucgucagcauucauguagcccaggcugaccuacuccauacagaguugaggaugccucuugaucccaaguucugagacuacaggcaugcaccaccacaccaacuaacggggcacaccucauucaucuuuacaguggaggccgugugcauugucugccucaaaaucauuuuugaacugaacugaguuuaaggaagauuggguaggaagauguuggauuccauugcauauauauauauauauauacauauauauauacacacacacacacacaccugugggauuaaaauauuugaugagugaagaaacagaaauuagauuuuuuaaaaauuguuuaaaaauaucaauuuuggaagacauguagcuugcaguaaugaauccuucauuagagccauaucucuuauugugugucaagaaaaagcaucauuaucuugagcuuucagagaugauguugcaugucaguccacuccacagcacauguaucaugucaccuguguccuugcaccucaguacugaggcauacaucggugcugugugcuauacagaggaggguaccaaggaagaguuugucaguguucauaccaagagcaagcuaguugcuuuuguaaauaaaguuuuauuggaacuuguacaagcuguucauucacaugucauugucuauggcuucuuuauacuaaaauagugugguugaaccauuguaucagaggcugugaagcuaaagaguccaaaauguuugugacuaguguuuuugacaccaaaaguuuuguaacucuuagagcuauuaguuuuggaaaaaguaaaaucccuuuuuguuauauccaaguuauauuaaaauccgugauuaguaauuugaagacuauacuuugaacaaacacacuucagcugagugagacuguggauggcuguccugcuccagcagccuacacagcacugucagcagccuacacagcacugucagcagccuacacagcacugucagcagccugcacagcacuguuggcucugugaggccgagccaguaaggaggaagcaccaacugucagcaccaaccugauuucuccauguccuguuacccacgugugugcugucugcagucauagguucuuaacugucaagcucuggugggcaaccaagagcagugaugauagccuguguugucuugggcggucuccaggaugucuuuugaugcagucuugcucaguuguucaaggaggccuugaacuuuggauccucuucuucuauucaccucagaagcugagauuauaaaccugugcuaccaggccuggcucucugugucgcugaagaaagaugaucugccuuucuugccauccuuuacguaugaggguauauucauauucuaaagguuggaauguauuacccuugugcauauguaaaacauggcacaccaacccaagauguagaaagcauuugccugucuggauuacugcuauguugaggcuuaagcacaagccuccccuuuaaacaguugaaugauuuuuuuaugucuuccucccugugucugaguacccuucuccacuccugccuucugguuugaacaauuacuuagucuucuauuucugaaagaaggcaggcagccuuuuauggagcaguugaccagauggaaaaccugguaaggucgagcagauucagaaacccuggcauuucucauugagaaugguagguguuuaaaucuacucccaaccacguuccuguccuggaacacgugaccacuguacuccauggaauggacuaugacaaccagucacauaggggcaacaccugaagccccuccacauugagaugagacauccuuaacaucucagaccaaaccaauagaaagcaucugccuuuagaucccaccccacuccaaaauguuuauaagguccuauccguaaggaauaaaguacacgaguuauuucaccaagguccuauucguaaggaauaaaguacaccgguuauuucacuaaagaccaucugagagugccuguuuuguugcuguaacacccuaagagaagagaauucuuucccggaccuuuaguagcuugaaacugcuccagccugccuuagccacuuccugcuugguggcccugauuuuggcuccuagcugcccacugugcccggccaccugccaucaacucuggaccagcagcgauuguggaagagaccugguagcccacuuugcucuagcucccccuuggagagcugcaacuuuuuggccucucuggcugggccagauuccugcagaucuuugugauagugcuugguacgcaguagccuuuaguguuaauuccccuucacuuuaccgaaggcaauuuaggcaauuauuuguugaccuagcuagguuugaguauggcuagucaggaccagagucugggaaugauggggcugggucccagagugccugggguguugacuccucgguugugugguggcaaggccuaggugccaggcuugcuugagaguuggcagagacuggugugugguaggcaggaguaggagugccagcuuacagucagccuucucuccccagguguguuacuuccagucaagcaaaguuuguucuguuuuauuccuuggucaaacaggguugagaaguugagccguguggcauacuguucuaugaguugaauuuucuuccugccaccaagaguuguguggaacacggugucaggaagugagaagaacuuguucagaucagggcuuuggcacugaugacagugcauccccaaagguucaagaaucuuaggucaacaaaagacuuuugacaccucccauuagaccuugagaugauguuugccuuacuaguuuugcuuaugaaaagaugucaauuuuaucgacagcuacugccuuccccgauauaauuaaauuuguauauucuagguggccugcuugauucgaguuccuucugaagugguuaagcagagggcacaggugucugcuucuucaaagaccuugcagaucuuuuugacuaucuuaagugaagagguaaggcugccuuuagguccugucucuucuuccucugcugagggagauggucucuuagaacaccgagggcucacugcccaagccuccgggacuuucggguaguuuaacguucaacuacaauaacucuuuucugggauuaguuuucauuugguuuugaauuauuuucauuguuuuccccuaauuuugaagcagucauguauuaagugccacugccgcauaugcccugaauguaauuugucucagggucagaaucagacagacuaaucaugugagggaacuaagacacucuuuuagaacauugcuucaaauuugagggccugugggagagaagcaguauuuauuaauaaugggcugaucaucauuaccagaaaaucauuaccauaacaucauaauguaauaugaaauugucauugcuuccuggguaugggggcauaugccuuuauccuggugcucuggagccagaagcagauaacuuuguaaguuugaugucagccuggucuacacggugaguuccaggccaaccaagacuacauagucagacccugcuacaaauagacagacagauggauagauaauggauagaugauagauagauugacccugccucaaacaauaagugaaugccccuccucuuccugaucagugcuggcuaucguuggaucugcccuaccuagauguguggcuccuaggcaugcugcuguuuuccuuguaugcauuuagcagaagccucuccucaauuuugcuuugaugugggugucaaaaccucauuguguuaccucagguuggccuucagcuucugggguuauucagucuugcuaccugggcuccugaguggccauggcuucugccaccaugcagugacuuuuuuucuccuccuccuuaacuaaugugagcgaucuuauuugagguuuaaaaaaaaguuauuuguuuuuguuuuggaggucggggguuuccuaugucgcccccuaugaguauucagucuuuuuccucauccucccaagugcugagaugaaaggugugugccacucacuauaucccacaucuuucuggucucuuaccaacuguaggagugaggccauugcuguuggcugugcuuaagcagauaauacuaggauuaucugcaguauaugcuuuauugagagauaacuggcaaauuucugaaguaagucuuuuuuaacauuaaaggauaaugaacauuuuguguacuggauuuugaaaauguauguaauguaauuauuuucaaaagucaaaaaugcuguuacuuauacuauguagcuuguuucauuauuagagauaucaugagcuugcagcuuauacaguuuaagccacuuuagaauauuuaacuucagaaaacuguggcuagugagugucuuagaacucaaauuuuggagcauguaauucucuuucuagaauguucuucacaaaucuuuguuguuucaaguuuuuaaucaccuggcuuuuguucguuucagggcauucaaggacuguaccgaggcuauaaaagcacaguuuuaagagagguaauccaauggcuguugacucgugaaccuacauuucauuucuuaaguaucagaaauauauuggagaaauuggcuuaagaaaucaaaaagaagggcuggagagauggcucaguggucaagagcccugguugcucuuuaggagguccugaguucaauucccacauggugguucagaaccaucucuaaugugaugugaugcccucuccuagugugcagacaucgaggaagacagacacucauauacguaaauaaauaaaucuuuaaagaaguuccccagaagcuguugaguugcaccgugguuguuccaucuaggagaaugccugugaugguuugcugaaugggcugguguccuuguauuccuagcugagccuuguagcugaaacaguaaggaagaacuaccaagugucugccaacaaguucaugcaaagccgcuuaugcaagaagcacuccaaagccacaccccuccgaagcccaccacagggagguagcuuugggucccccgaugggaagugcagugggcugaggaucucacucugagagaagccugcugcuuucauccugugccuuccagcuaacaugcuauacuggucuuuggagagggguggugugggagaggggaugauaaagcaaagacuugguccucaauaaugacgucacuaaugcuguagacggcaagcuuucgucgucuacgcagugaaauguaagaaacaguuuugguccagggcccagaaggaagaacuugcugaugcuucuuccucuucucguagccccgggaugaacgcauuuaacguguaagaguguugcagugcacgugauggggcaguuaauagaguagugaaguguucuuguucugcacuccuggaggucuccuuaggacgcugacagacugugugguguggccuaaagcuuugguuuucacuaacaaccugcacuccagccuguugcugugagccugccagcuccccuuuuggcagacugaacggccuguuuuuacuugcugcugucuggcugaaauaucaccugugugagucuccuuuugcccuuucuuucuaacucaccauaucugugugauuugcccaucuuauaccugggugcaggaaacguggagaaaaguaaucaacguguuuuauuuuucugaaaaggucugaauuaaugaauacauuuccauuccagagagugcuaguuuuucauacaaagauaaaacacaugcucacaacuguuguuccauccuuucaaaaauuuguuuugacauaugucaugcuaguaauuaauuuuuuggcuacaguccuuaugaauugugugaccuuacugagaugacuuuguuuacucaaaauggcagugcuuuguuggcaauuuaauuggggucuugagcauuaugcaggcucauaaaggcgccuucagagcugauuuugcuugaggucuauuacucuguguacauucucggcuggaacgagagaggaauuacuacugaaggaaauguagcuucucuuccaagugagacaaaucagaagugaaaugucugcuuuaaacaacacuuucgcauuaugaggaguuuugagccuuacauuauucuagcaguaauaucaaaucuuuuugucuggagccgucugauuguuucaauaagaaauacacagacguuuuaucgagaaccaccaggaaaugugugcuauuuguucagugugaggcuuuuuccuuuaaaauaguuuucucucgcuaguguuuagaaggggauuggaguuuggguccaugcauuauaaggaagauacauguuuucugggcuucccuagcacugucacaugcauugugcugugcuugaugcuuguagcuauuguagcccuguccucuugcucaucugaacuaguucaguuucugugaauuuuacgcugagucuaaucaaggucaacagauuagacuguuucccucaccuugucucuucucaucuuucucauggacuugaccauauuaguuaugacugaauucugggcguacuugacucaugcuguugaaugugacauagaaggacuuggggagggaaagaaagcugagaaaagccaucuguuucaaaggaacuuggaguaaacuaaauucagcuggugccuuuagucuacaaauucuacucagcauuaugcagauagcucuguccugauggggaaguacauggggagucuuccuugccaugcaguuaaagccugcugaggugaugcaccuggggaagcccaccuggggugccucucagcaucugucacauggaagcaagccuuagggcuggagaggugguucagguggugaaguaccugccacacaagugugaggaccugaguuucaaucccucaccacccacauaaaaaaggguuguguugacauuugccuauaaucucaggguuggagaagcagagcuauucagaucccuggcgcucacuggucacccagccuagcugauuggaugaguuccagguuuggugagagauuguguuaaaaaaaugagguaaaaagugauugaggaagacgucugcuaucgaucuuucaucuccacaugcacacauguguaugcaugugcaagugagguacacuuguacaaaagcuugccaguuagaaguagucaaagaaaacaagcagauagaauagccugaacaaagacaggaaagaacugcaugcgugcgugagugugugcgugugugcgugagugcaugcguauuuauguguguguguguguguguguguguguguguaucugucugucugucugucuguagaauagggggcaugaaucucgagccaaggaaggaugcuuucagagaguacugauaaggugggguacuugcaaggaggauaaauggaaccucucagcuuagcugcauauuugccagaaggcuggaggaaaagacauggaagaugccccagaaagagucugacuuuguguccuugagauguagaggagaaauuuccaguuuguggcucuugcugcucagaugugaagggaugcugcugcuguuggugcugugucagugauagaaauuuccaucuuaauaaugaguagcucaaccgggcauguuggacacaccuuuaaucccagcacucucaaugcagagagugaaucugaauucaaaggucuacagagugaguuccaagacagucaaggcugcacagagaaacccugucuugaaaaacaaaacaaaacaacaaaaaacccaagaacaacaaaagaguaacuccuggcuucuuguacagggguguagccucaccucccuacuuccaagcgggccaaaucuacagccuguucuauaaauuugagagcccaaauugagauugaaaagccauugacuagcucaccccagaagagauauggucacuuugcagucucaguuacucucaauauccugucuagcaacaagcaugccuccuuaaggaugccugugacuugucuauaaaaauuucuuucugauuucugcugucugcccucuguugaugucuccccuaaggucuucauguuguuauagucucuugagugccuucuacagccauccauuuguuccuuugagcucuguuuuaugguaaugguauuugcuaaccaaauauauuuuuggcucuuucuuuuucuuuacaauggcguagugccugauuguacaaugaaccuuuauauaguuaaccagccuccuuuuggcggcuguaacaguuuugcaccaauguguaauacuguuuguuuauauauccucuuguucaugguucaggcuuguagguuaugucaagauauagaacaauuuggcuaaagaaauaaacguguaauuuugacagaugauauagaguugcaggucauggaaguuccagucuguauuuuguugagaauauggaagcuccccuguuuucuggcuuucuaguggugcuagcuguccauaggcugaaaauaaugucaccuggguuuugauuuugaguucuacugaauguauuaauguguguuagaacucguuuguuuauuguuuguuuuuuagaauuaaaccaggggauuuauguaaaucucuuuugucgugaaucuucuuuaauaugaacucaaaaaaaaaaaaaaaaacaaaaaacaaaaaaacaaaaaaaaaaaccccaaaaaaacaaaaccccaugaacuaaguuuguagucuugguaaucaagagucuuuaaaguuggaggcagagggaugacuaguucaaagccuguaugagggaucuugcaagauccugucuucaaagaaaaccaaagccagaagaaagccuucaacaguaaaaaauaucuccauguaagguguaacucuaccccccaaaugcugucugcaguuggcaaguaauguuucccaguuuccccugcuuggcugggaacgcugcauacacugguucuacugaaaucuuagguaguuuggagagauguuagaguaauacagccugcccugacaccaagacuuaaaauugacuugagguuaaguucuggccuccggaagccacuuggaucuaucugcauuugaaugugugacugugguucaugauagauaguagguguucaaaagagagucccagggauugcuguugcucagccaaggggcaagaugcuucauccagauaucugggagagaggaguuuuaucaucguaaauagaauguggguauaguuacccuaaugauuggacuuucaaaaucauuauguagguugggaaaaauugugauuuaaaaaauguuggugcugauuugcuguaaaaguuugcuguuuuucaaauaagagcaccaucuuaguuugcuuucuguuguucugauaaaaacagucugacaaagagcaacuuggggaggagucauuuccaugucaguccaucuuugagggaagucacucaagcagggacagaagcagaacccaggagggcacacugcuuauuggcucccucccauggcucgcucagccugcuuucuuaaauaccugguaccaccugccacugggguggcacugcacugagagcugggcccucccacaucaauuagcaaccaagaaaaugccucacagguuugcccacaggccagucugguggaggcauuuucucaguugaggccccuccagcuccuaucccuguugaaagagcauuagccagcacaaugaccauucaaggaaagccucuugcuuugcugggauugaucccagcgccuggugggcaagcgggcucucgaucacugaggugcauccucagcccagccuuucugaaugagccuggcuuauucaggacacuucaguguccuccuuugaagaauggcaugaagcagcugccacugccgagacuuuaccacugucuguccuuaggucuguccacugcuuucuccauucuugguuguacguuuuacugucuaaugagagagguucucuuuuuagcuaugcguuccagcaugugucuuuaaaauugucucuuugauuugccccuuugcuuugucuuuggucucucccccucauuuccagaguguuugcuuuucuugucugcaucucucucuaagcugacaccuuuuuucugcccuuugcauacugccucucgagcacagcaccaucuacacagugggcucucaggaaacauuccacagcccauuugggucgcuucuguuuuguucccaugcuaccagacaccacguucaucgcuggagggugaggcaguucugacuggggcugaaacagccaggcucuucugcugcugcccugcguuguuaugaucuguacaauugcuaggcagugaaacuccaacuuggagauacuuuuccaagacaugaauuuucuuaacccuuagaaaaacuguuuuuuguaaguguggcuuuguuggagcaggagugcugugggcacucaguguggcuuuguuggagcaggagugcugugggcacucacuguugugcaucacaaagauuaucagacgcaguggccagcagccuuuccaaacuuuuaaugcaauguuguccuucaguuacaauugagugcaaacacaccgagccugauuuuaauccuccagaauucauuuuauuaacuauguccaaauagaacaucuguuuaaauuccauaaugcuggcuucaugggaaaagaaagggaaaucccuauuuggccuuggauuuuguccauugcuuucucagucagcaaacguguacuaagacauucguauuagugggaauguuaaacaaaugaaacacgaaguuuccccuuuaaucacagagcuuuauaagaugagucacuuauugcauuugcauuguuguagcuucuguagaaaucugugaagaguggaggacgguucauucaguuaauccuuuacugcaagauuugacgucaccguccuugaccuuagccuacaguuuguaucuucucaucacaagcaguuuuaagcagaacaauuuaguaagacggauuuaauguagagaaaauaaccucagcccccuacucugugugugauuaggguuuguuuacagaagcagcugcuugcuacuuuucuuauucuuuggaugaauuuugcuuuuacuguaaaguuucaaauuucuuggccugccagguggcuuagcugaugaugaccuggccacuugaguucaaucccucggacccccaugguggaaggagagaacgaacucccauaagcuguccucugaccuccguauaugagccguggcacucaaaugugcacacagacauauaggcacaauaaauaaagugcaauaaaaagaauuauggagucuucacauacuucuaugguauauuucauaguuucccaucagccaacucuucuacauauccauccaguggagucaguuuuuauauucugugucuucuauaaguacucuuaauuuuuauccuuucuaguuaaaguugcuccuguggaagggauacacacacacacacacacacaccccacauauauaaauccuauuacuguguaaauuuacuguuggaaaaacuucauaauaugauaugucucccuuccauaggagcaacugcaaccuguaaaaacaacacacacacauacacacacacacauauauauacauacacauucaucaacacauguauauauguguguguguauauauauauauguauauauauacaaacauacauauaaacacauauaugaaugaauuauuuucuaaaauuacauacaaaaauaguaaacaauuguuucaugaggaagauccuucaucauauauguguggucauugaacaucauaggcugaaaaaucuuaagucccauuacuguguaauuuuacugucggaaaaauuccaucucauaagaggauuaagagagaaacuauguuuaugcauuaagaaaauucaguuugaaacaaaauauagaaauuuuauaagcaauucaaggcugaagguuauuugaaggaacuugagguucaacagucuggcccagacuagcaugggcucauaaagagaaaaguacaguuugaaauggauuaugaucauguacuuaauguauuuuaaaauuuuuaaucuauaaaauauuagccuuuuuucagaucagugagcugaagcuugugaaauucaauagagcuagcaaagugguggcacuggaaugugagguugugugugugugccuuucuggucccagaugccucuugcucacaccucacagauugaucgccucacagauucucaguaaccuggacaauggcaacagaugugcaaggcuuggaucaacaccuaggaaguagaauacaaaucaguguccuguguguguggcuguggucuugugagcguguggaggggugugugucuaugagugugggcaugcaggggcacaugcuagugccugcacacagaggccagaggaagacccugaguguucuaucccucucuguccuacccucuugaggcagcauuugucacuaggcuggcagccagcaagugccacugauuuucccgucugucccccaguggcacugggguuagaggcaagcauguggcugugcccugauuuuuucuuuuuauuauuugcaugagugcuggggacucaggagccauuccuagagcacaguuuuugaauuguaaagacuucuaaaagauaaaaauuaggcauuaaugcuugcuucagcaucuucccuccuguaauccucacuagacuuccuggacgccccuccucuuucccucucugggugucaucguguauaguaggugggaaaggugaugcucaagccuugagauggcuuuggcacauagccaagugcauuauguaauggcagaaaagaagaaaccaguaggaaagggguauucucgccuuucaaagugcugcauuugauggcugggcuugcucugaagcuugugauauauaaugaagcacuagagggugcccaaggccuguguuuuaaaugugaagugagaacucuccacaggcaggaagcuuggccuuguucaccuggcuucaauaaaagugguucacguuggaaaaugcauuuuuuuuuaacuuugcuacauacaugcucagacuauuuuuuuuuaaagacaguaucaauugguagagugcuuaccugauauagagcugauguuugagucccagaacugcauaaaauuggguguaguaguaugccuguaauacccaaacuggugacagacacaguaugacccugaguccaguuugagggcagccuuggauacaugaaacacuuaaaaaaacaaacaaaaccaaccaaccaaccaaccaaaacccaaaaaacaaaaaugaaaugcaaaugaagacauucccuccuuaucuagagcaggcuguucucagacucagucccccuguuucagccuacuaacccaacccaaagaaaaaugucccugauuucagugugaucauggggaaacuucauacaggcccagacaggcaggugcgugaacuugucaagucuugaugaaaggccugccugagcucagagcucggagccucuagaggcuggugggagguggcuuuggggccuggaacaggcgaaugugaaguucagcugagagcuacaguuuagcagcuaggguuuguguacuggccucuguuugcagcaccagugggggcuuuguucucuauuguaguuacuguuguuuuuccacacuaggaaaaagccuucaaagauuagucuggagccagcagcagaauauguguggacucuaucccauccuaaugacuuuuauaaaucuuuuuauaaauuauuucaaaaacacaaaagaaaaaagcuguggggcuauagggaggacucaguggcuaggagcacuggcugcucuuccagaggacccagguucaguuccuaggacccacaugauaacuccaguucuagggaaauugucuucucuucuggccuccauaaguacuagugaugcauguggugcauaaacacacauggcagacaaaccacugaucauaaaaguaaaauaauaauaacuuuauuuuuaaaaguuuuuuuaaaagggagaucagauuuggguggugugugauauaauuuaaaauaaucuuuguuuguuuguuuguuuuucuagacaggguuucucuguguagcccuggcuguccuggaacucacuuuguagaccaggcuguccucgaacucagaaauccgccugccucugccucccaagugcugggauuaaaggcgcgcgccaccacugcccggcuggcaaguuaaauuuaaaacuuaauucuuaaaaaucuuacuguuuugucaacgaaguguguguaaggcuguaacagaaggagcgguggccagcagccucgccugcccaaggccuguacuuuuggaugcuguguugaaacauuagcgugugggauuuuuccguggaagagagggugugauuugcucugugcuccuccccagcagggauacggcuuagccuuccagauaaaugcauuuaguucuguggugcacgugguaugccuuguuuugacugacagguccugugacaguuacccagugugugggguguccguugauuuaccuuguuguuugcugagagcuuuucuccaacccuugcagacaccgaguuuaaacagugucuguaguguacacaggggucucucuaaugaagaccacagcaucuccucagacgcuggaagaucguacacugcaugugccuccccaugucccucaugcuauggagccacacauguggcgugucugauguucuuaagauuagauuuggguuacuuuaguuugacuguuuuuauacaggcgcgacacaaaugguaguguauggcuggcggcaggcagugcccuguuuaaucacuugaguagguguuccccgauuuccacauacagaugauucagguauuuguugugaaguguuccaugggguaauauuuugaggcugugugacucuccucuuccccaauaaucuuuccccuaauaguuuuaccgucugcgaugcucuugcuuggaacccuuguuccauugguauugcaaacugaugauuuuccuaaugcugucuuuuuccucggaguuuguuaauuggcauucaucugugaagaaguucuccucuuuuacccccagauuuuaaaaaaaccauuauuuaucuucacugcagucucaugaauuuauuuuuuucuuuuuggguaacagcuuuuuugagauauaauucacauaccgucaaauccacucauuuaaagugacacuuuagugggucuuaguguagccacagguaggugcuccuggucaccacagccagggaauccuuguucaauaauuauaauuauauuguuugguguggucagugggagccucuccaggccuaagucucuauugucaccgagaaccuccucuccuguugucccaagccauugcaaucuuaccuagcuguacugguccuugguugauguugguggaaaguguauuuagaagcaauaucuggauaauagguacaucauugcaucuaagcucucauuugaugaguggaaaaaaauaguuaaauggguuauuuauuccuugagauaguccauagaaugaguagggaccuugagaagugcaagcaggugcaggugugagcagucacuggccagcaugugaccccccccccccuccaugaacagggaguaaugcucugacaagaguucuaacaggaggaggagugaggaguugggcaggcugauauugggaagcauucuaguaagugcauaauugccuccagaaucucuuguaacuggaauauucuuuucaagugguacuaaacucugcacuugaggauccugccuagaaucacauacccagaccuuuuuggagcuggaacuccuuccuaucccaugucuaacucuagacagaaguuagaagggcaacacaggugaagcugagguugaguugguuugcaaggcucugagcauuggucucaugugaacugcaagaaagggucgccuugaaacagucagugcuggauaguaaagauaaacacacauaugcaacacacacauacacauauaaauacauauacacauacacacaccaauaacaauuaaagaaaaaaagcaugaauuugagagagagcaaggagggguagaugggggugugauagggaaggaaagggggaaaugcuguuaucauaauuuaaacaauuauuuuaugaaacaccaccugauacucauccuccucaccuguucuuggugacacugugugacauccacuagccuguguacugugaguggugacacugugugauguccacuaagcuguguacuguggguucuggcugagugccagagguaauaagaaugauuguagcgugcacucccugaggcugauguguggauaugaagggacguccuuuugcuugcuuuugcucguggcaucacuuagaaggucucgccucuccucacccugacugcaaguaaaaauagccccauccuuuuagggcaccuacugcaguuccucagggugagauggugcuagaugugggcugcaaacacugaguaaauacaggaaugucccaugcaaaccaauauaauaaccccagguaguucauuucccauuucccaucuuagagaauagcaaauaggccucaccucauggugagacuuuuuaggcauugcucaauauauaugacuuugucaaguugaaguggccccuguauuuucucuaacuugcuugugugugucugaaaaagccuguuauuuauauuccauuucuuaaaauaaaaaauuggagccaucaaaauuggcaagcguuaagcaugcuaauuaguucaauguacugaccaauucucugaauuauuaguucaaaggagcguguggacagggaugaaauuagauuuaggcguuuuucacucugguuguuuuaggauccucgggguugcuuugaucuguaaauaacagcuguuucuucaugcaugguucaggguacaugaaacacguuccaagcuguuucucagacuugggacucaucauuaugauccuaaacuggacaugcacacuguaacuguagcuccuauagaaaugccagcuugaauuugggaacagaagugaacggauuuuauucuuuauuuuguguuauagcauaguuacaagguaccacauaaaguuugcucacuaacuaccaaaauauacugacuuccuaaauaucacuuuucauucuaaaagcugagaaagcugugaacacauauagauuauguuuguaccugugcauguuuauaauuuuauaaacacauagaaaguuauucauauauauguguguguguguguguguguguguguacauacauacauacauauaacuaaauauuuuagacaucugcuuugugaagauuaccaugcuugucuugcuugguaaguauuuauuuaaauuuaagaauuauuugauaacuagaauuaaaaaucacaccuaggcuacuucacuucaguacacaaaaguguauuuugcuuaguuaucaugacuuguaugucugugguccaugugagaagggguuagaacugggaggauugcuuuaaggaagggcaggaagugaaugggagagagugagagggaagcaaggcucaguccagcugcuauggugugcagcgaagccaggugacaggaaugcagcaagugaccucugcagccuuccauuuacacauaauccuagaaacgauaggggcugcggagcugagagcaguuaagagcgcacugcucuuucugaggacauguguucauuuccuucacccucugcugacaccugcacaccugggacacaucuacauacacauaauuaaaaaauaaaauagaaucuuaaaaaaauggaaauugucaugucucagguuaauuuuagaagugagaucucauuuuauuuaguaaagccuuucuguucauuacaaacucugcaggauuuaacagugcguuccauuuguggcuuuucuuuacuguucacugugucaaacaucaggaagcagaguccacgcgcugcagugauguaaucugcugucuguggccucccagagauguccagucauccggacauuggucgugucaauuuuaagaugguaagcuguaacuugucuuuguaguaacgcuguaggcacauacauagcacucucgagugccccgcugccuucacacugcagugcggagugugguaguguugggacugugugguccauagagccugagcuccuuauccggcucaguuagaaaguuugcagagaccuggacucaauaaucuccaaaguaccugcugugccuugaguggguuuccuuuuugguagaaccccuccuuaguuccagggcccaaaggucuuugccauugccagaggaaaugcccaucuccagguguggagccugggcccgcagcaucaccauuaccuggggacuuggcagacauauaaguccuuagcuuuugccccagacuugugaaucuggaacucgggggaugggaucaagaguuugcguuuuauccccugcaggugacccugagccuacugugagaacagcuggaucuaagacacugagcucagggaagagauuccccugugggguagaggcucaccuggugcuuacagggcucugugccauccaguucccagcagagcaaaacaaacagcaaccaaggcgaaucccaaacaagccagaaaugaaggagcagggguuauaguuaggguuagggucaggguuguaacagagcuggguguucuguuuugaaauaaagaaauguuggauaacauugcuggaacucgggagacaguuuuuucaucuuuagcaacguuucugucaugaauugccgguuuuuaacaaaauuccuggggccugugucaucuugcacagguuuuuccuucacacgcgaguguguggauuguuuugauguuuucauguuugcgagccaggcacuuggcucacacucagcccuacccucucuugucaccuuguggcuguuaauggacagcaaacaugguuaccuucuucaugaaguuuucucucccccuuccccccaaucuugguaguaggcuacuuagaauuauuuuaaagcuaaaugauuuuaaauaguuuucaagauaaaagaauuacaugaggaauuauuuugauuuuacagaaaauacuuggaaaaaagaacauuuagccagccuuccugcuguggcuggauuucuuacuauuuugagaaggaccccguggaauggacuuuuuccucagugcuaaaacccagcagaaauguguucuccucagaugcggcucagggagaggggagaagaauugcacaugucaggaaagcgccccaggauggcauuguuguguggagcauugcuuucaucucugagauaucucacaccugcuucauuuggcacaguguucccaacaaccagcagacagccugccagcccaaccccaggcuugcggaagcuaacaaggagccauagcaagcaccagugcugucgaaaagcccaggguacacaaacuuuuagguacuuuuuacuuuauugaaaacaggcucccguguguguguguguguguguguguguguguguacaugacuguacauaaacacacaugcuaucuggaaguguaugccuaugugaccucaugugugcauacuuaggcacucucuacacuguuguauauuccaagugauaauaguccuuugcaaguguuucuaagacccaugugaaccgccugucacuagacuuccauaggcugugugguacacuaguugccugagucuucuuucucaguauccagugugaagggagguacacagguguggcgggcaugggcucacauaggcagugagaaugacuauguuagauccucuggacugcuuuucuucuaaggaccugauuuggacuuuuagacugcagugcuugugccauacuguuuauuggacagugugcuuauuuaaaugucaucauagcuguuugugaaaguccuggagagguuuccucgugcugguagauuccggaaagggacuguuuauuugcuucgcuuuuucugaggauggaaucggacuuuuuucacauuuuaucgaugacccauuggcuauccccaagccagcuccaguuaacaauaaucguauuuaauauuuaauaaauugccaggcuuuggagccaucuggaacuuuauuuucucugcacgcagcaucugaguuucagcuguuagccuuucuccuuugcucugggaagggucaauugcuuuuaaagucuuugaugcuugcugugucagcccuuuucauauuuucaaaaugcccguguaaaagggcuuuucauccauucaugcugauaauucuuuugaacuugagguuugaaccaaacuaaucaaauuuaauuauagcucaaauccuguuacagugaacuacaguagacuuccaggcuguuuuuuuuucuuucuuucuuucuuuuuuuuuuuuuuuuuuuuuuuuuauguuacacuggaauucagccauuaccaauauuacauuaagcaaccaggccauugaccacagugugaaagacccuuugcagugaccaggcuuuuguuacauugacaugguaauaugauuugaaccuuuuucuuuuuaaaggaaaucaggaauuagucacaagcaaauuuucuuuauuugcauaauuauguaaucuccucauaucauacuuagugguuucaacaguuagcacccagcauuaaaaucugagaacuacuuccuuuauuuucuuuuauauuuuugguuugggaauucuggguuguuaacuuccuccauuaucugcuccauaucaaacuagauugacuggcuacuguguugggaguccgaggacuccgcucugcucucuuuccauuugccaguuguuuuuagguguguuugaucuacaauagcgagggacuugaacuguacuuagugugguguuugaaugaguucuccaggugguggaauuguuuggaaaggaccaggggguguggccuccuggaggaugaaagggauuuucuuagagaaggccuuggcuuuguuguugcucaugcuuauuuuuauuguucuuaagaucuaaaacucaguaaggguuuccaucugucccuuuggggauggcaccauggcuugugccgugucccaguguucugaaaaagagugccuuuccuauuucauuaaaaaccuaucugggacaguagcauuuacuggagagaaaauggaagaagucugauaccacugugaacuaacggagcaggacuugugcugacaugccugaugcugccgugauugcuggccagcaugcaugcuuccacuguaguguccuguuggucccaucucugccuccauggguguugggggcuuuccccagcacuguguagauuuuauuuuacaauucacuucuggauuucuaagcauauuuggggauaauggcaauuuaaaauacucuaaguuucuuuucaucuguaaguaaaagccucuccagguuuaguauuggaucaaucuuaaggugcaagaaucaaauggcagauuuacucucuccucaggauauuuaaaucugaaauguacaguagagcuuauuuuuagaagagaaaaagaaaagcgaaaaucaguacucuugguaagguggaaacugacuuauuuugaaauuuuuccucaaaauugccacuuucugugagucagucauggcccugccuuuuguuuuaaagugagugugaaguuaguguguauacuggcugguuuuguaugccaacuugacacaggcuggaguuaucacagagaaaggagcuucaguuggggaaaugccuccaugagaucagcuguggggcauuuucucaauuagugaucaaggugggaggaccccuuguggguggugccaucccuggucugguagucuuggguucuuaagaaaguaagcugagcaagcuagaggaagcaagccaggaaguaacaucccuccauggccucugcaucagcuccugcuuccugaccugcuuucguuucaagccugacuuccuuuggugaugaacagcaguauggaaguguaaguugaauaaacccuuuccuccccaacuugcuucuuggucaugauguuuguguaggaauagaaauccugacuaagacaguguuuaugcuagguacuuugaaauuugagcuuugcucugagcggcaguagauucaaaucuuagcuuagcucuaggguuguuggcugcaucucccacucuggcuggaggacagggcugugucaaaagaacacaguagugugccuuugacuguagcuccagggagagugaaugacaauuuaugugaacuggagccugugauuggaaaagacaaacuuggacucaaagggacagaacugugcugggcacagaccauuucccgagagcgguggcgagcguuuuuuugaccagccacuucuaguuuugccccagagaacccugagcucaccuuccaucuguuucuugucugagugcugucauuuaaacucgaguugagggguuggagaguuauucuugcaaaagacuuggguucgauucccagcacccacauggagguucagcacuuccuuagguaccaugcaugcuugugguacaugggguacauucagggaaagcacucucacacacacacaaaguaaagcaaaucugaagaaaaagaaaccuugagcggaugagauagguugucuaugguuacagagucugagagcuauggagcuaacugucuagaaaugccuauagaugcuugcgugagaauguuuggaggugcuagaagacaggcucugaggucaccuggcagggugcagaucucagcucaacaccugacaccuguguggccuuaggcaaguuauuucaacugucuuuucucucucucucucucucucucucucucucucucucucucucucucucucuuuaagauaagaacaaaacaaugccuaccugagaauuauauauguucacacguguggggucucaggaguucacacacaugaggggcucaggagagugcccacaagaucuguguucauacauguuggagguucaggagagugccagcaacauauguguucacacacaugaggggcucaggagagugccuggaacagugcucugugugggccauccuguuuauuauggagaugcugauguuccuggcagucccugaagagcuuccucucugacucaccacucagccccuccugaguaucuccagagugccuuguguguccagccguacuuauccaggaucuuuccgagaugggcucagccccugcaggcugccaguucuuggggaacugccccagggccugaguguccaccuuccugcuauuuugaucccuuucucgcuggagccaauugcucucaccugugguagcucucaccugucuacucuguacucuauccuuccaucagccccucagucagugugugaguguguguguguguguuaaaaguggacaaauaagauucagugugugcccuaucuauuccagaacugugcauguugcuugcuaagaggaaaauagagcuuaaguugaagcccuacaccaaaagugaugagaacucaagacacaagacuugggguuugaccagacuuugcucuggagucugcgaccacucuugaacagcuuuccuagucagugggacgaggggcccgugagaauacagagggauaccuguggcucuccagcagggcgucaggaccugcucgcuuccccauggagugggagaugcuuagcagcauccuggccucucugcacuagauguagggaaacccagauauucuggguggcuggaagggcccaggcugaaccguccuuggguugaaagugacagcuuugaagacacaggaagugacaguuauaauggaguauucuuaugugucaguugcugugacuguuucuagugcuguuuuaaucucccccuccuuuuuuuuuuuuuuuuuuuuuuuuccguuuuucgagacagcauuaucucuguauagcccuggcuguccuggaacucaacuuuuguagaccaggcuguccuggaacucagaaaucugccugccucugccucccgagugcugggauuaaaggcgugugccaccacugcccggcuaaucucccccuccuaauguaacuguacagcaugcaggaauggcuuugucgacagagcugguagugauaugucucaugagaucauaauggaugccugcugucacagcaggcagucacaguggggaaaugaggugcguugccuguuugugacguuccugaugucaggaaacccuguaugggucagguuugaguuacagaaacaggauacuuggccuaauaaacugaagagagaggauauguucauuuugacucggcgucuugguccaugguugcugaucccuuugcuugguggccuguggugggguagaauuuuaugguaggcugcacacagugagugacucacuuaccuaguggcagccacagacagacaacuacuggaagagcuggguagaccccaguggccugacuuuucuuguuuguacugcucagaaggaaggugaggguugaguguuguuuccuauguauacuggcuguuaguaccgcagccucggaggacagucuuucguuucaguagcucuuuuacuaauuagguuuggguucuuguuuuagguuuuugaguucuuuguacagauguuaauucuguaucaaauguguagcugguaaagauuuuucucucauucuguaggcugucuucaugugauugucuauccuuugcuguauaaaagccuuuuaauuucaugaagucccauuugccaauuguugacucuacuccuccuauuccucucucuuccuucuccuucuucucuuccuuccuucaccuccucuuccuccuccuccucuuuuuuuuuuuuuuuuuugagcuagguucucucacacagcaggcugccucuaauucaucauguagccaagaaugacuuuuugaucccucugccuccaccuccuaagugcugggaucaugagugugggccauugggcucaguuuuauuauccugauagcgugacauuuucucucuauuuugucuuuuuaucagucucagaguuuccagucuuaaggucuuugguccauuugggguugauuugugugagggugagagauaaggaacugguuucauuugucuacauguggaugcucacuuuugccaacacuguugaagagguggucuucaaugggagguuuuggcagguuuguaaaaaugagguaauuguaguucuguuuguaugugggugcuuuguucuguuccauugaugugcgugucugguuuugugccaguaccaugcugcuuugauuaccaugucuguaguagaacuuuggguuugggauggugauaccuccaacauuguucuuuuggcucaggacugcuuugacuauccaggaucuuuuaugcuuucauauaaauuuuaagauuuuuuucuucuauuucuaugaagcaugauguuuacauuuuguucgugauuuuacugaguucauuuugggcaaaauagucauuuucaaaauauuaaugcuccaauccaugaacacaagagauuuuuccaucuucuaguaacuuuuauuuuuucccuuccuugcuguguguguguguguguguguguguuuauguguacauaguuuauugaguauacugaggaugacagcaggcuaggaaggaccuaggguaccacugcagccucuuucguuguuuaaugauuuuaauguagagguacuuacuuccaugguuaguuuuauuccaugguauuuuuaauuuauuuuuuaaggcaauuguggaugauauuuauguuuauuucguucuuucucaacauauuuguuauugguuuaugggaaggcuacugguuuugguaucuugauuuucuguccugcaacuuugaugaacauauugguaagauguaaaagugugcuggcgcacucauuaggaacucugugugugugugugugugugugugguguacagacgcggagacucucuucccuuccuguuuguaucucucucacuccccuuuucuuuuauugcucuagccaaggcuuccaguauuguaccucauaaggguagagaaaguggacaaccugucauguuucaauuuuaguggaaauucuuugagguuuuucuuuguuuggauaauguuggcugugaauuugucauacaggacuuuuaucauguugaaauaucuuccuuaaauuccuaguuucuuaaggacuuuuaccaugacugaauuuuugucaaaagcuuuuuauguaucuauugagaugauauugacauuuccaucugacauaauauuuuuauucauuugguuauuuuuuaaaaaccaugugugcucuaugugguguauauacacauuuguaugcucacacccaugugugucuagaagccagaggaggaucuuugaugucuuguucuaucacuacuguacugcuuugagguagggucucuccuccuccucuuuuccugucccugucucugaaacucuuagcuccaccuccuuuccccuguccaaucacaggcuucuuguuguguuaauauuuaaauuaauugagggaaaauucugcuucaccuguuuuuguguugggguaaaucugugucuucaccucucucagugcuguucuaugagguuggaugcaccuguguuuggcauguuuaaauauguaagguccucuuggguugauggggcugucuuuaucuuuucugacuaaauuugguuugagcuuuucuuuuguuggaacucagaacagcaaccccccuuguuuucuagguccauuuccucaggaugccuuucccaaccuuucacucuaggauuguauuuguuuuuaauaagcuguauuucuuucagauaacaaauagauguaucuuuuuuuauaauucagucugcuagucuguaucuuuuaauuggaauauuuauuaauugggguauuaauauucaaaguuguuauugggagagauauauuaacucuugucauuguauugauuuuuuuuuuuuugcacuaguuuguguuuuccuguuuuuugaagugggaacuuaaaggauucuuuggacagucaguuguguuagaugguguuuugcuggggcaaacgcguaaaagaguauuuuccuaaaguggacaccaguaaaaggcuaaggcagacccaugaagaaacuuucgaugaagcagacaugggaaaaaggaugauuugcuaaaguaagcacauuaaagggcacgugaugaaggauucuuuguuaacaacacccuuguacugaucugccuuacauggacucuauagaaagaaaugcaccaaaaaagcccuguuggugugccucggcuucuugucacuucugcagacuuggacugauuagcagagugaugucagcugagacagacacaugugcugagauauaagaccucuggaggacacacgauguuuggagggaguuuaacaagaacucguuggacagugauggaggcugagcugggcaagcuuauagaguuagcuguguaaagcuuguuagucuagagucuuuacugaucuuugcuuugcugagagaggcacagcugagaacuucuccuggccuuccuccuggucccuccugcugacuuguguggaggcugaggccuggcugucucugcuagguagugccacugcugcugauuccuguuugcucuuccaacucuccugagcuagacuauugguguacccacagaguguuugugaguggaucaaacugcuguugcuaaccuuugaacugaacugucaauuuccagacaguacaggcaggaguuguuccaaagagccauuucuaaacagguccacuuucccguauguuuucuuuuccacuaccucuggugggugaugggcuagcagggagguuaaagcauuuaagaaccaucauuaaaaauaagguuugaaaaauuaaaguuacaguuuuuauucuuuacuuaugcaucacuuaguuuuuccuguauccugauaggaagccuggaguuucuucaaggaucuuuaguagucaugacaccuucagcuuguuugcuuguuucuuuuuuaucaugaaaggucuuuuguuuuuuucaaucaugacagauaguuuuguuaagcauagcagucuccaucagcaauuacuguuuuucagugcuuagagauucaucauucaguguuuuccuguuuuuuuaggcuauguugaggaauaugcuguauucuuauggguuuauuuaugacuugacaguuuucucuuguaguuucaauauauuuucuuuguucucucuaguguuuuaacuauaauaugaugugggauggcucuuuucugggcuugccuguuuguucugaaugccucucgagucuggauguucaucucuuucuuaaguugggauguuuuccccuaugguuuuccuggacacauucuuuaucucuuuaggcugaaguucuuguucuuucaagugauucauaaauuagauauuuuugugcugugccauagaacuugccugcuguguucauauuuucuuauuuuaccuuuuuuggugucuggaucucucagcaguuaagagcauuugaugcucuugcagaagaucaagguuugauuuccaucauccacccaguggcucagaauggucuguaacuccaauuccuggggaucugguccucucuucuggccuucacaggcacacaaaauaacacaaauaacucuuuuaaaauauuuuuauauuuuuacuuuguuuauuuauguguauauauguguagaugcugguggaggccugaagagggugucaggucuccuggagcuggaguuagaggcagcugugagcagugguccaagaugugagugcugagaaccaaaucuccaguucucuucaagagcaacgagugcccucuaagccgaaucuccagcccuguguuugccccuuuuaauuagugcugugcauggugacaccggccuguaaucaucacacucaggagacagcagggggauugagacgccaaaaccgucccggcuacauagugacacacuaucucaagaaaagagaaaaacaacaaaugaaaccaaacaaauguauucccacugguagcagcaacauaggaacaauacaacaaacaacaccgggaacaaaacaggcaguggcauugaagcucaguggucuggcguaccuggcauacaaggucuaggugugugguacugcacacuccauggacaacggcaucagccucuuaucagauguauggcuuccaaaacugucuucacaguucuuuuccuuuucuaauaguuuucuuugcuguguggaagcuucugaguccagugugaccccagcuguccucacuguguucuguccucacuguagggauuuguaugucagcacuggucacuuuuaccucagcagucaggaaccaugagaagaucaccuuaaacauaggaacaaagugguagaaagcuucuguagggaagggcaaacauuuuuacauuuauuuaaagaagacaggcucuucuuuagcccaggauggucucagacccucugaggugagguagcuccugacccccuuccuccucucccaagcgccaccauugcaggugugcaccgcacacccagcuuacuuuagaugaaugccagcauauacugccaguuaaccuuccuagggcuuuucaaauagaucauaaucgucugccuuucacaguggacacacuuugugcaaguguggucuuugcacaaagagcacguccacuggcauugacaaggaagacacauucucaggcccugccuaaaguggaaucacauaggauccugcaccuguguaugaaccaggccugcaggugguucugcagcugccaaguuucuccacuuggaguccuuugcugguccuuauagcacccuaggaaauucuagaccuuggcucauuuggcuguuguccugguuggaaggcacucuucagccccagacccucuggagucaugcugguuugcuggguugcaucccagcugagaguccugucagcagacauccugucucucaaacaccuggaccaaaaugaaccaggcacacuggcuuacaggguuuguauugucaccgauaaacuaugaaggugguugugggaagggguggggcauuuugagaugaucuguauuugccaugaagauauggcagagaaucuuuuagaagggaauucucugcauuaauauuaacucaccagcuuaaugcacauuuuaguuuuguuaaaguguuauaauacauuuucucauugagauccauguuuuuccauuucuggaauaaaaauaggcagucggcuacaauucugaucucacugcuacaaagcaguuuucucagcacacccccuuccaccacagaugcacuuuuuagugauggcauuccaaagccuggugacagaggguguauuggagugagugucuugcuuuaacagacugcuguggcucuauuuguuucccauaauuuucugcauguuuauuucaaaugaaccauaaaaugacuuagugccaacaugugguuuuaauaacaaauaaggguuggcaaaugaguguugacuuagaauuuaaaguuuuauacaucugccacgacuaaccucugagccacuuuguagcucagcccucagccuguguuaaguaauuuaucaguaacaauuuggauuuuuuucuuucugcaugucaguuuucugggagugccuguucauaauuggaaaacacuuaucaauaaaccauuuuggugaaacuucauaauaaauucauuccuugucaaguuuuaugaaauaggcauggauuucccucagggauccuuuuuguucucuuuuugaauuauuauuguuuauacugcaucaaaacaucaauuucaaaauaaccaaacaugauaugauaaaaauaacugcaaaguuccuacugaaaucauauuugcaucagagcacguugucauccucucugaagacaaggcacacaugguugucucuuccuucuucccucucugguggcccaggguucauagcuguucugugucagugugccuguccucugauguguaagauagacaugagagauggagagguugcaagugcugaugugugggggugaugagaggccagaucagauuugaauguccugcugugaccaggccucaacucauuaacuucauguuuaaaaaucgagauugcauuaaugaaaauauucugguguaagaagaaauaauauaaagagcuaaaguaauauucuuuauuaguuaccaauguucauuuauaaccccaauuuuauuuaccuuauauuucauguccaugaaaaaccuuuuuuuaaaaaaaaaaacucauguauuagcaagggggaaaaacagauuagcuaggacccccccacacacaccaaaaacaaaacaaaacaaaaccaaaacagauuaaauuuguguguacaagaucauuaacaguguaacuggagugggguuauauuggguuuguaaaaccugcugucucaaguauggcugcagaagaacaggggccucuuguggaaaagcagacauccuguagaguaaggauagguguggcauauguguggaccagcagaugaguuuggaaagauuagugacauucaaacguuagacugcggcaccucugaaggguucugaaugguguggcagugaccuccaggaagggaaacuucagaguugcuuccgggcauuuaugaccaugggcuucuuuuuagucaacucuucuuucaaacagauaaaaggguuuugagagcuccaaugucuuccacuuaaaauagcuuucuuguuacaguagugugaucugcauuacuucaugucguagcuuuuucuuccuauuuucugaaaauaauuugacuguauuuauagcaugguuauuccucuuugaaauaucuguuccuuuuaagcugguuuuagugagcuguuauuuucaugucuagggcacaugcucaucucauggcuugugaguuuucacagucuuccagccuggcugccucauguaagauggggauguugcacagguaccgcuaagcucucuacgcagcaggucagacggccuuuuaggcuuugcaugccugaccucucuguuguagcugcuuagcccugcugggcagcuggagagcagagacagugggugcacagaugaccgacuggcuucacaugcuucacucaguggcagccugggcuugggaauguuucgucaccaccagauagcuguccugugcuccugucccacuauccacgcuccucuuaucaguaccuuaggcugaggguguuugaaaauggauugguuuauuuagacaacuugagcuguaaggaauuagacuggaggucuuuugcuaucuggcucuuguuacuguugcccucuagugguuauuucucggguccauuucuccggcagguaaagaaacaccuggcgagaaguuugcagucccagcacacagccaggauauauugaagcagaaagagcacacacaguauucaaagacagacuccuguaagggacggugggggugcuccaguucugagggguggucuggccucuuauauguccuauagaacgggacagagcuaggucugcuuucuccuucuugaauuggacugggaaagauuccauuuucugauuggguagguucagcugagaagcaggaucuuacuggauaaggcagguuuagagagaucugcgauuucuccagagaaaaagcugccaaagagccuuucuuuuggacaagaacuugggagucagccaucuuugaucaaagugaaagcagucagaggucagcuggccugauccaggcccuuucccuagcugucuaccuauuuaggacuuaagugccuugggucucugcuuuuccaguucugccccuuuaauacagagucucaugcuguggugaccccaaccauaaaguuauuuucauugcuacuucauaacuaguuuugcuacuauuuggaauugugaugcaacuauguguauuuuucugguggucguaggugacccugugaaagggucauccgaccccacagggguuguaacccauagguugagaacugcugcuuaaacucuugcaucuuucuucggcuucacacauuguuuggauucagucacacaugcaacaguugccucuuccuuuagguuguuaagugguguuuaguugaguaagaugugaccauuggcucaucuguccccccacagguagacauuugggcugucagcuucgggcccagguuaguaaagcaacccuguccauuuuucuacaaucuuucuauagauauuuguuguaaguaccuaguggaguaagugguuaauaugguauguaaacuggacagccauggugccugaaauucuagcgcuugggaggcugagucugaggguugcuacacggggaagcuuuguuuaaaaaacaaaacaacaaaacaaaaacaacuucccugagugacuuggucacacuagaucuuucccagccauuugagggcucuaguugcuccauguccuugccagugacagguauugccagucuucacaacucugagcuuucccgcuccauuaugcagucgccuuauuucuuucuugcuuggcuucucuggcucagcucuccagucuaacgcugaauagaaguggugaacacuggauagaacucagaacagcuugcccauguccccagucucuaucaaagguacagucugggcuuuuuguuaguuuguuuuugccauuuacuguuauaauagauauuacuuucuuauauauauauuuaaaauuuuaauuuuauuugaaauuguuuuaacauuucuuaguguguguggcggggguggggguggggacgggguggguggggguuagaggacaacuuauguagucaguucucauuuuccuccauuuugggccccugugaucaagcucagguugccgaggcugguagcagacaucuuaccugcugagauauccugcugauccuuauucuuauuucuuaaggaggagaauuccuuauagucugguagguauuuuugcguuucaugauaagcauaugguauuuucaggaaccuuucccauaucuauuguagugacuacaccagcgcuucuucgugcugcucuuaacuacaaacugcgcugaugucaggaagguggagcagcuucacaugucuagaaugugcuucacuacucgugaagugaugucaggguuuguaauuugggauucagucuauaauauuuggaguuuacccuuucuuuaagggcucgggaacacaguguccccaugguuuccagggucccucucagcacagaaucugggaaaacaugucucccugaggacagugugagucuuccacaggccguccuugugcuuaccuugucugcugagugagguggaacuggagggaauuguugagaaaccaacuuugcugcaggggaagagguuuggguguuagcgccugcggacagugagcagucagucuccaaaccaagugucacaucuagcaugcuguguccugaugggaccauguuguuucuauuggcuucugacguggguuucaaucaugccaccucagaugguccuaugacccuaucaggggauuggucuccggcucacugucuucuuugcuuucuccugagcucacagaugcccauuguggagaugucucauuuccuccuuuuuugcaugucgacucuuugguuuugauuguuuaccuggggucagcugaggugacaggaauagcaagaagaguuagugucuuuccuguguucaaagucuccaccgcucucuggagcaaaauucgaauggcaucugcuucacuccugacagcaagggcaucuuuguugccuuucaccuuuagcugccucugcccuguuaucauggaguagcagguacuuucccaauguacucaaggcccucaggggccuagcacuuuguaauguggaacucuacaagaguaccugggggcaugguacuuugggaggccacagccagaaagaacagucuggucacacaggaagcaguugacuauccccuucugcagcuuucagaaugucacaugugccuuuugugcuuggugagccacagacuucaaccucacuccucugcugcaagucaggcucugugcuggcacuguguauaaccccauucaugcugcuuacagcaaagugcagaccugggagcacaugucacagcuaaggaguuuaauacugcaacccaguugggccucccaggcgaggaguuuuuuucaaauugccaccccuccgcccuccauguugaauuugcuagugucuuaaaacagaaugguuugaauauguccagcucuacagcuacuuauuguauuuucaacaucaucucaguggauuccaagccucaguguacacaggccacuccauaggguugugugacagacagauguccuacaggugacugacugcuuaagagaaguauagggaaguuuuaaacagacuugggcaaauauuccuuuagcccccuuccuuaagacucuuccacccuuguggugagcucuuucuguugcuguggaauacggccuccacuagcucugcuuuucuuggucuccuuugauauuucuacaguccuagucuaaguguuucucuuagaacaugcaugcauuucuaguuuggacaagacuuaaagcaaauguuaaacaaaaaagaagguggccauaagaaaugguaaaaguuccgaggaaaggugaguucaugugcccuaccccuucagcaaauacucuagaugagguuucagaggaaaguagcuggauacauggcagcuuucuuaacuaaaccauuuacaguuguccauggggaaaaggugcuaugcagaagagaaaugucugccaacaaaguaaaucuguucuuugccccuuauccuugccuaccucccaaugugauguuugaaccaggcgugaguuauucugaauaccaugaguaggagaaggugccguccuuacccaucuguacucccccgcucccggauagcccagggaguccacgguauuguugugaaagugccauggaauuguuuucaguucuaauuccugguggucuaauaggaugcaaaguguuauuucaguuuguuuguuuguuuguuuguuuuuuugugguaucuguugagauuugcuuuguguuugaguauguggucaguuuuggagaaaguuucauuagaugcugagaagguauauuuuuuuuguaccuucucaaaagugaaguguucuauaaauauuagguccauuuggcuuauaacaucaauuagcuccagcauuucucuguuuaauuuuuguuuugauauucugucuguuugugagaguggguuauuaaauccucccgcuaucaguaugugaggguccauaugugauuuuuagcuguaguaguguuuccuuuaugaucuugggugcccuuguguuuggggcauagauguuaagaacuucagugucuuccuuuuucuuuucuuuuuuuuuuuuuucuuuuugugaaccuucauauuuuuuauuagguauuuucuuaauuuacauuuccauugcuaucccaaaagucccccauacccucccccccacuccccuacucacccacucccacuucuuggccuuggcauuccccuguacugaggcauauaaaguuugcaagaccaaugggccucucuuuccacuuauggccgacuaggccaucuucugauucauaugcagcuagagacacaagcuccgggguacugguuaguucauauuguuguuccaccuauaggguugcagaucccuuuagcuccuuggguacuuucucuagcuccuccauugggggccccgugauccauccaauagcugacugugagcauccacuucuguguuugcuaggccccggcauagucucacaagagacagcuauaucaggguccuaucagcaaaaucuugcuaguguaugcaauugugucagcguucaguaucuuccugauggauuuucucuuugaugaguauauaauguccuucccuauugcuucugauuaguuuugguuuaaagucuauuuugucagauauuaaaauccuaacuggcuuuuuccucgcuguuuccauuguuuuaucuugagguaauggcuacccuuuauuuuaaccuguguuucuugauugcagcaguagaagggauccuguuuucucauccauuuuguuagccugugccuuuugauuggggaacugagagcauugaaguugagcaauacccaugagcagugauaccugauaucugucauuuuguuguugugcuccgccccuccccagccccacuuuaguuuugugguuugggacucuuuguucccuguguuuccuggcugugauuuaccuuccagguugacauuuuuucuuccugugcuuuuugcagggcagaguuuguagacagacccugcuugaauuugguuuuaucauggaaugucuuucucucucuuuuuuuucuguuuuuuuuuccuuagauauuuucuuuguuuacauuucaaauauuaucucauuuuuugguuucuccuccaaaagcccccuaucccuuucccgucccccugcucaccaacccacccacuacugcuuccuggcccuggcauuccccuacacuggggcauagagccuucacaggaccaagggccuuuccucccauugaugacugacuagaccauccucugcuacauaugcagcuggagccaugagucccaccauguguacucuuuaguugguggcuuagucccugggagcucuggggguacugguuaguucauauuguuuuuccucuuauggggcugaaaaccccuuuagcucauuggguccuuucucuagcuccuucauuggggacccugugcucaguccaaugguaggcugcaagcauccaccuuuguauuuguuaggcacugguggagccucucaggagacagcuauaacaggcuucugucaguaagcacuuguuggcauccacaaaacugucuggguuuggugauuguauaugggaugaauucccauggggcagucucuggauggucacuccuucagucucugcuccacacauugucucuggaacuccuugcauggguauuuuguucccccuucuaagaaggaucaaaguauccacacuuuggucauccuuuuucuucaguuucaugugguuugugaauuuuaucuuggauauucugagcuucugggcuaauauccacuuaucagugagugcaaaccauguguguucuuuugugauuggguuaccucacucaggaugauauuuucuaguuccauucauuugccuaagaauuucauaaauucaucauuuuuaauagcugaguaguacuccauuguguaaauguaccacauuuucuguauccauucuucugcugagggacaucuggguucuuuccagcuccugguuaucauaaauaaggcugcaaugaacauauuggagcaugugucuuuauuauauguuggagcaucuucuggguauauguccaggagugguauuagugguuugucagguaguaguaccauguccaauuuucugaggaacugccaaacugauuuccaaagugguuguaccagcuuguaaucccaccagcauuggaggaguauuccucuuuuuucacaaccucgccagcaucugcugucaccugaguuuuugaucuuagccauucugacuggugugaagugaaucucaggguuguuuugauuuucauuucccugaugacuaagaauguugaacauuucuuuaggugcuucucagcccuuugaguuuccucaguugagaauucuuuguuuagcucuguacccauuuuuuuaauaggguuauaugguucucuggaaucuaacuuaaugaguuuuuuguauauauuggauauuagcccucuauuggauguaggauuguuaaagaucuuuucccaaucuguugguugccauuuuguccuauugacaauguccuuugccuuacagaagcuuugcaacuuuaugaggucccauuugucaauucuugaucuuaagaaucuauugguguucuguucagaaaaauuuccccugugcccaugugcucaaggcucuuucccacuuucucuucuauucguuucauuguaucugguuuaugauuccuugauccacuuggacuugagcuuuguacaaggaaauaagaauggauugauuuacauucuucuaaaugcuaaccccaguugaacuagcaccauuuguugaaaaugcagucauuuuuuccacuggauuguuuuagguccuuugucaaagaucaagugaccauaggugugugguuucaguucuauuccauugaucuaccugccugauacuguaccaauaccauguuuuuuguuuuguuuuuguuuuucacaauugcucuguaguacagcuugaggucagggauggugauuccaccagaaguucuuuuauuguugagaauaguuuuguuauccuggguuuuuuuguuauuccagaugaauuugcaaauuguucuaacucugaagaguugaguuggaauuuugauggagauugcauugaaucuguagauugcuuuccaaaaaauggccauuuuuacuauauuaauccugccaauccaugagcauuggagagcuuuccaucuucugaccucuucuucgauuucuuucuucagagacuugaaguuuguaucauauagaucuuucgcuugcuuaguuagucacaccaagguauuuuauauuauuugugacuauugugaaggguguuguuucccuaauuucuuucucacccuuuuuauccuuuguguagaggaagaccauugauuuguuugaguuaauuuuauauccagcuacuucacugaaguuguuuaucagguuuaggaguucucugguugaauuuuuggggucacuuaaguauacuaucauaucaucuacaaauagugauauuuugacuucuucuuuccaauuuguaucccuuugaucucguuuuguugucuaauugcucuggcuaggacuucaaguacuauauugaauagguagggagaaagugggcagccuugucuagucccugguuucagugggauugcuucaaguuucucuccauuuagcuugauguuggcuacugguuugcuguguauugcuuuuacuauguuuagguaugggccuugaauuucugaucuuuccaagacuuuuaccauuggauuuuguuaaaugcuuucucagcaucuaaugagaugaucauaugcuuuuuuucuuugaauuuguuuuauauaguggauuauguugauggauuucuauauauugaaccauuccugcaucccugggaugaagccuacuugaucaugauggaugaucauuuugauguguucuuggauuuggucauugagaauuuuauuaaguauuuuugcaucaauauucauaagggaaauuggucugaaguucuuucuuuguuagaucuuuguguaauuuagguaucagaguaauuguggcuucauagaacgaauuggguagaguaccuucuguuuccauuuuguggaauaguuugaggaguauugguauuagguuuucuuuaaaggucugauagaacucugcacuaaacccaucuaguccugggcuucuuuugguugggagacuauuaaugacuauuucuuuuucuuuagggaauaugggacuguuugguuuaucugauccugguuuaucuuugguacaugguaucugucuagaaaauuguccauuucauccagauguuucaguuuuguagaguguagucuuuuguaguaggaucugaugauauuuuggauuuccuugguuucuguuauguuucccuuuucauuucugauuuuguuaauuagaauacugucucugugcccucuaguuagucuggcaagggcuuaucuauuuuguuguuuuuuucucagauucugguuugguugauucuuuguauaguuauuuuuguuuucacuuaguugauuucagcccugauuauuuccugcugucuacuccucuugggugaauuugcucauuuuuguucuagagcuuucagaugugcugucaagcuacuaguguaugcucucuucaguuucuuuuuggaggcacucagaguuaugaguuuuccucuuaggacugcuuucauugugucccaaaaguuuggauauguuguggcuucauuuucaguaagcucuaaaaagucuuuaauuucuuucuguauuucuuccauguguauuugggcuuucugcuguuuauuuuauuauugaagaccagccuuagaccguggugauuugauaggauacaugggauuauuucaaucuucuuguauuuguugaggccuguuuugugaccaauuauauggucaauuuuggagaagguaccaugaggugcugagaagaagguauauucuuuuguuuuaggauaaaauguucuauagauaaucuguuaaauccauuuguuucauagcuucuguuaguuccacggugucucuguuuaguuuguuuccaugaucuguccauugcugagaaugagguguugaaguuuccuauuauuauuguauguggugcaaugugugcuuugagauuuuuaguaaaguuucuuuuaugagugucggugcccuugcauuaugaucauagauguucagaauagagaguucuugguagauuccuccuuugaugaauaugaagugucuuuccuuaucuuuuuugauaacuuuagguugaaaguugauuuuauucuauauuagaauggcuacuccagcuuguuucuugggaccauuugcuuggagaauuguuuuccagccuuuuacucagagguagugucugucuuugucacugagguggguuuccugcaugcagcaaaauguuguguccuguuuauguauccagucuguuagucuaugucuucuuauuggggaauuauuaagagauauuaaugaaaaaagguuguugcuuccuguuauuuuuguuguuagaugugggauuauguuucuuugugguuaucuucuuuuugguuugucaaaagaagauuauuuucuugcuuuuucuaggguguaguuucccuccucauguuggaguuuuccauuuauuauccuuugaagugcuggauuuguggagcgguauuguguaaauuuguuuuugucauagaauaucuuaguuucuccaucugugguuauugagaguuuugcuggguauaguagcaugggcuggcauuuguguucuuuuagggucuguaugacaucugcccaggaucuuuuggcuuccauagucucuggggagaagucagguguaauucugauaggucugccuuuauaugcuacuugaccuuuuucccuuacugcuuuuaauauucuaucuuuguuuugugcauuuggugacaggaagaauuucuuuucugauccauucuauuuggaguucuguaggcuucuuguauuuucaugggcaucucuuucuuuagguuagggaaguuuucuuuuauaauuuuguugaagauauuuacuggcccuuuaaguugggaaucuucgcucucuucuauaccuauuauucuuagguuuggucuucucauuguguccuggauuuccuggauguuuugaguuaggauuuuugugugugugugugcauuuucuuugauuauuguugugucaauguuuucuguaguaucuucugugccugagauuuucucuuuuuuuugaugugugcaucuaugucuccugaucucuuuccuagguuuucuaucuccacaguuguuucccuuugugauuucuuuauuguuucuacuuccauuuuuagauccuggaugguuuuguucaauuccuucaccuguuugguuguguuuuccaguaauucuuuaagggauuuuuuuguguuucuguuuaccuguguucuccuguaauucuuuaagggaguuauucauguccuucuuaaagugcucuaucauuaucaugagauaugaucucaaguccaaaucuugcuuuucccauguguuaggcuuuuuuuuuuuuuuuuuuuuuuuugguuuuucgagacaggguuucucuguguagcccugguuguucuggacucacucuguagaccagggugccuuugaacucagaaauccaccugccucugccucccaagugcugggauuaacggcgugugccaccacugcccggcuguuggcauuuaauguaggcuuucuuuguaaagcaaaagcucuagggaauaguugggcuggguauuccaguguauuauauaaaagcugccucuguaagcuaaaguaagaauuuuaugcauaacuugcaauugagacaaagggcaaacuguuuaucuauggaaugaaaauuaaauaguccuaacagcccaauaaauucaguuaacagucuguguagucacuuagguuauuuuaauuuuuuuuuaaaaaaaguaauuuuagcaacaguuuuuacagucauuuaagccuuuucaucuauagggugaaauuuaacauuguuguagaaugugauaccuucacauugggaaggaaaagucccaagaagaaacauagaauuagaagacucuaaguccuuccugcuauuccucuuggcuguaucuuauggcacaauaugauuuuuuaagcuuuagacaaguucuuagaagccuguucuacagccagguuuuugguuuugguauuugauuucauugaaaauagagcucuuaaguuucaggauggucaaugucagaauuguuuugggaaucaaaacaccaaacuuaguuucacuucuugugggaauuugacacguaggguggcugacugcuuacucaugacauggacuaguuuuuccaagauuuucauuugucacgugaauccaaacuagugauacugacacacacucccacucccguuuucuugcugaauaggacagaauccaucucuguggugaggucagucccauucagcugcuuuagacagaugcugauggacuuugaguucuaagcacagcagucacuucccaccccaaguucaugugaugauaaauaguugucacacgccugcuaauuccuccaggagcaagugugcggugcacaauaguugacauugccugcagucuacacggcacagucuacauggucuauaccugaaguagauugcauagaggccagcaacacgggggccacugugccccaagugucaccucugcuggcacuuagugugccacacagggcagagaugggaaggcagcagcuggaguccauuggaguucauuuuuauuuuggaaaaguaggcguggcuucuuuugucuuuuuagaauuucaaaaaguucaguuaaaaguaaagguaguucuacugugugggaauuaauaagcagauaaacaugguuagaugccuuugcagguaaaugaguaguuagggcucugaacucagauggucugacucgaguuccuaacuaugugucuuuuggcaagucacacgguuucuuugaggccaucuugcucaucugucaagagagugacaaccucacugauuggcguauggcuuguuagcagguucagugaagcacagcuuacugaggguguggugaugcucacuguaaacacuuccuaaguauugcgaucuuaaccucuccugaugucuguaggugaccugcucccuggcuccguuagguuuauuguagagucugcauggagcaucauucagagcuuuucuucuucaauggugcagcgguucccuccuaggcagucagcaggucucuggagucugccauguuggcaugcuccugcaaguggcucuggacuuguuugcuuuccuugccuucaauccucuccccugacucccucuuccuucugucagucugccacauuccacuugcucuccuucaggccugccuguccuucgucuucccccacugucuucucacacuguccuuucccucgccuuccuugccucuuuucucuugcuuuucuuucucuccauugucuuucuuuauauugucuccaucuuucaccucuuucccuuuuccucccccucauccuuucuguucagcggcucuucugaaugcucacacugcucgcugagagcacuccaccguagcucucacauagagagagccuggccagcucucagugcugccguuacuaugggagauguuuugugucugucucugugucagccguguuucugcucugauuuucucuccauuucacagggcuucacaauguucuuuaugcuccuugagcuugaaguauuagaggaccuauggccaggguuuaucagcuuuuuaaauguguacugcgccugcuuauuugcuuaauacuggucuuaaugcagccaaacaauaaaaugaaacacuguuaauaauccuagguucuuacaauaaugccaggacgaccacugauuuucuuuuaucuaauccgcaugauuucucucucucuccagauuccuuucuccuugguccaguuucccuugugggaauccuugaaaguaaguuuuaaaaucaucaugugaagauuuuucuagugcccaacaguguggguaugcgauggaaaaaggucauagugaguagaaguuuacauacuucaaaugacccgcagcugagagcguuguuccaugugaccucaggcgguuucagacacuacugaggggugugugcugucagguagagccgguggaacugagacgcacgugcuagaagcaucuugccucgcucuccccuggacugccgcuuuucuccacuuaguugaauggugugugagcaugugugggugagugggcucacaagaagagcaaugaggaagaguggaaagacagcaggauccagcccccuccagcccccggcaggcagaaggagcaacauuaggcugggaagcucuggcucuccuucaccucugcuguggaguccuaguggaacuaggagccuugagugacugcauccugggguuggggaagaucacgcaucuguuagauagaagggaacacuuuaugcagugacggcugggaagguggcucagcagguggaaggcuugucacacaggccugacaaucuaguucaauccuuaaauccuacauagaaagccaguaugguaguguaucgcaggaugccuauggugagcugagauggcaacaguagguugggggucugugggcuggaugguguggaguaugcugaggaacguuccucagcaaggugggaggugauggccaacucucacaggucacccucuaaucuguacacauaggcgugcacacaugcauacaugcauagcaacugauuaauuaaaugacuuaaacaugcauaggcauuguaucugcucuucaucauuuggggcaaugguagugcuaggaaugacgugggucuuugccaguauuguaaaggacuuaauaaaaagaguacuacaugguucggguugucaucaucauauauaacaucaguguugcacugugcacauacacuuagagagcuauacugagucuguauguccguaauguagacuguaugucuugcuaggauaauggucaugaaagauggaacauucuuguuucagugagaaggguuuauaaguaaugaagcaggaaaauggcagauuaucaugguaggagucggggcugggacagcucugcaguccagugcuugacuggcacgcuuagaaccccaaauucaauccccacuacugcaagaaaaggaacagacaaaaaccacgccgaugccaccauaauuuuauggcuuugcuaugcaugguguauagaaaagucuuuaaaaguaucauaggaguuaguuuggacuccaaaauaaauccuauuaaaguuguauaccaaagaauauaaaugaauucaaaacauugcucuuuuuaaaagcacuggaagcuggagccggcaagauggcaguugccuucaagccugauggcccacguugucuccaggauccgaucaguggaaggaccaacuccuaaaaauuaucuucuuaucgauucaugcacacacaggcacgugugcgcccccucccacccacaacacacaauuaaauguaguuuuuuuuaaguuucaaauaaacuagaacccuaaagauuuauuacaugugaugauuuuaaaagguacugccccucauuuaauggaguuucagggcccuuuguugucauguuucaauguuuccuucgugguguagggugaaaacagauuccuuagcccauuuuucaaggcgugauguaacagccauccaaugagaaggucacauucccuuagcauacuagguuccuuuucagugugugacaaaagaacagccaggccaacagcacacaagagcccuguguaagcucuucagugagcagcauucacagccugcagggccugacaauaaccagcauucacagacucugcucacgcugacgccccugcacgccgcguccacaggaauguuugcagguccaaagauggaagaaguacgggguuggcucauuucuauccagaaauuuaaggacauuuguagcuaagaaauugcuaggaauuuuuguagaaauugcagauuucuguguuuaaaguucuuuuaaaauuuuaguuuuaguuucauguguugccugcaugcuugugugccugcugccugcagaaaccagaagagaacauuggcuccuguggaacuguagcuacagauggucaugagcagccauaugagugcugggaacugaacucggguccucuggaagagcagugcuccuaacugccgagucaucucuccagucuugauaaaugcaacuguggagugguacauaguguuaguuccccaaggaauaccaugcacacaguaaacaagaugcauccguucugaggguguucagagccacugcuguucucgcaccccagcuuguucauguuagccacuguuuugcauugccuguaagcaggagagugugccauauagcgccccugcucugcuuccuccucauuuagagugcucuugcgucuuuuugccccgguggcauuucagaauguguggcuccauucaguacugauagacauuugagcuauccccagguuucccugguuauucacugaguuucuguaaauauccaccugucguauuuguaugcacauacgcuugcuuucucucucucucucucucucucucucucucucuguuggucugucugucggucugucugucucagaaagcuaccuaggaauggugucgcuaggcuggaaagagaguaugugcuuaauguguaagaauuccgacagguguuuccuuaauuguauaaaaguccauaaaggggugugugugugugugugugugguuuccagugcauucugcauucucaccagcacgggugagagauuccuguucuguguccaugcuacauauucauugauuuaaagaaaacagacacucugagaguuguagacuacugagucaucggaguuuuugauuugcauuucccucaagguuaaauaacaguguacacgccuuccuauauuccguguuuuucuuuaacaucuaaacaugagaucacagagucuuuguggaagcagaaaacuuguggcugguuuuuuguuguuguuguuauuuuuguguguguguguguguguguguguguuuaugguuuuacacgcaaacuugcuuugugucguguagggagauugugucaugugaggugaugucucuguuguguucauguggagacaugacuugggaaacuuucucagccaggacccuagcaguacauaguauguagugagcagugggagucuggacaccacuguccgaaaaauucuuugucaaaaucauagcagucaccuuccuuuuaagcugaguuccuucagcuguccccacuuccguguuagucacagcuaugacacuucuuacccugaccaaccugguagcauuaccucuucuccugggcuuugagggggcagcaguaccgacuuguacauguguagcucaaggcauuugcuuccucugugugcgagcauaggaugcucagcagucucauuggcacccucaaguaaggugucacacggugaccaguucagaacaagaugcccaaccuuuaauagaacccuggggaucauuccagaaucucuccuucacuuaccugagugugucccaucagcaacgccuugcucggcuccagacuccacuuuacccuggcugugccucagaugcaccaccaaguuucccucaggguauuuagagacuuauauuuuuuggugcauagagcaggcuggccuugaacuuggaaugcugcuucaacccuuugagugaguguggaaguuacagauaugugcuacuguguccagcuugguuuugcucugaauucccuaacucccuucuuccccagauggucaggugcucuuugacugaggugagucacaucuuaugcccucuccuaaaaccucucuaaaaccuuaaaaggaggaagaauuucuccucuucuuccuccuccucuucuucuuccuccuccuucuccuccuccuccuccucuucuuccuccuccucuuccuucuccuccuccuccccagccuauucccucaccuagaccaucacucuccgugcagccaccugcacugcucccccauggccccgugcacuugcugggcugugcucccugcugcccugcucacucuggcgcugugcacuugcugggcugugcucccugcugcccugcucacucuggcgcugugcacuugcuggacugugcucccugcugcaugucauuuaguuguucauuugaugcacuauugcuugggugugagagacauuuacuucuacuuuuccaacaagacaagugaugauggucugucuuuagggugugugacacgguguuugaaagagauguucaucaugcugagugggcguuuuccaagggacagagugauagagagcaaaugccuuaggacuggagcgacagcucagcaguuagcaguacucacugcuccuccagaggacccaaguucagugcccggcaccuaaaacgccagcuccaggccguccgacgccguuuucugacuucccucuagccuucacagacguccacacaugcaugucauauacuuauccuucuuauaaacucucuccuaggcuccauguacuccacucuuucccucagccuccucaaguccaguuagucaucacuuaggucuuagacugaauaucacgcuagugagacgcuucccauccacccucuucaagaaaucccccgauucucccugggcaucacagcaccuguguagucucucccuaaccacacuuaccaaaacccaucagcuguaggaugagcagauagcauggcaggcccugggugagggccuacauuuauaucugcuucgcauccugcaggauucaagagcucagccucucauuagacuuagaugggaaagccgggcaugcgagagaccucugucuucaagucagauggauuuauauuugcucauaacacuuuuuuacugugcaacaguaguagccauaacagaaauacuaaaaaccauagccagcauuucuuaaagguacagugugcugggcccuguugugaccacugugcaugggugaucuggcgcuaaccuuuguuucuccucuggagauaaguguuuuauuugucuucuuuuuguagcugugggaagggagggggguuggaggcaggcaggcaggcaggcaggcagagcaugccaaccaguaaggcuugcucccaguuacaggagugcuaaagaguaccaucaagacugaacccaggugucuggcuccagcccugugcuaauccuucugaucacgaagugcgauguccuuacuauuauuuucuuuuucauaugcuccagaguuagugagaguuagucagagucucucuccugaaccccugaaggcaguucuuagggaccacugugcuugugcaaaggccacuccagagcuacccuuugugagugucugugucacguuccccauagcacgcugcaugaagaugaaugaacggugucguucauaugcuucauguucugccuuuugucccggcuguugguaggcguuugcugauuggugcagguuaguauucuuuccugauggaguuacuuggcuguuuuauuuauagguuccuucagaacuauauucacagccauaaaaacauguuuucuuugucuaaacauacauguuuucuuguugaguuuaguugaagaguauauauuacuaaaacauauauugaaaucuccuguaggaaagucaagcuuuaagaaacaaaaaacaaagccaggaacaauuccuagugugggaaucacucccaggucggaaugaauagucuuacauuugcuauaagaaucgcauagcaguaccuacgaaagggaaacaugagccaaaaaagggaagucagcuuacugggcuaagccugcgacggcguucucugcuucuuaggguggaagaggagacgggguugggacacccucacuccccuuacucggaguugugcacaguaguuacucagauauuucucuuguauuucauagguuuucggcagaagcagugcuguauuaaaaccauguuuucaaguuaaaagaguaguaaccuuuugcuguugugauuuagugaucuguaaauauccaccauuaccacauccacggaagcaucucguagagguugaguaguaaccagccauucagagaugcccgggagagagcagcauuuccacacacaggcugcuggcucacaacagaccgcaguacagucaggcugagcuggggcuggugagaguaacguguaugaucuaugcccuuaacuccaugccagcacggaggaagaagucuuaaaauaagaacgggguggcuuuuuuuuucccugaucacugggucuaagaugcugucuucauuugcuucucuguggugagcacugaccaaaaaaacauaggagaagaaagguuuauucucaucaucaugagaagucaggcaagagcucaaagcagggacugaagcagagaccuguugucugacaccauugcugaggagauaugagcaaacauguguucacccgagaucuggaaccaaugacagaccacaguauggauaccaagucugccuugggggaacccguaagcuuuguugugaucguauacagguuuagguaugcaaugugcugugugugugcuauaucucagcagacaucacuaguugaucacacagcccacaucuuaucaagcucacguuuuuggaaagcucagcagaaugcuacguccugugauccaugaugugggaccuacauucuguuccuguuuugcagcguucucagcuaaucuaagaguuaggauuugugaugaauggccaauucacacauucuuuauacaagcuaaagucaucaaguucuugccugcuuuuuuuucuuuucuuuuuuuuuuuuuuuguuuuuuuuuuuuuuuuuuguuguuguuguuuugagacaagguuucucuguauagcccuggcuguucuggaacucacuuuguaggccaggcuggccccgaacucagaaauccgccugccucugccucccaauuguugggauuaaaggugugcgccaccacugcccgguucuugccugaagguaacggucccuuuuguaguugaugcuucagucugacugcacagggcacugagcgagcuucugaaggcugguguucacaguggcugcucugugauuuccuggugcuuugagaugggcuugcccuucagcucauuagcuugauaagcaucuucucugagauuuuuaguuuuaauugucauauagugguuguguauguacaugguuaguuuggcauuugguacaguauccaggcuugugucuuaucccaugagaugucauuuuagaguucuuucuuccggaaacaaaggcaggagcauuaaaacagcugugccauuuguugacucauaggaagcaucaugaaccucaauuauaauuuguuuuaucguaauuauuacucaacagacaucgagaugcuguugugugaauauggccucuucucccuucugccaaaacaaaacaaaauacccaaacaaaacuaauacaaaauaaaauaacauacagaaaggucagagaacuucccaguuagaaugaauaucccaaaagauacaucuacauaauccaaaaaagaaaugucugcauaaacaguguucccuaacucuuacuaagcaagcaugguucuguagccacuucugccuuugcccaagaaugauauuuuuuucuguuuaaggcuuuuagaaauucuuaucuuuacccuucuccccuaucuagaaaggcauaguucugaaagccucagccagcuuaaauucaguauuuuacucaaagaucaacuggaaggagacuacugcuugcaccucccacccacagcaucacccagccaccaggacaaccagucagccugugggcucuggaugauuccuacugagcagcagggugccuccagucuucauugcauaaacucuggcuaagccgucucuguucgcccacagccacccagugaugccuccagucuucauuacauaaacucuggcuaagccgucucuguucgcccacagccacccagugaugccuccagucuucauugcauaaacucuggcuaagucgucucuguucgcccacagccacccagugauacugcugucuugcuguuguguuuucuguucuuuuugguuuccaaagcuuauuuugaaaccuuugccuuacacauauugguguacgaucacuucacaagauggcuugucugacugaauaggacagucaugggcagcucucagaauggccuugggaaugcuuguguaaggcuacacaguagcuuggucagcuuccguaagcgaacauguccaggaaguggucaugugcuagcucucuguauggcaaaaccuguugguggguucacagcugugaggcccccagagcugauugaucccaagagcuaugcagauuugaaaaccuccauguuaucuugguugucuggugguauuauuuugaaauuguauagaugacuuggaaaaaaccuauuauguacccaugaaaaccacauaguaaaauuuuauaaucuuacaagacuggaaggcagaugcguccuuuugaauagacagcuuaaaagucccacguugugaauguugucaggcuggagcuaagucacuuuuuuucaguuugccuuucaucagacaguagcguccauguggguaggucuuuagaagugaaaaacacaaggucuucauggugugcucuaauggaagguagcugcccucacuuggacuccauccauuucugacacugccuauuuguaccaagauuaucuaugaauucuguuacuggaguuugcugggcugggcuggggaagggcgagccagaguuucucacauuguucuuccuugcauaggcuuucaaccacggcuaaaagcagguugugguguaugccuuuaguucaagaccaaccuggucuacauagggagcucuagacaaaguuacaagaugaaacauuaucugaaaaaaaaaaaagugagacgcauucaggaaauggaaacagcucaguuaucuguaaagcagugccacugaguuaccacugggugaaaagagccaggcuaaugucuguagcuugcauacuuauagacaguagcaauucuugugacauugcauuaaaggccugcacuuaguaggggcauacugauuucuguagucaaguuugaucauuaaacuauggaagcuagugggagaauacguagggacucugcuguuucagcaacucucuuguaagucuaaaauuauuuuacaauaaauuuguuugcacacgcuauuagaaauguuucuaucccucucauaauaagaaagguuuaccuaagggacacuggagacguuaaacacauucugauggcuggucucaacccuuaaauuuaaauuucucucugauauaaaugaaugucuacauagucaucauagaacuucauuuuuauuugaaaagaaaaaggaaaaaaaaacccauggaauagauaucaggaugcaaauaccugagauauguggccuucuguauuuuuaaauucuuacuuaacuucaaaguugagacuccgacauugauuguucauguuuggaccccuuucugucccucacucgcucaccuccccugucaucuggcugcuucagguccacuucuguggcagugggaguauucacucaagcugagaauguuaugggagcuuaaacugucugcauaugcauucagaaaguuucuucaggcaagaaaacuaaacaucaaaaaagcucuguuacagacuacaacaauuaagcauuauuggcgugaaaccuucuuucucuaccauuugcuugaugcacugugacuccacuggacauugugcggcggccguggcuaaccuggagaagcggcacacagacaguucugacugucacaauauauguggcuuugugcaaagcaaaacaagccaucugugucagcugcgcaaccuuggaaaguuugcuccacacugcucuuagccucugcaccacacccuuggugguuuguacagaucugggaaauucuuuaauaucccacuugggauaugcuaguuacucagagagcauccaacagcaucagugcgaaucauguggcccacugcugcggcuaucuuuauuuuuauucuauugccaguguggucugaacuuaccuaaauauagccaguuauuuagucuuuuugugagugaucuucccuagcuucccagugaguuauuguuuguuuguucguuuguuuuuguuuuguuuugauuugauuugguuuaucccauccuccuguccccacacauaugagcuaaauuacaacuucaaauauuuuucuaauguauauguaguacuuuuuaucagcacaguuccuacuguucuuacuaacucgaggauguagcauuuguaaaugguucugaucuguuuagauuggucagucucaaaauuacuuuuccaagauuuuauauucaguuacucauuaaaaaaagaauucacuauguagcccaggcuggccucaaacuccuaguaaucuuucuucuaaauguugggauuauaggcauaagccaccucucuuggauauuucaguaucauugcaguggcaacugugguuccuguuguauuuauucuguugcauauacugcucugcuuugaagguggugcaaaucccgguguuguauuggggacacaccacguggucccauucacaucacugcuaggcuugcuagugauuuaagaucuuggagcuucagguuuucugucuaaagaaugacugaacucuaacuguugcacauucuucaggugacuguggugagcguccuauugagugauguguuuaguggcuagaggagucaguugugcuuguugcugucagucauuauuaacacugaauuuuccacugacauuggccucugacuuuguuuuaguuucucuagggacuuaaggacuguuuuuccuaagauuuuuauuaguuuucacuuuauuacaaaaugauuucuuuauaucuucuuaggcuaauuuugccuaggugaagugaaaaguuaggcuugucuauagggauucuacauuuaaacagucuucaaacauuggaaucuauuuugaucauuucuuucccuuuuucuuuguagaacacaccgacaccucuguaaagcugcuucacccaucucucuuuuucaaaacccucuuccuccuaugcaugcaauauauuuauaauauauaguauaucacacacacaccucucauggaguguccuggaaguucuguuguucccuugagcuugcagcacacaccuggaggacaguucugcacauuuguuguauuaugaauuacauagcaccuuugacuucugugaugucuuucaucccguguuuguucuuuacuguugcuauaaaucaagcccgcgagcagcagcuugaguguucggaaucaucucuucuugagaaaaugucagaagauuaauaauugaggaugaccucuucucacuaagaaaaugugguucaugucugcauuucuucuccagucaguauuuuagugagugaugguguuaaagcuggccugcuguuaagggcuggagguauagcucagugcuagaacauguaccuagcaugagcaaggcagacucacgggcacacacauacacacacacacagacacacacgcgaggggggugcaggggagagugugcacacgcagacauuuaacauccaugcuuuguggauaaauacauaacuauuucuacgaaacauaaauguucuuguccuucccugugucccauugcaucucuaauguuuauagagaaauggagaaaauaaugauuuccacagaggcacccauuuauuuucaaacauuaaagcauuuccuaaaaucuaccaaauucugugcuguguagcuuagaacuuuagaaguuuauuuguaccaagguuucuuaaagcuuauuuguuuuccuaaguaggguuaaaaagccuauuugauagguauacuucuaauccaguagauuuaguaaauauacagagaauuaucccuccucauagggcugggaagaaaugaaauaucacacagcagcacugaauaacaauucaguguuaaaagccugaacuugucaaggaaaacagagcucugugcaucuugucuuguuuuuguagaaucaccacccagucuuuagugauccugucacaacccuuccggagggaguugucaguggggaaauaaguacucagacaggagauggaugccgagucagcuguuuuguuuuacuuguacuauguuuguucaguuccccagagaccacucuacuucugggucaucguacuauucuaaacaccuaagauauucaggagcuauguuugguaaugaacggguguggucauuauuucaggacaaggcaaagauaugauguucugauuaaaaaggaaguaggccugccuuuaauuguagagaaaguugaugguguccacacaggagcagagcugaaccauucaguggcugauguuguagaacacaaauuauacacaaucauuuguauugaugaucaguuucuauuagcaaugaacagacagacacugacuauucaaagcaagcaguuuccuuuacauaguucugcaacauguggaguacuuaaaaauaaaucugauaaaaacagggucaaagccuaugaaaugcuagugcagaguuuagaaaaaaauagagaaagccccagugaagggagagaugauuacuguggugguuugaaugagaauggccccuguuggaaguguuugggagggauuaggagguguggccuugcugaaggaggugugucacuggggcugggcuuugagguuucagagaggccaugcccuucccuguucucuuuucucugccuccugcuugugagcucuccauuauugucccagugccaugccugaccgcuccugugcuucccgccaugauauaaucgcaccacauggaauauuacuauugcacaaugcuuagucuagucucuaauugucuucugaagucugugaucucccaacaaccuuagaugauggaucauaguacuucuguuuaggcuucugaggaacagccuugcaaaaaaccucacuuccuuggcuucccugaggaagcaggcacuaaacuucauauauuuaaaguacacaaucugauaaauuuggauggccaugcacacacaaucacugcuacaaagagaccauagacugacuuaagagccaaaaguucuacaucccuuugggaacuucucuccuuagccacaccucacuaucuucuaagcaauugauauuccugccacuaguggcugguuugcauauuccagaguuuuauacaauguaaacccauuuucuuuuaucugccuccucucauaacuaugcugugcuauaucuacaucgugacagagaucagacuucauucccuucuuguuagugagcaauauuccugacauaggugcaucauuucuuuuucuaguuuggggcuauuagugauaauucuacaugagcauuuauagucgagccuuuacaugggaaaugccugaccuccuuccaaauaaagaaauaacuaauaacuaagaaggaaguuguuaggucagaaguaagguacauuuaacuuauaaagcuaccaugcuauuuuccaaaauggcuauacauuuuacauuugcccacuacuacucucccaagcuugguugccagcauuuauaaguguucacacucuaguaaaaugugcaguacuguaucacuauguuguuuuguuguuuuugaauuuaaguucuguauauaugugcaucugucccuuggaggggaaaguaugggcacguggauauagaugcccacagaggucagaagaaggcauccaugaugccugcagcuggagauuauagauagucgugagccacuccacauggguaccaggaaccaagcgugcagccucuguaagagcaguacacauguuuaacugaguuguuacuccagccccucuacuauggcuuuagcaugguacauucucuucacauacuuaucucccaucuaugaauguucaaauacuuguguauuuguaucagguugucuauuaucgaaauuaaagauauugcaaaguucuuaauguauucucagaacauuguaaaugucugugacuuaccuuuucauucucugaacaguguuuuuugaauaagcauuacauuuugauuaaguccaaauuauuuuaauauauuuaauauauauuuaauauguucauauuacagaggaggcacuuuguuucuuuugcuggaggcaggaccucacugcgugguccaagcugaccuaggacucgccacauagauggaguugaccuaggacucaccacauagauggaguuggucccagaccugugcugauucuuugagugcuguggcuuagcgcuguggucacugccgcggcccacggugccuaggcuaugaacccugcuuuuggugucauuuguaagaaaacuuggccuauuuucauggcacaaagauuuuccccuuuguguuuguaaauuucacauuuugaagaguauuuccaucuuucccuuugaguuaauaaucuguuagguuaggaagucugggcugaggugcuuucguuuugauuucaguauggauacucacucacuggcucuagagcuugaaauaaaccgccccucccucagugaagucccucccucagugaagucccucccucagugaagucccucccucagugaagucccucccucagugaagucccucccucagugaagucccucccucagugaagucccucccucagugaagucccucccucagugaagucccucccucagugaagucccucccucagugaagucucucccucagugaagucucucccucagugaaggcccucccucagugaaaucccucccucagugaagucucucccucagugaagucccucccucagugaagucucucccucagugaagucucucccucagugaagucucucccucagugaagucguucucccaaagucugcucuccggagacuguagacuccaguucuggacucucgacugucacagguuuaauguaguuugaaaugaagaaguuccauuuuccagauucguucuuugucaacguuguuuuaacucuucuagguucuucacauuuccauaugaauuuuaauaucagauggccaauuuccccaggacauccuucugagaguucauccagauuacaggaagccauggauuguuuuuggacagaauggauacauuagcaauacagcuuuuuuuucccccugaccuuuucaucauaaaaaucuuagcugcuuuucuacuucucugaagagacacugugaccaaaacaauucauaaaagaaaauguuuaugguggcuugcaguugcagaggguuagaguccaugauaauaccaggcaguaaguguucaacgagcaaaacacugucuaccauguuccccagcucacaccugcugugguguuugcaugauuccagcuuauugugugaacagcauaaacaugcuuucaguaauuuaaauugaugcugggcacgguggcacacaccugcaauccuagcacuagguaucugaggaagcaugauccuggguuuggggguagccuggacuauuguuagccccugucucaaaacauguuccaccccuucaauuaaaguagcgcacagguaacagcuaguaucuuccaaagguggguuauggauaaggacuuugaaaagaacuaaggaaguugacauauauuguucuggaauaauuauaaaguauuguauuauaugcuuagaguuauaugggaaauaugcaaaauauuucauugucauaaauuuguuaucuuuauuuuaccuuguggguaugaaaucguccuugaaaaugcuuccuuugagaaccguaauguagcugccacccguacuuuuuugacuaauuuuagaaugcuguuaaauccuugggaaagucacuuaugucaccauugaggaaugcuuccaaaauagauucucacuuaaguuccaucccaagcuaaacccacagcagguucugauaaacuccaagauggaauaacuuguauuuuucuuucuccuuccacacaggcccucugggcguggcggcggggucaugugguggauucuuggcagucagcagucugcggagcuuuugcaggugcaagggauuauauuguacugggagagaccggagugugugugugugggggggggggacgugaaugugaaaaugcuagcugugcaaaacagcauuccucaggaauuccagaucguuagaugaagacagcuucacugcuauuuacgaaaagaauuaucuuagaggggaaaaaaaaaacccguuagaggugucugcuucaaugacaaccaauuugucuuugacaaauuuuucucucucuuuuuaucuuuauuaaagccucacucgggcccuuggauuaucuuaaggauaauuuauaaagcacucugugggagugggggugugcugcacagcugucugcuaggagcaguguugugggugauccgagauucacagcccaugugacauguuugacagugcgggagauuaauuacuauugggagagcaggggccacuccacagcuuccugcaggcugaacugcauggagcaggaaauacagccuugugaacaucugggcauucuggagacauuaaagcaagagcagagugcagugugcaguaccaugcugccuaucaugaagucccgagaacacuggugcuuuaaaggauguaguaagugguaaguucagccccuaagagaaagagaaaugcagguagcugcaguugcaguaaagcaaauggaacuuggccagagaauuguaagggguuuagaggcaaugcuggugaacagauggacagguagguuggaagaucagcaacuuuaggggaaaaugauuguuuuccaaguucuauaucaauuguuggauuuauuuauuuccauguacugauuagggcaguagaagucauacauuuuauagguuccuuuguuaauaauuuaaaucuauuuaaguuguggaaguaaucaccaaaacuaagcacuuucccuggagaugggguaucagcacacacagauggggaggguaauagcuuccauacccggaucgucuguggcucgguuagaggaggagguggucuuaauucauuuuccagagguuagguuugcuaccuagcccuuuagagaaguuuauuuuuguugacugucugcuugaauuggucaagggaccaggggauggugggggugguguuggaugcagaacacuaaguaaacguuaugggaauuuaguugcccuggucaaggaaagccacuucuuggaguugaauacuuucaaacagugguucucagccagccuagugcucugacccuucauuacaguuccuuaugacccccacccccaccccauaaaacuguuuuuguugcuacuuuauaacuguaauuuuucuacuguuauggauauaaaguggauaucugugguuuucugauggucuuaggugaccccugagaagggucauucgacccucacauugaaaaccacugcucuaaaacuuguccaucuucaaguaagggauaagcauguuccgauagagaccccacaccaugagagcagagauucacaugcagauacauugauacuauguguuugggaaauggcuuucaauacaguccccuuugcaugacacauuugucaaaggggacaguuucugucacacuaccucuguagugagaaccuaccaucagaaggugguaguucacuaaggcugccgugaggcugggcugggauagugucuggaaccuaggcugggcuuucugucugacaaguggcugagucucugguuuggccccaguuccuggagaagauguugggcucucugagcaccaguucucugauccguagcauagcaauacucacuccucccugaagggaugcagugcuauaauguguguuggcccuuggugaucuguaaggcugaccagcaguaaggacuccucacucucccagcaagaaaaagcagcacucccuucccccacauggcaagcugcucucucuugaauggcacuggaagaugucaggaucugaagucacugugcagugugcuuuccuauuaaaggcuguaaacguucuccccggccaccucacuguuuucagaugagauucugccaaagagaagcauuuaggaccugcgugggaaauguuaacagaucuuuauacauuaaaaaacaaauauguuuuuguuuauuggggggggguuacuugguauaaauguuagucuagagaaacaagaugaguauuuugaaaacauugcugcaggauaaacguaauuugaaaauaguccaaauugaguaaauuggaguucugcaagagcggacagauugcagcccugucuuguacggccggggagaugaagaacggccugcuauccacaguccuguccagacacccacacacugccuauggacucccuucuccucaggaucaaacucgcccgccaucagaucagauuucuucugcauuuguguuuuccaaguuuacccuggcgugcguggccaucgccaagaaccgugcucugccauccucggccugcuccuugcuccugcuuguuucauaaacgacuuggcacaaauacccaaacugucucuugagauuggagguguugauggcuugucaugcuuagacauuccccuggcuuuuggucaggguuaaaguaaggaaaaagaaagaccuugccagcuccucacuccaggcccugacucuuaaaacagugauguugaguauugauaugguauacuuccucccauuauggcauuccaguaucuuuugaucaguuucuuacaguagaaacuucuuacauucucuuaagagagaagaaaugagggagaggcagcucucucauccuagcgugguagcacggaaugcaggauucagugugugacagaggugagagcuuggcacaggcugggucacacagccacacuguggagccgugcuugcagacuaagugugaggggugcaggaaggaggucuugcuccugaaagcaucagcuacgaggauccaggagcagagagaagccaggcugccggggcugagcuugggccuccaccucacugcccuccuguacauuccuagcuucugcucugaggugauagccccaggcugucagaaagaaaggaguuccuuugccugucagagggcauuuguuccccaaggcagaaaguaguuuuucugugaaaaucagaucaguggauauggcccagcuuaacauucaguaaacaccccaggagcuagguucacuugagaacagucuguguuugcugugccuaaugguuguuuccuaucuggugugcuaguguguuccuuacauuuauccucuaauaauacuacuuuuuaaucuaaauguuaaagauacaaaacugugcccugugugaguuaaaguagcccagcguuugagggccuuuaaauugauuuauuaaugccuuccauaaaguacagaucucagugugguaguaaaaucagggccuaucaaagcuaaaaaauguuuugaguucaucuuucuuccacacuacuuucacggagcccacaucucuggagaauauccagguguccacagggaaggaugguuaaccugucuguggccagggcagguucggcuugaguuaaccaaauuuauuaaauguucucugucagcuuuaugaguugauuuagggcagcuugugaauauuuuuacauaaaagaauaaaguuuaaugcucagacuuauuuuaguguguuguuguaccagaguccuuggguguggcgagaucauuuuaggggcuagcauauuugcagccuuguucccagcuccauacggcugcuguguggcagcaguagacaccagcgauggugcuggcaucaaucuggagagccuggcaaguaagcgaggguggcacuagugccagcccuucccugcgucuuacagggucaccuuacaugcuuaguuuguaaaaacuguagacuugucuggagauauaacuacgcauauugagugccuacuaugugcacuagauuagagaugggaagaaaaaucacccauucucucuacccaugucuuagcuugcguccuguugcugugauaaacaccaaaacuaaacgugggaagaagggguuuaguucagcuuguaucuuuuucugaagucaggaauggaacucaaagcagggaaggaagcagaguccguggagggacacuguauaggcuugcccgacaugccuugcucagcccgcccuuuccuacaaccuaggaccaccuggcaagggguggcacugcccacaguaggcugggcccucacacacgaaucagacuugcuuacaggccacuccucaaguaauguuccagaugacuccagcuuguaucaaguuaucaaagagcuaaugagcacagugcccgccgagacuggagguccuaccuauuagcacugcuguggguuacuccucuucuagacacuguagggacucuuuagugacgagaaucugccccacgguugccugcacuuuacaggugagccuuugaggcaucagggaccagggccaaagcuggaccucugagcggaccucaguuuuugacuguuguaagaucugucuguguaguguguggugggugggggugaaggcacgugugugccauggaagcuuggggagucagggcaggugaggguuagcuuccuucuuccuccacguagcuucauggcaaaugcucugaacuugcaagccaucucgguggcucacaaacugucuaaaaggacaaaaaguaagagguucuagacaaagggggcacugacaggccuaagaugugggccaauuguggguaacugaaaauagaacauaaacaaggagugggcaggccuggccuucccacaacugucagaacagaugucaccgcagccagggucacuguaacaacuucauuucagccccguauuuagaaagauauuugucagaggucaaaugcccuuuuugcucacacaccacagcagggggcgccuggagcuauuucuagagccucugugcaaaccccccccccccaaacagcugcucaucggcagcuccuaggagcugaaccuccugaaagcccuuuagggugugugugugggggggggggguguuauuucuccauucuucuggccuuucaggguuucaacugcauuguuguaccaaaugaagaaaauauugacaucaagcuugguaugguggugucacaugccuuuaaucccaggugggugggggugaaagcuaguucuguggguucgagaccagccugaucuacauagcaauuuucaggcuagcuccaaguacauagucugaaggccuugucuuaagcaaacaaaaucaugucagaccacaaacuguaguuuacauuagcaauaagaguuuuggauucuguguccacagauaugaacacuguuaaaaaucuauggacaguuugacaucacagaaauuagaugaggaaaaccuagugagagugcggaggccaaaugcacgccagggcaaggggugaugcagaggcuauacggaaauaaagaaaacauagucuuguaucaugaagagcuuggcugguuauacagaagccccugugacacacaggacggagccugcccaucugucucaucagaacaggagcaccaaagcguccuggugcuuuaagacagguagccugcaggaaggugcgauuccccaaagcccugggagccaugugcuucucuccccgaaaauccacaucuggccauugacaugugucauguacacauuuggauuaguguaccaggcggugggagagcaaggugagucgcagggccucacuccucagccugaguacccuucaccuucuuucuccaguacggcaaaagaugugaaauagggagaugaacuuguucacguguauccugcucucaacgccgucauguagacacgauggcaaguuauucugacaguuauguguacucggcgcaguuauguguagacguguagguuacugucgagucuggacaugucacugacugcugggucuuacacacagguggcuuugcagcugcagugacuacaccucuggacguggcuaagacaaggaucaugcuggcaaagguggguaucagauaaugcagguucuaugccgugucuguuagcggaggguauggggguggaagcaucggagaaccugccggaccauuaauaacccugacuuuggaagagcggcucugucaucgccaccgcauguuggcagcugucacugugauggaucuguguguagcacgcuuccauuucuccagcacucucccagcugugccgugggagcggcacaucugagggccccugcuugcucuugcuguuuucagaucuaagccuugagagaggcugacaggcuucauguucugaggcagcugaucugcagagucagaacucaggccaugggucgcggugaccacugaagacaguuguccauguuguuaaaaggaaaaccaaacaacaaaacaagcucugagcugagcuuuaaggaauuccaguaacaucccuggaccgaguauacucucagaguacagaggaccaacccugaugacggggucauuuuaaagauagacccaugcaaacguagaagugccacccccaucgggcuuccuguugaauaguuaccauuaguuucuaggugagcuaugagaagcugccccccccccgcccccauccccaaguauuugucuguaugucuaaauguaggcaagauuuccaagcuaaccccagggcaagccuuggaugaaggugaggggagucugcucagagaaccagaagguaacggcccucucucccuuccuuaucuucccuaggcggguuccagcacugcuguggggaacgugcucucugccaugcacgggguguggcgcucacagggacuagccggguaaggacaaagcgagcccucggcugccuugccucuucuucauuggcucuuucucaggucccuaugcuugcuguggaugaacacuucgccuuugccuuuucuuagguugcauauguaagauggcacacucggcgacauaccauucuagccacaugguucucggucuuguccuugacacuggaugacaugcaaaugugugucguauuuuggcugcagcauugguacaaauaagcucccaccuacgcagugcagacugccagugaauuagaagaaagcauuuggggcuugaguaggaaccacuggcagccgugccuuaugaugggccugcgcucugcaccaugggcguuguuaguggguaauuuugucacuuaaaacaucaugugguggcgcacgccuuuaaucccagcacucgggaggcagaggcaggcggauuucugaguucgaggccagccuggucuacaaagugaguuccaggacagccagggcuacacagagaaaccaugucucaaaaaccaaaaaaaaaaaaaaaaaaaaacaucaugugcuuacacaaauguagauggugucaccuacagaccuguggaaucgggcuccuggcugcaagugcagcaggugauacccagaagaucauggacaguuggaagagcaguagauauuagugugucuggagauacagaaauggagagaucguggguuucagaugcaccaucaucuuauaugcagucuguuuuucucuaaagcguuacccagcucaucacugcgcugucugcuccacagugcucagccuuggguggccauuacuguuugguugcuaaguaccucacauuuuuuugcaugugguaugcagaugggugugugugcccacuaguguagccauagaggauagaggauagaguuuucaguuggaugucuuccucagucacacuugaaacagucucuuacugaacccggagcucaccauuuugacuauaguaggacccgaggaccgaccuguucccuuccccgucgcuggguugcaagugaggaccacugcaccuggcuuucuguggugcugaggaucugagcuuggguuaagcuugcccugcaagcaugcuaaugaagcaucucuccagccccacaugccuccaaaugucuugcuuuaaguccuaaaaagccgucccugcacacugguucaccauacgguggugcuggagcugugucuaugcugaguuguuagaaaagcggaaggguuuucucuacggaacggucuggacaugcuguguggacgugccuccaccuggagcugggauggcuggcauugggagcagcagcacugugcccuccuggccucuuuaccuggcauagccgccccgcucacccccaugccaggguacaucacugaucacuauuuuuguguaacuuuggcauuuuaaauuucagcugaugguccgggaaacauggugaugcuuuugccagagagcaaacuccaugucuguuugaguuuuccagcuggaugcuucaaagugguggcugggugcuuucacucaaugucugcucugauggucggaggugcagauuggaucuaacagacaggacuuacugacucuagaugugucagacauaggaaaggcauggugcuagcuuccggagugagucugcuguucauggcugaccccgcgugaggaauaagaacauauuaguuguuaauuuggguacgaauuugacacugaacaaagauggaaugaggagggacauggguugugugccccauaugcauuauuugagaagccucuuaggaaagcaguggcugcgcucacgaggcagcagcuggugacagugacuuuugacauccugaaggccagcugccagauuguguggugacuuagcugggccccugacuauacuguuguggggcugcagcccauuugccagugucgagaaaguggugacaagaaaggacacacuggaugaggcagugccccgcuguggccaccgcaugcugcuggguagaugaugcaagagcggccuucccuguccaggucauggcacacacuugacuauaacuaagcagugccagaggaaagacagcaaaacaggccaaggguguguguuuguucugacccagccuuggugcugaaagguagcuuggauuuuuggcucgucuucugagucuccagucuuggacucuggucaccuuguccagggcagcacugaacagcauguucccagcagcaguggccaccccugagcauacagcaacuccagccccucuagugagcaagugauuggaccaagagacaaaugaaaacuacuggucccuuucugggcagguggcucagccuacuuccucuguggcagugccagauagagccaccacugucugugcccccugcccugcacacacacuaagccuaucaagucuacauaacucccagcagccccucccaccaaggaaccugaugcuaucucagaggagaugguagggagccacgcuggagggcagacugggguuagcccagaagcugcagggcagaggggagguccacuuguccuggauugccccuggcugauccccugaacguuuucccuugaauaugcccuuuauguacucgcugcugcugggagcuccugcuuauccugucaccuguugucccuggaacacaaccugcccuacucacaagucugccuguaagcagagguggaaccccuccccccuacaaaaccuccacuuuaaggaggcugcagucuguuggucaucugugacgcuguaacugcucccaucugucucuggccucugcugagcuggguaguggcaaagcugagggagacugaccuccaagcccagcucagugucuccaggccugccuucuauaugguaggugccuuguuugccacuuccugggccaggcuagcugacccaagagccuccgggacuuccugucacuacaggagcacugggguuacugcagagcugccacgcgcagccucacgagguuucuagacauuugaacucaggucuugcucgcuuuacccacuaagcuauucucucuagcucccuaaguagcuuagcaagaggggucccacuauguaaaguccuugcuuucuucugugcugccugcuagaggugggaggggcagcggaucucuuccacuggcuguguagggcaugggcuguguauccagcagagauuccugucagcuuucuucauuagcuuccacuuagcuuagcacaaaggcuuucccacaucuuuaaaaggcaugagcauuguuauaauaaaacacuugcccuauacccaaagccucuccacgagugugcacacauagacaucaaacugguucuuuccuuguccagggaucgaacuuggguuauccaucagucuugacagcaagugccuuuucccaccgaggcagcccaaguucuggcuucuaaguuugucuuucugcauauagaagcacuuuucuggguaacaggguuucaguagaaauaagaucaggcuuucugucugucacucucucacucccacugccucuguagaaagcaguaauuuacagccuaggacuugcccuguguucaucagcccagcgaccauggggaugguaaccuuuuaggguuggggcuucugucuuguucucuccagcugugcgccacucuguuuucacaaugcugucucaucuggccagguaaggucacuaguagauuacuucaguaaugucacgauggauauuugaaauuuccugggccucuggagaauggcuuccugacaccacugugguguucugacuggauuggggaugggacaccugagaaucucgaacugacacugugaggcgcuccaccuuuaccacagucaugugacucuggcguccuuauuucgauugaacaagaaaaagggaguccacaaagauucaucauccccuucuuguagaaucgcauuugugggacuccaaugacaaauauaaccgagcccaggguaggagagcagaacuguuucagaauuugcuuugucucccugacugagaccuagaggccccucagaugucccagggccacacacccuuaccagccucaccucagauguauccuugacucccuucuucgagcacacugcugggagagugguuacuguguuaaugugaguguucccagcuaguguggccgugcuaggcuaagcuccaguuucucaugcauauuggggaauauuacuuaguagccuucuaaaaggaaggaaagacacuguaaauuucugugggauuucacaauggaugugauggaaugagcgaacugcgggcagucaggaacaugaccauuuccugucccuagguuauucgcagguguccucccgaggauggcagcaaucagcaugggcggcuucaucuuucugggcgccuaugaccaggcgcgaagcuugcuguuagaggugggcaggaagagcccaugaagcagacacuacauguccuugcaguccuuccugugccuggggcuccaguguggcucccugaagauggcugcagagagcagcuuaaugaaggccaaagcacaggcugccccaggaaacuuuucuuggugaaacuggggccaccgucucaguccucucaauaaauacucccgguaaggccaaggccaggcccuucagaaugcuuuuuauuagcauccugugcuuucugcugucuguuggagucaccaggaaagcaaacuggcuacaacugcagugaaugaccagacugggaaaaggaagggggcaagaaccgugcguguggcuguuucuccccugggcgggugccuauuguguaagauuauagcuuuguuuaaaaagcaugagcuacaggugcauagcaugcauucuuucuggugaggaugcuguuuuuaauuaccuuguauuucuccuauaaaaacacaugauuauauuacuuuacagcaaagugccccaaagucccuggagugugugacagacagcagacagcugcagcgccagugagugggugggcccaagugacuucaguuaggaacauguugagggaagcaaagcccaugcccaccacuguccgucccuggaggccagcuggagcagcuccuuuguccucaugguauaugccagcaggaggugggagggucagcauacuuggggagcauaaggcuugacuaaccaacuccauguggaaaaaaaaaagcuaucugaggaaugcagugccacugucuuucuggggcaacaguguguagucuaugcugcuucgucuaaguauucuccuuuuggagaaacauuaauagcagaauaaaagagcagugaccgccgcacacacuuaguauuuauaaaugaaccuuuauuaaagacacuuuaugccauuuguuagacacuucaauauuuuacauguuuucaauguacacuguaccaaaauuucuauaaauaaauaacucuguacauaaaaaguaauacuuccucuuucac

SEQ ID NO: 3247 - RNA, 96621 nt, Mus musculus
ugauuguucgcagcgcugaggcacggugcgcuccggccgcuccgggacgggcaggcgcgugggguccacggcuaucaucagcucagcgcccucagugagaugcccgcccgcgccacgcgcagaggccgaggcuaagcguuuucaguccucagaggcggcggcucucggcgugcgcccgagcucugaaggcgacucucagcgcggcgggaaggacgagcagcggcggccgggcacucacugcgggacuccacagaguucgccgcgcgcggggcucggcccggaugggcgcggggguggcgguccccgcagggugcugcgaagcggcccgggcagagcgugccggcugagcgccgcggccccggagccgacuggagucgggcguccaugucccggcgcggagccuagcuccgagcgcagcccgcgcccgcggccgcccgcaccucgcagcccucgcuccccggcuucgcggcgcguuccagacaagauggcgcggcccgguccgggagugcucggagccccgcgccuugcgccucgccuucugcucuggcugcucuugcugcuacugcaauggccggagucagcgggcgcccaggcuggcccgcgggcccccugcgcggccgccugcacuugcgccggggacucgcuggacugcagugggcgcgggcuggcgacgcugccccgggaccugcccuccuggacgcgcagccugugaguaucgccuuugccucucguccgggcgcugucacuaagacggggcugcuggugugcucagccggagagggugcggagugcgcucugugggcuggggagacuuguggguggccgaguggaggucacgcgugggagcucgggagagaggacucugcuucugggguuugaaggugagcgugauucuggaggagccugccuugcggcgagcguguguuguggagaggaugcaggacaugagugauccuguaagggugaucgagugugccucgugaagucuggaagucagcgagugugggccguggaggugagccaccgguuugugauuugaaacugagugagagugcuguggagcgcgaaauauguguguguguagaguggaggugagcgaauuugugugcaugugagacggacgcaauggcagaguguaggagccuguguugggauugggauccauggcuguaucuuuucuccugugcuguauguaacccagcccuuaggugucuugaguucccucaacuuaccuucaguugguaaugaaugacagugacucacaucuccaggguucaugcuauuuauacuguguauuagugaguauguguugcagucuccugaucaccagacaaucgugguggcuugacuuggcauuggccagggcaaaagggacccuguccugaagaagccaggaguugagaagcuuugagacaguucuuggagaugucugaguguggcuguuagcucuuuuccgcauggcuggcaaguacaggaacuguguuccagaucccuuccugucuguucccugggguccccuugggcuugauccacuggggcugggucugcuccuacccucgaguuucuccuccauaaauggcacaaguuaguuguggaguagugcuacuaugggagaaggugacagggggccuggcuagcucugucaguuuaggugcacuucugugcugcugggauugggguucguugggaacauuagauuucuguaaacaaaguggaguagaauagcauuguuauucuuaaaaaaaacaauacaaaacaaauaaaaaaccaaaaaaaccuagaccuuugagucgaaucuugcucagcuaucaguaauuagcaucucuagaacuauuaguaccuuccagagaaaggccuagcuugaguagucugcgucucauuugagcuuuugaaugucuuuccuaggacacagaaguaguacagcaguagcuucagucaugacauuugcuguuuuaaaaagcgaaaauugaugacacaggcuuuaacucacaccuguggcuucauugcagaaaacuaggggcuggguaucugaccgucuugaaggagagaaguugauucuuuucuaacaagaagacuguauucuuagagugaggggcuugggucuucacauuggucacuugggcaaucugcugugggaguucugaagccagcaaagacccuucugcuacuguugcugccuugaggauuuuucucuucuucaguaucugcuuccucucuggaauucacuacugaaaaugccuggucuuagaguggggcugaacaguggcucugucaguuacugggagguagacacacuauugcucucugcuaagauuuuuaucuauuaauaacugaggcaguuuggggacauuuugggguuuuuuuugcauacuuaagauggaauauuauuauuauuauuaaauaauagaacuauguggguagagucagagaauguucucaaguguucacuuguuggaagacuugcaaagccaugugucagggguguucugaggaaggcucuccguucccaagccacacuuccuggagaggacagagugcucuuauuuguacuuucuuuuugucacaagaccuaccuuggcuugcccuuccuuggagcagaacuugcuggucauuuuuaggcuuucaguugccuacaagugacaauucacacagcauaaauaccuuuaaaauuguagucucucuuacucacacaauuuagugaucaguaaauaccagacugaguguucugggcuucaggagauaggccucuacugaagaugguuuuaauggauuaguuuuaauauucaagcaguuugguuucuggguuaguauguggcaugugcgcgcacgcacgcacgcgcacacacacacacacacacacacacacacacacacacacacgggccuuugaagaauacucacgaguuuauuuuauuucugcuuaaagugaaaucaagugugaauugucuccuaaccuucauguuucucaacauauuuccccccacugguauugaggguugcacccaagggcugcagcacgcgaggcugggcaagcucagcuacuucugaaccguaucuccaauaccagcacuuuccuuuuaaaccauugcuuuuacuuuuuggcaggauagcaguggagaaagucuccguauguaauacaauaaaguaucuuguauuuucacugcauuuacaccuuuuaaggucauugugucuagaaaaugcuuugagcuaguuuauaagccuaugaaguagauuuacugcagccugcucaaacaguuucaggcuguggguuugcgauagcaggagaccuauggcuuuaugggacuccucccccuuuuguaaacaguacaucuaccuuuggaguugcucguaggccaaguguagagaagcuaaacguuuuuaauagugaauaaaaguuuagugugaguagaaaaagcagggugaugcugauggaggagaacagaacccuuuccaaggcuggggauaacuuacucucuauggcuauguagagugguguggagcauagcugagucgccuguccuguugcauaggagagauuggcaugguccgaccagaacacucauaaacagcgccaaacaccucccagaaccuuacaagaggcugaacuucuuagaacuuagguguuugcuuuccuucaaacuauuuuugagagcaugauuucagaagcuccuuaaagagcauuacagauuuacuuuagacuguuucucaccugucuaaauuugaacagaggguuuaguuacaaaauaguguuaguguuaacauucugagaguuaacugaugguugggagugggagggaggcgggcuuaggagggcaguccuuggauccuuguucagugggggaagggaacagggauucaaaagcaagggccuuuaggaaaggacaccaaguguggccaucucgagugccaguagugagcacuuauuguuuuggcuucucuuguaucauauacguauuugcaguaucagguuggcugccucaaaucuagcuucgaugguuuaagcacauaaguguugguuuuggcuacauuagacaauaugcauucugugcuuucacuguagaguugggacacaaggacaaccccugucugucagauucuccagcagugcuucaagggcuuggugugcaaaguguugugaguuaagguucuggaaaugaccuucuaucauuauucaaaucagaugaccaaauccuuuuagaauccaaacugcuguguguguacgcgugcacaugugcagauguguacguuuaaaugaaguacccagcugguugauagucagucccuccucgcccuuucuuuuacauuggucucauaucacuuuaagaguucagcagaccuugagcuugugucgauuugggaucagaggcuguuugaaguagagacggauuuauuuauuuuguggugcuagggaucugaacucacugccugggacgugcuaaacaacugugcuuuccugcggaggagcuccacccccagcccuacaggccuugaggggauuugcaccuuucaaagcuuucucugcucuggggccauauugaagagaucuguaagaaugggauggaacccaaggcuuugccuacucuuaggcaggcauucuguuaacugagcccuauccucaccacauugucccccuccagggcacuauuuuaagaauccacacgcucaacccguucuauaauuacauauaguuacuagauuucacaaacuuuggacuucugaguggauuauaggcaguaguucuuggcaagaucuugagaaggcuggggacagacagugcaguaugcuguguuaagagcuucuuucugucccauguccccauaugccugcucucuagccuccucccucuuuggcuaauuaucucuccuggguucccugggcugcuucccugaccaguuggguugcccucuggcugaccuuuuccacugucaggcccuaugcucgccaugaaagagucucuucccuucucugcagaaguguuucuguggugcaaagccuugucaguagagcuagaaaugccccagagccugcuagaggcuacugagacaccuggcucuaaaauaugcaccugccuggaagagaggucugugagauaggaaggccagaugguggccguuugaaguagcccauggcuuuuuagaagugagagggaaaucuagaagagggauccuuugaauugaaaguugcuguaagcaguaagaaugguggugguuuuguugauuuugucaucuuucucuuccuuguccucuucucccucuuccuccuccucuuucucuucucccuccuucucucccuucucuuuccccacauuuguuuaaaaccuaaaggggauuccucuuucccuauaguuguaagacuagguuuccugguuauguaagccuaacuuucaacuaguuuugaugagcuuggugacauuuacucacugggguccuucccccuccucagcaauccccagggggucuuuaucaggagcaaaccgaacuucagguuguguugcuauccagaguugauuacaauggauguucuuucaaagguuaaagcuuugucugagacaggagagagaaagggguggaggggaaaugucccaggcagaggaagaaaaauacacagaaaucucaauuggugucuggccugugggagguuuagggguuguaccaaaccagugggguccauuaaggguggacuucauuacuuuauuucuugcucugugcggaaaccuugacugcugcuguuccuaguaacguagcaguuuugguucuauuuccuuauagaccuuguugaagaccagacguuaaacuuuguacaguggaagucacauucauuuauugacuuaguccacauauuuuauguaugaaugaaaauuucaguuuuucaccaguuaaauugcaaacugccaguuuguguccacacucucuugggugggcauucuuuuucucauccaagagcuuuuugcuuuauguuugugugcuguuauguuuuguguaaucuagugcuuccuuuguagguuuaaaaauacucauguccauuauuuuaaauuauguguacgccugaguguguguauguggcauauauacccaugaaugcagguguccuuggaugccaaagguguuggauucuuggagcuggaguucuaggcaguuaugagcugccuggucuagaugcuaggaacugaauacaggucuuccaacagagcagaaaguacacaagugcucagcucucucucgggccuuuaucaucuguucuuuugacccaaacauauuuugcauagacuucuaaaacgcaguuccgcaaaucugcuaauaaaaguuguucuaaaagugguuucuuccuuucccugggucuuguacucuuugauuucccccugccuuguucuuuguauccucucuaaaugggcacccgguccuuauacccuggugucugaugagugugauggaugggaauggcaugaauagaacuuccuuuauuuuuacucugcuauacauguuggugccauccaccuugcagggcgcacggggugggggcaccgggugccacccgucaccucggagugaggguggaaagcuugaaaguucuucuuaagguuuguuucugguaucuccacucuccagcccuuuguccccguuuuuuucaaggggaugauaguauccuaucucauaagggcugggcggacaguuacauugugcaugugugcccuggcuuccucuguggaguucaccaguuaaagguuaagguggcaguaccucugucuugcauccguucucaugauuaguuccuccgaguugcauuucccagggacgaaagaguuuccuagggaaagguuacuuuucagcuaggaaggaaucuuuugcugugggagcauggcaugacucacaagccaggcaucgugcucuaacagccguuuuggugguucaggaaagcugcaacagguagacaccgccgccgugugccuugggaaucucagaugaauaggcaggaagcuguacacaguugcagucaauuauacaauuagcaaaaauuguugagguaguuuaaaaaucuauuccaguuguacaaauacugccgagguagcauuuauucuuuugggaaggugcaugggaaaaagcaggaaagugagaaguccuuaaaccaaucacuuuauccucuuguuucucaggguuucguugaaauugagcucuacccaaauacagguagcuuggaagaaugcaggugugcucucauagacgagauuauguuacagucuuuagggccggcugauucucacugcuucccaccucuguauggaaagacuuggaggagaggagguaggaggggagacaguuacuguugaaggcagacaagaagcuucaucuauuuuggucuguguacaauggugugcuaacuuguaggcagugcagacagcaaaggccuggccaucugaggagccuggcaagggugcaccuugaaaggccguuugcuguugcuccuggugcaccuguucacgaguccuuucccucgugaauggccaugauucacagccuugcccaccugaagggcugcgauuguuugcaccuuauuacuauuuaauccaaccuaaccgguaaggcccauugugcuaacaacuaguccguucaucuccuugaggcccggccggauucaucgcugcuuccuugugaaccaggauaccgguuccaaucaccgcuccuugaguuuguuuuggcaaaagacaagaaagcacggccugucuuuaagucuuugugaugccuaggucucuuuccuuuuaugaucaguagguauuggaaaugaauaaaugaguaccauuugccccccacaagcagcccugucccauucuuguaaaagcugauuuaaaaaccaguuaguccuuaaaauuuguuuucuguagcuucuuugugcagcagugagcaguugcccccaaccccacucccuuccuguccuuugacccuucuacuaauggauaaugugcuguucaaaugauucacugcucaacucgccagagcacacacugcgcugguaaaauucugucuucuggauuaccuacuugaugauggcuguuggggauccucaggacugaauuucugaacuggggggcaucaggcaucuagguagcacuagguccuguggucccaguacucucccuuugaaagccauuugcaucugaagcacuuuggguuggacaacaggaaagggcugugaaagcugucaacugacugugacaaagccuguugcagagagaacuuuuuuuuuauucuugugaggugauuggaaugaccagccuuaaaaccaauucugaguuaaggaaauguuugccauguagccucuguugauguaggauguuuucuucuuaucacuguuucauaagagagacaagugggcaguguauuaaugacgucgugaauucugaaacugucagccaccuucaguaauugcccaugcaggccuguuucauaggcuccaugcuccuuucuccuucuacaggguuuuacagaaguaaauccagagcaugccauuuucucuguaaauguguaggauguucauuuagcagguugggggggggggcauacucacauggcaacuccucauuaaaagaugacuuuaagacaugggaacaugaacaaguucugaaaaauaauggacuuguuuucuaaaggaaauucugacaacguguuuacaggauguuugccaagcacauauuucaugcacccuguuuuuuauauucucaaauuacgcggguuuuuuuuuuccccccuaccuuugguuuugugaggagaguuugaaacauuuuuagcacccgagcucagucagguuguaaaagucacuugaguuuucuuccauagauccuuaaaugagaggguucuuccaagcuauuauuuagauuagacucuauuagcaagcaaauauaauuacaaugggucauuucaaagaggcauuuuagauauuauuauuauuuaguguagagaugauuagccgguugguuguagcuaagucuugaaucugaauugaguuaacucguguuuacuuugcagggccugacccuccagcugugucuacuugagucugcuuuaaauagaguuagaagcacccuauaagaaaaucccccaaaagcacagagccagcuuccuggaacccucugggcuccuuuuagcuucacacagauuagaacaaugcuuuuuccuccuugcuacugagcgguccaugguccuugguuccguuucucuguucucuuucuguugguuggaggaauuucuuuaaaauaaaguugaugauuuucauauucugucugugaaaaucuaauucuagguaaauuacauaguguuuagugguuuaaaaauccagccuguaugugucauuuuaagcucacagacucaguuaagcauaauuaagccacugucauauuugauuagauaccauuuacaguggauccucuuguuuacaaaagcaugcauacacaaaagaguuugcuaaaacguauaggcaggagaacuaacuaugaggcucugauuguaacuuuaaguucuguuuugcagauugggaugugugguaccuagggucaucuucaugcucacagacugaguuuucuuuucuuucuuucuuucuuuuuucuuuuuuuugacuaaaauaauuuugugugcgucugugacuuccuuucuccaccugggacagugugaguuucuggcacaugagcgccuaguguuugcaaaacuuuauaaacagccagaagagcucguagcuuccaggaaguggguuguugaugcaaccgagugauggaugcugaggccaacuugagugggggggauuguccgcuccucuucaggagaggagagccagaaaccaagccaaacaaaguguuuauuagcuaccagggcuaccucauucccaauucacuguuuucucagacccaauguccguccgugucuuguccacagguaaucugaccucauggaagaggcucucugccuuacgcaagagaaaaaccagaaauucugcuaagauuuucgcuuuguauuugaaauuauguauguauguauguauauguguuuguuguaugugcauguguucacauguagugugugugugcuugugcauucucucucuugccccuggagcccagaagagggugucagaugccuuggagcuggaguuacagguguuuccgagccagccaacaugggggcuggaguucagagucugguccucaugguugaacaacaagugcucucaaucacugagcucucucuccagcccccgagaagaugucuagauuauuucacaacucuguuugaaauaauaauugggaacaguuuaauuauguuaguucuggacccacaagugaaauuucuaaaguuguggauaauaagaaugugguaauauggaaaccagcuugcagcugagucucagcaggccugaaguucuguccuggcucugcuacugacggggagugugaccucgggcuggucaucuacuuaccuaucuguaagagacuuaagacuuauaaaaauucauuuuuaggguuaugauucuggcaauuggaagcaaagagggagugaauuuacugauuauuggauuuacugguaagagaguaagugggucuguguaugggaugccuagcugaaaguacucuggcuucucugcacagauaccuaggacagccaaaggagaaauggagcacugggggaggggcuccguuagggacccuucacucagccuuugguauuacuaaggagaagcaaauagugcacuuuaaagcaaggcggaccuuccccagucugaaaguccaaaaugcuucagauucugacaguuuugagcgcuagcaugacaccacaaguggaaaauuccguacugggaacuucguuuucauguacaaaaguauuaaaauuaguguauaaaguugccuugaggcuauguguauaagguguauaugaaucauaaaugaauucauguuuagacucggauagacuccucauguaaauaacccagaacuaaaaaaaaaaucugagaucuggaaaacuguggucccgagcauuccagauaaaggauucugggccaaagaaaacuacgggaccugcaagcuugacgucuuugacuuagcuuuugaggaacauagcuuuagagaaaaggcaagaaguuccagggucauuuuaguaggguuuucuuagggccaccgaaggccacggauggaguaguuggaucagugaaguuuuccccagccugcuaaucuuucagcuccaugggcugagaguacagauucauuggcaacagcugcaaggaaggccacacccacagcucuguccucuggagccagcuugccuuugguuguaugcaugaacauggcugauucugaguagcuuuaagccauuuucccugggagcuuuucugugugcuuuucaguguggacacucaguagccugacuuuuguacaaaucagugacuucuuucuccaauuuuuguauucgcucacuuccuuuuuaaaaauuguuuuauuuauuucuccagucuauuuuuguuguuguuguucaauagauaccaaauuuacccaucuauggguuuccuuuuggucuaauauuguuuuuggaaagucuugauuuaugccaaauaggaguuccguggaggaccuaguagcuuuuguuuuuuguauucuuuauuuuaaauaauuauuuguguuuguaugugugcauguguucuuguuucuguggguguggauguaggugugggggagucuggagggccaguguugggugucucucuucuauggcuccccacuuuauuuugaaguggucugucaaugaagcugagacucauucuuuaggcuaacuuagguggccaaaggcgucauuuagaaccuggugcugagguuacaggcgcauccucauccaacuaauuaugccggugcuggagaucugaacucagggcucugcgcacacacagcaugcaugcauuaucugcuaagcuauuucugcagcccguucucugugcucuucacagcuaccuuccuuccaugugcaucuguugucuucgcuggagauuguugggcucuuccuuuuaugcaauucuuacuuuguauguuuucaugagaugaggccguaggguguucuucuguucucuucuugaaaucaugcuucagggaguuugagcuuuguuuggggcuacaccaugaauggggugaaguuggaggccagguagugguguuuugaaccucuugauauaaguucagcaggaauuagagauuauuuuaggagugaguaguccaaaaagcuucuuuuaaaaaaaauaucucauuaggcgccaaggagauagcucagauauuaacaugcacgagauccuguguuucauucccagaauucauguaacaaaauccaagucuaauaguuugcaccugaaaugccagugcuggaagggcagagacuggcagauagagcccugggcucacugggcaaccauuuucgucuacuuaaugauugacagaccagcaagagagaaaagaacgggucaggugguaccaaaugacacaugagguugucuucugaccugcacauguacguguauguacaccccgcacacauguacacacaugacacaugugcagccuuagauguguauaaccuuacaccuguagucucagcacuggggaggaggggcagaagaaucaggaguacaaggccaacaccuacugugguugaacccaaucuggacuaccuuuguuauugucuaaacaaacaaacaaacaaaaacaagugaaaaggcagcccuuuucuguccuguuguuuaagaucaaaauagcccaaaugcuuuucccacccuuguacgagcuuaaucuagagugccauuuucugcuacuccugugcucuuccgugucuuuccuguuugugucugaucuucucccagaggauucucaguccuauuagguaacuuuuuaccucaguuaguuggggaggccauaggaacugugguuguuucaguccggucuguggagaggacugaaggcacauggaguggggguuagcugugagguacugccgugugugggaucuguguugcccucauagcccauugagguaaaggggugacaguggccucugucagguggggagcagugcuucuuagcuuggagucaggacuuugcuuguauucgagagagaaucugggacauaaaaccaacauuauggcaagugcucccuucccuccuccuccucucccauuuucuccguucugccugagaaccacuucaaaggcuccgaugugcuggugccgcaagcugcacaguuauuguuaaagaauuuggagauauaauugaaaacaaacuguucgagcagagcagaucuaggcaaguucuagcucugagggagaagggaauuccaaguucuuccucuauuuggagcugaugucucagaacacuuguucuguagagucaucagugaacguuacgucugggaguuguauguugggaaacggcguucuuuuuagauggagaagaaauauaaacgcauacauagaguuacagugcaguuggaaaaguguagucagaguuaaaaaaaaaaaaaaacacaaacaagcuaacauuuaaaccagcagagugauuggccaugcgauugugacucuucaaauggaauguccauauuuggaugcaguaccacagcuaacuuacuuacugggcccccuguucuucguuuugggggccgcugacauuucagaaauaucacaggcagaaucauuagccacagcaagugugacuucggaguuugaguucccuaaacauuugugcuccuuacgucaguucagcuucuguuugccaguaaaggcccuagagcauccaugguucggacucugugagaaaaacucacuaucaucugugagcuucuugucacaggcugugguugggagauaaaacagccugugaucucugauuaagaguggcaccccuggaacguggccuuguuugagugacuuuggacaguuuauuuucucuuugccuccuuuuuuuuuuuuuuuucuuaaaugagaaugacugaaguucccaccuuauugagaucguuuaaggacaaaugccugacacgugguugaagccacaugaguuguaaccguuuauguuuuuauagcaggauauauguguuaacuaauuugaaauauucuguugaaauauaucauggauguuuuauacaucaaguccaguguugguagaggacuggucagggccuauccguagcugagguuggaagucuagucugcuugcacaugaucguaauagaaaaaaacgcuguaagacaguuccuggcccuuguaguauuuucaggucugaguucccugaggccagucacuggccccuucugcucucgaguggccugaauuaccccguuuuggcacacaguuggugcuuuauuaguggugucuaaagugugauuuuggaguguaugcuucuggacugcucugugcuuugccucuuuggugaggaggugguagcaggcacauaugccuugccaucuguuguuuauuguuucuguuagguugugguuugugucccuguugcguguuucuuugguuucuggagcaacugccaauauuauaugcuuggggaucaaaaaaaaguaaacuauuuauaaacaguaaaguauccuuggguuuggaaaguguuuuucucaaaugcguguauauuugguggcuuuauuauaaucucacugauguaucauuagacagugugcagauugaggcucaucuagaagaugggcaagucagaguccagccuuguguaaccagcacacaaacagccuuggugauaaggccccgguguuaacgcugacccgagcgguguauuuuuaacucaagaacauauaaacaguuuagccugcugauggaguuuauacuugcccaaaauccuuggcaugcccagggccggguggugcuggggaauacauguggucuuaggagaaugcuucgagcagcagucacccauggcccccaacccuucauuuuagagaaaggaaugcagggauggaaagaaugaagggacaggccgguugcugauuuuguauggugcauuuuacauugaacuuuaaaaagucccuuuucuccuuguuguguaggcgugaggugagguagagagcuguugacuccggguuuugucggugcuuucuccccucccuucucaagccacaaggggucuuugcagagucacaaauuagaauagacuuccugcugcaggcuguccacucccucucgagcuuccuagugcauuccuagcugguuccaucugcccgugcuaucaugugguguuuuuucuagcuucugguuugccagcuuguccugugcaugucuggaagaagguucuucaguuuuggagacuccugucugucuuucuuagaugucuguuccccggaaacuaucauuuguauucucuuugacuuggauucccguuccggaagacccuacaguacucauauaggcuuugcagggcguuaauguggcaccucaauuugucuguaagcugcccuagagucgagacugccuuucuuucuaaugcuucuuuuuuucccuccacagacucuagguagcaucaagccugauagauacauaauaugugcaggcagcacagguacagaaguacaaagacugacaguccuucuuccaggcucucuggcagggcuuggauagcucagguuggccucaaguuugcuaguagagaagaaugaacuugaacuucagauucuccucuucugccucccaagugcugccuuccaggugugugcugcugcgcccacucuauucaagggcagggcuugaacccagggcuuccugcaugguaggcauuugguccuggccaguggucuucuuucucucuaccuuucuaaguccuguaggaauggacagaacagcucuggcuucccagggcuguguaucuguuccuuuccccauugaccuacuuguuuagcagcccccuucaucuucuaccaagugcucauguugaauauuuagaagaacaggaagguuuuaacaccuuacaacaggaguuuagaagaugacugacaggcacuggaggcacugcccgggaccugucuucccuguggggucccuggguucugcuuccuugcuggagucuuccccauggcuguccuuggcaggugggccagacuguacagcuuuccucugaguuguguuuggccagggcacccauggcauauuucugaacuguugacauggucucucaucugcuccuuugccggagcugcccgguggagucuguuuuggggaggguugcuuuucacuuugacuaaggcugucuagacacccuuccccuugugguuauucugcucaguuuaugcugagcccucgccaggcagcugguuuugguugccugagcucuugguuacucugcuaagaccuccucugacagaaagcaugaauaggccaaggucauuuuucuuccucuuugcucuuggcagaaggaaggauugcucuccuugacuggauccaguacauacaacauucagggcagguuacuguauccucaggggacaaagccaaaguagcaacacagauuucuaagggccaguacaacagacucuggccucaaggacuuauaaaucugaccccuuucuguguggcccugggguaugacacuucagccccuacuccauccuuaaauacauaggaccucugaaggcagaggagucauugcagaucuucucaggguggguccucgcugggcaguugagaacagcugagaagacggcucugcugcggcucagccuugcucauugguuuugaugauuagggagacuugcuugggcuugggauucuucugcagggaggccuuuguaccugauaaccugagcuagcuggggggaggugugcuuucugacguugguugguugagcaaagcugccuuaaucuagugaacauguuauuaauuacuuuuaauuuauaugguaauaaauguuaggaauaaaaaagggaaagugcaaaagaaauggugauucgcuuuauuauucaguaauaaauaccaucauuuuguuguaugaguuugcaucgguguugcgauuaaaugccugcuucaaacugcagguguuuguuuugaggugacaauaugauaauguugugcaauccugaauggcuuugaaucccacagccuccugccucagccuccaaaguguugggauuauaaccccaagccccuuacaauaccuggcucaaauuauggguuuuuuuuggucuuuauuauuuuuugaaauaaaaauacgaucacauaguuuucuucuuuucuuuccccgaucccacccuuucugugcacaguucucucccuugcucuuucuaauucauagccucuguuucuuuaagaguuuguguguguguuucuaaauacaugaagacaaccugcuuaguccauauacuauaacuuguauguauaugguuucagggcugcuuacuuggguaaccaacaauuucaacuuauguuuuaaaaacucaguauuaugaauauuuccucuaugguuaaacuuuauauaaaacaguaugguuuaaguuauaauuaauccuucccugauaacgagccucuaauccuuuugugcauaguuauuuauauacuucuuaguucuuagacugaguuaccucgucuagguugcucuugauaggaaaauucuuaaggcuuuuacuacaacuucccccaagaaagcagcugccaaccaguuuccaagcuccugcuugcuuuccucacucucagcagcucagagacugcuuuucgcucucugugcugcacaccaggacgcugccucgcagccucccagccucccuuucuuuggauggugaggcugaacauguuucacugguuagccacagguucuuccucuuucaaucuucuucuucuuuucuucuguuugauccaguaucgaucaugaugcccuaaccgugggcuugagacuuggccacugucggacucucuggagcuggcguuucugagccagggcagaucuaauucuguagaaagcugugcuccugguggccauggcauaauuuuggcccugaaccaggacguucuuucuuuuuccuuuuuuuucuuagacucauuuugcucuuguguuccacagaggagaauugcaguggcucuguggguccccaggcugcuguaacccccuguggacucaggccagccuacucagccucuguaccccgucuguggccagagugccugguaccuacagcugguaggaaucagggcagauuagcguggccgagaacccuucaggaacagcuuccagcaaauggaaauuauuuuaaaacaaauugaugugguuuuucugucaaaccuacuuggagcguaaacaagguuggacuguaagcugcccgccgucuauggacaagccuguguuuagaguguggcuuucagcacaguaaacauggucucuaaagugaguugucauugugucugauuugaaaaguaaaaguuguaggcuggagccaagccggcagacaguucuaaggcggugcugcgcaagacaucacucagucauuugucuuucugccacaaagauaccacuuccuguaaagggcuauggagcgaggagucauuugguguuaaaccgauuaaggggaaagaaacaccagggcgauuucuguggugagauaacuucuuuuauguuguuccuuugccaugugguaauaucaaaaacaucuugugaaaugcuuaauucuuggguguuugugagugugugcccugcacccucuccccagucucugucuguguguaugucuuugaauucugugccaggcucaaggugguuccccaaccuaggaacaauaucuuauuaaauugguuucagccucccuaaagggugaaacaaugcuuuuaauguucugaucauguauuaaugaacagccaggccaaggggcacuugccaaaaagguuagggcgagaaggccaccaauaucagagggacuuuguacucugggagugugaauggucuugggugaaaggaguuuauugcacaaggggagcaacuagaaucucuuugauguuggcuagcauccuccggggcuucccagcuaacaggucucugcuggcuggggugcugcugcagcgugguacugggggggggggugucccugaacuugcccuugacugggaaggaccaguuagguaccugugcagaaggaagcacuggccacucagagggucuucagugaaguucaguaagugcacgcccuacugcagaaggaacagcuguaccucccgagcuuuccucuggagggacuguuugagaaccagcaugcuaguauucuaaaaccuccagccccaaccacagaaagagguuugauccuaaucuuaauaugacuaauuuauuuucuccccaaugcacugacauuuccuccugccuucuggccuguucuaaauuuuugaauggcuggcaauugggagcccugcuuuccauauccuuauuaaauaauuacucaaaagaagaaagaaaaaagccuuuucaaaaucuagaggccaugggcgggaggaggagcucccauuuagguuuuguauggugaggauuggcugagcucggagugaguauguccuuccagaagcagaaaggggacaguggcggaacuaucacagguucaccaucauaaauguagguacuuuggacucuccuguaccuucuagcaugagaguuugaaguuguuguuguuguuguuguuauuauuauuauuauuauuguuauauugaagugagguagcauuuuuagucuggaauuuugagucucaaagugguaggacacuauuuuauccccucccucccuuuguuuucuccuuccccuuucccuccccuccuuucucuucuguauccacucacccccuuccuuccuuucuuuuuagagacaggguuuuacuauuuagcccugauuguccugaaaaugaccagagcugugccugccucugccuccugagugcuggaauuaaaggcgugugccaccacuccuggcaggcaacuguuuucuuuuugacuauuagcuuuacggagauagaguuugaacaccacauucaucuuuuacguguugagagucugaguuuuuaguauguccagagucgugcagcuaucaccacuaauucuggguucuuuuuaauugcuccaccacaaaaccccaugcugguuggcgcucccauccccagccuuccuuggcuucuaguuuucugcauugguaagccuguuuugaguguuggguguaacuggaaacauacuguaccuggccugucaugcuaccugccuuugcuuagccuaauauuuucagaguucuuacauauuguacauaucauuccuucuuugcucguuuaaaaaagauauuuauuugugugcgcauaugugugcacucucguguaugggugcucauagaggauggaagaguguccgcuccucuggagcuggcguuguagacaguugugagcacucugaugugggugcugggaacuaagcugguuccuugucagcucagcaagugcccuuaacuacugagccaucguuccaucaccuucaccccacuuuaccuuuaaaacaucugaauaauguucagguuuuuuguuguuuguuuuuguuuuuguuuuuuuuuuuggauauaacaaauauugucuauucauuuacuagccagacauuggagguuuucuuaccuucuggcuggcaagaauagcacaguuaugaacuucccccaaccaggccaggucuggcuuuguagcacugccucugcuuccuguaugcugggaugacagguauguaccguaccauaagauuugacaugacaguuuauguguauguuuugugugaggguauguguuucuaugugccuuggacauguuccccagcauauguggaauugcuggggcauaugaaaaguacaugguuuggggugggaggauuccuaggcuguuuauaaagaaucuguaccauuuuuaaaaaagaaaaguaguaugauuucagguaaggaaaguuugggcuguuucucagguagggauguuccucucaggcuugucuucgggcuuagaucucuuggagucuucugguagaaauacaaguagaaaucacaaaugcccauuaacucauaaagguaauaucccacagcccauggugagugagaaacacuaaauccaaaauguauuugcuucuuguaacuuguagcuuagcaacacagugcuugguuguuuguguugguugcugggagcuguggcuugccugcagagagaguaaggaucagaccacacaucacuacuagccugggaaaagaugacauucaaaauuccaaguacagcuccuacugugugucucuggcuguugaaccuccacaaaguccaagaagagugacugucuguacuuaguggcuugccccuguggcagcacauggcagugguuacuguggggacccucgguaucugaguccagagggguucacagugcuggucucugccaggacagacuaggggagcuugcuuuucuguagccugcugaaauuugcuaugcgucugcacccgucucugggucugaucauuucuucugcuuuggggcaagccugcuuugccaaccgacuggcuauaaauuuaggucgaaaugcagaaagcaggcuguccaaagguaggcuggauaauugcucuggacagguuuacaauagggaggugugaagugcuugguggaggcaggaagcugggggagggggauugaacuugagcaguucagggagacggucugacaccacuaauugaaaacuauggcucugguggcuucuaauuggaagggaaaccagggcauacagugggguuuuguuguuuuguuuugaagcaggaaagcagagaaaaaaaccacucacugaguuacugaggaggucgguuugggaucuuuucaaaugguauugugggcuggaaccuguauuuuaaaagcuuuaggaaauugcuuuggauuuuuaagugugagcuuuccucuaaagugugcuugccugaacucagcugacgcccgaucaguuguuuaacuuauucucauggcucuuggcuuuuuuuuguuguuguuguugugcucuuuuacuugaaacacugccucugauacuaguuguuuauuauaccucagauuaagagcuagauucauuuucauuuauuccagacucccagcaacaacuugcagaaagucuguucaaaacugagguauaaaggauauauggggaguggaggugagucuuccuugaagugcagugguucucaaccugugggucgagaccuauuugggggucagaugaaccucucauuggggucaccuaagaccaucugaaaacacagauauuuacauuacaguucauaacuagcaaaauuacuguuaugggguagcaauggaaauaauuuuaugguugggggucaccacaacacaaggagcuguauugaaggguugcaguauuagaaagguugggaacacuguugaaguguguggugguuaacgguuaaucucuuuuaacaaggcucagguggaccuuuauguugccuugcaacugugauggauucauaaacccacacagugcagccaacucauauccucaguuuaauuuccuuugguugaaauaacagccagcagcuguuuggcagucucuuauucuucagcaugcugaagacacucacacgguggcuggagagaggcaucguuugcacacagcuuuaggauucauguccuggcuguaacauuucuuugggaaaugagggaaagugauuuuaagugagaccaaggaaagagucagagugguuagggugggaggggagaaggggcggggcgaggaggugcagagucacuuagucgcgggauaagaaagguccucugaguccgagcagcuugucucuugaauggugguuauucuagcucucccucugcuccacugugcccugcuaucuuuggggagugucaguuggaaggaucaggauuaaaaacgggaaagcacagucacaguacugccucagcagcaaagcacuguccugguggggagugucuacaguucuguaacuuacuguccaccuguucugagaggcaagggcagcgagggccuuacacauuguggagcccagaggcccaagaaccuggguagugguaugucuggcuucacaaacagcacuuugaagugcuaccugcuccuaauggcaacagaaccaucaguuaagcaggcagcugcuaagcacaggaguguuugcacaagcaaccuucacauuuucugauccuugaugaaagcuuguugguugugaaugauuaacuucaaugugcacgaggaaacgcuauccucuuaagugucagguauauuuuuauguaagaaaaaaauaaaacuaaccacacccucagcugucaccauuugggguugagaaucugugugcucauccggcgaauccacugggcaguguauuuaaagcagaguaggaauguuagugugugcuagcucuccgcugacugucacauucugugagaacgggaagaagggaauggguucugugaggcgcugagauguguaaacgugacgaucuuaucaggcugcagcgaguaucuagauucacagggaggugcugggugggguauuccuccacuugggaaacacguuauacgcauaacaucaaaagaguuuggauaaaaggguuggcuugagaagucugccccagugucacguccuagcacuucaacaagagcgauugaggcaggugcucugucuaaucugucccuggggagcugaggacuuugauuccagugcagugugucucuuugagagaauggcaaagagcugacugacuggggagcuacaguguagcaucccaggguacucuggaucacaagagacuuggagauagccauugugagucugguucccaccaugugcagcagugcccagaggucccuacagccccuugaagcugacaaugaugggguaguuauuucuucuaucauuuacuggggaagaaaacuugcgauaagguuuucauguggagucagaguggaugaggucauggggaaggaggaagggagaaaagagucugggaaaaccaaggcugaccugaaggggccauuucauagcuucccaaugcgugagagugguggaggcugaagugauggauguggugugagugguguggagagggugcuaggcaugacucuuggggcuugguuacuuuacugcaagcccaaagcuuugcucauuuccaggacagaaagcacgcaugcuguaggaggggagaaagcagguguuuugccuuucuucucugccucuuuauugucuucaggugcagugacauuugauauuggcaguucugaaauacaucgaaggcauuauucucaagcugcagggauuaguccugacauaaacgguggguccuaccgccagccucuuguauggcgaugaagaaaagaaacucaagcuguaaaugaaucucuguuuuggggcuuuguaguggcaaauuaugugaauggcugaauugaaaaggugccugguuuuauaccaucaugaauacccaggucuuagauaaauauugacaccagcagugugacaggccuaccauuugucucaugcucguaggaauaaaagaucuuuucucaggugcucaugaccuuauaaaccacccugacgaguuugugcaggugcuuuucugcacugcuucucgggguuugagagucggugguuuucucuuugugcagacuuaagccuugccugaucucaacucacuuuggcuuauugaucgugguugaguuggcugcaagugaggguagccacucacacaguuuugcaguuuggcagucauugggaugaccuggguugggaauaccuuuaaugacauugguugaauuugaagagugaggguggcuggauuaugauaagaaagggaaagcauguauagaccugugugguguacagcuauggagcauguauagaccugugugguguacagcauguauagaccuguguggugugcagauagggagcucagcugaguaaacucugccugaaucccaaaccauacuucucuuauggaacagagcuagccugacacuucugaagauaauaccaguuuugccagugugagcuauccagcaggcuagcucuccuacucuccagugcuaaugggccagggcagucauguuagggucauuugauuuagggcaggguggugagcagauucaucagcagcucugguuugauaccaucuuugaaaaggugugauugguggaacugggacuguuaacccguaggaaguucuagcuguucauagggcagagcgucaguggcccaaccucauaagugucugcaucugaagagacccugggcuuugauuucuugcucagaugggaggauacucuguggacugacuauucugccuuuccuaacauacacaagcuguagaguaucuagaucugugggucuacucuucuuucuauacacagguaucuaggcacauguguuguauuucuuaggauuuuaccuuuaaauagaacucaaaagggggucauuuaugugugauuuuguucagacuucuaaucaccuuugcugguucuauucuauaggcacaguagcauaucauuugguuaaaguaaaaggaaucagguagaauugacuggucauaucaacucucugagaccugccuuuugggagcaaaugaccaaaagucgaguggagaaggaguggcaugcuaccauaagccucgcugaugcaugaguaaaaaccaaacauuuguuuuguagccagcuuuccuuuaugugugguauaguuuuaguguauuagaggagagaggucuuagacacgcgucaccugauucucugcacuuguaaugucguugaaaagggaggcccauguagggacagcagaaagcaaccugugaauggugcgugcugaguccugcuguucagucagacacuggcuuuguaucugucggggauguuggcaccagaagcagagugauugccacugccccugcuucucaagcagagaagguaaagcuguggaccgucuuucauguccauagugucuuaggaugcuuuccuguggcagagagaaaacuggcuuccaucuucagcuaggcauccuguagaaacacaugcaaucuuuacaaagcuccuuggaaaaacagacggaauaaaagccccugucuguuagcuaguuaauaagguuguuagcugcagauaccuuacgccugcacccguguauaaugcggagcaccgugguaaauucuaguaaacaugggcuucuauauuguguuacggauucugaugcuugugcuugccguagacucauagugacaucacauagagaugguagcaggcagcaggcgugacguuaguuaaaaaugcaaggacacguguaagccaggggagcucacaguccacuggcaaggguuuuccuuauaagaaguugcaggaugggaaaguuguuacauucacuguguccugugcuuauuaaagcgguuuauauggcagagagagggaggagggacugauaacaccaagguaagcugcaguuuguacagauguauuuguuuaaaacacaccacuucuguuuccuucuuccucccuuuuaguggaggaaguuaggcagcauauuauguauuguuccuuuguaagcuaggacauagcugccgaaaauuauccuucugacugcuuaccuuaaacauugaggacaguaggcucggugguuaaaagcacuggcuucucuuucggaagaccuagguucaauucucagcacguacaugguuaucccccagugggacuccccccaugguuacucccaguacccacaguuuacaacuaucuguaauguuccagagcaccuaacauacucugacaucuucaggcacauacauauaauguaguuugaaaaaaaaaucaaauaaaauuuaauaguuggguguaauuccaacacucaggaggcagagacagguggaugucugaguuuguggccagucuguucuagagagugaguuccaucacagacagggcuauacagaggaacucugccccaaaggaaauaaaacaaugaaugaaugaaugaauaaauauugaaagcucuugauuauuacauguuaagaaaugaguaucaaauugauguugucuguuuguuucugugauaugaaauuuuguacuaguauuuucccucaacugguuuauauauaguagaagaaaaagaauuggaacuaaggguuuaaaaacagaaacuauaaaaaauuauuuccugguucuaggaaacuggaaacugguguuuaggauggucucugguggggugguccagauagaggaauuuuguuuguuuuuaugaaugccuguuuuacucagagaaagugcugagccauggagccuucauucuuaaugcauauuuauaucuucugccaggaagacagguguggaacuuggucccuuuaaucagggaugcuccuuauagagcucugcuaagaugguuauuuugcacauugagagcuguccuuucacggcucuuacuguuaaacacauagaugugacucugggcaugaaguagagaaucauuuuaggugcuggaacaggaaguuggucacagcauuguggguggugacucuaccagagcugacagcuaaauucugucgcucaucagaagugucuaucaagguaaccaguuuccaucuuccuauguauacucuaaguagugaauuuuaaaucugucuugugagcucaggaaacacacugucucccaagaacucacauuuggugggcuuugcaaaguacuuggagaacccaggauuucaaauuuauucacuaggcuaauacaucuuuuuucucagucccuccuguccugaccccuuugcccaacugauuuuuguuccucuagaggcaaacguuaguucccuguuucaguagagcauuaggaagcuccuuugccauccucucacugugagcacuuauuagcuucuaaguaaguggccagaagugagcacugucuguucucaggucugguggccaucuugggaucaugaagugcccaacuccgaauggaaccauacuuuaaaagguagauuaugacccaagagugacuguuguacaaauaaugaaugaggacucugggagaauaaauuuaugacuucuuuguagagaccagggaagaggcgauucugaggggcuagacuuguacccugcuucccugacacuuccauuucuaagucuguuugaaaccguucucuaaugguaaaauuaaauaguggcccuccauaccacuucccugcuucgguggucauggucacacgccucugguggcagauuuguguguguguguguguggggggggguaaguggggggaucaggcuugugacagguggccaucucaugcugaaauaaacgccuuuugcuuauaaagugcccaccagcuacagcagucaugggcuggaaugcaccuucaucauggaauuaauucauuuguagguguuaaugaugcacagaccauguuaacaagugacuauuauggggaaauugugacuuccccucagugucagccucuaccaagcaugccuuaauaauaauaauaauaaauaaaaccaugcccagucacaucaccccuagguggccaagcaaagauucuguaaggaaaacagacccuggaaucucuuuuguaaggcgcgauguacagaaagcgaaugcuguuugucuguagcgaugccagcaaacauuccggugucuuaggcuuuagguuaaaauguuuaccuggaggaacaguagguaguucugugacugagaaaaggacuuuagcgguccagugauuggcauuuagggagagucuuggcugugagauuagguuaggauuggaguaaacgugggcucucaccugcuuguuggacggaccaggaagcucugggcuccucuguaccacucugcccuuuccuuucuaugagguucuggucgcuuggcaucuuuagccauuuguuuuacccguuugccguguggccucucugcuccuccuaucuugcuacucaggacucuucccccagaaaacaaguuccuccacaucucuucugccucagccuugguuuuuuaaaucauucucgucacagcagaucuuccgugcccuggaugcuucuggacuuuaugugcccaucccaggggugcuagccucaacuaggggccaagcagauacugcugaugagauuagagggcgagguuguugguacagaaaagcccacacagugauuguucucgagagaagcugcaauacacucacuggggaaacaguuugugcuugucuuguucguuuuaacauacauacauacauuuauuuauuuauuuauuuauucacuauuuucauguguuuggguauuuugcuugcaagucugccuguauacuacauauagugugaguggaggccagaagagggugucugaucccucuggaaaugcugccacaaaugguuuugaacugccaugugggugcuuggaaaucauuuuuccaaacacauuucucugcaguucaguuuuggcucaggucuacuagugugcaacuuuuaguguaccucugugagauucuuucugagagccguuugguuaugguuuuuggucaggaguccuaccugaucaauacauuguaaucuucagacaacagauaacauuuuauccuaauuuauaucagaauuuauuuauucauuuaaagauauuuuauguguagggaugcuuuaucuacuuguaugucagugcaccacuuguguccagugcccccagaacuagaagaaggugccagaugccuuaaagcuugaguuacaaaugguugugaccugccaugugggugcuaugaauugaaucagucagugguuuuaccugaugagucaccucuuacuucccagaagguacaaacacagacacagugcuaaaugcauagggcuuauauggcuugaacucucuugcacuuuagaauucucaaaaggaacaauccugguuuccugaagugggcaauugccucuauaaugggugacaaacacuacgaguucugggguugaagaagagacaaauggccagagcauaugguaucaugacaaaggaguuucugggcuagcucugggcaccuccugguacucagaagucggccauugguugucucuuacccccaucccccuuuguuguauuucacuuuagcaaauaucugaaagcuuaaacuaagcaaaauucuguguaguccaggagcccagccagggcggagcaaugggaaauauacucacucggaggccaaacuguguagggaaaccucauucagaagggaaugcuuucccagacuuaggagcaacgccucccacuuugacuucucggcuguuaacguugagaaccagaacugugcuuuuuuuuuuuugguuuuucaagacaggguuucucuguauagcacuggcuguccuggaacucacucuguagaccagguuggccucgaacucagaaauucgccugggauuaaaggcgugcaccaccacgcucggcuagaacccugccuuuugcugugcuuugugcuucgcagugagaguuugccuguagaggcuuguuuguggggaugaaaugcuaauuguguugucuagugaagggagguuacuuccucaccacagcuugcucaaaaaguaaguggcacuuuuugucccucagcuuccaagaagucaguggauuauuguuugccagcuuuggagcaugcuugccaaguuuguaacaugugguucaggcuauaauccaggaaggugcuggucagauuauguaaauaccgauuaagccuauagcauuacacuagaguaguuuuuauuagagucaccuuccgagggacuugggauuuccagggcccauuuccugcugggauaguuauaagaacucggggccagucugguggugcagacccaaauccuaacauuugagaaguacaggaagaucagaaguucaaggucacucucagcuguuuaguguguuugagaccagcuggaguuacauuacuaagacccugucuaaaaaaaaaaaaaagacuuggauuaguuuauuaauaucucuguacacuuugaacaaagcucuuguguuauuaggaaacagcuuuggagugcuggugaucaaagugcagaccuugaguauaggcaagcacucucccacagcccugaguuaccauuaucauuauucugcuugguguugggggggccucacauaugccaggcaagcacucuaccccgagccccuaagauuaacuucuagcauccaucuuucuucuguaguugccauuucaguuagaauggugggguggucauaucaugacuuagaugcauugguucugacacaguuuagcagaaauuucagugauaacugaagugcccaccuccauguagugcacaugugucuguugagcgcuuacaauaugguuaauaugaugaggagcugagcucauagacugauaugauauuaagugguuucaaugaauggccacaugguuagccaugguagugaucucucagcuauugaaauucucuggcuuguggguggggagcuugcugggcagcaugcucagcgagcacaggguuguccugugcccgguuaaacagugugcuuuucagacacgccugaauaaaaccugagcuguucucugcagccuugccucuuguguguucugcaaauggugggcugcacgaccaucuuucagcagauuagcugaaaaaagugucuauggcugggcccaacuguuugaagaucagcgugcucuuugugcaagaacaggggcgauuuguguugugacaaggcugaugguacucagugaaagcagcaguuggcagggacuaaauucccgagguuucuuuccuugugcgcuaccgaaaggugcagaaguacuuucgaccguguguccugcugacagauggauuguuuugacaggagaaucugaacccuccacugaagcaccauucagaugucaggcaggaaggggcagccaugcuccuugaaauaagugggauguuuuagaugugugugccugucagcugccaccuggaggagcagaguucgguaguuaacccuuucacuggucuugggaucggaaauaaauucaugcuccuuucugcuggcuucgugggcuaaguauaugucuguuaauguuggaaaaugaguguugauauuaguaaguauagaggacaagcgguuuaaaagccuguuacuuuucuuuucuuucuuuuuuuuuuuaauuuugggaaaaaccacacuguacucauaauugcuuuauuuauagcagccaaaauagaaacaagcuaacugauccucagaaaguagguaggcaaaauguagacuguucauaccaaggaguauuguucaaccaucaaaagcaaugagacuuucacauaugugaugagauucaucuaugaaccuugaaagcauuguauuaaguuaaauaaggcagacacaaaaggaccuauaccugugauuccacuuacaugggguuccuagaguagaguuuauggagacagaaugaugguuggcacauacagggaaaauaggauuaggaaaaaguugauagugguggugacgaugggugugucugaauguguauguggucacugagcagcaacguacaaaugguuacauacauuuuauaacagugagcgagcgguauugggcauuuuuguuuuggccgguguuugacuauuuuauuccuuguuagauuuucacaggggaauuaacugguuucccuguuuccugcuaaugcauuugaggucucaguuccuucagaaauucaggaccucuucucaaauuuaaaagccagaguagcucugucuagggacaggagcaguuccaggggcugugagcuguagcaccuucacccugugcugcccacagguguuaugggagaauggcccuuucuaggcagucccuuggcacguguguuggucuguggcuuuucugguucagugacuauccaggcugacccagugagggcuaacacacuuaguguccugucuuuguagcagaucgcuggcauccugguaucaaagaccugguguuccucagcuccggaugacagugucgguaaagguucuuuucucaaucugcccuaagaagcagaauuaguguuucugaaagcuaguuauauuaucuuuccaagaaaauacaaagcauuggguauauggcuuuuaauggcuaugugaggugugggaaaggagagacaugauuuugucucagaguguucagaaugaagccaucaggacuauagaaagccugcugagccccagccccucccacgguccaugccuucugagccuguagcuucuggagaguccaggucccaacguaagcugguguccucaggccaaguguggcagcuggcagagagguuuuguuugcccuguccuugguuacucuuuuagguuuguuuuuuuaaggaacugagaacuuuucucauaagacuuggaguuucucugaaaauccaagcuuggugucagcacgagcccuugccucuggagugaaggaguaaaugccugugaagguggguagguggacuugcuggcuugcuccaucagcagccuaaucugaugacccucccaccugcucaguggccucugagagccuuuauuaaguucucuucagcucaaccacgccaauuacccgugaugauguaaguucugugcugccuuuacaucucccccgccuccgccccagacaauguucccauauccuuaaugauaaucugaucaaagcagcaaacaguaguccaggcagucuuuuaugauguagagaauucucucaaaacuggaguuucuuuccugggccuaagcuguuaauaucuacauucucauuaauaaauaucucccaagcacagucaaguucauacuugacuucaguaugugguuuaaaaauuaccaccuucaaucuuuaugguaacuuaaucucuggacaaauugcuuuuaauucagacugugccaugaacacagaugggccauuaguuucaagugcaguuugacuuuuauuuagacgaaugucuuugaguucacaguaaaauggcuaucagcucuaggguaguauugaucgaaacgucuccagaguaaguuuaaaagauauuuaccauuuaugauuaguagcauuguuaauuggcauuaaugucaauggaauuaauagccaagaugaaaaauguuaaucucuugcacccacaggccuggguggacuucuguggcaaggaacuggaaggcagugaaacucaucuugauuaccuguaguggcuucuguuccugauggguuagccuggcuuguguucagcgugugguuaaagaagcugagcugacugaauauuacugagcuuacucugccugcagcuaaggcuguguucccuaggcaguggaggggagagagguccaguucugaacaggaugggugcuguuuuacacacacacacacacacacacacacacacacacacacagcucuuguguggcuucccugccugggguuagcaagaguauguguccccaccaguuggcuuucuuuucuugugacugucauuccuaaucuuauucauugaugguaggcauccuguguucauaaauagucacaauucugaaucuguucauuugucuaaaugucuauccccccccccgacauuuuuuauuauuaaauucuuguuuugacugagauuucugggucugagaaugaacacugaggugcugugugccugcuugugggacacugacugcuuaugcuuggugggauguuugagaacaucugcagcuuaaucuaccagaucuuaguaccgccucuaccauugcugagagcugaacauaucucuagacauugucaugugagugcguggguugcacgcccgugugugugugugugugugugugugugugugugagugagagagugugcgcguaugcaugaaaaaucacccuuguggagaacuggcuuagacuaugaagugcugacaucuguuguucucucucucucucucucucucucucucucucucucucucucacuugauguugauacuuuaguuaaacauucauuuuuuaaaaagucaucagggcugagccuguuagugugcuucuuuaacccugccagaggcagggugaucccugaguucuugggccagccuggucuacauagcauauuuaaggccagcgagggagacccucucucaaaacaacaacaaaagccauuaagacuguccuugaggagucgggcaugccuuuaaugcuagcacucaggaggcuaagucacauucgucucugugaccagacuggucuacagagugagcuccagguuauccaggucugcuacauugagaaacccuaucuugaaaaaacagacaaacaaaagauuguccuugaggauuugcuguaugggucucagccugugggucucagccccuuuggggguaucagaugacucuuucacagggguugccaagaccggcagaaaaaaagauauuuacauuacaauuuauugauccauaacaguagcaaaguuauauuuaugaaguagcaacaaaaaauaauuuaugguugggguuacuacaaaaugaggaacuguauuaaaggguugcacuauuaggaagguuaagaaccacugacuuagagagugaaggcacacaugguggcaggcaagaaccaacucucacagauuguccuccgaucugcacgcgcgcgugcacacacacacacacuauaaauaaaaauguuucuguguauaagccugaguauauguaugugcaccauagccugugugagccugcaguuauuaguagagaguguuaggcucucuggaacugggguuacagguauuugugagccuuguagguagguacuggguaccuaagccuucugcaaaaacaguaacuacucuuaacccuuucuccaguccuaauacaugcaguuuuaaaaccugaguggcccuggacuugauacgguacaaagcauuuggauuaguacuggcccuucuuaguuucucaaguguugguuagccaguugguacuggaagucugcuugaguccacccuggaagugcagguucccggccuugcucugugcacucugugugcacugaagcaggcggggagagcgauguuuaugaagcucaccgugucuguuacuaaaacaggacacaggagggaaaggucacuaggcagaggguggagguuucucuuugagggacuuggugaguggggaaagguuucuuagucuuugaugaaaugucaacuauuaauuucguacuuuucacuuucucuucuaccagaaaccugaguuauaacagacucuccgagaucgacucugcugcuuuugaggacuugacgaaucugcaggaagugugaguguccccuaaagccauagggguggagggcaagaacgaucugggggaaaucuuauucuauuauacuguucucacucucccggguggcuggucucaacuuauaggaaggaacauuugcauauggucagccauagauggaugcuuguguucacguaaugccaauuucccgaguaauggucccaaaacacaggguuagugauaugacaauaggauaugccaaaaagaagcucugaagugguuccuuuaagugagaaaaugaaaauacaguaagguuuuguguaagagaucaaauucgcauaaauuuuauaauauaaguguuccuuaaauuauugucaaucucuuucuaugguugacuuuuguauggaaaaggacuauauauagaauuucagguacccauggagguugaggaguggagcccucauagauaaaggggugccauguuaaauuccuuucccuuugcuguaggccccguuuucuaugaagggcaugcuacagugcaguagguguaguauuauuggaaauccugguugcccaaugggaguauaagagaguguccuuugauggaagguccuguugacugauuggggaacacuucugugccagugcauucucacaggugccauagagguauaauaguguagucaguggugguaccuggugcuagcccaccacuugcaguuuccacaaaccuggcaagaagcaugggcaauagaggcuccucuucccugucccgucuagcaaaccaagcaucacugucacugagcaccaggcuugcuaccucuugagcauccuuuaaugcaggcccuagacauucuguauauuauaaagauuuaugcuuugguacauccauugggauuaucaagaauuuuagccccacagcaaguuuacagaaauuucauguaaguugugcaaagcucucgugauuacuugcuguaaacuacacacauaaaugcauauagguuuagaaucuaauguauauuauaguucuuuuuccuuguauuuuuuuucccaagacagucuugcuguaagcccagguuggucugaaauucauaauucuuuugccuuagccucccaagugcuuggaaauauagguauuuauggauuuauaucuggcuugcccaauacuucucacaguuaaaaauauuuuguuguauaaauuaaaauuuucccacauuauuuagagacuucauuaggauuacuuucaucuaucuuaggaaguuucugcugcacugguucccauacucccucgccagugccccucacuucuggcugucucucucuacauuucuuccuucaaccccacuucugcucccccuccccacuugaucuuuccauccugucaugccccuccaacccuccaggccuuccaaugugcucuaugcucuuuuaugaauauuuauauaaaauuacuauaaaucauuaucaaguuguguuauagcauuuuagcaacucauuaaguucucuacacauuuuuacuccaggcaguugaggaaagucuuugguggcuagucuuuguuccauuguagcgguauaucuaaugaaaccuuaauuuuacuuacugauauaguuugcaaaauagcugcauucccuauccucauggccagauuuuauggccuuuaugucuuuuuuucaaagcauagacuuccaggguuaaaucccagaguuggaaaugccuuguguugugccuucauuugcccaugaggucagugagacgggugugggaggaugaaaaugugaaggcggccaaggcuucaguaacagaucccguagaccgcuggcuucauuagcagaggcugacuccuccugguggggagcuagaaggcuguagggcuggcuucaccugcgcgcccucuccuuagcuugcaggcgguugcaacuuacugugucuucucuuggucuuuccucuguguucauggaaucucugguucucgugaugcauccugauuuccuuuuguacagauaccggucacaucacucaggauccacccauguggaucucacuuaaccuuagugacaucuccuaccccugugcuagagauuaauugcagagccuggaccaugcaagccaaacaguccacaccaagcugcagccucagccuccugagucuuuaaaggcuugucuguaaacaucuauacucugacguccuggagcuuuguccuucaauacugauuugaggaaggggacacaguucagucagucauaguuuucuaaguugguaagcuuagucuaccaggagcccguugacuuuauaacccagggcuuugcugugcuuugcuuugguacaggaugguguugacucuugcgguuauccuacguucaaauucucuugucauucucagagauuauuauuggaagagauuagaauuaugccauuuccugugacaucacagacuuccguuuauacuuacuugagugucugcuuugugccaggugcucuucugagccaagcgagcuacaaaaauaggucugugacuaggaugaggcaagagaaggccuguccuuaggcacugaugucacaagggugccaaagcuuaccagccacgauaauggauauuuugacgucacauuuaaaaagucaagacgaagaauauuuuagaaaguguacagugagcaaaacauggaaagucugaaucaguguugcugguguuuucccuuccaucucagcuccagacuggcuugaccacgcuguuuuugaucuaucuugucucggacuuuugaguucguucauuauguguuucacauucauuuugaccuuuaucuuaaauucugguaauagauucaguguccugccuuucagacauauuguaagcucguucuuuauuuucccuacauaucuguaccuugcucgugagcuuucugcuuccaugugguuuuacuccuuugaccuacccccucccccucaccccucacccccagaaucuccaucauaccauagcuaggaaggggccccccguguaccacagaccgcccuguucucugugacugcaaggccucccggugggaaaaugguuguucugguagcaagagugcuagauuugagauucuaguucuggaucuguuccugcacaagugacuuggcucuucagugucccuuucccuuucugugacauggacagagugacccauggucagugccugaugugcaugugugacuccuuccugcuuuuggaaccugcagcucccauccugagugcguuguuuagaaacacauccuugaggcugacagagcggacugcuugccacugcugacugccuccuaccucuguggaucauaaguugaauucaucaugcccagggcagcaaaaugaacuucucagugguggagacccaggacuuucccuuagagaauucugguaaauccuggugacucaaagagguaccagcagugagugguggaaacuagguaagaauauggaaggggaaaaaaccaaaccaaaccaaaacaaaacaacacaacacagcccacaguugacacaccagugcuuccaaauuaacugggcucaagucgguucucccggaccuugcggucuucagagccaaaggcgggugcaggaguugugguggcuuagcagugguuuaauuuuagaggcucuagaaccacauaacauuguggguugggaagagagagagaaagcaagcccuuuggaggcuccuggaggacaugugcagcugcuuccaagccacagcucuccacugcucacaacccugaggaaagcccaucagggagugcccuaacccggagugcuggacaccgaguccucuauaaucagagggcuauuuauacaguccucuaugaaaaggcccuuggaucacauuacugugguggcuugggggugcuugcuacuaagcugcuuugcuggggccacugcccuacacgcuuccuggagaggguaagggagcccugccuucagguauuuauggcucagcucugcucuguccaugcugcugcucuuucucucacccugcugugugcaugcacaagaacaggugcagaggguugggauggcugugacgugaaggaagacugaacuacugaggaguguuugauagacugcggcuguuaguuaauagcuaauagcuguuauugcuauuagugcugacugauaaguauuucccauguaaguauccacagccuaaacuuuuagauuuauuucuccuggauccugccaaagccccaugacucugguacauguauuauuuacauuuuuuuuuaaaagaggaagacuaagguucagcaagguuagguggcaugcugaggaucauuugauugguacggaguagaagaaucgcucucuguuuuuuaacaaucuguugcuguaugaccacaugccucugacauuguaauugaguguacuccugaaggacugguguguuacucagacuuuggacagagcuggacacacacucaucuuucacccuucuugucauaugcgacuauuaacuuggaccuccauauccauggauuugucaucuguggauucagccaaccacugauugauaauugaaaaaugcaucugcuugcaaugcacaaauguccuuuuuuccuugucuuuauguccuauacaguauaauuaaugguuuaccuagcacuuacauuaucuuagguaugcuaaguaaucuagagacaauugaacacagggcacauucaggucucaaacaggcacuguauauauuccuguaagggucuugagcagauucugguacuugcaggguguuuggaucaaaccuucauggauucuaagggaagauaucguauauuauccuaaaguaauuuuaucuaaccagcugcauauaucauagucuuaccaaggaaacucuuuagccaguguuauucucuagucccuugaagccuugauuauaaaacccguguuugcuuguaagcgcuaauggauuuuuuuuuuuuccuuguaagaaaugaccauccaaacuuccaaccugacuccuauggacugcagcuccaucucuguuaggaaacagccaacagcccagagcacccacucugucuacaaagagccaacuggcuaaauaaaugagugaacauaguggcuuggucucaccucccacgucagcaaaaggcuacccuguugcuggucagaagaacguuuguaguacguaagaaucugugugaaacagaaaugugcaagucuccccuagcugccagaggagcguccucugaggaaguguggggccggaagcguaaggaagcaugcuuuaucuuucaucggauucucauagucuucacugggguguuugaaauucuuauugccuguccauuucagccauuugguaaauuaauacagcacccuccccaccccccacuguaacccacaauuacuucuuagguagguuuuaugucguuuguuaaagccaaauuugacuaaguuaauuaaugaugaugcuguacugugaacugcccuuuaugacgcuguguauauuacagcguguaauauucucuuuaacaagcuacuuguaaguggaagcuuggagagaaagcugcaggaucagaacguuccgacugaccuccagggucagggggaagcaccccucccccagguucuguucuggggucgggcacucggugugccucauugacccccacuuacaccuccuccagcuccaggguugggccaugauucaugcucuggucuugaaucaucagggaaagguuuauaaaagccagacauuucaggaagauuugccgugcuuugcauggaaguaaaguuuuggggguuggguggguagagucagcagggaaaugcuagggcacagggcucgaggaauggaaguacacaaccguagauagugaaaguaccucagcucacacuagccuccaucuuuaaaaguucuguguucauggagacugcuguacacccagcacgucuuuuucucgcggugcuccagugcuauuuuugacuggucucuauuucagucuggcacacagcucuucgugucucagaguggguuugaugccuuugccuucugaggauugcauucuccuuuuggccugacaaacaacuggggagccaagagugguggggcuagccacuuacacugaacuagcuuuuuuuuuuucuuuuuuaaaguaaaaaaugaucuaaaaguaagcuagccaugcaguuaguuccugugcuuugggcuccaacuguccucuccauaaaucaggcagcccuguugaaauuagagccugcuauuucugacugagccuguugcuccaggacugcucaucaagauguauaaauucaccguucagcuguagcccugcucuaccgaugggaagugcuagcuagccccuugcccucgcucauuuaguucugugauauguauggaguggggugacuguccauauguguagcagggcuggccugagaccaggcuucucagcugagguucaccugcagggaauccuguacucauuguuucagguucaaaaucaaguuauaauaagcaggcaggaaaucuggcacucuugcugaucccugaggguucugaguggucaagccugccucgugcuuccuagccugugagcuugcugcuuucugauuugcccagcagguugucuccuggcugugcugcccuggucaugugaccccaggcuagcuuuuuaaauggacuuaaauuuacuguaauguagggaauaccaguugcugguaucugacucaaaguuguggcaagcgaugaaaucaccaaagcgcauggugcacgggcuguaauuacaaagcagcagccgguagcguugggcaccuaguucuugaggcuucccuccuucagccacugucgcuuauuuguggugaccuuggucuaguuacuuuacauugguguacugggauguuccugggaccuacaucuaggugucgaaagaugagguaagcuccuagagcgacacccaccccagucucuaggagaucacugcuguuauugugacuaucacugccauccugguuuccaguaaaccuuaagaaaugagcuuuuaauuuuuuuuuuuauuuauucacuuuacauccaucccccucuccucucucauacugucuuacgcagaccccgcccccaccccaacaacuccccugcgcaucagguugcugaagaacuaggcacaucuucucccacugaagccagacaguccauuuaggggaaugagauccacaggcaggcaggcaacagcaucagagacaguguucuccccaugacccgccaccccacuccaguuauuggggaccaagcugcuuaucuacuguauaugugcaggggccuagguccaacccaugcucaaucuuugguuggugauucagucuuugggagaccccagggguccagguuaguugacucugcuggucuuccuguggggucccuguccucuuuaggucgugcaauccuccuaacuuuuccaugagacuugaagagccccaucuaauguguggcuguguccgcaucuuuuuccaugggcugcuggguggagccugucggagaacaggucugcaggaugccuuguuggcagcagaccuccagcaguuuucuugcucugauaaaccgagggggucauuucuacucaucagcacaccgcugggcacuaagaagauuuauugguugagauuaggacugaugagcgcuuucagugccuccacucugugaugggaaauggcaggcaggaagagauaacaggagagaagcaggaucuaugugauuuagggggcagucagauaagagacuguuaaaguaauuaauugucuauuuccccaaacaagggcucuuuaaguagcgaaaggauuugccacaugauacagaccugccuucucccugccagaugcuucagacauggaauuagugaaaaaggcauucuguguccuacagacaguaauugccaaguuucaucccuaacugacucuggcacugaagaaagcaaaugggauaauucaagcccccaccacuucuauucauuucugaaaagauggcagccagccagaugauucaagcaaguauccaagccauguacuuguuugaauacagcugucauuucuguggucuuguccccaaauggagugacaugcuuucuguaagauguaccucccuuaagaaauugggaacaagauaaccaauuucuuuccccucacuccccuuguuaaauacuauuuccuuccaccugauccccucagagccugaacuuugugccuuggguuucuuaaggcuucgggggcuggcacuguaagucugacuauggcuucucuucccagauuuagccaugcgugcccauggaaagaggucagguuaccccucucggggcaggcaaggcaggcugugcuuuggcuugcggacuuucccauucaugaaaagauaggaacuguggaaaucuggauuuagacucucauaaugggacaggguccuggagagugaauccugucuacagaggaguuucaaaguuugcacuuuuuuuuguuuguuuucuucacaugucacauaguccaacuaggcuggaaccucaagaagaugagggugugagucuagccuccuuguuacaucagaagaggagcacuggaugccugggaugcccacccugcagugagcaggcuccugcucgcauucucucguugccccuugccuggggcacagugccacugagaucuguucuuccuaucuccgagaccuuugugacugcuucaguucgccgccaucguuucuguugaaggucaugggaacacauuuggcuagaaccugcaccagggccuguuuucacuucccuuguuagucugaugucugagcuugaugggaggccagaacauaguuccugccuguguguacuucuggccagggaugugauaggugguuagugguuuugacuucagguggcuugucucccuuuaaaaacgcauucuaaaugccuuaucucuuaccucacaucucauagccugacuauggcuaacuacagcguugaucuguuauuuuuguugugugugauuucuaacuacuaauguaaauguucuaagugauggauugcuucuucuucuuacagguaccucaacagcaaugagcugacagccauaccaucacugggcgcugcuuccauaggaguugucucucucuuuuuguaaguggugacaccugaggacucugggcugugugguggggucauggcgguuacugacacuugguuacugauaccuccuguccuuuuugguaaacaaugaccuucauggugccuaauaaugauuauagcaacacugucuuugcuguuugagaguuuauagaauuacaaguugaaaguuugcugcauuucuaauggggaaaacuagucuuuuuuuuuuuuuuuuuuguaacacccugacagagguacacagaacaaauccuuugcuuuuaguaauugaguucucacuugggugaugauacuagguuaaacgacugaacuaugacaguuuuaucuuugugcagugaauuuugguaaacgcaguuuacuuuuauggcccuaaaaaaaaauaauagagucccuauaaagcacuggcacccuccuaacagugaggaguaauccgucggcaucuguaguaagcggagacaaagccuauguacggcgcuugcuugugcaucucugagacaaagcaccugauggaaacggguuaugcgaggaaacacugauuuuugguucugagggguuuggucccucagagggggaugcgagugguguguagucgauuggucuguugcaguagaaacuuguggcaauggcugucuaaaugccacagagaggcuagaacuaguccucauaaccuccaaacaccugcuccuagugguacacucugcuaucuagccccagcuucuaagaguuucacaaccucuccccaaacaauacugucagccaaggaacaaacacucaaacgugggucugugggggacaguucaaaaucacauuguaauaccauguguuacuguagacaaaacauucagggucuuaaccagaaacgaagaggagggagcuuugaagguguugucauuuaagcugcuucuagccuuuucuggggauuaagcaccuggcuucacuccauuccuguggcaucaggugaagugccacagguuucagcucacucagcgcucuuuccaacugugcccugaguacaguaaugcucaauaccagguuuuacuggcagcuuccccagcagauuuccaugcguuacugaguuucccaucuuccgcacguuucucugcauaccuucaacuuguugguuuaaugauucauugccucaccuguauacauugguuuuuuuuuuuuuuuucuuuucuuucaaagugggcacagcaggcugagcagagggacuuagcaggaagcuaggaagauugcugguguggcuuacagaucugauucuggcuggccacaggagcuguguucagggcugcuguguccugugaacuguguccuggaacuuaacccuuucuaaggccugguggcuugcaggagagcacaggaaguagaaucugacucucuguguccuggggauaugacucgcccucucagaaccucuuuucccucauuuacaaaacgcaucccuuauucuuuacauauuccccaugagcaaggucaggacuaaaggggaguggaaggaauuuucauaaaguguuuguuaucccaugagacaugauauauggcuacugcuucuggcggguggcuugucacagcucuguggaccuuggagaccucucacuuuuaggggcauaagauuugugaaucaacacucauucugugaggugcuuuugugaaagcuguaccccuuuuagacaggcaaaggucugguuuuuuuguuuuguuuuguaucuacuuggccuuugugcauagcaucuggagaguguuuaauugcugguaaauuaggucaguuagccuuaugugaagcuaauuagggaugugauaaucccucguguguccaugaagcacagcccuugaagaugcuuguuaacuuguggcuccuggaagcccagguuguagaccagcggugccugucagcucccgcaugcuagaaugcagaaccucaugccacucccaucacaggccuuauuuaacaagggcucggccacuugcccacucaucagaguacaagaagugcugcuuucauucccuggcuccuuacuuggugaggaacccagagagggcuagcuccccaaagucgucuuaguugcuggaugagaaugcccugacaggugauucuugucuugacucgguaauuucucugaaucuagcaguugaaggaucuuuaucuucuuguucugaaacugccuuccugaugauuuacagugugaccgcuagggagcaugauuauaggccaucuugcuuccaacagaugggcgguagauccuugguccacauucagcuucucgcuuuccuucugugguguaucacaaagacacaucgaccuucugccucaacuucuacccuugguacuugagacuggaggggguagguucugacucucaguguggggcaccugccauucuggaugcagcuuuaaagcaugcuccuuccuucucucucucucucacucacucaggacugggucuucacaucacaguucccuucuuucucggugucaacccugggaaggccucguggaggagguucggcuucgugccuguguuuaauaucagggcaucaaaagggcuugagaagcuggggucaucagcacaauuucaguugguuauugcuuucugauugaaggcaucugguucaauuaacgugcuugucaaagagcagguuuauuugcauuaauguugaggauaaugccaaagccauuuguccuuaauagcagaaagcaugaaaacccaaggaaagcuuuuugauaggauuggguuggcgugagggagcucaugucauaaagauagacuuuagggaaagaaacagacuuuuguuaggaagggacagaaucugccagcagauguuuauguuugagauaaaaaaaaaaauguugguuuuguuuguuuguuuguuuuuguuguuuugggaaguucaggaaacucaaguuuugauugucagggcgacaguaauuugucugacaaauggaucgcguuucuguuggaggugugugcccucccuccagcgugacugcacuuagacuacugaguacuggaagcauccuucauccgucacugcagagaagcgggcuuugacucugccucgugcaccugcugccgcgcauuccccacgugauccuguagcggcugcuguacuccuccaggugucaaauguuucagacuugaacuugucaccacgccaugcucuuuguucuucucggucuguguccuggauaggcaggacacccgagcagcagugagcacagaaucguuugugacuuuguaauauugcugucuaaaguuuauguuguuacuucgaaaugcuuacuauuacuauuacgauuacuuuagcucacguguaugguuguuauagcuccacaugccuggugcucacaaagcccagaggaaggcauugugucccuugaaacuggaguuacaugugguugugggcuccccuauggguacugggaaucaaacucagauccuuuggaagagcaaccaguauagaaaucaauucauaaugaaaguguaauugaaaagcaguuuuaaaggggagagagcugugauuugcagacccuguaccuccacccccacuccugccaugaaauuaugccuaguccugagcuaagaccaucaggaauucagcuugaagcauaggcaaauuauuuucucuuuucuccuccccuucuccuccuccccuucuccuuucccccuccuucuucuccucuucaucuuugcguguauuauguuuuuagaggcagaucauaguucacagucacagguauaacuuggcuggguauagaacucaguugcuaauauucuugaaguaggguuuguguacugggacaggaguguuuuuacccuucaccugggguacaaguggaggaggggcucuugccuuugacuuucccuagcugucuuucaaacuuccugugagugcaucccccaaagggccaguauuugcagacacaauaaagaacucaugggggggaaaaaucccuucguuagcgcaugauguuuaucccaggaaggaugaaauaauggucaucuuauagcugaggcugacugucauaugggggcucauuguauaaacugggcguuguggggugugcacaguugagguggcuguagcugcuccccuucuugguguagcauuugccagucaccaguagaagaaagacaaucaaggguguugaaagcuggcugcccugauucaauaguuauguuugggucaagagaauuagcuuaugucuuccaaggugcgguuguccugcuguggaggaccacugccuagcuuuacgugagaugugggagaggagcccagggcugauguauucuuaagcccauugggcuuuggaagacaauaaacuauacauuuccuugugucaccuguguggcaaccuggagucgugggcuacaagugaauggcaggagacuacaggcaugaguaccauggauauacugaccaugccagagacccaugacccuuaucaguuugaugcuuauaggugagcuacuuggggcucccagcugacuuuccaagguacuagggagggaaggagcugaggagcacugaggagcacucuugugugugcccuaaccuggcaggacacauacugccccugaacagaugauuagagaccugguggcuguugaagcggucccccauucccccggggcaggagucaggguuaacaccucuuacuuuacugugauuaucaguuacuggaaucccucagguccuuguccuuaccuaagcccuaaggcaccucuuuguuucuuauggcaguuaaaaggguguuggugaggucucaguucucuccuugcucuaaugggccccccucuugucuuuccccagccuugaauuguauauaauaacccugccauuucuucuugcuuucccagccuucugcccugagaagacuuuaguccuuaucacugguaggcaaaagaaauaaugaagaaccagcuugccuccacuuuaggcauaaaagcucucuuagaauaaagauaaaccagguccauuccuguuuaugauuaaaccuguuucucaagcauugggcuaugcccccuguaaccuuaacuacaaaugguucugugcugccuguuucagguauggcaaucaugucuuuguuucaaaaagcuaagaagcauccugcuacccucccuuugcaucaaaggguugcuauagcuaccuuguugcgaccaccuguuguuaugccugccuugcaacccugucuuuguuucaggaaucaugauagcuaaucuguuauucuuauguucugcuccuguaacccugcugguuuuuuuguuuguuuguuuguuuguuuugccugccaacuccccauuuggaaacccuguacccgugagcuauaaaacacuugucuuccucacauccagggcuguucucuaaaauuccaauuuagggugagacagcuggcuggccaauccugggugcaccucuaaaauaaagcuugcuuuaguuugcucuuuccucuuacagugcucagguuuaacaauaaaagcaaagcaguagggcacaggcuggcucucauggacuuggcacuuauagauuaaggcugcuguaucuguugggaggcuccugggagggcccuaggagcucaguaacaacuggucagugucuucuuuuccuaaggaacaacaucuaccugcagagaaagacagagaaaacagauaaucaucauacaagggccggguacugucugagucccuucauguugcugaugugugcaugacaggaaagacucucagauaacgagucauuugacccaagguugcuuacccugucugugguagcagaguauggcauagagaaagaggcaucagagguuaacaaaagagccaaagccaguuggcaaagccacugggaaccccuccccaccuggcuauaugaaacaaaaguugaagcaaaagcccacaaauucuucaagagaaggugggugugaugggcaugaccugcauagggucuccaggcuuagggcaagaagcuuugacaaaagucucaguccugucccagcugucuagcccacucccaucuuaggagugccuuucucuuccuuaauauacuuucccuaucucuauaacugucugugugucccuauuguaaucuuuguucuaugacucaagaauuuggaaaucucagcggcuacccuguggacucugacccacaacucuaauauuagacuugcguucuuaccccuccuggaagugggugugauuuagcacuguucagcuagcagagugagacccugaggcacucagggguacuugcaggacgacuaggacauggcuagcuuuauuugggggccaauuugccuuucugucuuuuuuucuuugucagcgagugggcuguuaggcaagccagcaagcuucuguugaaaggcccgagaaggaccuguggacucagaacugcagucucauuggaugcuggguaccaccagugagccuggaaauagaaaacuaucuacuuuuacacagugaucaguccugugucccggcagcuucccggggacucugcagugcagacguccuuuugcccccaguugaagugagccuuucucugggaaaggagcccauguggccugccuccuagagagccugccaaauuacacacagucaugacuggucauuuuccuucucuccccccuccccugucuuugagaguggggguggugguaagccagggagaugagagguacaucugcaaguuauuugcugagaaagugaagggaacaccagcugcagagcuggggagcccaggcaggggggcgcuugccgaauaccaacuuggucauggaggucccugccuuuuugggaacugagcagcugaaguugugcugauauuaguuaggccuuugggugguucucucccuccccucucccaucucucccuuuguuccuccccuuucucucccucucucaauauaguacaggauccagagggaauacaggcugcuugaugcuugagaaaccaggaagacuuggaggggaggagccacuccuugcagcagcgggcucugaacaccccccagggcuccgggacuugcagcuuggaagcagagcugcucugguugcacaaccucccgugugaaaggggcuggcuccugcccacaccagcagacucauuccaacugggccauuuccuucuccccuccucccccuccccacuuccugcagguggcuucucuaauccaguuagcacuuggggaagccuccugugccugugcaccuaauccgaaaauggcuggcuugacuuugaccugcagcgugaccuugcaaagaaggcuggaccuauugugucugcucacaccugggagccauuuucagcuguccuagugcaagugagagaaauguguucguguuuauaccaggcaggccuuucuuucauaaggccugucauuguugggcaguauauauggaauguagaaucaacccacuugugcagagguugacaguuugucaagauaggcuacaucgcuugguauauugacaggcauaugaaauaaacuuuuuuuucuuuuaaauuaaaaaauggccagauguuauucuuccaccuuuucacauauaagacauugauagcagguuuggugugucguccuguguacguucugagauccaauucuguagcccagugagauugcgaaaagcacaggaaggcagguaucuuccccgagguuccuuuucucugcuucucaagcuggcugcucacuuuguucuggaaucuguggucugggagcuuaggaggguuaauacaacuugauaugccaaauccugagcugacauaucaaguuguauuaggugugagaccccucgggguguggggcaagaugcggucuguccagguaguguuugcuuugcaagcauucugucagccucaggugagcucauuugguaucauucucauuaaagauugcaaauccuuggaaaggcuuccugccucugcacuucaggcuaguccuccccauccucucacucacauagcugcugcugcuucuggugguggugguggggcguuuauggcugucuacuccuaagagcacauccagggacgugauccugcugccaagccucugcagagccccagcccccuuugugguaaugccagcagaguugcccacaauggggaccugcccuugaagacaugacucuagggcagauuccggaguacucuccucacuuccuggauguauuucaaacccaaacagcugaggcaaaggugccaauuugugguuucucuucccagcuucuuaacugggugcugaguguggggaggcugcagcacuggcacccugggcccugucuccagugccagcagccucugcacagcugcuugggacagagccuugggggauaaaaagguacuuucccugggagagcugccggggagucacuucuggaccacguggcucuggggugaaggugaauaggaucuccuugcuuccuaccaucuccuguagcuucagguugcggugagguggcucuugcuuuguugcugugcucugagacuauugcuuuccuuuaccugaaaucaggaggccuggaauuacauagucugucugccuggaauugaucuuacuugcaggaauuccuucugaaugaucucuuguaaaccuguuggaguucagagacugugugugugugugugugugugugugcgcgcgcgcgugugcgcaugcucauucuugacuuucuguuauauuaguuccuucauuggaagcuguggaguauagcucucuuacuccaccaggccuucugguagcugugacuguccuggcauuuuguucuuguuacacguuuuacuuugguaccuuaaaguaaauuguugauugacaaguggcugugagaaauagaaauucucugaauagcuuuagcuccauuuccucuguggugcaaucuuguaaaauuucacaaccaggacauucauaucauauagucaaguccuagaacguauccauccccacuaaaggcccuccuccugcauggccacacccacugccuuccuuguaacguguucugaagaggaaacggacuggacagcacagucuguugggauugguccuucuguugagugugauucccuggagguuggugggguuuguguguugauacuuuguuccuuucugcuaccagguugggucuaaucuuucaccacugaaggacaccugugguccuuccaggcuuugauuguucugagaaagacugcugugaccaaucaucuucagccuuauuggcuaccugugggcuguuuuuauauuuugcugguuuugauacagcccaggcuggcucuugcacccaagacccaagugcccaacuaucugugaaucuuuuugcugaaaugucagacuucuugcuuauuuucaaacuaguauuuuacuuuacuuuugguauuucaguucugcaggucuuuacauauucuagauacugggccuguguuggaugugugguuugaauauguuuuccucuagucugaggucaaguccaccaccuucuggauuaugcuuuuagggucaggucuaagaauuugccuagugcuaagcuaaaagauuuuuuuucucucucucucuuuuuuuccccuccauauguuuugcaggcuuaccuuuggcauuuaagugcacaauggcuugcuuuaaaagcaugcaguuccaagaaaaaaagagcacacgcgugcucugguggggccugcagagcagacuggacuggggucugguauucaggggugcagaacaguggcauugaccgugguguugcucugguccuguggcaguugugucaccuaugggguggauaaggagggcaucaugaaagggccugcucaugagcccauccuugaaucuccaaguguacuuaauucauaugcugaaaggcuugggaaaucgugugguaagagagaaucuaaaucuuauaaucaguagaucaaaagucuuccagaugaggcaggaaacaggccugguuuuauuuuuaaaggcacaacaugguauaacuccccagagggagaggacuuugucucagaggcugcagccaaaugcugaaacagcuuccuccucugccuggaacugcagggcuguuucaaagcuggcuuauggaucuaggggaauguuucaguggcaggcagcccguuggugccccugaagaaauuucuaagacaucccggcuccaccaguuuccuuuuuguuaucuucuugugcuucuucugcacacaggacaucauagcugggagucugagaacaccugggcuugcacccuaguuagcuggauaacucccagccaggauguagccucuucaguguggaccuggaugagccuugacugguaugguugggagcagaggguggaaggcuucuccuuggacaauaggucuaaugcccuagagcaacaauguguuuauagcuugugcacuaagggcgugggacguucuuugcaggugugugggucacuagggguauauauacaauguuuccuaguuucauuugcuuccuuggcaucuguaaagacagguccuacugcuguucugaucacgugguugccccucacuggggaugcuucucucugaggggagguucuggguucuguccagugaugaucucuuccccagggaucugacuacugcccuccuccaucuugaggcuuuuccacaucucugagacugugggugggauuuacauucugguacaaaguuauuuccaucugcaaagugggaaggccagccuaucuguggacaagcuccaguggguuuaauccagguuccaacuacaguggcuuuuuaaagggucuaccaccuggaguaggcucacaugcugugagacuauguuaggguacaggguucuauaggagacuccagacugcaguacccggaauucucaucugugcacagugcacacauagcuaauuaaugaaggcuaugccccauacauacucuuuaccuagguauuuccaguuaaagauuaggacucaggagggccagagugauggcucagugguuaagaguccugguuguucuuccagaggacuaauauucaauucccagcaccuacaugacuccaggcccaggagcucugguguccucuucuguccuuuguaggcacugcacacuugugcacagauauauauucagaaaaacaaaaacaaaaccacuucuacaacauaaaaauaaauaaaaucuaagaaaauaauuuuaaaaaagauuagguccuacagcucagcaucuaaugcacauuuaacugguuuuuauuuuuauuuuuuaaauaagcuuauuuaccaaauuggaaagcacaguggcaauugugcaaaauaguaagagugaaaauuugauugcugucagacucuggugagagcucuguccucccuuucuccgucuaggacuuuuagagugguccccacacacacugacagcccauguauccugccucuggcguaccacauuggauagacgauguccugguaaacuugacacccaaggaugacaugaaggauggccaugacaugaaggauggccauaugaaggagucugugcucugcuugggaauguggaaugaggucacccuguuguugaggucacccuguuguuucucauccuaguuacaucaguuuuucugguccuggauggugaggucaguaggaagagggaccacaagaguuggugacagagcccguugguguuuggacuccugguguuccccucacaaaccagcauuuguguggggucucuuucaugaaaacccuugcugggauagagcccuuagaggagagagacuauuccuaugguuacuuggucagaguaccuggaguauguugcuggccuuaaaagguccucuucccaucuuguuuugguaucugccaucuccuaccuuuucuccuucuccauccugguaacaggaagaauaauccacuuaguggaccguuaggggcaaggcacugugcaauaacacgggugcugccuggcuuugucugacuuggucguucagagacaacugcccgaaggcuaggagagcaguugcuccucauuguucuguagaguuuucucuccuacaggcacgggccaugaccuugaccacguaagacacuggccuuagacuccuuuacucuaagucaggagaggccaggcuggucuugcugcacccuucgcccuucgguugugccagggaugggggcuucacagccugguagucugcuaaagucuaguggagggggaugcagggaaacaugguggaugugcuagggcgugugagguagcagauguaccucauagguagacuacggucgcuagggucagaaacaaggaaaacaaucuuggggaagagaaagcugaaagagcaucugagggccacggugguggccuugaccaggaaugaaaacaucuguggcuuuucccuguaggaugucuguauguagauggaaauucuaauggucucauggcugauagacaacacgcuucccugcccagauaucaggacagauucccuuccugcagguauggaaggaaguccaagccuuuagaaaucccagccaguacuggggaucccagcaugugucccuggggauuaaaggcagauguggcuuuuagaacacacuggucagugacaucugauuggaacccuucugagggagugggaaagcauugagcuggugacauuaggaugacucagacugcugucauccaucucuccagugaguuuuaauucagguuccagcuacaguggcuuuuaaagugaaccaggcaaaaagaaacagcagcuagccuugauguagcagugucucacucacccuugcuaacuuggacucauccauggaucucaguguuuggggcugaaugaaaagguguaaguaacucagaaacccacuucuucccacucuauuccuuaacaucgccuauaggcuccuuaccuggaaaggaaaguuagcucucugcuuuacuucuaauuucccugcuuuguuaacaaauguuagcuuggugguuuuacuugcauuugcuucuauguaauugucaggagguugagcuacaguuguaauucacuuguuugcucaacaacccuugguagagcaacuucuguauccuaagcauuuuucuggguucugaggguauagcaguaaagaagagaaguguguacucugcauucugcugcugggacgucaggacuguauaauacuucaggagacuuuuuugaggugggggcagagauuugagacagucucacuuugcagcccaggcuaacucuggauucauuaggcugccucaucucgugagugcuaggauuauuggcaugggccauccacaccuggcugagauuguauuuuuaauuaauauauuuuuagagcagguacaggcuuauagaauaguugcacagagcauuccucuagcacccccuucuaccccaaugguugcuucccuuguuuuacugugguucguuauguuugaugaaucacaaauugauacauuaucuccugguauuggaauucuauggaucugaaugugcagugucuaccccgagacucuggaacuccacuuguuuuaccuauccauccugccgccuucccuaucgcucuuggcaacuacugauaccuuacuguuucaguguuuuuaucuucucagaauuucucagaauguuguucuucagaguguguauuaggaagccuuuucacgugggcccuuuuuacccagcaauguacacuuuccccaggacauucuuuguuaccguuuuauuuguguaucuuuauauaggauacgacaacacucugacaggacuuccucaugaaccaguucuccccugggcagggucccucuauacccgggcuucucgcucuuccuaaugcuguuccuuuaauacaguuccucauguggggacccuaaccauaaaguuauuuuuguugcuacuucauaacuguaauuuugccacagucaugaaugacaauguaaauaucugauauucagcauaucugaugugcucgugaaaagguuguuagaaucccaaagaggugaagauccaaagguugacagccacgacucuagacuuaaaugaugcugacugcuccuugguuguccccugguucuucuucguaaaccuuuaguuucuagcucaguccuccuaagccgauggugggggaaccacgugggaucugccacuguagccgcguccuuggggccaugcguucacaugggcaugagacaccagguccuuuuuuuuuucuucccgagaguuaauggaaacugucugcugaggaccccaagggggucagugauccugaaggaagugagccggcugggagagugguugacacagcccaguccugccuuaggaggguugacccugccuggcggaggcuguuuauccugccacugggcugcucuuguuuuuuauccaaucuccaccugaauaaacagauucagaacgucaucugcagccaggcugagaaucugccaaaauuccccagggaacgggugauucacuagcagcaggggaaagagagagaggcagugggcaagagaccugcucacccugauucucacuuccuguccgccagaucauccgggcugggccaucuuaaaagauacuggugucuucaagcagguugucaguucacacaaugggccagaugguucugguuuucucuuuaggaagaugguuauaaaccaggcuagugggggcaccgagaccucugauugucaugcugcacucagccuuugaaagcucuucugugcucacuugguuuaaaccgcuccugggccuuguguucaggcugcauaugggcacuaaucuugacaucauccuugccagcuuauaccuuacacauguucucaucacugcucauuguuagguccucacuucacagcuuaacaaggugauuacauugaauguuugugguucugagcuauguuccugauacuuaaggcucuuuuuuuuuuuaacauuuacucugagauggauggaugaauggaugggcggauauauauauauauauauauauauauauauauauacauacauacauagauagauacauagauuuuucaggagcuagucuucaguagucagcuucuaccaugugggucccaguggugaacuuaagguugcuagacuuggcagcaagugucuuuauccacugagccaucucacuggcccuuguaacauaauagguuuuaccgagaagugggggacaggaacauggugugacuuccggaaaugguuaaaugaaacagcauaaaauggguauuugaacucacuguuucucagguucauuucaaccuuggagaauguagucuacaagaaagcuaccagcgucugcgugaggcugaaaaugugcaugccugaugaccguguguaaugucaggacuggcccuugcaugccuaccagauaugcaccaacaggccuauuuggaagacuuuccuguguucaugguuaugauuuuucacaauagucccagcuggaaguacuccaguguugguuuaaaaauggaauggagaaaacaaacaaacaaaaaacaaauaaccaaauuaaaugucaguagaaauacgaugcuguaguugggguggaggcucaagcuuuaggagguugagaguagugccagccugggcuacagaccuagacucaguuacacacacacacacacacacacacagaggcagacaugcaugcacacacacacacucuuucucaguagaaaagagcagucugaguagaacuuaaacucugagggaaaguagcuagaaagagaagaguuuauguggaaugauuuuguguauauaaagcauacaaauagauacaauuauucaugguuggaagaaacuauaggguugguuugagaagaauaacagcuaagagaaugucagucaggagguggcaguuuucuguccugaucugagugacgucacguggauuguguaugugcuuuuuaacaggauacucugaacugugcauguauaacauauauaaaagucucagggugacuaguguaguguuacaauguuuauaaauguauauaaauaaauaucacguggccugcucaagggugccuugguuuuuugaacucaucaucucaguugugguuugcgguggaaccgaaggucaucagugaucggaugugaggucuggugaacuagccagcuucagucugcuuuagcguaguuggggcaguuuucgggagccauacacacaguauggcugucugugugcuccacucucuccaacaugaggcauuugaaugcaaacaccccccuaagaagccugagggccucucagugcugcacuguuaaacuucauggagggucucugguugucucacaucgugccaguuacauguaugauguguuaagcuacacuguaguuucccgugucugaccagacuugagugucugcugagguugagcagugggcugugugcuaaguggcagagucucuuaaccccagagcagagcugugcuaugcaacgugcucuaugaagccagaguuguccugcugcuggagggucugaucaacugucuccaggcuggccaugggaaugcugggcuggaggugagagaguugaagguaugcugggcauguuacaauuuuuuuuuccuguucaggucuagauuguguaaaaaaacuauguuuucuucagagguucaagcaaagaguuguaauuuggauuuuugcuaacuucagugauuuaaaauuauggaagcuuuuuuauuucuuguuaagaguucacagucauaauggcuugagagaacugaaggucaucaaugacuggaugugaggacuaguuuccccccaacccccaaaucugcuucagaagaguugggacaguuugagagugacacacacucuggugcacaccgugugcuccuugauagcugcauuggcugaacucuuuccaucagcuccaggauguaaccugggucaucuucaaagaacacgccaaagcugggaauccggcuuucauuuacuucugaagagcuggaaaagacaggcaguaaagagugcaacucgagauguccaccaugggcaaggaggagagggagaaagggagacagacggggagguuuucucuggagagggaugcugagcacaauuuugcagguagcuaaaccugauauaagaaggagacugacacacagguacaaaacuguaccacaccuagaauuggagucucuccuagaaacagaaacugauugcccugcuacccagaagguagcaaauaauagcagaugcccagccugggccugcuucuuguuucuguuaguaaaguuucagaagagcacaaccaugcugacuuuguauugucugugcugcuuggacacuguggucaaagcagaauuugaguaguugugacaaacaucacauggcuuacaaaacuuaaguuauucaccaccuggccucuuccagagaaagcuugcugguucagacagugaguggggugcacaauuucaggaaccagaaauugccacucgaccuaccgugucccugugccuuugauccacucaccucuccuccuggcugugaucucugacauaagaucuuuuccacuacuaaggggacguggugaaccaggcuucacaggguggaguggaacaggugcucgugauaagaagucuuaagugcucuucugcaugccucggucuguuuuacugucuaauuuaacaucagccugaaaguguagccaaguggagggagcuuaucaugcuuacccuccuccuuugaagacugauauuauuuuugaagccuuuggcagguguuccugugacagacuucugcuguaucgaguuuuccuuaccccagagggcagccucagggguaaacuaacacaggauagaagugaguaccacgugaccaggcugacugcagaaucacuggcuuugugagugcuccuuugaugaggccauugcugccccccaaaauguagccuuuugcugccucacuugcccaaugaggaaacagcugucugugagccagucucccuuccagugugagcgaggccuuugguuccaucugucaugcuugucuaggcuuggucccacagguccuguacccguaugcuguucauguagaauccugggaaguuggaacugguggaagccaguuuacauagacccaucagaguugaucaagaaauaguuagcuaggggcuggagagauggcauaccaguuaagaguacuuauugcuuuggggcuggacugauggcucagcaguuaagagcacugacugcucuuccaaagguccugaguucaauuccuggcaaccacaugguggcucacaaccaucugcaauggggugugaugcccucuucuggugugucuggagacagcaacaguguacuugcauacauaaaauauuaaaaaaaaaagaguauuuauugcuuaucuagaauaccuaggcuugauucucagcucuuaagacugcccguaacucugguuucaaggaauaugaagcucuguaagcacaggugcucaugagguaccauggcauacauguaggcaaaacuuacucauacacauaaaagaaaaagaaaaagguauagccagcuaguaugcaaauagagucaagcuuucuguguacuugcugggagacccuuagcaggccaggccaagacucgagcucuccuggguuugccucacaccuccucuuacaucuaacugugaccucaauuaaguaaauuccgacagcucugagccuucauugcuuugaaccaucaaguagaaauggaagucacauuuaccuggcuagauggcucuuugguuucauuguuuuacccaggacuggcuaugugacaugcagcagugggucagcuauggucaugaacuuggagaugagucagaguauggagaugaaugugaaaugacuuguuugaauauucauuaggaaugggguguuuucucaucugggcuguaugggacucugucuuaagcaaacaagcaagcaaacaaaaagaauaggaaguuuugugguaugcugucuugaguuggugcagcagaugggcuuucauguccucugcuuucaggagggagaagggauggcuucucugugugaucuccaugcuuguccuuugcucuagagccaggaggcagggccagcgagcgaccaagaagaaacgguguugggggugcuuagcacucaugggucaaagaugcaugcuugcuguaggaacaagaaguggaucuaccccagcugguuagaggucagucuuggauuugcuuuggagucuggcucccugagacagcuugguuguuccaguggcuggaaaugguauucuuaccgcugaagcaggccugguuccuaagugaagaagcugagagcucugacucaguccuuuguuccugagagaagagccaggcuugccuauuugcauugaaugugcaauggaacaggagggagccagucagucagucauuguucucacuuuuuauuucaaagcacuuccuaugagcuagauucacagauugcuucugaggaugcaaugugacuaauaaaacaaguacucauuuuauugagcaacugcuagaacauguuaggucauaucagccuguggguuauaggaacuucauacuccacuuuacaaaugcgacucuuuaagauucacaccugugaguggcaccacugggcugugagcuugagugacagcagacacagcacaucuccaguagggcucagacagaucuugugcauguucacguugauugucuuucaaggagaacacagagaggcucugagcuuggcugaguguucgggaagaguuacuuggggcccgggguguaguugauggcaaagaugaagccccagagagaaugugguuauauucucagcagcugggcugccuuggacaugacauagguguuugcaucugggcagggcugucagaagaccugugccguagcaaacuucuuccuguugauucugccugaaguucuuugcucgaacgauuucuuuugcaagaaugcuggugaaucccauuugugugcucacccguagcucuuuugcaucgagcugcauucccucuuggugaccuguauugcagcuuguacccuucuagugccuggaggcacagucggaaguagagacacgucuuucuucguggcagcaugccauggugggaaagaagauggugaacuagauaaauaugcacccaggauagcagacagcaguuggaguauagacagggcaggugacgggguggggggggggaggugguggugguggugguguaugugggugugugauuucagaaaggguagccaggaaaaccucacuagcagggaguaggggaugagacgcacggcucuguggagugucccaggcaguagaagcuggagguacaaaggcugguggcuuccccagcgaggacagauaugggacagagcaucugaaguugaagauuaggagcuuaggcaggucuggcacagacacugugccuagaggccugaggugacaggugggcuacaguuaggguggaguugauuucaggagagguguggcaggaaccaaggacuccguuccuuuugacuuuuaauuuuuuuuuuuuaacugaaguuaaaauagacaugaaaaugaagcaggaaguucaguagguuuuugaguuuguuguugugcagccuuccucaaggggcuuccugaccugcaauacuaaaacuccauguccacugccaagcaaucuuuauuuuuauuuauuuauuuauuuauuuauuuauuuauuuauuuauuaaaagccccugauuuugcaaccacuuuuauauuuuacuuuuuggugccugcccacccuccuuuccuuccuuuugaaacagggacucaucauauagccuaggguaccuagaacucucuagaacuugccaucaaacuugcaauccucagggcuaggguuaggauuagauucuggcacccacguaaugcuaggcauucugaaaugcccuuagcucuagcgcugagagaucuaauaauacccucuucaagccuucacaugugcacagguuugcauuacacacacacacacacacacacacacacucaaaguaaaucuuuuuaaaaauuuauaauuguuagugcuaagaaugcuauuuuguauguguuguacaaaaugauaaaaguaugguuagggccauguacaaacuguuggaaauucuauccuaauuuaaaagagaauucuuugaacaaugugugugugugugugugugugugugugugugugugugugugugaaacugagaucaucaacugaaacagcaauuuuuaaaauguaauauuugaauauauuucagagaugaacuaguaugauccauguucagcaaugaccggaaaguuuagaagucuuugcuuuuuagaguuaaacaauuaccuuucuauaagaacagagagcuugcacaaugguaggcauauggguguauaaaauagguauacaaaauaaaccuacugacaacaggccaucaauuacuuugaaacauuucuuugguguauauacaaaucguacaguaaaagcacuggcguuuguaacugacagucguuucaaauguaagcugagaugucuuucuguagcgugcggacacacacagcacagccauugguauucagacccugggcugcaguaaguccacgugauccaccauggguaugugcaauugggagcacuagugacaccuucaauuuugaauuacuauuuugucaguguacauucagaaaccuacuaccgaguuuuccccuccuccaugcauccauucaguuauacgaucacacauacgguggcacacacagcuuaggcaacucuacuuuaucccuaguuuucuuuaaucaucugccacuagacauuuggguugcuucaccuuuugaauauucugaacacuacuucugugaacacaugaaagugugcccuugagaccugccuucuguuuuggggguguugaacaguggugauucugaauggcuaugauugagguaacucuucagccauacuguuugcugcagaucuucacuccacacugcuugcugccauccauuuucuccacauucucuugugugccuuugauagcagcuaccauaacuuggauuuauguuucccucaggaacacugaugccuacugggcauuuguguaucuucuucaggaaaugucuauuuaaguccucugcugauuacaaacauuuuuguguucuuuauguauaugcauguuuaugcgacugcaugccaugucugagguggcuguagaugguaucucccuugagcugcuguugcaggcccuugugagcacccugacauucaugauggaaacugagcucucucuccagcccucuuugcugauauuuuaaucgauguuuuguuguugaauuguagugguuccuuaucaauaccuaaacccagaaugcuuaaguucuauaugcaaacuaaugcaggauuuguauguccugucuacaguacucgaagugucuggauuacauuuaauacccagugccguucaaauacuuaguaaauaguugucuuacucauacgauauugcuuugggaauggugagaagacugcgugugugcaguacaggugagacgccuuuuuuccuccugaguaucuugugaaugcauuuguuuaaaucagcaggcgugggacccacaggaucuaaguugacuuugcuucgcccuuacucugaugcuugauuugugggugucucccccugccucacaugugaccccauugguuccuucagcugcuggcuugggagcugacuacagguggcauugcucacguggcugucuuugcugaccaguagacguuucucuugaugcggugccuggcuccugucccccuuuuuugguggcuaccccuuucucuuggcccacugagugccuccugguuugguucagccugacgggccagcucuuaagucugacccagcgccugaucuccccaccuggcucuuccugccucaguccucucuuuaggccuuuccugaagacuuauacccuguuuugcccauagcggacggagcucauaccucacgcccacagucucuucaucuccauggcugcugcucuguucaguggggaacuuuucccacuguguaaaaaugucuugucuucuuaacagcggcaucuaaccagaaugggggccuagaauucaauucaggggauaaauauacugccaagaaagaagaaaaaguguaagacagaagacaaagacagaggggagguguggggagagaagagaggcaagacugacacagggcuugcuugugucaggcuucagagugccagacucuuuuguggagccugucuucucuguccagguccucugucccuggcuuccugguacuauauucagaguucccggaugaggcccagugcuguggccuuuauuucuuguucuuuuucuucccauacuuuacauaauaaagcuucuauuuuucuuuuggagucagaaaacugaagagaccgccuuuauuaaagacuuuaauaaagaagucaggaaguagcuuggggaggagccuagagagcuaaagggacaggauugcuccucucugggaagucugucgcucccucagcacaguugugcaaaugcauuuugaguuucagggccugggagacuugugaagagaacaaaggggccugggaguccagagcuucugggaaagagguccuuguuuaugccuguuggaacugauuuggucaaguguuuguuuaaaggagaugccaccaagcuuuuuugguuuuuguuccagaaggcuucugauuggcuggagagcugccccuguuuacucauagcuggcagagugugugccugggacccgcagucucagcacuuccacccagcaaacuuuucacuguggcccaacuaggcagccaaacccacaccagugcgcccgccccugcccgcacccgguugucuguugccuuucuccugaugagugcuaacgcuggcuaguuagguuuuggguuuugcacagagaggauuaaagguguggauaaaucaugccaaggaaguuaagcaccagcaguacuccccagaauuuucagagugguuucagguagcaggcuguggucuccccuuucugaucuuucagacgagaaaaccaaggcccagagucaccaagggcggagauucagggauguggucccagcuggacccagcaaugaucucccgccuccuuucagagucagguuuagucauuaucaugguguucuuuacaguuccaucugucuucaugccuggcauacaguacaugucaguagacuguaaccugugacaugauugguuggguugaacugagcucugggcucuggugccugcagucuguagucacaaugcuacauuggguuccagagaucgggaugggguuggacuggggcagcaugguguacuugcauauccucuaugcacugagcaugaaucauccuguguucuuuuggguggaucagcugaggcacaguacuugggcaaagaacuuauucugcacagaaagccuguauaucacauugaagcaucggaugacaaugcacuagaaagaggaauagguuacauacugaacgucacugacuuguaguuuuagguaaauguagaauugcagaaacagugaggaagacaagaaucuugccuccugcuuagucucagcguguauguguauguguacguauugugugcgauuguuggggauaaucagcuguugucuuacccccugcucugucucaggcagcacaacaagauccuuaguguggaugggagccagcugaagucguaccuguccuuggaagugcuggaucugaguuccaacaacaucacggaaauucggagcuccuguuucccgaacggccugcguauaagggaacuguaagugucucugccauccauguaccucagcuuccaggucuugcaguggcugcccuggugcccagcccuggacacaggaugggugcuugccucacuguggcucuggccugguuaaguccaugaggcugcacagaccuuuguuuggcagaccaagggcggggucuacucuugaucccuuggacaccuguuguagaccauuuccagcucccuuauaguacucuugguguuacaggcagaaggcagcaccgagguagggagagguuaauuggcuauccaaggagccuccccuugcugugcagagcccaagagucaggccuaggcucucugcucacaaagucuaguuuugcucucaugcucugggcucuucuuccugagaaacuuguggggaagaguugggugaacaguggauacacagcagagggagcuagguuuaaagagcuuguauuucuagcaucagagaccacucagauaagcugcgcuguguuguggcuggcuccuuugcagagggcagcuuuguaguuguuuagauggccuuuuuuuuuuuuuuccuuuuaaauaaaaacccauuucaguaccugccucacacaguguaugguagacaggaaugaggaagcuaaaccuauguaauccacucgcugcagguaggaaaaugcugcuuuggguaggaaucugaggacugaggcuaaagcaacaguuucuaguuaugagugcauuucaucccaucuccuugcuguuucugggcuguucuguagcucaucugcaaggcugcuguaggucucacugugacccaucuucucagggagggugacacuugguacaucuuuccaagucauucuaagacuccagggacagaaaugauacuuucugaaaguucaucaagguacaagaauuggagacaagaggcucuggcuucuaugaagcccugggagggggcuuucuaaaggcccagcuacuaccugguacuucuuguguagagagccgccaaccacgacgcuggauuguauuguccucucucugcagagaugcagagggcacuuucuccuuggcagcuguuggcugcugugucuccaucacacugaugacucuuuaauuggaguguuaagaacaaacaguccagccccguuugcagaguccucaugugcccugcccucggcugcugccugauggcgggaauagaaguaccucauucccucuuggcacacaacccacugugguugaagcuucucucuagucugucucauuugcacuuaagcuuuugucuggggaaggcaggaagagguguggggugguccuuccaugucuugucuuuuuuacuaccugagagaacaucuaugcuguaugcugccauguaacuuugagaaagagucccuucccguguggucacaggaggcuccccuggcaugcguagugugcagccccaugaagauguaucucuuguuuucuaaaggacucacagaggucucuaagugcuucuugaaguuguuagaauuauuuaaacgaacgguuugugcaucuucauaagucauacaguuagcccucuucaggauuaaauaaaggauguuucuuuaaaguauaaaacccauugaccuugucugccaauugacuuuuuugcuauuagggcuuuccuggccagccugaauuagugggcgguaaggcaggaaucugcaaguucucccgaggcaggcauuguucugugcagcuguguggggaaagguuagucaugcccaccggcacgagcacauugcuuugugcugcaguaaggccugugccagugucuucucuucaugagacauuccugcuaccggcauucccagguucccugucuucaagucagggcaggcugggaagccuugagaugaugaacagcuaacucaguggagaucugccccucugggucugccuuagcacuuuuccuagcggacccagcuggaucuggaggcacaaggagugaggaaggccucccacugccacuacauuuucucuccugaaucauuccagcaacuuggcgagcaaccgcaucagcauccuggagucuggagcauuugauggucugucgcggucacugcugacucuccgucugagcaaaaacaggaucacccagcuuccugugaaagcguucaagcuacccaggcugacacaacugugaguacagaaaccugcacuuuaauuaagguuagccaaacuuuauggggccagauuuccccaaggacccuguaccaaucgccaccccuuccucaccccccugguaaagcucugcauaaacuaucauuuaugacccuaccgcaacaccuaauaaaagcaaauuaggagcugggucuggugcuggcaggcugccucagauggccaaggaaaagacccucgugcuuggaugauuagccucccugaugcuauacuucugaagugcaggccccaccccccccauccccacccccccuugauccuucugccucagccucccaagugcacucaccacuaccauccucacuucguugagcucucaucuugaguauuagcaauguuuaaggugcugaggccgucuguagcuuggaagggaagguaucugguccuucuggggaaguuaaccugaccagaggcagcugccucuucauuuccuaaauuuuagaagguuagccaguuugguuuuguauaaaaggauuuauuuaugucucuuuucauggagccuaaaauggcacagggugcuagaaaccauauauuaaccaaaacuccccagucaguaaaagguucuucaacucuuuguuucccugugucuucguuuuagcagaagaguauauuucagggaaauaagcuagaauucacaauuugguucgaucaggaugaaacaguugcagaccaggcuggcacagggcagagagugcccuguccucauuucuccugagugcaggagcuugacucugcucuuuccagucuaagaagcugaagaggcugugugugaagcagggucaugagacacugcagaaauauuuggggaaaaaccaagggcuuucuaauuagugcagugucuucccaccuuccccagaguugcuaaugggauccagcugacccagauuccagauagcuauuggucaacuaaggcuguucugcuaggacgaggugccaaguguguaucugcuccaccccccacuucuccacaagcugucacuucuucccauugcacagaggucugucagaugccccgaguggaaguuuugcugauauuugguacccaaugguuaggauuuucuuggguugaagcaucugguauggauuucuguugcugagcucagagacaccucagcgaaggaaugaauguaccucugagucaugcccagggccugcucuagacuccugaaugguggcuguccugagggaagaacuguggggugcuuauguccccacaguacuggggcaguacagagcuagccaugcagcauucacugucccucuccuaggcugucacccuugcuguugacagugccagugugccagcugagguguccccuccuccaugguuucaccaccgacucggaacggugcagccuagaugugcacaagggaugcucugacccgauggcuuccucucucuccauagagaccugaaucggaaucggauucggcugauugaaggccucacguuccaggggcucgacagcuuagaggugcugaggcuucagaggaacaacaucagcaggcugacggacggggccuucugggggcugucuaagaugcacgugcugugagugcggccucccuccugggcacggggaugguggccaccuggaugcugccuuuuucugcaaaaugaaccaaaaccaagguuguuuuccuugcaagguagaaggagguuuuaauggacacauggucagcuaaggaagugggaagagauggauugcacuagucugcugggccugcucuccacccccacuuccuccacaaacccaagacugcagagugauucccuccccacauccucuccacucccacaccuuaucggaagucccuucuuuccucacgcugggcccgauaggcuuucuugaugugcaggugggccaaaauguauaguucaucuugggagauuuauucccgccuugugagcuaaucaagacacggagugcagaugugcagcuuuuaucaagggaguuuccagccagaugugugcagcagcagagcugccugcugccagaauaaugaaaaagaacagcagaggggcaauuacugaucuucugauuuuaaaccucuacaauuguuuaaaucaaaaguaacgaaucugcauagucaggaaguaaagagaaggugguguugugaccccccccacccccguugcccccagcuuguuuuccaagaggcagucauuucaaccauccauaucuuugguguuuugguguucugguuuucauguuugccagugucuccuuucagguggacacaacuguaccucugccuuugccuguguccaucagcggcucagcugcucaccucuuuuacgccugguuuccuaugcaaauuacauuacaaccuguacauaugcuguuauuuuuguagcugaaaucaaagucggaagccuagguucacagccaccaguguguuccccagccucaucagcagaagcaucucccagugacucucccuccccacguaugcccacuuuguauggcaugcacaggaggagccugcugcuuggcuucuugcuguucacacuucccacuucugauuagcugaauaucgguuuccuguguucauuuaggaaucugagguccagaucagaguucucagaacaaaauuuguuaucugccacuugguuuuuaauguugcguacaucaguacaaaugagggguuaguauguuucucaggacuuuaaaaauccacuaaguucucaugcuuugagcgguaggagaaagucagauggaccaaagcaagaucugcuugcuuaaauuuccucucuaauacugaauguggcacagauggccuccugguugcugucuguguaaugggagacuggcagucucauccccugcaugugugucucuguaggcaccuggaguacaacagucugguggaagugaacaguggcucccucuauggccucacagcccugcaccagcugcaccucagcaacaacuccaucucucgaauucagcgugauggcuggagcuucugccaaaagcugcaugaguuguaagucuggggcagugggcagugaaguaccuugggaagugaagccucuagagcccagcucaccccaugggguccaaauaaggaggcagcccaaaggugggaaggcuggcagugugugcaggaaggaagacccacguggacucgcugcccgccaggucuuagacuuggagcuggaaauagaggacagggugugcaggaaacagaagccugaugucgucaacacaacacucauggguggcaguaguccacacgcaucucuugacugaaaaggucacaucugaguaggacuuugaagcuaugcugaugguggaaagaugggucuggccuugggaacuccagcaagagacaguuccucaggacacugggauccuugcugccuguuugcaucccacugcagaaguggagaugcaggguccuuuagacaggguuccuagguugugcccuugcuucugagaaugguagugacagacuuccaugauggggagggcguggccuggguggccuggccaugcccucacagcaaacacacuaacacugccagagccauggacucaucaagcaucuuuugccccuuugucccugucccucaucugggaguucuuuuaguuuaauagacacuguauaguccaguagguuuacuuuugagaaauucaggguuucucuuuuuaucuucuuuggcuaggcuuggguauaggaaaagauugacccaccaaagcauaugauugguagaaauguugcaccuuacucagccucucuuguauuuguuuaucucagcaggaauaguuagagacccuggaacccaaugaugacuccugcagccuguuguccucuggucuucucuauucugaucucgcucucagugugucugucauuacccaggguucauacuuuagccagucccugugcuuugugaaaggccacaguccugccccuugcuuuguauucauuucucuuccauucuguguuagugugcauucuuugaguuuagcuuccugccaccuagaggugcuccugcugaccacugcccauggcuuugaccgaggcuuuuguugggagcucggacuuguagggaaaagagaggccuugaagguguucagucuaguucccaaguaaggacagucuuauggaacacaccagaacggugugggccccuugaguuagggcuacauggaaagggaaaacucgcaggcagaccccugaguuccuuccuucccuuucugcauggcggacaacauuacgcuaucuccugugccauuuagaggaagagaagguucacuugaguguauuagacuaguccuagcgaucugcuccauuuuagaaaaugucagagccagauauaggguugcucugcaguguguucuuacccugccuuuuaguuaaauucuuuaauugcacaugaggauguaacgauggucuccugcuaggucuuugcaacugauagacacugugacauauuucucuuaauagggacagaauauggucacugucaccuuuaaaacugcauuaaucuuccaccaauucauuuuuguuccuuuuguaccaguccagacuuaacauuuccaaccauagauaacuaauguuacauaaaccuacccaguguagugcacaccugcaguagugcuaggaaggggguuugguucuagcaaaagguaugcuuuggcgcccaaucccuguugagcgguguacaagucacagccugagccuuuagugucagggucuuccccugguguggcugucccaggcaguggcucauggugcccucugcuggcugauacagcaaguguagcuguggcucaguugcucaguacagaauuccagguucuguugugucagucuccaucaagauagguccuucauuuccuacaccaagacaugcaguggagggguuuggcgccuugggauuuggguuguaugacagguuuuuacaguguauguaagcgguaguucucagcucugugguacugguuucauggcuugcaugauaguuaucaaacuaggugauuguugaccugauggucuucugacagcaggaguccuguggacaugcuucagucuccugucuccagggaggucaggccaguuguggcaugagacacaacugaagacaagagagaauagggcacccacauagcugcucaguggugacauuugucuucuucuuucuuccuuaggauucuguccuucaacaaccucacgcggcuggaugaggagagucuagcggaguugagcagccucaguauccugcgccucagucacaacgccaucagucacauugcugaaggcgccuucaagggacucaagagucugcgggucuuguaagaauugugcuuuugagggugacagcaugaaggggguccccagaugggagagcacacagcaaagcacuugcuuuguugagauucccucuugcuggcuuguagucagaauugggcuguaagcuggucugcaacaggaacaaggacuagaaccaaaaauaacugcugaacaguuaaauccuuccuuuacugagcagaaaaauccuuccuuucccacaguggugccuauugcaggaugaggacucuugaaaaaucacuguuaucaauaguucucaguacacuuggccggaugggaugggugggucuggaaaagcauuucuacauaggguaucugcagcaacauucacacaguccugcaugucucugcuccauucuuuugguugugaccucucauuuauuucucuuuuagagaggguaugguagugguuuuguucauuugcuuuuaaagacuggguucucuggcucagguuagccucaagcucauauauugaggcuggccuugaacuuguggccauccucuugcaucaagggcuaggauuacagguaugugagccuccaggccuggauguacguuuugagaauuuuuuccuaagguuucuauggaucaaacccaaagcuuuauguguaauaggcaaauucucuucuacugagccacacccccaguccugucuuccguucuuaaauccuauguauuguuuucuguaacucaguaccauggcuacuuuucugcucuuucuuugaagcucuuuaguggaccugguauccaagauagaagugaggguccuguguccuuguccucauucaggagugguguaagaaagagaaagugagaauaccauguccuuugaagggucagaugggugaggcugcuagaagcugcugagggugcuuuucugggacuuuucauagaacuuuuuucacuuguaaacgcuaggcugucuccuagcagccuucagucuaaaaccccccagaagggcacacagucuuccacagauagugguagcaguuccacagcuuucuucugcagccuggucugcugggggagcaagccugucguugugccuggagggaggccucugcacuugcaccaggcagagugggcuucagguuugagucagggauggggagcuagugccaagcaagcuauccgagcccaggucagucugugagcccuuccgaggcccggacagaaaggccagaaacauucaagcugagcaggccagaaagagaggacuaauuuggcaggcaaggcccagagcaggaagacaggcacacagaaccgcagucucugcuguacucagucuaaagaugacagggugggacucguugagagcagaggucccuuccagcagcacauucucuuuuagcuucaugcuggaaagugaaggucagagcaagcauuguguacuuucgucccagcuccacucccagcuggcaaugacuuuccagcgucuucccagagccaagagcugcaucccuuucuguccuuggccauaucugcagggacucgugcaggggaugugcagggaccagggcucugugaaaaauuggaaagagugaaugugagaguaggggucuggcugccaggugcguguggcugggcagcgugaccugcccuuggaagcucagggaggaagcugaagcacugaccauauccagacagccuggggccgaguaguuggccuccuuuuuccuguccuggcaagugggucacaagauugacucagcacccagaugugugcucuggcucaguauccagugcuacauaagccucacgaggagcagggugcaggcccuaggcuuccaggccggccuggaggaacaucagggcccagcuccuucgccgccaccucuuccuuccacgugccuuccaguguccugguugaacccgagagaggacuguggcuaagaguagacagaaaugguuaggaaucuuuuggguuagaggucugcuucagagaggugugugcaagccuggcuucuucuugugcugucucuacuauuucccucccugaggccagccagauugguuggugggcgggcuggcuuuguuggaagcagcagaagcaaggucaugcugauaguacacaaaaaagaacaacaggacguucucagggccauacuucuccuggcaaugcaugcugcugggcccccuggggugcaccuggaugcuuugcggcuccuagugaaagccuggguguggggcuggucucccuucaugguggagaacaaaggcagagcuuaagauagugggugaacuugccuucuguuuccuucuuagggaccuggaccauaacgagaucucggguacaaucgaggauaccaguggugccuuuacggggcuugacaaccucagcaagcugugaguauuucagacugggagugugcgguuccgcaagcucugggaugcaggggugccacucaugcagcuccccugagucuccuguguccugggaccacagaggacagcagcaggccuucugcugugugcagagaagaggcugagggcuacagugaggaauccgcaguggcucacaggccacucucacagucuucauacugucaguguguggugguccuuagggcugcugggcuugguccuguuuacagcccaucugaaagcaccuauauguucuguccucugcacagagggguguugcugccuucuuuaguuucuagagaugugugaaguaccuuucaguaguauugaggcucuugucagucuuuuuguugcuaauuauaaucacaaguagaagcagccaucaccaagagcacuagucauagcuacuuugaauucaguuuggagagucuuuguccugcccuccuagaauucguccacugcuguaguagguacaugucugugugcaggcuccauuaugcagccuuuagagcuccagagacaagugaagggaacuagcccaggaccuggcagguggcagguucggauuuguaccccuggauaugguauacuuguucucuugcccaaguugcagaaugcucugcaguucugcugcugggggccuguccaugccagcuugugagggagggggcauuucuggaccucacagaagaacuucaagagaaccucgagcgaccuguguagaagcagcccccgcccgaccccuguccaccucugacauugaucaggaggggaagaggguguucuguguagggcacacguaaagggggauagguagaguacacagaagugggacccuggcuuccugucaggaugggcacuccacauugugaggaaggcuuguccaugccauggcuccuuccaaggccgugaauacaaagccgaccaugacacguuccgcacucuguacacccauggugccuuugugcuugcuuuagcaagcacugaaauggcuuuugggagccuacgcugggcuggccagauguguaagaggugacaucugagaucacugccugucugaguccuuagcagggaggucaggcuagccaccucuucccuggagcacccuuccaguccagggaggcaccgaugugugcugagaggaggucagggccuguuugagccuaucagugguaugauuggcacuguguaauugagaauuugagaauuuguuuuauugcuguugucaccauuagaaguaacagccugcccucacuguaagaggucaacgugacuaauauuuaauggaugaaacaaggcacagcuuuuccuagaucugguuuacaggagauuucacuaaacagcucagcuuguuuuuacuaggccccggagcacaugguacccugcuugugggaucugaguaagugcaggagcuggcagacucgcaggcacugggguucagugccccgugagcuguuauuugcugcuaguuuuguggcuaaggagccaaagugaacauggccacugggcuucuggcauuugguuuauuuuagaauuccagauugcgaguuguggaagucuuuucaggaugagauuguuuucuuguccacccagauugccugugagagagaggggagauagaagggccauuggcuguuugcccuaagucaggaaacaguagguuuugucuaaggcugaacugaccacaggggccccuggggccagaaucuguaaugaaacaggacuuaggaggccucauggugugcucuggcagggcccuugggggcagguggauccgccaccucugucuguguucuuugcauuguaggaggcuguucugggaugcggggccgugcuccugcaggccagccuguuucugccccgugucccuucagagccuugacaguuagucugaagcucaggccacauggugggugauggcgaggccauggucacaggcaggcuaguauuugucuucccuugagggaaucagucugacauagguggaagauagccucuaguccagaucuuagcccugcuucuccucucuuugggaagaggugagccaggcuagcucuguucagaagcuuccucuguccacugcugccuggacuugcugguucugauuucccaggccuccagccuauguauguaacaugccugauagaaaaugcuggaagacauuacccucgaggggcagagcucauuaggcaucacugucgugcccugagcagacacaugcuuguguugaguuagcgcauaccuuugaugcaccucaaaagcaaaggaaggagcuuugccuuccagcuaccugggccacagugcagagccucuucugcagacccugagaggaggguaaauaucaucagggcagcuacauccuggccacuauagugcauggcagacgcaaagagcuacggggcuaucuugauggaugcccucuuccuguucucugcugguuaguugggacccuuuaugcccacagugcagugcacagaaguggauggcagguuuuagucccaguuucuauugccuucugacccugcugcuucucacugaaacaguaaccagccuaguuuucucugcaagggcacuaccuuaacaaacuccccacccccuuggguggucccaggaaagacagcauggccuggccauggcgauuuccgcuugacacuacaagggcucucuugagacuggguggaacaugcaauuucagccugucaucaccgugaaauguaauagagcuagagacauuucauuucaggguggggauggccugugcaccccagcccuguaauccccuuacaggucugcagugcaccugccucuugcagacgggugucaggcagcacugcccugauugugugcuuucuuucucgauugcuucucggucccuuucuaccuaccuacccugggccuggauguuuggaaacuacaggacucuguuuggaaacaagaucaaaucuguggcuaagagagccuucucgggccuggaaagccuggaacaccuguaaguacccugccagacccugccuggcccugccugccaagcguggcugccgggggaguaaccacuucuuuguaaaccaagaaacaggcuguuuggaaacaccaucugcuuccuucucauuauaagucagcuucaacucuggccuuucuuuugccucugccaggaacacucacagagcauauagucugcugcugugcucccaauuaaugugauugguauuugaacaaacaccuuccucccaccuguugggcuauauuaccaugcaucagacuccuuaaagggucccuaagcucucgccacuuucauaaggauacuuuauucuagcaaagccaggcaauaccccucccccuuuaacagcucccuguccuagugcaugcugggagcuuuucuacuggggugcuugccuaugggaccuuggaacugauugaggaacgcuaguccugagauguucauacugcaguugggaguggaugcuucuaguuccuggcucuuaguuuuaucuucgaaucaaaguaagccuuuauucuggguaaauuuuuccccaguuuucuaccuaacgucaaggcugcucuuagguugguuugcucccaagucauucugugugcuugcaacaacaggagaaccgagagccucucccaguggaucuggcacacgggguauggcuagcaccugugggucaucugugaaccagggcuggccugaaaaacccccaaguguccucacuuggccacacauuugacaacugcccauagcuccuaagcacaaaguacuguguucuguuucaggaaccuuggagagaaugcaaucaggucuguccaguuugaugccuuugcaaagaugaagaaccuuaaagagcugugaguaccugggaacccauggccucacuggcaugaguggagacuuguaauugcauugugcucauuuucuguaauagcugugauuguuuagaggucagauaggacuugucuuuaaaagcaaaaugccggaugggacuuagcucuggauggggguggcagauucuuucugaaaugcugacauagcaaacguuuuggacuuuuggggucacaggggcugggucaggaauacuuaaauguguuauuacagcagacagcauuaauaauacacagacaaaugggugcagcugugugcugcuaacuccacaccaacagagacagacaguggcccgcaggccagaguccacuguucuguaccauucucuuccaaacaauggaucggcaccuuuuuaaggagagcaguuuucaucuuuuagauuuauuuuguauugagagaggguuucugaagguguucuuuggacaguggcagggucucuguggccugauuccggacgcucagccugggucccuugccuggucucccuuuaacugcuguguguucucaaaccaugacugguccugggcccagucuucugaugggacaaagaggcuuccucggcuccaucauuuucuuccacagcagaucacacagguuacccucugcccuuaguuucuggguaaauuuccacaaucagugaugagaaacacacuuggaaucaugaaaauccacaacggaagccagugaagcacugggaugguuggaggcgggccacagagaacacugccuaucugccugugugaagaagagacugggaucuacagagcuuaggcagccauggucccaccauccaaccggccuggccuuugccucuaacuacggggucccaugguugucuaggaucuagcguucucacuucuguagggcuccagucauucguucccuguguuccuugcuccuguacucaucacuuaagaaaaccuucccuuuccggguucccaugguuuugcguuaucuagccuggccucuuucucggugcuaaagaccuuagcgcuaaacccaguguauacacugacugugguacaaagccugauucuuugaacauauaucuggucaaagguugaggugagauuuauuucuuccagcuuguuccuguggcuaacauuuaaauauaccccugucauggcucccagcaaugcccuggcuucguucucuaggccuucuccugucuugugcucuaccacacacaaguguccuuuugaugaggaggugaggaaguggaccugacaauggaaaguuccucuggcccuugaccuugacugagacagccagccugccaccacacagcacucauugcugugacacuugccuccuugugugguguaugaaucggucacucucucauggguagugugaauggccuucugccaccacaguaacuccucagcaggacagcccucagauaccucccaguugaauacuaccugcccaucaaaugaaagugcagugccuccucugguacugcugucacagagggauauaucacaggaugcuaucacagcaucccuguuaccaugcuuugagauaaauuagucaagucuuuggaaacguauuuccuaaagugauuuaaagaggccacaggugggugaugagaagagaggaggagggguugacugugcugucagccuagggugguggugaccucuccuguccuucaccagugugacaccuucacuguucauuagaaaucaggagaggaaacagaaagcuaguucauuuguugguaugagaagaagccgugcucaggauuucuaaguacacguggguucccuuugucccugcguaccacaggccguucaggacaagaagcccauguuuccuuucuuguucuuguccuuggguaugucuggugucacucauuaacucagggcuccaggccuuuccgaaucaaggcagcuggauagugugucacuaacccaagugacucuuggagaagggauguccgcuaggauggccauuuugaguucuguuuggaaguuuaaccuaaguugcugaaaaaugaaaauguucucuguuuugguuggaaacucagaaaaccaaaguugagcauucugcugcccuccucaguaacacuggugugaagguaaacacaggcaagaggaagguauaccggcgaggcuccagcuuagaaguuaaaacaucauacuuuugccaaauuaaaaagauagcagccauguaggaaaagauuucuugggauuuuuugcagaauuuaaguaaagucugcuucuguuuggcuguugcacucugcagaaugaggagagaguuguggguagugccccucacauacaguguguaucccaggucacagcagguuagaaggcacccccagggugacaggagcuuugauccccugagaacauggaugcugcuguuccaguuguggucuucagaccagcauucucaaugccgcucuggggcuaguuuggcauguuguaucuugggcucuguaucagaagccauauucuauucaaaucugcauggagggugcgugagcugucccuggucacuggggaaaaucguucccuuuggaacugcauguccugccuucuaagcugauuagcugugauguuuugcaaagaacccuuccuuauggucuguuaaauauucaccucuuguuucucuuucagcuacaucagcagugagagcuuccugugugacugccagcucaaguggcugcccccauggcuaauggguaggaugcugcaggccuuugugacagccaccugugcccauccagagucgcugaagggccagagcauuuucucagugcugccagacagcuuugugugugguaagauuauccuugagguuuuugguuuuguuuuugauguagggcagagaggccaggaagaacgucucaucauaagacugauuccugugacccuaguuaguguaguccaugguuacagaucagcugcugggugcaauuuauuucccacggaaaccacauguauuuacugcacagugccucauucugugguucuuggaguacacauauuuaauuaaaaagggguagguuuagcuacaaaucuaaauaacugguuacagugcgauaguucugaucuuuucagaaggguccugggcccagguuuggcugugaaugagugcauggggauaggguuucaauguguguuucuuuccagcucuaagaaugagagguuaaacacaggaagagcaggucucaggagagcagccacugcaguaaaaauaauuccuccauguugacuugcacucuugcugcuuguccaacccgcugaaaugugcacugggagagucucuuuccuccacuuugcuggaacauagauuuaaccaucuucuugaccagugguagucaggacccaaguuuaguuacagagagcacagagaacacggaacagcugaaacacacccacaggcuagcucuggcaggacuagcauagccuccuagcuaaggagaugggauccaagaccgagaagaccguugaggucucguugaggucugucuggguugcucugagcagcagugggaaugcaugauccuccugucagugguucccuguggccucacggagcuacaggaucacuuccugaacgaugcuaguuaugacccaucuagcagccugggugucccgggccacuuguccgaccuuuucccugugaguuaugccugcuagagguaagacaagcauccucuaccucccacugcauuaauucccaaagcaggcuugcugacucucggugcacuggcuaccuggguagaaucaggguugugcagacagcacccuagucacauuagagcaggcagcacuuuacagccagugcuaauugacuccacacucauuaacuuguuuagguuuucucaaguuaaguugucuuuggcuucccccucugucugguggagggcagucuucuguuucccuaaaaccugaucccuaguuggugaccaugcuacacugggcauuguagcaauccccucagaacuacccacccacgguucaugagaauccuugguaggaaaucagagguucaaacucugcucccugucucccacuuguuucuaagaaacagaaauggccaccauacacauucuaggaaaucagcaugaagcuaggugaugacaagaacagaugagauggggagguccuuuuguggaggaagccucgcuauguagacagcacaguaucggcuccugggcccacccugggauccauccaagcggaugggagcagcucugaccaagugcucaaagagcguuucucauaacagccccagcuggagcaacccagacacccaugcauagacaguaggcagguagcuaugccaugggacauuaggucagucugucugucucacagcaugggugaauuuugacaaugaucugccaagugaaagaagucucaugaaaugucuagaauaaaggaccccauagaggucagaaauguaugucaccagucccacuggugagcaguggagacagaagggagagcuaaacaggacagccuucucuguuagagaugauaaaaacauuuaauaucgauugugccagugauuacaacuauuugugaauacacagcgaccgccgugucugguggaacugacucgcaagugaccaguuccuugucagccugaacauuugcugguguccgaacagaacaggggucuuacacuugguucucucccuagaugacuuuccaaagccacagaucaucacccagccugagacgaccauggcuguggugggcaaggacauccguuucacaugcuccgcagccagcagcagcagcucaccaaugaccuucgccuggaagaaggacaaugagguccuggccaaugcagacauggagaacuuugcccacguccgugcacaggacggcgaagugauggaguauaccacuauccugcaccuccgucacgucaccuuugggcacgagggccgcuaccaguguaucaucacaaaccacuuuggcuccacauacucccacaaagccaggcucacugugaaugguaaggacauggcaucucgugcuucucaagcacagagucccacagacuacacugcugauuguccucucugacacuggugugaagagacacgagccguggggugcaucucuuuguaccaguccuuggguuugucccagaccaaguuuaacagauugaaccaucguuuuuuguuuggggugggagauuuuuaaaguccaguuauguuaagugacauuguggaguuaagcuuuguauuuuuauguuccuugucuuccauaagccaagagaugcgguuucuagauuccaagcaucccuagguucuaaggaagcuugugaccuuagaguagauguuauaacugggagcaaggccguuugggacaaguacaagccccacuuccucuagaacaaugguucuuaaccuuccuaaugcuugaccccuuaauauagucccucaugcugugcugacccccaaccauaaaacuacuuucuuugcuauuucauaacuguaacuucgcaacuguuaugaaucacaguguaaauauuuuugaacauagagguuugccaaagggguucaugauccacagggugacccauuguuccgagccgcuacucuucaggcuguggagagcagguguggguugagccccuggcuccgagguccagugugcagggaaguugugacaagggucucuuacucaggagccagccccuggccaucaggguggcuuucuucuggacuacugauggaugugguauguugagggaugaggacagcaucaguagcuaacucuuccacacuaggcuaagcuggcuuguggguggccugaagcacugccuccaugcucucugcuauuguacaacaccacaaagcacucuaccacagcgaggcuggccuaagagaggccagaguguuucuuggagaccaaguagcuguagacucuccaccacaguagcucagacaucaagucuggauacuguccacuguggcagcauugauacuaaagcuacagaagcgaacgaacuacauauuuuugccuggguguggcugguaguguagcccccauagaccccacccagaguggguuuccucaagagaggugagccagcucacugguuccuccuggugacagcauccagcuauccccuaauagcaaauguuuuguugcccagcucucuccagauagcuaacuaaagcaggucagcaccagacuuuuacuucuggaggauucccuacauaguaacuacuguggagcuucgggaggcaaaacgcuccaucagaagccuuccgagagugcuuagcaccaggcuauagcaauaggaaggcguuaaggguaaugggugcaguauugugucugugacggggagaggcugggcaccccuugggugggauggaguaacaaugaacugaggccugggcacagugggaucuguuuacuaugaguuuccuuuuguaugcagccauuccaaguagcuuuaccuaucauuuuuuuccaguguugccaucauucacuaaaauaccccaugacauugccauccggacuggcaccacagcccgccucgagugugcugccacgggccacccuaacccucagauugccuggcagaaggauggaggcaccgauuucccggcagcucgugagcgacgcaugcauguuaugccagacgaugauguguucuucaucacugaugugaaaauagacgacaugggggucuacagcugcacugcccagaacucggcaggcucgguuucagccaacgcuacccucacagucuuagguucgcuacgacagcucucgcgcacguguggcagggucggguggggauucaacucaaguauuagagaaccugcuuucuggagucccugugguagacucugucuaguuaauuugaauuuuggggcugcuuuuaagcgaguaguuucagcucauaaaagacaaugagcuauauguuagucugcgugagaauucugugugugugugugugugcacucacacaggugggcuaugaucuuaggaguagugacaaaggucuauaacaggacaguuugggauaggguagggcuuuaguucuuugcucuguugagcuguuccuagaauggcagugauuuaauuacauuaggcuuucuggaaagcuuggugcuccaauaaaagaucucagauagcauuucacuacaacaugggauugucuucugucuggaaaacauguauaccuccagcaagcgagacccauagaauaaaugugcaauuuccacugccuuccugcagaaacuccauccuuggcagugccucuggaagaccgugugguaacugugggagaaacaguggccuuccagugcaaagcaaccgggagccccacaccacgcaucaccuggcuuaagggaggucgcccauugagccucacagagcgccaccauuucacuccaggcaaccagcugcugguuguucagaaugugaugauagacgaugcagggcgguauaccugugagaugucuaauccccugggcacugagcgagcacauagccagcugagcauuuuaccuaccccuggcugccggaaggaugggaccaccguaggcaucuucaccauugcuguggugugcaguauuguccugaccucgcuggugugggugugcaucaucuaccagaccaggaagaagagcgaggaguacagcgucacuaacacaggucagcagcacagcggacuuggggggcugggggcagauggggugacacugccgcaguccgagguaaacgaugcaggccugggggcuugccuagaaccugaaaggucucuagaacauuuaggaauauggacucugccuguagaguugggacuuugguccauguccucccccccccccaacagcaagcuagcucugaaggacagaacagaaaaugggaauacucucacaugcaaggacucgcuggucucugcaguuucuggucucuuuggcagcucagaggcccuagggccacgccuguuaugaaccggauuguuccuaggcucucagucuugguuaggccuuccuuuccuuguuccucauggagccaggcgucugacugccgugauguuuacaccaggguguaaaggagguuaaugagcggcugccgagccucugcacagcuuucugugugugagccacugucgugugaccuugugauagugcguaguuaucuguauuuauuguuguggcagcccuguuauuuuauugucuuggcuccuugcagaugaaaccauugugccuccagauguuccaagcuaccucuccucucagggaacccuuucugaccggcaggaaacuguggucaggacugaggguggucaucaggccaaugggcacauugaaagcaaugguaaguucggaacagugagccagcugcccucguccuggaugaagucuggcacugggucacauuuggugaaccaggccuuuaauugauaagauaguuugcuuuggaucuggugugugcaaguucuauacuuuuaacguuagauccuccggaaagucccugcacugggcuuagcacucugucuucuggucagaaggauuauaugauaggauugccagaaagaauauaugcaaaggacauuccaggcccccaaaucagcccauagcuuuuacaguacuguagcacuuuacaugggcuaaguauaagucaaccaaccacagacugaaaauauuuagcaaagaaaaacugaaucuauauggacauuuuacgucguuacuagguacuaugagugaagaugacuuaaggucugucagagaagguguacaguuuaugugcaaacagcauuucacagaaaaggaacuuggcauccuuggauuugggcaucucagaggagcauaggaaccaaucccuggguggaugccaaggugcugggaaaagcaguggucugguggccaucaggcugcgugauguaagcagcuucuaagugguaagggcucuguuucaggugugugucugagagacccgagccucuucccagaggucgacauucauagcacuacaugcaggcagcccaagcuguguguuggauacacuagagagcccuggaaggugacggagaaagccgacaggacagcugccccacauacaacagguaggagacacuuaagucaggggacgcgguugcuuuuggcccugaagcuggcuugacugaguaaacuagaguagcggcagaucacuggccgcacgcugucucugaguuauguuuagaauacaaacaggauuuugugugauucuagaguccugugucgcuuagguaagucagucuaugauguggugagcugaaggcugaguuuucuuaacauggcugaguuuucuuaacauaaggaacuuacaagacaaggccugcccuugcgccaggacuguugucccgacaagguuucacuucguggaucaggcuguccucagccuccugagaugcuguggcugggcuaccgugcccgucccuuagagugcgccuuccucaugucacucagcucauguccucagucacucuuuguccuguguaaugaacagggauucucucucaaacccaggguucacugauccaauuuucuagcccgcuagccugcuccgggguuuccugccucugcguuagcugggccaccacaccugccuggcauuuccaggaguacuggggaccugaacucggguccuuaugcucagcaagcgcuuucccuacugagcccucccucuccgcagcccugcuggcgggacucuuuaaggccuacugauuaagauuccuuacuguaugaugccuaaugcaaaccguuccucuuccucuccccacccucauuuuccugugauuagagugugccuucgaaauuaauuuuacacguauacuuaggcacacaagacuaagacaugguuggucuagcuccucuccacauacacauuccaggggguggggaggggagagacagggugguuaugaaggcagugguaagcuggacucaucuuccaauagugccucugagagggaauggagacucaguugaccucugguucucuucuucccucagcacacaguggcucugcuguauguagugacugcaguacugacacagccuaccauccccagccugugcccagagacagugggcagccaggcacagcgagcagccaagagcucaggcagcaugaccgggaauauucuccacaccauccuuacagugggacugcggaugggucucauacccucucuggggggucccucuauccaagcaaccaugacagaauacugccauccuugaagaacaaggcggcgucugcagaugggaacgguguguauuguguuagaggaaccucgguggcugcugggagcccuuugguuacggugcauaggcugagcugccucuuuuuuuuuuuuuuuuuuuaaacaggagauuccucuuggacuuuagcaaaguuacaugaagcagacugcauagaccuaaagccuucuccuacguuagcuucaggcagcccagagcucauggaagacgccauaucuacugaagcccagcacuugcuuguuuccaauggccaccuccccaaggccugugacuccagcccugaaucugugccacugaaagggcagaucacugggaaacggaggggaccacugcuauuggcaccgagaagcuaggcuucaucuaccucagcucuuuuaaagcagucgcuacaggaaagagguaggagaggccguggaaagcuuguguccagacgucacuccggacaguccgacuuccguguggaaugucagucagucggcuagaggaguggcaucuggagcucagaaacgugagagacuauuuguguacaaaaggcaggaaaaaguauuugauaccacuguacauaagaguuuucagagauuucauauauauuauauaucuuuuacagagacuauuuuaauccuuagcgcaugggucccgcuuuuggugauauuuucacauuagguugcugucuaauuuuggagagggucaggaaucguucuggugccuuaaugcacagcuggaauucagguaaacacaucagcuguugcuggcgguuggaaaggagggcaucuuggcuguguggcacuuaguggucagauucgagugcacuggccagaccuaugcaggcgugguguuggcagccucacuguagagcagggugcacgggucuguaguugaggacgagauugagagcuguuaauccaccaaaugcaauggcucagaacaauuaagcacugccuuucgucuuucuuuguaacucacuugguaaaagcaaaugucuugucuccuucagugguucuuugaagcuuagugaggcggaggcugccaguguugguaccuguggauuuuccaauagugaggguuagcucugccuccagggcccgcuaaguucugcugagcaggccuguccacgcuguuccuuaccggugagacugggcuuggacuguacaagacuugaguccuagaccuggguguauuugcacuuuggggcccuguugcuagccaucuugugagugccaauguauaaugcaguaaagacuacauggaaacacaaacucaguccuuaaaaccccaggaguugaggggaaguguuggcacagugauggccugugucaccguguagugucauaggccaucacugugccagagcaagcacgcugagaaggcuagucuccauaguugaugguuaauguuacuuccacaaaauaugugaauuugcugcuucugagaggcaaugugaaagaggaaguauuacuuuuuauguacagaguuauuuauuuauagaaauuuugguacaguguacauugaaaacauguaaaauauugaagugucuaacaaauggcauaaagugucuuuaauaaagguucauuuauaaauacuaagugugugcggcggucacugcucuuuuauucugcuauuaauguuucuccaaaaggagaauacuuagacgaagcagcauagacuacacacuguugccccagaaagacaguggcacugcauuccucagauagcuuuuuuuuuuccacauggaguugguuagucaagccuuaugcuccccaaguaugcugacccucccaccuccugcuggcauauaccaugaggacaaaggagcugcuccagcuggccuccagggacggacaguggugggcaugggcuuugcuucccucaacauguuccuaacugaagucacuugggcccacccacucacuggcgcugcagcugucugcugucugucacacacuccagggacuuuggggcacuuugcuguaaaguaauauaaucauguguuuuuauaggagaaauacaagguaauuaaaaacagcauccucaccagaaagaaugcaugcuaugcaccuguagcucaugcuuuuuaaacaaagcuauaaucuuacacaauaggcacccgcccaggggagaaacagccacacgcacgguucuugcccccuuccuuuucccagucuggucauucacugcaguuguagccaguuugcuuuccuggugacuccaacagacagcagaaagcacaggaugcuaauaaaaagcauucugaagggccuggccuuggccuuaccgggaguauuuauugagaggacugagacgguggccccaguuucaccaagaaaaguuuccuggggcagccugugcuuuggccuucauuaagcugcucucugcagccaucuucagggagccacacuggagccccaggcacaggaaggacugcaaggacauguagugucugcuucaugggcucuuccugcccaccucuaacagcaagcuucgcgccuggucauaggcgcccagaaagaugaagccgcccaugcugauugcugccauccucgggaggacaccugcgaauaaccua

SEQ ID NO: 3248 - RNA, 1097 nt, Mus musculus
cucacuggcaugaguggagacuuguaauugcauugugcucauuuucuguaauagcugugauuguuuagaggucagauaggacuugucuuuaaaagcaaaaugccggaugggacuuagcucuggauggggguggcagauucuuucugaaaugcugacauagcaaacguuuuggacuuuuggggucacaggggcugggucaggaauacuuaaauguguuauuacagcagacagcauuaauaauacacagacaaaugggugcagcugugugcugcuaacuccacaccaacagagacagacaguggcccgcaggccagaguccacuguucuguaccauucucuuccaaacaauggaucggcaccuuuuuaaggagagcaguuuucaucuuuuagauuuauuuuguauugagagaggguuucugaagguguucuuuggacaguggcagggucucuguggccugauuccggacgcucagccugggucccuugccuggucucccuuuaacugcuguguguucucaaaccaugacugguccugggcccagucuucugaugggacaaagaggcuuccucggcuccaucauuuucuuccacagcagaucacacagguuacccucugcccuuaguuucuggguaaauuuccacaaucagugaugagaaacacacuuggaaucaugaaaauccacaacggaagccagugaagcacugggaugguuggaggcgggccacagagaacacugccuaucugccugugugaagaagagacugggaucuacagagcuuaggcagccauggucccaccauccaaccggccuggccuuugccucuaacuacggggucccaugguugucuaggaucuagcguucucacuucuguagggcuccagucauucguucccuguguuccuugcuccuguacucaucacuuaagaaaaccuucccuuuccggguucccaugguuuugcguuaucuagccuggccucuuucucggugcuaaagaccuuagcgcuaaacccaguguauacacugacugugguacaaagccugauucuuugaacauauaucuggucaaagguugaggugagauuuauuucuuccagc

SEQ ID NO: 3249 - RNA, 3618 nt, Mus musculus
uagucaucuggcugaggcgaacugucacucugaggagugagguaggaaaagcucuuauugagcaaauuuccccggcaagggccucucuccuagucucgacuccacuuuaaaaauaauugucuucauaccccaaauucccuauccgugacuagauucugguaugaaaacgcgcucugcacgagggcuaugaaacuccgaaaaguuggaaauggucaggagggcuguuauccaaaaauacaaaggauauaagacaacccccccccccccaacacacacacacacaccaucgauaggucucugaugagucaccuguaacgcccacuugaaauugcauccccuuagccacaugccccgcuuuucacagaucaacugggucugguuacauggccacucaggaccugaauccacuuggcuugcauuucuagcacaccaggaaacaccugucacaccgaagagcgcucgaguacucaagggagacucggauaauugauuuccccugggcuucuugaacgugaagagggccuccggcuuuccugugaagagaugcuggagagaggcugagccuggcgcuccucuggaccgugcucaacccuggcucuugcacaagcucuuccagcccuugaaccucucuuauaacagcgagcacucggcauucagucuacuucauaguuuuuugcaagaaagcagggguuuuauuguugaccuauuuuuuuuucuucuccuauugugugugugugugugugugugugucugucugucugucugucugucugagucucugugugugugcauuuguaucugugguuugguguuuuguuuuguuuuguuuuguuugcacgaguggauguacauguuggggggcggugcaggugcacguggaggccggagauuggugucagaaauccuacaacgcugcuuuucuaccuuauacagugaagcauggucucucaaucgaaacccagagauauuaacucucucucucucucucucucucucucucucucucucucucucucucucucucucucucggcauggcaagcacuuuaaucacggagccaucuccccagccaccuuguuaucuauucugauuuccucauccuguuucuggcaucuaacaggaugcucugacaaguuguagaaacuuaaaagaugaauggaaagcgaagugaacaaauacuugcagauaccccuuuaucagugaaugggaaggaagcuucaguagagacuuaguucacaguaguaacuuuccuagcauuaggucaagcaguugaauauuuuauuauuuuuuauuuauguauuuaguauauugcuguaaauugaaccacaggcaccaugcaugcacacuaccagcucccagggagccucaucaccaacuccaggugaccuuguuaaaggggucuugaaauuuuaccugugacugauagagugggaaugauuuaaaguaguucuauucccuagguacguuagaaauuuaaacaaaguuccaagugcugugccacuaggcaaauuaauaagauguggugcuuccuggggaucggggcuuaagagccucacucacaguccuugcuaaugaaacauuaaaggcuugcuuaucagcauagucuuuacaugauaaauuugacuucauguuuguuacuucuaacuuuggauuugcauuuuucauguauucaauaauuuaguaaaaacauucugcucacaauauugagggcauuaagaaaaauggcauuaucaguauaaauuuagcaauuaaaacagaaagcaugcauuuugggagaaaguccuauugguuguuuaacugaaguucaaauuuaaucaacaacuuuuucaaugcuguuaaagcucuuuaagagacucuuggcuaauuuucuuucauucuugcuuuuaaaacucaauuuucuauuuaauucuguacuaauuaaauaauguaauugucuuuguugcuaaauuaagcaaacgaaagcuuccuuauccuuuaauggucaaagauuugucaauuugggaauggggcagacuacaaaguacagaaacuaaaucuaaauguaagaaauaaaaauuuguaagcuugccauuugcaugaauauccuauaaauagacuccacaacuggucagguggcauugucuagagaagauuuguuaucauuaugaugcacauuuuaaacaaaagggauaagcagaaggaucuuugacuaagccugcucagucagucaacagguucuccagggcuggagugaggauuaaaaagaaaaaagacaauuagacaacucuguaacaugacuucagucaguucugaggcugagguggguuuauuuuuuucccaaucuacuuuuauaccauuuugauuauauacaggggcuggagagauggcucagugauuaagagcacugacuguucuucuggagguccugaguucaaaucccaccaaccacaugguggcucacaaccaucuguaaugagaacugaugcccucuucugguguaccuaaagacaacuacagugaacuugcauauaauaaauaaauaaauaaaucuuuuuuuuaauuacauauaagaaauaaggucaguucuagguaaggaacaagcaagacaauaaacaaaguccccugaucacuguuucuaggggcucaucaggaugaccaagauaucugagccuacuucccuguccuaguccaaagucauauucuugccugaagccuauuucuuuguucuagccccaaaucagauuccuuccugggcuuacuuccuauguccuggcccaaagucaaauuccugccaaguggccccaaaauauuuccacagaucucaaagaaaccuaccaagccuaugaacagccucgaaagaaagacgaaaagguaacccaguucucuugauguauucaccacuguguugcccuuugaagcaauuuucccacauaguuacaguuuaaaguaaaauauauaaaggauagaaaccuauaaaagcaaacuggaagaacuguacuuaaguuagacccuggggcuuucuuauaguauguauauauugccuuggaacuaaaagcaaaaagaacuucuugaaaaaagucuugaucuuuaaguuauagaaaagaugaagagucgugaaaacaacaaauucagaagaugagaacaaaaugcauucaccuuucugugugugugugugugugugugugugugugugugugugucugucuuaacauugaaagaguaacuuuuagcgauuauaauuuguacacaggcaacugucaguaaugaucccacacaacacagaugugauagcagcugauggcagaggaggcagaggaaauagaaccucacuucugcaaauggauucuucggcucaccaauuuccuuguugggcacuguggaggcugugagauuaaccagggcuguauaaaaggaaagaagggaggaaggcacauggaagacugucaccuuucagcaaaugacauccuuaagcauuuaacaucucagcuacagucuacuugauguggccaaugugacauuugucuugccaaaaccuuguaucaucaggacuaaugccuggaauaaagcaacagaguauuuuuaauauaaauugaauauaauugcagauacuaaaacugauguuuuaaauucuggggccua

SEQ ID NO: 3250 - RNA, 245840 nt, Mus musculus
cugggcccgggcgggcucccuccuccgcccccucccucccccucgccgccucucuucagguuccugguuaagauggcguccccgguggccaucgcggcgcaggcugggaagcuucugcgagagcgagcgcugcggccgcuccuggcggucaggucccaggugagcgcggcccgggccacgcgagccacccgccguggugccccaugcuccgcggccucuucgccccgcgcgaccccuggcgauccggugcuccccgcagcgcggcgggcugugcggcguccgaggugucggggaucgcgggggucagagugcacaccccacgacccggaucguucuaauggcucccaucagccuugcccgggcacuggcaccccgcgcugggggcgaguucccaaaaguugggcgcacuguuggaacgcagagguuucucagccgcuuacuggcucugcccgggggcggcucuaagcccgagcucgcucggcagccacgugcucgcuccccagacucccgaggcagcucaccugccccagucaaccccgcggggugucgcuugugacccccuugugcuugucuguggggaccugcagggguccaggaggauaguagaaguggagucuuguaugaaaggccugugugaaaacuccugccugcccacuugguccgugccuccuagagacuuaacuaguguuagacucagcagcuccuuccuccacguugcucucuuguugaauuuaccuucuuccauugcaagcgucgcaguagcgaggcuuuggaagggaaauugugaguuggcauugacacuugggagaagucauccaacuacuagucuuccuacuuucucuaguuuacccgccccgccuccccccccaacccccccccccccccgcaagaaaaacuuuccaguccaaugagaggcaaaucacuacauucugaccaaggcaugcauagggcacuaggaaaaacgaaaagaaaauaacuuacuaaugauuuuuuuuuuguuucucuaaacuuuggaucauuaugacaucugugaagguuuuuuuuuucuucuuuucauuaccugacauuccauuucucuguuauuguuaaugggaauuuaagaggcgcuaauaguuauuacuguaauauccuuaacaggcacuugacaguaugguggguaaaggagagggauggcgguuugucuaauuaaaaucacagauaccugcuauaauagagugaggagagaucuccaggcgaucugaguccuguucauuauuuaaguguuauauauaaaaaaacaagagcuggggugcuguugcaguagguuugaauugaugagaaacauggagccuagggcagucaaaaaugaagagugagaaaugauuguucagagaaaccuaaaacagaauguuuagcuggcuggcguauguugucaccuucccuauccaaguugucaucuucccuauccaagucguggaaaccuugucauccugacaagcagacugggugagaccuguuaccuacauugggcaauguucauugauuacauacuuguaugugacucauuacucuggaaacaucaggcuuagauggcaguagaacucagagauggcucaggugguaacucucuccccaagcaggagagccuggaauucagauucccagcgucuauguaaaaagccaggcaagccugugugagcuugugacccagcacugggaggaagagacuuguggggagcuacugaccagccagccuaggggaauagcuuagguuucacuucagugagagagacccugucuuagggaaggaagcaagguagagagaguucuagaaggacacaagugacuuccaggagggccuguucuggucuguucaggcuuucaugagcgcaaacacacacacacacacacacacacacacacacacacacucacucacaagaugauuaguuuuuguuucugucuuaucuaacccuagacaugaaggucagaagacauguccaguaucuccuggaacuugaguuacugaggguugugaacuaucccaucagccaggacugaaucuggguccucuguaagagcaauaacuacacauuauacaauguucaagaccugaaccaugcucacggucaagugggccuauguagaaaguccaguacugagcaguucacugaccugcucaagguuacagagaguuugaggucgagcugauggguaaagguuacuucauguucccacucuaccagggcccagucgggugaaugccccuuucccuugccaauagaucugcaggccaguagaaaggaagcaagucacuagugcuacucacacauuucuuacaggaacaucuuggaguugauaguggaagaagguacauacgugcguacugccuuugacuuuaaggagcuauuucuuaguaccagcucuuugccauucucuugcugugccccuauucauuuccuggaucacagcagauacuacaguuaagccuggcucauuuuuccuaccaaacuuaggaaucuucaaguauuuuaggaaucuguuggcaccgucggccuagaccuacuuuguaucaggccuggugggaaaaaaaacaaaccaaaacagguggacgggccaagauaaaagacccacuuucugcuuuuagaagcaacucuagcuuguuucacaaaaauguccacggaauaauaucccuucccuggguuaauguuaacauuugacacauauuuuugaugcuuaaugucauugaaguuuuuuuuuuuuaaacgucugccucuggcuucacuguuuugacuuuggccauuucuacgcuguccucauggaggacugcuccaggcccugggacuugggguuaugaguaaaaaggggaagauuauagaugcuccaauaagaaagaugauuucaaggacugaugaagccauaaugaaggcaaacagggccacacaauguggaauaaauagcuucccaggcaggcaugugaaagcccagaaaaccaaccuguuccauagggugguuuuauugagguuuaauuguuuucuauuuugagacugggucuuggcuggacuauguugagcaggcuggcuuagaauucacagggaucugcuugugucugacucccaaauacugggauuaaagguauauucuugaucuauauuuaauuuuuuaauugaaaaaaaaaccaaaaccaaacauaauguacauugaaaaguguguccguuaguugcucuucucauugcuguagcaacgaauccaagaaggcagcuugagggagggcaucauucuggcucacaguuugagcauaguguagcucccuauccuagcagggaaggaccggccucaggagcuugaggcaacuggucacauuguauccccagucaaggagcacaggggcuggaugccaugcuccuuuaugccguuugggaucauaguccagggacaggugccaccugcauuuugggggugagggugggaguggggugggugucuucccaccucaguuaaucuagcaauacccucacacgugugcacagagauugcucucccaggugaucguagauccugucaaggugagcauauugacggucagugcacaguuggguaagcuugcacgugaaagcagccaggucuccagauguccaaugagagagugauuuagccgcagcucacauccuuuacugcuucuaccacuacccaugcuccacagaaggaacaguuuccucucuuugcauguggauucuuuuuuguuugucauguaaauaaaauuauacaacaugcaugccccuguuagguacagcuuuacucuauugauaagauccugaguuuugacauuugaacuacguacugcaaaggagcuggacaaucgggaugggaagggggugguaagacaacaagugcagaggcccugaggucugacaaguagggaagguccaaaucauguggguaucacguggaguucuuaagagcuuagugguugugugacuugcacaaaauuguccaucuauuauaacaggaaauggcuggguuuaagucccaggacucugaauucugugucccacauuacuaugagaagucagaacucaggauggccucacagcuucugaggguauaguuagcaguucaguagacaucuaacagucuuuauagcccccucuucccuaguuuguugagaucgggucuuguuguauagguccaguugccuuuggccuugaggcaaucuugcuugaaccuccugagugucaggauuauagacauauacaggcgugcccagcaauacuuccugguagauaacuccagcuagcccuucagguauguaggugccaugaaaccuugugucaugaucucgcaaugaguggcugugaugaaugcccaggaacccauuuuucucuguugagucuuauuguaaauagagaucucucugucugagacagggucucauagcccaggguggccucaaacucuuguucauccacccucuaucucuugagaugacaggcaugauccaccucauccggcuuuuugugaugcuaagggucauaccggguccacugugcagaggcaagcacuaaucucaguccagguacuaaagacuguguguagagcugccuuuggggcauuucucucucaugccugggugaaguucagggaagcucgugucuuaagggaugauauaggccuuucaggucuaacuuugggguuuccacugugugguucucuuugaagcccagagggcuguguauuguccaaggaaacugcuuaccccugugccucugcaguuggcuccuucagaaaggaggagcagcgcagccaugugcuucuucuggcaguggagacagauggaugcaugguuuuaugugauguucacuuauuugaaacggucucacuguguagcccuggcuguccuggaacucaauauguagacaaggcuggcuuugaacucugaucaggcccaacagagaucugccugccuuugccccuagaguccugagaucaaaggaguguaucaccugcccagcuaugcauggauuuuaaaagugaagggcuaaaggcuguagacacguuuauaccagcuaaaucaagccaggagauugccguaagccauggcuuaccugugucugccuacuauugcccuggggaauaaauagcuuggcuuuuuuucuuucccauuuuuuuuuuaaaccagaaaucaaccaaccaaucaaaaccaaauaaacaaaaaaacuacaaaacaacaauaaaaaggaagaaaagcuacaaugccugcugcuaaagaggaugcuggauuuuccauaauucaggugcuaagcuuuugacuuucugcacguggaaggccugugacugauagcccgguaccagcuuggcuuuguucccuguaaauaaagcacugcuuuuaugggaaagugauuaagugcacgggcccaggguagccagagcugucucacccuuguucccuggcuagguucagcaggcacggagccuagaaaguugcugaaguauguccccugggagguggaaaagaaaggacacagcacucuggauugccugcccuuagcucuccuuccugcucaaucagaauccuccuccagguggcacguucuuucaguuguuggaaaaguuuugccugacauauaaacaguuaaauaaauaugagcauugugcugauuuggaaauuaagaucaggaguuaauucacugaaaguggggugauggggcuggcauuccaguggagaauggaucgcaugccugucaaaugcuaugcugugaagaagggagaggcagucugaagccagugauacagugauaaugcugaucaguuagacggaggaggaaggauggcuggggcuguagagagcccaggacuuggcaggucacacacacagcuccacaacagaaagccaaacaaaauagcauucuuuugucagauacuuucugaaugcuuacugugugugugcccacugcuaaaaaguucuacgaagaaaauuauuuuaucauaaaugcagugauuaggagaauaaugaguagguuaauguaccuaauaauucugauggaguggagagguggggggaaggaagggagagagggagacugaaggaaggagaaugaaagggagggggagaggaggaggggaggagagagggaggggggaaugaaagggagggagagaaggagagagggaaagggaggaagaaugagagauauccuuacccucaaaauguuuguggucuaauugcaaaaguguuguauagcccagugguugcacuucugucgcugagcuguggucugagacacuuguugagcuuguccuacuuuggaccacaugcuauuucuuuggaagcaggguuccccuugaauccugucugcucuccauuucaucaacucucagauucaguguuaauucuuuggaaagacccuuuccugaucauuugacuggcuguuucuauccagugauugcuggcuguauuuuuuucugcuuuauugcaguguagggcacaggacuuuaccucaucuuguuuauugugugucucccauuucccucacacauagaagaaugugggcuccacgagaggggacuuucucacacauugccguuucucugccacccuagcuagguguuagcguuugcgguaugaugacucaguggacugcacagacaagggagagacagguaacacacugagaggugauguaggcuagagaggaaggggccagcugaugauugucagagagacuaauuaucaccugcuugacuuuagccccccccucccccccccaguaucacacugcaggguggugguaccuguggcaucuccaagcuccaugucaaggaucccaggcacagaaaggucaccuaauuacuggcugaaaauccuagugccaggaagucaacugccuccugccagugaagagcuuauacuguuaaaucauuaaacccuauuaccagaagguccaguuugggccgagccacccaacugaacccagugagugccuguccugcaccagcaccucugacuuugguuguuuagguuggguuggcucagccugcuggagcugcacacaucucucaacugugaccgaacucccccuguucuugcucugggaucuaggaaacaguggcagaaggcacagguucugcauuuaauucagcugaguucaaauacuagaaccccagugcuccugcugugcaacucggaacaaaugacuauuuuuaaaaagugauuuuauuaguguauauuaauuacacagaaaguaggcuucacugcgcccuuuccacacgcucuaugugcucggagcugcuucgaggauguggcaugcauucugugaucgugucugggacaggugguuggacuugacuguucucugaaaaggaguucucacagguggcuauaaugauucaguaugauuuauuaaacguuuggcauugugauuagaucacaggccuaccuacagugauuauuucuguugcaaugaauuugaagcuaaauugauuugccuuuaaagaaaaggguugacuaaccuguaauaacgguucuuucccagguuuuauaacauuuaucauguacugucacuucagaaucagggacugauuucaugcuuccuuaggcuugguuucaccagacaaccaugugagacagggaugauucugcccagcucguaugugcagaauuugaggcugcggagguagauggaggcuuaccccaaagaccuugggaugggucaguauccuagggauaggauguugggagcuaggauugcaaagcugauccuguugaucuugccugacacgcuugcauaacaccgagguaguguuaggagcaaagccaucuggacaugggugacuugaauguuugagguaagagaacacugaauaaaaggccauaaccacaguggguaccauuggcuaccuagcaggaagugcuggcuuaguucaggaaacaugaguugacuuuuuaggauagcguuucaggcaucgaucaguguguugaauuuauggugaguuuacuuauagacaugauuaugaaagaauagcguuuaggcacgagcugugaagguacaugccugucaucugccuccaagacuuauuuuuacuguaaauugcagggacuugauguagcgcgugaguugguauuggagauacugcagaggacaaggaauagauucguguagguguggauccgugcguggggagagggccaggugucugccucuccagucccacccauucuucacagaccuuucaccugucaguuucugugcuguggacguccucaguguacagcuugaaggcacugaggacuuucagcagggcuugccuuguagaccugggggugguggggccgugagagaugaggacagagaaauggggccaaauucagugcguccuugucauugugggguggagugcagugggagccauugacguuuuguagacagacaaguggcacaggccauuuucugcuuuagaguauguucuagucaguguggagaggguuggagggcuggagggggacagaucaccugagacagacuuuuguaccaguauggugcugugagucauuacucccagaucagcagcguguagcccaggacaggaauugcuaggguugaaaccuugccccgugugcaccgcuuugugaugguuuuaaucuuuuuuuuuuucaucuauuuuuuuuucauguugcugugucucugaaagcugaauguuuuguuauuuuugugucauaaauugauggacauguccccuccaucuacaaacuuuauagaaugggagauggaggggugggcaaaaguuauuaugcagccugggacacuugagaacacugugagugauuauugugugacaguaggcagaagcuaggaugucucugggaagcuggaugcuguuaauuaaaguggacuaacuggggccacggggauaggaaagaaagauugguguuauuaaagaaggagagcaauggggugguggggaggugccuucuccaugccaagcuugauggccugagcuugaccucuaagacccacaggguggaaggagagccaacguuggcaaguuguucucugccuccacaaacaaacaaacaaguuaaaaaaagauuaaaagaaagugcaggggauauaacccaggugacaagguacuugccuaacaugcagaaguuccugaccucguccccagccccuaggaaaccaggaaugcugacacuugagaggugugggggaaggaggcugaaaaguucaaggucauuuuuggcuacaaagcguauucagaaagccugagauuugagagacgcuuuucagaaggaaggaagaaaaggaguuggggguggggaggggagggagggaaggaaggaagagauagggacuagacagggcucuagucuugguuucccugauggguuuccauugcuagccucucuuccugcccugagccaggugacagaagggagacauagggcuguggcuguuccuggacagaggaggcaagcauuuuauguccuguguaaagccucuccgauuucccugcuuucugagcuguacuuugucccaaugccuggguuauugcugggcguauuagggcgucaguaaaggaacaggcacauaaaagaagugucaagaaggagaacugcgccagcuuacaaagcacagcccagugcaggauguggagagcccaguugcuaaggggacgccuccaagccuucucagauccacacuuggaagggagaaccuguguccaccaguuggccuccuacagcauggccacaugcccuugcccacacaaauccacgcgcacaaaauacguguacuggcuaguuuugugucaacuugacacaggcuggaguuaccacagagaaaggagcuucaguugaggaaaugccuccaugagauacaacuauaaggcauuuucucaauuagugaucaagugggggaaaggccccuugugggugggaccaucucugggcuggaagucuugguucuauaagagagcaggcugagcaagccaggggagacaagccaguaaggaacaucccuccaugaccucugcaucagcuccugcuuccugacuugcuugaguuccaguccugacuuccuuuggugaugaacaacaguauggaaguguaagcugaauaaacccuuuccuccccaacuugcuuuuuggucaugauguuuguacaggaauagaaacccugacgaagacaaugcauuuuuuaaaauguaaaaaaacaagaccacaagauacucccccugaccccccagugaagugcuguggucccuccccaggugcaugccugacuuacccaguuccagcagcagcccaggccgugggaaugcugcagucugggguagcuuuuuucuucuuugcccucaguguugggugcagguuauagauaguccuacaguuuauuugguugucuauaaaaaaggagauacuuucuuggauuugucucaggaaagcaaauggcuaauaguauugaaggggaaugcuggagcucgcugagccugacuggucagucgcagaacauuucuuugucauccagccaugaguuuuuccacagguaagaccagaagcuucacacagggcggggagacaucccuggcuuucccugagcagugagcacccugugcuucuugguucucugcuugcugcccucagggaagaggauuuccgugaggucugguggucaguaaagggcucccuuuggggcugagccucuuugaggucagccacagcagcaguugcuugucccaucagccauguaacagcuccaagcuaaggcguaggacacauucugcucagaccauuaguaagaagcuccuacaucuuacuucuaaaacuggguguguuugagagcacgcgggaagcugcguagaagggaaucaugccaggguuuagggauaacccagaccuggaaucgcucugccagggcucagaucuugcugucaagguuuaguauauuuguaguuguggagauuuacucuaggacugacugaccuuccuuacaaugugcuaaaugaagaugucucuugcacucuguguccuggugauuuuccucccuaaaugguauguuaagagauacauguuauagugcugggaauugaacccagugccaugugcaccacgcacgggcaagccucuccuagccacauuccagccuucauuuguuuuuccuuccuuuugucuuuguuguuuaucuugguuuuagaucucacuguagcccaggcuggccuccagcucccagugaucuugugccaucuugccagugcugggcugcgggcaugugccuuggcgccuuagagcugguggaguuaguuuaauuccuagcgccucugcuuccucaucugcaaacuaggcaaaguugcuaccauaacuuccuggcguuguacugggcugcacaugagcccugucccuggaucuugaucacuaaguguuagcuauugguuugaguauaauuguaagcaaacaggauaucuaauugggagacuuugcuuucauaacagagcggcuucgaugcaguucugccuuuccucucuaguccuuuagacuagaguuggguggaaaauuaacaggaaguaggggacugggagcaucagaugggaaagugacuuuaaggggcagaggcucucuguggggucuuguuuugugauguagaugauuccuggacccccaccguagcuugaaccuggggaucagcauuucaacuggaagaaaaugugaaucuaguuuguuccugcuucgcucucagcacaguuuccuaggaaacccauccugaccuccauuagcaucaucugcugcagucuucuuccuguugcugggaugcuugaucccagccuuggauugaaggacuuauuuggguuaacuuccuuggccaggaagcagauaaaccacauuuaauauacacucucauuccagccugaggguauaugcaggccuuuaauaaguaauacaaagaaaguugggacuuauuauuuuugauuaagggaauaaacuauuaaugauggaugcuucuuuguugaaauuuaaagugccuuuaaagugaaguaucauuaaaauugaaagccagcaacacaaggacaacaaaaugaauuuuuuacuggcuuuuaaaaauaaugaacaggaaaaaaacuaaaggugcuauucauauaauuagauaagccaaggauauugagaugguggaguugaagacagucagucuccaugaugcaaaacugguguugagcaacgaacagccggacucaggcugcagggacuguggugugaaucagagugcaaggaacugagguuggaggcuugugacugcuucaaaggggcugggcccaaggggcugcaggauugcaggguuagacaccagucccaccagggcagggcccgaguguccuggauccuuucuuuuuuguuugaugccaguuuaugggggggcuuuuuaugagugcuauaaauggguuuuaugacuauauuuuauauaaaauguaauuuaauauggaggaaaauuuacugaguuaaacuuuauauaaaagaugagaaaccuuuauauaaagauguauuaaagauucccagguagggcuaugcagugguagguccccuuaucuucauguugacaugcaucgauguuucauuccuuguuuagauagugucccauguauccaggguggccucaaacucagcauguaaccaaggauaacuuuggaauuuuaacccuccugugucuaccuccucagugcugggaacuaguugugugucugugcucuguuuauguggcgcugggggcagaacccaggcagggccuucgaauacuaugcaagcacucucccaacugagcuacauccccaacacccuguguccuuucuugaagguguuugguucaugaggaauccauuucugguucagagaaccucuugccuagaacucugaacuuuagguuauuguuuaaauaagauuaaugcuuaacacaagacagcacuugaguguucaaauuuugcuacauuuggggaaauaauaaaggggcugugguagggcaggaaccuagggccaugcacuucggaagcagugcugugcagcgagccucgucggaaaccuuggaacugcucuucugauuaacaaacuggacuagcaaauguuuuuuaauggcucuaaaaccuugcuuauguuucuccaaguuccugaagauuuaaaaauaugaaugcuuauuuuuuuaguuuugcugcuuuuguuauuugugauaugagcuugaccaucuuaagcuuuugagcuauuguguggcauuacauacacccauucacuuccuuuguuguauaccuauugcuaguggcuacugaacuuacuaucuucccaaccaaaacucuaugucauuaaacacacuucacacacacccaccucgcagcaaggcaacacacugcuugcuccguucaguuuccaugaugggguacacuaagugggacucauaucucuucuuucuuugcuggcuuauuucauuuagcauaucuucagaauacacccauguuguaguaugugucacaauacccuucuuaaggcagcauaauacuuuauggggguauagguguauauaaauauguauuauauauguucauguauauaauuuuauuuauacucuaucuuucagggaauacuugggugguuauuuuuccuuuuggguagucugaauauugauauauauacauaaaaaucuacguuaauauucaccuuucuagaaauguucaguguguaguaugagcuauauuuuuugacuucccauguguaauuaaaaugucuacuagaaauauuuuucuucaugauagucuauaaaauauuuauauucacguuugcuuccagcauauuggcucagugugacaaagguauacuguuaagcucaggagguggugccuuggagagccguguggggacagagacaguugcagcuucuccagaaccugucucacucgcuguagacucacagugagugugcuuggagcugagacagcuuccugucccugggcaucuagcugcacuuggacucaccuacacaguggcuguuaauaauacccggagagccaaagccaagcuguggcaacagacauuugucaaggucauuccuccaacccuguguccuuugcaaggaagugucucuuugaguccucgaggcuacccugguggaagacauuuuuauugucauugugugagcccaguuugaaaaggaauacacuguggcucagagacauuaacugucuuccuuauugccauugcuggugucccucaggaugucacucacaguggucacucacaguggcauauugaauugugcccuuuauggacugagcugugucugugaaguccguacuccaguaucucaggguguaaaguuugggaaaaauagagaugacacacaggcacucaagucaaaaugaggucaucagagccagguguagaggggcacaccuuuaaucccagcauucaggaagcagaggcagguagaucucuuaguuugaggucagccuggucuagagagugaguuucaggacagccagagcuacuuagggaaauccugucucaaaaaacaaaggcagauaauuagcauggauccuaauccagucaguaugacugauggcuuuauaaacgggggaagugcagacucagcugcacauacuuagugaggagggcagaggaacaugaggcaguggucgggaauaacaaaauggccugcagugaccagagcuaggagugagguguagaauacagccugaggacucagucuuuugauuuuggacuuuuaggccaccccccacccgaacugugacugaauaugucucccccuauguccucccuccccccagaaagaaucuggcuguguaacccagguuggcauggaauuugaggcaguccucuugccuuagucuccugugauaggauuauaagcaagaccaccacauucacauuucuuccuccuccuccuccucuucuucauucucuucuucuucccgauucucucuaagccacaugccaugugguacauuguuaucagacuaauaacagugaacaauuuaucuucuguucuuuuugaagaauggagaguuccaggagccccucuaccccauugugaagcuagguuugaucacugggacccacagaaauacugugugugcauguagaagaagcacgcauggaugguguucuggucacaugaggggacaaggugcuucuccaggucacugugugcuucuugagugucuggguuugucuugagggugguguccccaguaccuguagagaccaaggccaacauuugacaugcuuuaagcuuugcuuuugaaccaagauaguuucccauucaguuacucccuagugcuaggcuaggaaagagaagcuguaacggagggggaguaugggcaggacaggagugggcuuugacacugaauccaaagaggaggugcagaaagguuuuaaaggcagugcggcuggaauacacgcagcccuuuauacagaugugucaggucacguaauuuucacuuagcucugaaaguaagaaaacagcaaaccuuauuauuguuauuuuuuucuacaugucacucccccccccaaaaaaaaaacccaaaaaacccaaaaaaacccauucucuuuguucagguagcucacucaagguuaaacaaaccccuggcguuuuaaugcccugugauaggccuuuucagaagcacuugcauaacuuaacccagcuuuuucuuuuucuuuauuucuuuuguuuuuguaaucagaagcauugcaccaggcauugggcucuucaguacuauaaagcugaaauuuaaaaauaaucagcaugcaaucaaaagcugauuacacacgaacaauaaugaacacgaaagugagaccucuggaauggaagaaaaagguguaggagcaguugaagaggaaagagccgaggagaaggugugguguccugacaggcauguggugggcacagcuuaacaugcagcaaugcucccagacugcagcggggagaaggggcauuggggacagucacugagacaucggugcuguccacgaaauaaugcagggaaagccauuggguucuaggacaggucuguuuaguguugauggaaggcacagggaacagguuugugucuuucugcccuguugauuaguucuguggcuuucagccucucugagcccccauccccuuacuaaacugcuucccucuuccgugugugucuagacucuugcucagugcuggcucgguguguaacuuugcacgguggcugcugaagcaggaugcccugcaggccacugggacacaggaauuuaggaaauccaggaaguaacaucaaaucccagcauucugcaaucaggugaugcacaggcgauaaaugaggugggcgaaucucacgcaguagccagcuauauucagaacguuugacagcuuaugcucugaagguuaagugucacgugaguaaagugugcagagacaaagugcaugugccaagagcguguuuucccacagaggcauauaaacaaacaacggcagccagauguggagacuaagcugaaguaagcucucuccuggcaggggcaggggacuuuccaggaucaguucuguggcuucgaugagacaaacugaggucccgagauccuucuuuucuuggaguuuucucacaaguacucagaauucuccugggacuccauucuuggaaauaaauaguucuggguggugcguguuuguuuuguucuuugagagaaggccucauacccuguuagacuagucuucagcuuuuaguccucucaaaugaucauccuagcuacuagcuaggaaaugcacaccaccacuugccucacccggccugauuuaugcuacuaggaaaagccaggaaggacauggugccuacaguagagggagugacagucggaagguuaaggcuaagcaaaucccgggaggagccaagggcuaugaacuguggaguaauuugcgaaaagaguacugcaaacaaaggaguaguaagugcagcgccuuggugugggccgugugcuugauguguuugugcaguaagcagauggugggcaguccugggcuugggagagggcaguagauguccaaguuagacguguccaaguuuauguuccuggagcacaagccacagugccacagauuacauaauaugaacguugucuauuguacguauguuuccuggguguaacccaggcugcaggugguacggauagucuaguuuaauugugcaccugcugagagacaguuugcuuguuuucaguuuauguccaucacaaauaaccaucuauaaacagagcuguuucaguuuuuauuugaacauauuugugucucuaggguauauucccaggauaaguaucuuggucacauuguaaauguaugucugguuuuuaaagaaacuacuguacugggcuguggagauggcugagaggccuaaggagccaugcucacagcugguaaucugauguuuccgguuguacuuucuuucccaacagcauggcaugagguaacggguuucaguuguguuuccauauggccagucaggaugaauauccugcuguuggcuuguuugccuccugccuaucaucagugaagugucuuuucaugucuucuguccauuuucuguuuugacuuuuuaaaaagaguuuuaaaauuuuauaugagugguucaaucugcauauacaucugcaugccagaagagggcaacagaucacauuauagcuguuuaugagccacuaagugauugcugggauuugaacucaggaccucuggaagggcagacagugcucuuaaccacugagccaucucuccagcccccugcuuugcuuuuuaaaguguugaauuuugaaaguucuuuguuuucugugugcuauuuauuguguguggguaugcaccccugcagauguguggugugugggugaaagcuugucuucucggucuucuagcauagccagagaggaaagagcuugaacuguggucagcuccaguuugccuccuugauuuauagacagaguuauaagaugaagguuggccuugaauuaccuuacaucuuaaggggcuuagccuucugccuccaaaauacugggagcugucagccaccacacccagcuaaaagguggcuuuuuuuucuuuccuuuucuuuuucccuuuucccuuuucccuuuucccuuuucccuuuucccuuuucccuuuucccuuuucccuuuucccuuuucccuuuucccuuuucccuuuucccuucuuuccuuuccuuuccuuucuuucuuauuuauuuauuuggcuuuucgagucuuucuuucagcuaaauuuccuuccucccuccccucaccccuccuucccucccugccuccucccucccuccccccuccccuccccuccccuccccuccccuccccucucugcuucccuccuuuauuuuaauagcuuuaaaugcacaucccagguccaugcugaauaucuacgugcacucggucaguuacagugagcuugcuuacucauucauuuccgcugcacauccuguuguuucagcccugcucccuugaaggauugacacccccaccaguggaugcuggugcaaugguucucauucuucccacagaaucccagcacuuuaaaccauuacgcgacccugauaucauccuucacaucuuucacuaugaaacuccugaaguuuugagccacuaagguugggagccagcucugcaucuccgccuccugccaccuucuucuagugugggucaucuguuguccuuuguuuuggaugugaccucugucucucuguggcauugcuugguuuuucagauucacuuauauguuuugagucaaggaccauuugagauuguggaaaggggucuuugacauuugcuuuaauguuccuguugucucuuggcuauaaagucagaugaagcuauugugucagucuacagugagagagauacugcccuuaaaacuugauauuuuggugaaaucaauuuaguuugucuuugcauaacagcuuucuuccuacaguuuugauauguaaugggguacaggaauacagacagcagacacaucagugguaggcucagucacauuuguaacauguugaucaaguuaaaaaacugaaguggauccuggugguugauagggcccugguucucucagcuuccuuccuuuccaucuccuaggaaggagcugacagaagcucagauggucuuaagaaucacacacgugcacugaaauuaugcuuccgugguggauuauaguauuuuaggacuguaaguaacuguggaaaugauucagccccaacauagaagccaacacuguuuuauaugggcagugaauauaugcuuacagggaauagaagccugcuucaugucucaugaaagucuggcuguuacacagacucacauuacugugccagagaccccucucucauucuguuuuauaaacaguuacuguaaucacaggcugucaaggcagacuccuggaucuagucccuccccugacccuguugggucuguauucuuggguauucucuaccugcuuagagaauccaaggaaacacagguaccgagauggcuuuaagagcugaagaccacauagcugaagacagguaggguggccagugguggugauugaacccuuggaagcacauacuuuuuugcuagugaugcuaaauauugugguuauuuuuuuauguaauaaauuacauaugaggauuuucaaguuuucccugcuucucaagaaagaauucuuuccuccaguuugguuacuugcuuacuuucauuaaaaauuuuaauacucacauaaauaaguaaauagguagacuucccgcgggccccucccccccccccccccccccccagcagcuaagacaugguuucacuuuguagcucuggccuagaauucauaaugcagucuauacaggcuuugcacuccuggugguccuccugguaccaggaacucuauucaguggggacaggucucaggguaaagccuaugccugauacacaagaggacccggauuuggucagcagcacugcaacaaguaacaguuucugcucgcccagcagggccuaucaugggcaugcagaccgccaaccuucuggcccucuguucucuuucucuacagccuguagaagugcaugcagagcgccccccccccccccacuguugucacacugagcugugagguucccucugucucuggccuagaaguccuugccuguuuccacauugcuguggaaugccuccccuccccccacaucucuuuguuuauccuuaggauuuauccccaaaugguauucugugacauguuuucuguuucucucuggucccauccucucuggacauuugcugaguucccuucaucuuugucuuuaaugucuugaauaugauauuguguagaauuaagaugucugcuugcugcaucggcagucugcugccgaugaaugaaauauauuaacuuugaguucuccagaagagagugugggcuucuggaugacaucacaacuugcaaaggagagagaucaauuuuauuucucauuuaaugaaaaacugcccaugaauaagugauaaaaauuuaauugagaggauaaucagauauugcuucuagccuuaucaccccccaacccccauguaaaaauccaauuaauuuacccccuuucccgagaagcucuuuaaucaguaaguuugcaguagaucgugaggaguaaguugcgauuugauggcucuugauuuucaggcuagaaaaccuguaacucugaguauucuguguauuguuuccacagugugguguuggcauggucuucagugcagaaaaaguuccuaagcaaacugugauguugcaaauaaacaugggcauagcuggggaagcguaagguuccagugugcaugcaaggucagcuaccgaacaaaacaccgggcccuucccccuucuugagugcugguacugaacacaggacuugaggagugcuggacucuuucaccaaggagcagcugcugagucucucccuccccucccagguugauucuguuuuaacuguaccucuguaguuaguuucccgauuuuacuuggugaccauugagagguuaacuuaccuccuggucugaaaugaaggagcgagugagucacuuagucacuguugugagaaaagacagucugguuuacagugugucauuuguguaugagcuagaauuacauuaaggagcucucucugauuaaaaggcuguccuuacuuugccaugggcuggguuuguuaggcgccuguggcugucccccacuguuacuaacgugguuuuagaagucaucuggaaggagaggagaacauaucuucuaguuugacagguagcaauugacuugacuugcugaggcuuuggcucucagagcccgagaagacuuaaaagggcucguuuguguagaugggcccuugagagaucaggcugcugccuugacccacccauuggcacagagacagccuuggagaagucuaggucuugcuguuagaugcaucugaucuaaaacagguuggaaccaccuuucugauuuuaauuugauuuggaaaacuuagcugaccgucauuacaaaaaacucagaaaaacagaaaaauacuaagacuauaaugguugcuugacucaccuagcccuagagaaugcuguugugagugacuguggacugcugugaugcacgcagauaugccauguguuuaucacuccucuuaaccagguuuacaaucauagcuaaucuucuaguugauguugaggaguauuuaucuacucauuaagaauuuacggaaauauuaauuuaauggcaaagaauucaagggaagugaagacugugccgaauagcuguagucuuuuauuuuuauuuauuuauuuuaaauuuauuugcauaugcuaauugccuauuguacuggcuaguuuugugucaacuugacacaacuggaguuaucacagagaaaggagcuucaguugaggaaaugcuuccaugagauccaacuguaaggcauuuucucaauuagugaucaaggggggaaggccccuugugggugggaccaucucugggcugguucuauaagagagcaggcugagcaagccaguggagaacauuccuccauggccucugcaucagcuccuucuuucugaccugcuugaguuccaguccugacuuccuuggugauaaacagcaguauggaauuguaagcugaauaaacccuuuccuccccaacuugcuucuuggucaugauguuugugcuugaauagaaacccugacuaagacaccuaugcuaacaguuucauugugauauucucaugcagccuaucaucuucacuccauugccggcugguucccuccuuaccgcugcacucugguuccugacuccugcagagcccuuucuuauuccuugccaaguucuuuucuauuuccaugggugcgcaggagcguguguguguguguguguguguguguguguguguguguguguauuuaaaauuuaauuuauuuuauuuugaguuuuuaaacacuuuuugagauuauuaaauaauuagaucaugucucccuuaccuuucuucucuccaaacccuuccauauaccucucuuuguucucuuuguaguucauggccucuuuuuuauuuaauuguuguuacguguguguggugcaugugggguuuuuguguguauauguguguguguccagucuguguaauauacuugcaugcauguuuuggcgacugacaacuuggaguuugauaaccaauuaguaagcccuuccuucccuggggaagacugugggccccucucucgguaucucuugguucccuguaguucuuugucuaagcugaggccucaugaguuccuucccccauccauguuaccauguucauugcugauguccuuguucaucuccuauuuaggcagucauguuggugauuauuuaugggcauagcuucugauguuccuaggagacagaggcucauggcaaucucuguguuccucugccucucaacagcuuuucugacucccugcuuugcaaugaucccugagcuggaguugcuggaguuguguuauguguggagucugggcuccacaacucugcauuuugaaugguuguggcuuucugaaguggucuccuguugcgaagagaaguuuccuugaggaggagugaggacuaaacuuacuuguggauauaaggacaaauauuuagaauguagcuagggauugugauuguucuguaaaaugaggguuguagguucuucuuuagguucugugaccucauuagcucuggguaguugcuaaguuuucuguaccaggcaugauuuccauuuuaagucuaauuagagaaguguucuuuagcaucaggguaugugugcuacgacuguacccuuaaaguuucugugugugugugugugugugugugagagagagagagagagagagagagagagagagagagagagagagagagagagagagacagacagacagagggagagacagagacagagagagagagaggaagacagaggaagaggaagggaagugggagaaggagggagagggagagagagauugauuguguuguuagguuuugucacaugaucccagguuagaaauuguuucuuuggcugugaaagaaaaugucucuuccuccccccaggaccuguaacuguguagcucuuuagggagggguggggcucuaggaacuccuaccccuagcuacccugaggaccuuuaaauccuuggugagagacagggcuggaugggcccuucccccacucacagccugauguugacaggcucagccuuggguauacuugucauagcuaugcugccaagggcacagcaguguuguccugcucugaaggcagaagccaaugcugccccucgcagagcugccccucgcugugccgccuucuugaucuugccuucucuccaccucuucuucagagaugcucccugagucccagccauaccacguuugaucuguuauguuucuggggagaugcucugggguuaucuguuuugucauuuaccucuuggugggcuuuagugcugucuuuaaauguccuacuguuuaaugcuuacucaucaaaugagcccugucagauuucccuccagaaaaucaguacaauaaucaugauaauggcuacuacuuauuaacaacgcugaugcuaagcauuuuguguagauuaacucgcuuauucucacaaaacauuggccuuuucuuuuagagauuaggaaacugaugugccaucuaugugacuguuuucgaguaccccaaccaacaucaaauaugguaauuaaaaguauuuccaguucauuuugugugaaacagccucucauuauuccaaauuguauugcucuggugcaacgaagauuguacuuuucuucaucugccagacggcagacaucauuauccuuuuccacuuuagacagaaauauucuggaaaguucacuagggcaaauucuaauaucuuauaaguaaaaaaaaaguaguuauuaauuucaacaggauuucuuugaaugccugccugaacuccaaaacuaaugucaguuauucuagacaccaugagaugcugauaaaugaacaguuaucauaaggugaugguaacaagaugguguccuuccauugaccacaugguguaucccuguuagccauauugcuuuaguguuuuuuuuuuucuuuuuuuuuccuuuuuuuuuccuuuuuuuuuuguuuuuuccuuucugguuuuaugcuugcugcacuuaauauucugcuuauugauaauuugauguucaguguuuauuaauugaaacuuuccacacgccucacaagcaugguguagaggagaaaucauggagaacgaugcagaugcuccauggaauagucucugucaccggcuugaagcccgcgggcacauuuagguugugugcacauguacacacaaguccgugcagggugcuucauucccuagcuuuuagcugcucacagggcaugagguaccuaaggcauuuauccuuguaaaugcaaauaagugccauguaaggccagcacgguuuguuaaaugaaauuccucauuaacuugcauuuuuauaaccugauggguguaucucagggcauuucucuauuauaaauaauuggguuuagggaguggagcugaaguuuauuucacaugauacugcucagcugagcauuuuaauugaaugucgccaguagaagguuugaaguagauagagauggugcccauagaauucagauccagaugagugggcugcugugcuuagggacagccuggcagagguggaggggcuguugggagcuccuguguuggaaaguccucagcuugauccccgaucccuggcaccaagaugcccugggaacuugcaaaaugccaacaccuggggucccuuaggcauaagcuguugauggagcccgggacucugaauuccucgaagaagucccugagagaagucuucacuuagagagggugcauuugucacccucccaagugguaaucaacacggcccauuucacuuaguuuguagggaaaaaacccagagacccacuuaggccuguuugaauuuuuguuguuguuuguuuucguuuugguuuccugagguagaguuucucuuuguagccgugguuguccuggaauguguuugaauuuucaauaagagaauuauuuuaguauauuuuugagaguauguuuugaaaaaaaaaaaccaguuuuauuucuuagaaacagaauagauaucaaaaaaccuacuuuuuuuuaaagcuuacuuuccccugaagaaguuugugucucucuuaccaggcuuugucuccaugaucacugugaggauuaggucacauacucuuugcugaagccuucacuugcagaggugagggaaugccuguuacugcccgagcugcugagugauuagcugagaggcuaaugucccucaucauggugcaagcucaucacuagggagccucagagcucgguuugugugcuccacccaccugucagaugguuucuagaaauaccugaguacuagccagggaggcuucaggauguguguauggggaguggagagagggagggaggacugauaaacaccgauuggcucacucuaaccuccugccuuacccucucaagcacugcgauugcugacaugagccucugguuugguuucuucauggauuuagaccuugguguccacuuauuacagauuauguugaguauguguuagcugccuugaugagucaugucugccugguuuucuaccugguucucugauuugaaugcaucaucugguucauggcgucugcggugggaacacuccaaacucucggcagaggcagccgugcaggugugaugucagcugggugacugagcgcguuccucagcguggcuggaugcuguucacucuguccugaucucagucugccucccuuugcugaggggugagucgaagccuggggagguuaagccguuugcuuacacuucccagauggaagugauagagcccacaucagggguauggggacugaagcuuggaguuuuauugaagcuuccuaaaguugugaaauacaccauacaauacuaaaucccagcauaauacaauuauguagguugacuuguaaccugaucugacaguccugcuucagccuccugagugcugagaucacuggcuugaaccggaacaccaaguucaaguuguaugauuaacuuaccuuguuuaaacuuuuaguggaugguagauugguagugauuugaaugggaaauaucuccuauaggcuuguguguuugaacauggaguuuccaguugcuguuauuuggucaaguuacagaauuuuuaugagguggagacuuucuggaagaagagguucggugacuggcuuugagggcuuacagccaggcccugcucucuguucacuguguccugagucagaugugaugugaaccauccggccuccccaccuuucccgacuaugccuuccccaccaugauagaagauauccuucagacuguaaugucugcagaaccuuucucagcuacagugcucuugucaggguguuggaucccagcaacagggaaaagacuacaguugguacagaagaccgugaggacgggaacccgagguguagauacacuccuucuaaacugaguuuaccugggcaaaucuccuuucuuugacaaagaagaguuaggcgagguaaguucugaauccccugcccacaucagguagagaaagccuuaguuagcugaggagcaggugggcagcccacaucagguagagaaagcguugguuagcugaggagcaggugggcagcaggcagacuugcuagcuucucuuuguugauuuaguauggggcgggcggugguauggaaaccguuacugaauucaguacagccgccagucauuucaaguaguaaguguuuuguucauuuauguaagucaguaaguugcccuuccaccuuauugauuaaaacgucuuagcuuuugaaggacucgcagguauaauuucuccaauauagauuguacuuucauuuuuuaaaauccacgguugaguucugugcaugauaaaguggaagcaagugcuuaucaauuuuuuuauugaaaucaucugaauaaguguuuucucuugguuaguuucacacggagucauauuccugaaucuaauuagaggcaguucauguacugugggcuuauuaagauucaaggcacuuuuuuauuuuagccugucugauaucccuuuuuaauuucacuuaaauuugaauuacucuaacgucuucuggguauauugaagauacucaguaauauuaauaaugaugauguugacgagccugucucgucucauucucccaagucacauaacuuuauuuugcuucuagcaugugaauauuuacgauuuuaugucuuccuguggcaaacaucaguaaucaaucaugaguuuauucugaugggucuagacagagccucauggucuuacuugaugaagcaccgugagccaccauucgcauucggugagaauuggcagacguuugccaucuccgauccggauguuguuugucuuggguaugucacaugccuguugccugugugucaucaccugugauguuguuugucuuggguaugucacaugccuguugccugugugucaucaccugugauguuguuugucuuggguaugucacaugccuguugccugugugucaucacuuuacauuuuuaucuuucugccuuuggcuaaagagcgucugccuuugaagaccccucuauuauucccacagauguuucugagccucugaagcugcaggagccaugaaccucagaacaaacuucaggcuugucuguuggccagucuuuccugccuguguagaauuucuuaaaaaggaaauuaaauugaggacuuugcucauucauuuugaugaauucuuaaaacacucuuuuuugagugugcaugaauuuguguuuccugguugccuggauagaacggaacaucucucaucccucugggugguaugucaucaccaggcuccauuucuguuguggccguguucucuucacugaccgacugggcuuucgaugcugguaggagcuguucuggacaaaacacccaaaacaguaacucaaaggcccuagaaaauagaagggagggagggaagagaguugauuuagaaaacccaggcauguucugaacuucuggcuuuuacuuugggauuugauuuuagugacagagcgcuuuaguagaggaguuaaaaaccaacugucugaguauggugguaccuuuagucccagccuucuggagguagcagcagaggcagacacaucucuuugaauuaaaggccacgcagggcuacauaaugagauucugucucccaaacaaaaacaaaacaaaacaaaacaaaaacaaacaaaaacaaacaaaaaaaaaacaaucagugcucauuauccugaugaacaugaggacagaauucauggccauuccacauggcaaagugggagcgucuccaaaaguuggaagggugggguccagacuggaaggugugcccugaacugugcuugugugaagcugacugcaaguggcguagcuaaagugagaacacagauuugagcugcugccuacggcaugguuugcaguuggagucuggguaugugucacuugugaaucacuguucacugagaugucagcucuucuuaagcacgaaugauagcacaguguaaacacacuuucccacuguucacuugccugucacaguuuccuaugcccaguuaguucacuguuguagcguagaaagguaggcagguggucagaaaaguaguguaguuucucaguccugagagcgaagcuugauggguuugcccccaguucugcuccuucugcagucaugagugugcugugaagcuguggcucaugcaugugaauacuaugggcuguauacuguggguuaucucauguugccuuugaaauuauuguugaauuuugcaagaaucauacuaaaaacugauaauaggugguauguucaguguugcauauaaauacuauucuaagcacuuuauaguaguauucuuauaauguccuacuuaucaucucuuuuacaguuaaggaaauaaagagguggcuguguauuuacuuagagauagagccaggaaccaauaauauaagggaagaaguagguuagugugacguguaccccguacgauagugucucaaacacaagguucaccuuauguauuauuugggcuuaguuccaucagauuccugggaaaggaacauuugggaaacacuguuuucuguuauugugucuuaacaauuuugcuagcagggauuuggcaggggagaaguuaagaacauuaguuaaggccgucaagauggcucaguggguaaaggcacuuacugccaggccugagaacuugaauuugauccccaggacuuaugugguaggaggagagaaguggauccuacauguuguccucuggcuuccgcuuacaaaccuguggugcuccccuccccacgggcaugggcaaaucucuggguaugguugaaugagaggaugaaaaugaacuugaucuguaggccagacuggccucaaacucagagaucugccugccugccucugccucccuaaugcugggguuagaaaugugucgccccaccacugccuagacgacgacuacuacuacuacuaccacuacuacuacuacaucuucuacugcuacuacuacuucuucuccuccuccuccucuuccuccuauuaaaugagacuuauuuacuuuguuuuuuuuucuuuuuuuucuuuuuuuuuuuacugggaaucuugaagucugcuugaagauuccuugggcuugggugguaugugauggugguaggggucucaggcaggacuuggugaggaggagauagcuuugccugucuuggcaccaaggaaggucagugguaccaugagcccuguaaagugcuguugugaagagguuggacuguaggaucugugugggcacagaaguggggucuaggaaggacacacuguuucagcucuggucuugagacacaucugcaacuaugucucuucugaacuggcacuguggcuaucuguggaguaacuuguaggacaccaagaaguagcaggguagcacaccgguagcuuccagauacaauagaauauaugggacagaguuaacaaauacuaaaauagcugaagguuuuguagcauaacacauaugagguccaaacuggauuccacccuugaaguaggcagaaggcaggcaggccugugcuuacagcucucuucgucugagguuuucccagccuucaggaugcagcaaacaacuucucaugccagggcggugucucucauggaauuguucuuguucucuagagccaaguuggccccuaccucucauccuccugacucuacugcuuuggugcuaggauuaugaguguguacuaccaacuaguguuuuuuuccauuguuacuuaauaaaacugugguuuauugcugcccagaaaacucauugaacacagaugguaauacgaagaguuguuuuauaacugauauuugcuauaaccagguauuucccuggaacuucauuauggaauaucgauuuaauuucaugccaucuuggggagcaaauaauuggacuucaucuguuucauuauuaucuagguucuagaacacauggaaaucaaguauggaaugcaugagucagcugugaagugagugagugugugucuguuagggcuuagaauuuggguuuuuaaauacagaggauuugcuuugcuuuuuucuguauuugaaagcuugaccccucuaaaugacuuggauacagaaaccagucgacuguaguacugcauuguuuaugaauauugauaugauaaauauuuaacauuuucugguaaauacuuaucugacauagaguuggagaaauuuuacuugaaacuaucugugaaacagccagacaacaucaccacguccuucugauaacccuaagcacaguuuacuguuucuugcuuugcuuuggguuucugguuuaagcacguucaguuaaagcagguaggcaccauacagugguggcugcagcgcugagugggaugaaaagcaaaauggaagacgcucagguuucauuuucaauaugaaagauuaugaacauuuuucuuugcacacauuaguagaaucugugagaucagaugaguucccugcuugacagccuugaugauuaucaugcuauaauaguuauggaaauagaggcauuguccagugccuacuuuguguuaggcaaggugauacauguuuaaauacaguacugcacugauugcaaaugguaaaugacagugggcugaccuaagcagggggcucccggaaggucaguuugacgcgugauguaggaaaaguaucauagcuguucaguguuucucagaacugaacaguguucucaguuuccccucugcaccuagagaccauucugcaucuacuccacuucauuaaaagcuuaacacugguggggcuggaaagauggcucaacaguuaaaagcacagcugugcccuuccagaggacccaaguucaauucccagcacuugcauguuaucugauagccaucuguaacuccagcuguagggggaucuaugccuucuucuggccuccauggagacuguacuauacacaugugguacacagacauacgugcagacagagcacccacacauaaaaauaaaagcaauaaaaagcauugucacaaugccacugucccaugucacaucauguuacgggauuguagccuuugucuuuguggaucuaagacucaaaggcagguuucugucuucacugcccaugaucuuaaucauuuucuagucacugccugaacuauuccuauugagguacucagcuggaguucuuaggugcauuuucuuuguggauuuguauuucagcuugcuuguuuggguguugguauguaaugcagggcuaaaugaaggaggaaacaucgcagcuuaggagucuuugagauaaaaugagcauguagacugaaaacuguguuguucuuaaacaggaugauaaaacuguuaggugggaaccgccuggccuugucuaauauaauuuagugucacaggggccauuguuauuugcucucuuugaaggcaggcuaggcucucuaaguuuuagauugacagugcuuucucgucaguaaucuguguguaauuaucauucgcugucuacuuaauaacaauccuaggcauagggaaugcauuugggaaugaauuagacaugguuuuugccuuugggacuauuguaguacaccacagauacacacacacacacacacacacacacacacacacacacacacacacagccacaguagcacaguaagaauuuuaagggaaaaugaugguucauccaaccuccugaaaauaccuuacagcaaauauuuuagacuuaugcaccuuauguuuccugcugcaacuccuuuauucagucaucgccacaugaaagcaguccucagugguguauaaaugaauggacacagcuguauuccaauaaaacuuuauguguaaaaauagacaaaugacugaaugcaguacacucugauuuagagaguuaagaauguuuuucuugugaaaauuauuuguuugaaaacaugauuuauauucuugaauccaaaugguaaugcagaacuuuaaguaaaagucagcauccucacaccuaaguuuucuucuggagagugaagugugcuuguuacaggcacugucgugagacuuuggcuuucuuuaaaaacccgguucuguuaugugaccaugucuuuguuuucauccccggugugggguaugggcugcuucagacuguccacagcagcugugguuugucuccugcucuaacaggagugggauucugcccgcugaagauaguuuacuuuuggaacucuagggacucuugagagaccagcaaaugccaggucgccuagaggcugugauggugauuuugcuguuugcugguauguuggguugcugguugaagauauccugguggugaacaucgaacuugcaccuaggaacucaaugcccuaaucagcaggaaguaggagaaagagaucuauaccccuuuccccucuaaccuuaauucuugccuaacuaguguugaggggguuggaagggguuuggguagagaaggguaguagauaucagaacccaguaaagcagcucacaauaugguuacgugccacuuuccuuugugaagagugucuuuugaauaaccaguaccuagaagugagaagaggcaccuggcuaugcuauaauaaaacucacugacuggcugaggggaauugacugagagcuacuacagcaggcagguagguuugccuugggucccaccucugcugauagucucuaguccguggagcacugcuucaugaugcugcugaccucauucucugugggaaaggaggugguugauucacccugucaggcaggggccagcuuuaggagucccagugcauaugcugugccuuuucguuuuuuguuuuuuacugcuaggacuaggagugucuugugagcagauauugggucauuuaucagcuguuuaacaaaauaguuaagaaugcuuucucaggagcuggaaugguagcucagcaguggaucacaugcuacucuugaauaagacccaaguucaauaccucacaccuacuccccauguaaauuaaaaaaaaagaguaagguuuacaaaugaaaggacauuuagcuugaugcuguccuacaaaaucaccuuuaagcuauuuauaaaaauacaaugcuuguuaaauguguauagcauuaacauaaauauuuguuuauuuuaauguuuuuucuaagaaauuuguugcuuucuauguuuaauguccuuggccaucaauauuuuaccugucuauauaauagaacaaccaaagucaagguuuaaauuauuuuguuucagucugcccuuaagauauuugugauuaagaacuucacauuucuuacaaauaauauaaacaaugcaauuagaguuuuacauuucuuuugaaguauauaaaaugcucaauccaggagcagcuuuuuucauuccugcuuauaaaaucaguuucaugccuucauaauaauagaguauaguacuuauauacuuaaaaaauaugcccuugaauccuuuuuuuuauaagcacaguauauguacuucaucgcucacucagguaauguuucuuuuguguaggguuguaggaggagacaggcagagucaauguuguaauuaaaguugacuuuccuuaggaugucauacacaaggcccugucugucugucugucugucuaucuaucuaucuaucuuguauguguguauuccaguuguguguguuccaggucccugcccagaccuucuauccuucuauagcccuaagaacuugaauuuucuaagugauaggaucaccuuuauuguuuauaagccccccuuucagacuuauuugaguugguucguguugaugaggccacccuuugaggaccuugagacaguuuuaaggaagguggggucugccauaccuacagagucagucaguuggaagcucaugucuaccaccuacauauuaucuagggauugaguucacucauagcugauaaaucaggauucugagagaguuggaaaguuaugggaaaacaauauggauuugguguuagaaaguacuacccuucuuguguguuuuugcugauguuugacucaguguggaucguaacacuuaacacaaagcaccuauacagcuauagcagugguucucgacacguuugggggucacauaucagauauuuauguuacgauucguaacauuagcaaaauuacuguuacgauuuuuauauuuuuacauaguugcauaccacaaagcccugccagcuagguuccuuucucucugaugggagucaggccaccuuuuguaauuguuuaagcgccaaguccuucuggucagucaucuaauuacccggcaugacuuaccaauguauaccauaagguuaaucuugauucucaacuugauugaauuaagacccuaggaaauuuguggagcucacccccauauaucugugagagccuucccagagaggauuaacacagggagaagacacugugaauauggacgcccuauggugggauguggggagagccuggcagccugaagugaauucauucccucucugcuuccugccugaugguguaaguggcugugcuguuccacaugucgccuuucacacuggaggaaagccucagcaauggggcaggcugaucccuuccuccuuucggguuguuugcuagacauuuuguuagaguagugagaaguuuguuccuucauuuguuccuucacacacuccaucauucagggaaauuaguacugauguguguguggucaacugcuggugcugaguucucgucaacaaacagaacaagcauuugccucacaagcugcuauuuuaaacucuacagauauuugaaguguaguugcagauaugaauguaugaaauggaaagaacuuacagauuuaacuguacucauauuuuccugcuccguccaguguuugucauuugaacccaguuagaacuauagaagcugugugaguuucugccaugggaaaaaaaaauagcaaaaggaauagaugaaagaaauacugaagggcuagguuaagcaaaaacaaaauaaaugguagacuucugaaugggccauggcuucaggaagcagcugcugcucuuggaaugcaggaagcgggugagcuucugccggagcuuguggacuuggagugggguccuauagagcuggggcuuggcagaugccaucuucauucaucaccagcuucuuagccuccguguagagcccgagguuggcagacacugugggaagucagggggcagaggggaagaaguucccaccaggcagugagcacugagaacugagcugaaguuucacuggcaucaugggcaauccugggauuuggggcaacuucauccugccuguguuuuagugcaccagaucccagaaagccugacugagggggaaggaaagggugaggcacugcuucccagaagccccuuuaugcaagagugcagcaccaguucccucuguguguacuugcaguuuugcagaguauagcauuuggaaucuagucccauggucuaaguagaugucaaguaagaauuagcuuggaaauaauucaguaacaucaaaugcccuucuucuucccucccucccucccucccucccucccccacuccuccucccuccucuuccuccuccuccuuccuccccuuccuccuccuccccuuccuccuccuccccuuccuccuccuccuccuucuucuuuccucucccucucccucucccucucccucucccuccgucccucccucucucucguguguguuggauacauggaguaugcagguauaugugccugugagcaggauuuagggugucuuccucuguuaucugccuuacuaccaccagacaggguuucucgcccugaagcuaaucugguuguggagcucugggaauccacuggucucucuccccagugcugggguuacaggcaccuguagccaugccuggguuuuuauguggguauuggggacuugaacuuagguucuuaugcaugcagagcaagcacauuuaccuacugggccauaacuccacccaccacauuuucuuuuucuuuuuuuaaugauuggacccucagaaccuccauuaagacaguauauugagaaucucugagucuuucuaaaacuacauuguuuugcaaauauuuagaugcagaucuuuuccaguuuauaacuauuuuugucaaacccaugucuccauaaucauuuuccaacagucaauuaaauauuugagacuucuuguuauuucuuggguggguuucuaaaucuuuuacaucucuggcauguuauacuuucauagagcagugcuuugucugcuuuggaguuaauucugucuguuuccuuuugugauauuccugggugacaugguuaauccucuuugucaagcugacuauguuugcaaucaccucugucugucuguuucucucugugugugucugucugucucugucucucucugugugucugucugucuuugagaacauauuuagagagguuuaagccaggagagaagcccuauuugaauguagguggaaccagaaaugaggcugguggccugaauugaauaaaaagggaagauguagagacugaguugaguaucucugucuacuccucuggucccagccacgcuuccaugucuaucaacucugccaugauggucacuacccuuucaaccugugagccacaugagcccuucuuaagcugcaucuuauccuauguuuggcuguguccaggaggaagguaacuaaugcaugggcccucucuuguucacugugcagagugacuauagacauguguauaccagccacugugauggcugaugauccuaucucacauaggaaaguaagguaccugccggucugugggaggugcagaugaugguucaucagguccucagcuuuauugaucaggcaguguucgguugcuguaaggaaguacuugauacuuaguaaguuauagaaaaaaccaaaaaccaaaaaaaaccaaaaaaacccaaagcgcccccuauuucccauaguucuggaggcugggaagucuaagaugguuccagcagcuggugagggcccucuuacagcagcaucaaauccaugaugaagcagaagggcuaaugagcacaugggaggagaacaauaaagcaaacccaccuuaucaucuacuguuguggggagaaugagccccauggggaagccuucacuucccuuagugacagaggcuuaccucccugugugaccacugugcuaguuguaucucaaagugagcuucaagguggcagacgacccagaccgugaagccugcacgcucucugucaccaugacauccaagaagacacacagcauggcugauccucugcucauucucauuuucuuuggacuuuguuaaacuguaaugaugauacagucucacaguagcuccugacauaaguguuaccuggacuguacguggcuuuagggccuuuggcuaccccaacuuuacaggaguguagauuugauuggagcugaguuuccuugcugcuuuccugugaagugucagauugucugcugugccagggugcuugugucugccugcagaugcuucucugaguuccugauccucacucuggccuuugagagggcagcauuucucccugugguucccuggaggacagugcauggcaugcacucugcaccgugggauacagcucccaguuugccgaucgcucacuaugaguuugcuuucuguggucauacauucagcuaaagguaaggcaguuccagggagaaggccaggacaacucgaguuucaucuccuugugaaaacccacagcuccagcuccaguguuguguguggaggguugcuggagauuccugccucuggccuagcuggaacagcaagcccagggucgcggagaacacagcugcuagggaaugacuuccugcuagaggaagaugucagaacuucucuggcuuuugcaugcacacuuggcauacacaucuccucuuguguaacacacacacacacacacacacacacacacacacacaagauugagacaauucucuuccucuucucagccaaggaaacccaaaucacugcacaagaagagauaacuuaugcagauugcaacucucagcauaugguuuucuuguguagcucagacauuuuauguagauuuauuggagaaugaaugcaauagaauuuaauccuacagauuauaauuuuucuuaaggaaaaacucucaaacuagaaaucuaguuuucuguugcaguaauauugcauucaucaacaacagcaaagacuuuaacacacagagaauucuuuucucaacacaagcaguggaccgcaggccucccugacaccaauuaguauucugcagagagaauguguggaaugucagaaagaugaucucgggaauuucuccagcaaaggucgcucauuuacuccccuccaagucauugcuucagcuuccaggaugacaggugagccugugagauugaauuagccagguugcucaaaacuguggcuuuaaagaagccaugagaagucuauugccagcagguaaaucccauuaaacucaaauguacccucaauuguugagcacuauuagauuauugaaggagcagaagugaguugauugaaauaaagucugaaccuugcaaguuucuaacagaauuuauuggaaaagacuguggggugugggcgucacucagggacgacucaaaauuggaaacugagggugauggagaucgggaucugggcccugaggaccugucugaucuggagagcacagccccagccagugcucuggugaugccaugcguguguuugggcuuacagaugugugcaguuuccuggcagcagccuaggcagcugugggggugggggugggggaggaggaaggccuugaacuaucaagcacaucugcuuuacuuagugucagggcagauguguuuaggcagggcaguuggaguaaaauguuauacuauuuuccuuccugaauauuagauaugauuacucugaugccauguguaaauguguaaagcuggugugguuguugugaagcuaauggaccaagaauaaaaaugcccuccuccucuuagaacuugggaggacugcacccauggcucuuguguuaauagaauauacuaacuugguuugcagugaccgcuuuacauaauuaggacuucugaaagccaaacuuucuuuugucaccaggggcucacuucaacaggugccaagaaugaugugcaggggcacacagacacacacccacacuacuuacacucucacucgguaaaaacuaugaugaagcagugcccugauuuucuuaauucacacucuacaugaacuucagaaacucaaauuuuaaguaauaugucacagcauagcucaugugacaaaauuccuggcaaagcaccugaggaaaagggcuuuucuuggcucccaguuugagggauacagcccgucauggugggaaggcuucauggcucccaguuugagggauacagcccaucauggugggaaggcuugagggagaagugugaaguggcugcuuaccuugcaugcucagguaugaggcggaguggggugugcacuccuuacucaguccagcucauagaguguuguggcccacauugagaaugugucuucccgccucaguuaagcccuugggaauccccucacagagaucccagagcuguuucccuggugguuuuaaguuccaucaaguuagucgugaggaugaaccaugaugacuguccucauucuucccucuguggggcucaccuguuccaugagauguagcagcgaugcagaggcagugcccaggcccagggcuggaugccugcgcuagcucacugaggaagcaacagguugaaggagggccuguaccgccugcaggcccuggcuccucauuugcaacaugagcaugcugugaucucagauuucuuccagaacuuguuagucuuuuaaaaguaauuaaaaacuaagaaaagaaaaaaaaaaccuaugggaaauguaauuggaaaaauuauuagccuuauuagagguaauuagaaaaguuaccuuuucuagcuuucuuauuuuuugauuaauaaaucaagucuucauggaauuacaugugcuuacuacauuaagcaugcaaguaguuuuacuuagauggagaacauagagauuaauaccauagucacauacgggugcagggugcaaguguuacuuguuuggaucacaguacaauuaaaagcauaccgcauaagugcugauggugacuugccucagacccacacagccucuccuggugccugucacuggccagagcccccccccccccccccuuucagguuucugugauagacaggcauacgugagaagcuuugcuauaaauuccuuccauauucacgugugcauaacugcugucuacggcucacuuucuuccuguugcuuguuuuccuauuuugcuuuggaaaauaucuuccugugucagugcauugcaagagcuguuucaauaacuugaaacauuuucaauauuauagauauauuuuuagauaaggccucuuguagaaucagcugucccgcucuacagcugaaggcagccuugaacuccugaucuccucccaccccuucccaacuauugggauuacaagcugggucaccaccuggcaaugauccuuccucauuucuuuuugguuauuccuacagaaugucaccagaguccuugugccuucuccuuggggagaagcucgcaccaucuauuguagcaggcuggagcccuagcagguaguucacuauaacccaggaggauuaauacuaaauauggaagaaaguugcaagaucaaggaccaggcagcuccaaugugguggaaugauguucagggaugucaguaauuaaguggauuacagaggucagucaguuugagcaaaacugcagguguuguuucuaaagaaauaguuuuuaaaaaauggcuggaaaauuucuaacccagcacauuuguucgcauuaagauuaccggaugccagucccauucuagauugucuuccucuucagccucugucuggucauuuuguaagaauuugcuucaccagcacagucuagccagagucuguucaucucagugucugucuucaccauguucucugcagggaacgaggggcagcaaacccccauucugucuguaacuaaggcuuuaucagaacacguccauucguugucuguuacccgguggcuccucugggcugcagaggcagagcuggauaacugcagcagagaagaacaucuaguguucuauacucuggcccuuggcugaaaauuugcugacccugguuuguguauuacagcacucacuuaacuggcuuuauucucuacaaagaugacagaguggcuuuuccaaacucugauuuugauauuuuauuuuauuuuauuuuauuuuagagacagggucucacuguguaguucuucuggcuggccuagagcuuguuauauagacagcgcuggccuccaacucucagagauccacaugucccuuccucugccucucgaguaccccagccuagugcauuuugaucuuaucaacccacuucaaaacguggcuuaaauuaaguguaagcuacaacagcagccuacauuuaucugcauggucuggcccucucuaaccuuccccauuucucagcauccuuagcuggugucucuauaucuuauccuuuucucucagagucucaggacagucaggccugccaggcuccugugcuucuccuuggaguuucuucacauaucuagcuguucucuagccucaggucccugcauauaugccauauccuuggaggaggugacagucugcacccagcacagggcucaucaugcaucccguauuuccucccuagcacuucccacucuauuuaaucacauucacuauuugagcgucccucccuauuuuccucuucuccacuccugggacagugauuucuugcuagcagagaacuugucuguuuauccggacgcaucuggauggcaggcuccagguccacugcaaaucuaggugcccagaggaaaacuguuguguaugugaacccguagaacuucuggcaguuuccguggaggggcuuugucuucauuuucuguugcuauggugggauaucauaucauggguccuuguaaagaaaacacauuuauuucuuacugcuuuagaggcuggaaaguucaaggccaggggcugcaucuucuuguugagggccuucuuacuggggucccuguggugagaggaauauaugcaugagacagggccaaacugacuuuagagcagcagaccuccuugagauaagccuuuaaucuacuaauccacacacagauuaauccauuuaguaauuaaucacuucguaaagguccagccucuuaguauuucacaauaaggauuaagcuucagcccgaguuuugcuauggacauugaaagcgcugcagaguucaguuccaggguaugauuaugccgcuugaauuuguuuaucuacaaaucaguguugccugcuucugcucacaaugcaaaaugaaggugcuuuucuucugcaguagcauaaggcuggcacacucucuggccagggucacagaauguagaacuugcagaugcuggcaggcauuugggaaggaugcagcucgggguuuuuggagccuuuuccaugucuguuucugcgguugugcuaaugugcuaauguuuaucaaggucacauguuucucuccuuucuuugcugcugacagaggagcugugcaaaaucaggaagggaauucuccuuugggcauuuguccuuacuacaaagauuuuaaccguauaugcugcuuaaaaaaauaggcuguguucugcugaauucaggauaaaaagaaagaggcaguaucucugagaaucuuaauucuuugacuuguugaaacccauccagcaaccucuuucacccagggcuccaaguuuucccacugaaccuugugcucauuuaccacagccccaugccucccugcagccaaagcuuuccaccccaccacaaccccuguccccuuccucaguuggcucccugccucuguugucaccaguuuccucucaacuaucaaaggcucugcaugcagucagacacacuuggguuuagagugugauucuucuucauccucacccugagcaagcuuuucaccacccugagccuucauuugcucuuccauggaauggauuucugccagccuuguuaggcgaauuaaaugaagugauguugaaguggacauggaagcuuuuagaacuucaugguaaucagauaucccuaaguauucaguuagaguuaaggacauaacucuggccagggaugugacuuagauauggaguguuguauauagaagucauuuguauauagggagcaccaggugaagcccagcauggauaaccuagauguguggguguguagucuucuaauccuuguauuugcuguaaguugaaagucagccuuggcuacauggggaauuccaggaauucauuugacccugucucaaacauaaaacaaaugucaaagcaaaucaaacagaaagagaaaaaguaagaguuuguuaaggaacuuuaagagaaaggaauuauaaauaugaaucuggcguaaucaaguuucugaaugguccagagcucaauucucaguucuuuucugguaggacaaauaauguguuauuaguuuguuaagcaggugcuguccgccuuacugcugggucuugcaucuacaaagcgugauguaucagauaguggaguaaaguuggccugaggcucugggucugauccuaggcugcuuuucugugaagaacagcucgagcuugaacuguaagaacuguaaaguacaucucguccuacagucaucuguucuaguuaaguuucaugucccaucacugccgaguccucaggccuacggcaucaugguuauuauuucuuuuuuuguuuguuuguuuguuuguuuucuuuuuugagacaggguuucucuguguaguccugacugucuuggaacucacuuuguagaccagguuggccucgaacucagaaaucugccugccucugccucccaagugcugggauuaaaggcgugcaccacuacacccggcaugauuauuauuucugauucaucgauaguguauauuuuaagguggaaaguaauauuguuaggucuuuguagugugaguaacuuuucucuacguuuuccucgagcugaugagugauucagguauagagucuacaaguaccauuaccuguggucaugcuuuuuccuuuuuuaaagaauuuaauuucuuaaaauuuauguguauguguguguguccauguaaauuuaugcaugcucugugcauguaggugucuaaacugagaaagccaaagaggcuagagcccaacuaggcuauaggauguuaugagcagugauguagauguugggagucaaauguagguccuuugcaugaggaguaagcagucuuaacucugagcaucucuccagccugaaugcuccgucauuuuuauugccauugaauucacagacacuucuccaguguuauuguuauagccuaguuaauuuauauauaguauacacacacacacacacacacacacacacaaauacacacacaucuuuuucccuaugcuuaccuacuguuuuaagagaaaggccaaagcauuuuuaggcaggggcuuggauugaggucuucacuaugacuuaaccaguagagugaccuuaaacaggucaguucaaucucugacucucaguguuccuugucugagaugggaaaguccuagcucaaguggggugcaccaugcguuuacuugauucuuuguaagaugcuuacauuguaaauuacuacucugucuuucugugacacucaacagaguuccaccauuagaguuuaaaauaccuccccaaaugcauuuaaagccaacggcagggcacuguggccaccuuccucuucuccuuuaugcgaccaccuaugacuucuauugcagggacugccggagugucucuguuuuucauguuuccuccuccauuauguuuuguauuaaauaauaacagcuaacauuucugagcacuuaucuuaagcuuucucauuggcuugcauauauuaacucacauaaucaauaagcagccaugaauuugagccuguuaguauucuucaucguauaaaugagggaugacagcuuagcuaccaucuucccaugugauacgguccaggaagaucccucucagcucugcuuauaguuuaagaacuuagccacagggggcuaauuaacuggcuaauuaauuuucuuacaacaugcaaaacaggucuaggcuaaauggagccuggucagaggcuaauuuguuuucaaaggugacugcagaugaagacccugaacuucccaaucuugucuucaucccacucugguccuuugcagacacuuggccgcucagugccacuguugcuuuucuacugcucuggccugcucaggcugcagaagguagcaugucugcaucgucagcaucaagcccacucggaaaagguauucuuacuccucuuacaauuaguguuccacuuaaucaucucuuuacgagauggcacaguuaagaggccacuucaucauggccuguuucgagcaaaccagccuuuuauuuuaugacacucguaguaagacacauugaguuauaucugucuuuuccuugacaccaacacauuuauuugagcucaguauguccaaguagugugaccaagguagauuuaugaggacucauuugcauccagaacaacauuggcaaaacugaaauaucacagacacuaacuuuuggccugccacagcucacugagccuuuaucacugggccuguaacgagagggaaauauauuuuucugguguuuacagcuaauuccuuguugccauuccacuguugucguugcuguugagagcuggaaaugagguuuaagagccucuucauagcuaacagcaggagcuuaugugugaggaacagaaaaaugaagcuucccacuuccaccccauccuggauuuaaagaacucugucacaguuaaaggacucaagcucuuuauuuucccaacaaguuagaccugacuuaguugagucaguaccuggauuugaugacuccuuuucaugcuuauucuuagaguagauugguuuucauugcuucuagcccaccacucaaagauaggggaagaaaagaugguaaauaggacaaggggauguggaccuauguagaaguaguuccuugggggugauuccaaucucuguugucaggacgucagcacaguacucuucaguagugucaggauaccaaacacaaaucagcagugauggcaggauccagcagaaacagcuaggcuuccucugaaucagcacaagucagcucgagcgacuagaaccagcuggggugacagacaccuacuucucaggacccagagccguaagcaucugcggauuguuaucucagcucaaaaaugggccauggcauuuaacaaccuggaccaacccugcagaagccugacugugauuuccuguuuaugaccuccauguggauagaaaacaaacaaacaaacaaacaaacaaacaaaccccagccagaugauugauacuaggcucuuucuuauauaucuauuuguauauacagaacacugcuuuauguguguacaugucugaaauaaaaugauauucuacugaguguugagugugccugaucuagucagagucuauuuuucuguauugcugguuuucuuuaguaguggcaguuucucuuugcaauaggccauggagaauaaucuguguuagcaugcucagauauaauaggcuagaaauaacuauaaugauuauucccaaauacucaguaguugauauaucaaagacuuacuucuuauugucugauuuuuaggcaagguggcauaaggacugcugucuuccuuagaguagcucgauccaggcgacuuuuguucuuuuguuuuaucaucuccacuucuggcuucugaguuacuauaagcaacaaagaguucuggagugccaugcaugguuuugaaaguguuggcauacuugauacaugcaggggaacaugugaauacuggugguccugugaggucacugaugguuuauaugguuccugaacggguguuuccucucuuguaauggcauguuguaccacuggaccuauaauacauugaaaacaucagguucuuaacacacaagcuugagaaccugagucugguccucagaacccaugaaaaaaaacguggguguggcggggcccacuugugagccucgugauagggagguagugacagcagagcccugccagcucaccuauauguguuggugaguuuaggccaguucagcggagcucccgaacgagguggacuguucccgaacagugucacgcagaucuccacaaagcacacacaacuguacccaugaugaccacacgugagccaaaaucccuugccuagggaagcgcaccaugagcacccuuauaauauugaucaucuuacaguuggguagauuggccuacacaaagcucauuucauaauaauguaccgaguagcucauuuaguuuguggaaugcuacauagaagggggaaauuagaauaguuggggguugugguggaggcguguucccuccauuauacaguugacagaguuaggugaagccauugugaguugggaccagcugcuauuugaucaugucaugacuuuggcagccacucuucuauuugauggcauuuggaucauuuucaguacuccacuuuauuaugaagaacaauacacaggcauaucuuauguguaucucaggugcaugcuauaguaguauaaucauaaaaauagacuuuccagggaaaaaauauagauuguuuuccuuuuuacaaaugaaauuaaguguuucagaaauauaacuaaaugugauuucgaggcacgcuucauuauguagacaaaguuggcuucaguccuaaggcccguccaccuuagccucucaggugauagaauuccagguacguuccaaugggaauggcuacuaagcuguccuugaagguguugguaccacugguuuguguggauaggcagaguacaaaaggcauuauaucacugugauuugcacaaugacagaucaccccccuccaauagcgucuucauuacuucuggccaagaggcauuucuuauaauauguugacucucuaauuucuagcuuuguacuaugacaaaggaucuuucuaauguucucaugugccgcauuccagagugaugccuacucugggcaaagucaagcugaugaugccacauugagggcuuguagcucacagauucugccuccagggggcgccuggcacagugacaucccuuuauuuguucccuuccucuguggugcucuuucagcugucucugcacuuugacuuugaaaccacagggugaagaugcucucucagaccugucauucuuuagacagaguagcugucuaauuuugggcugugaauuuuccugugcauuuuugccugcuuagucauugucuuuguaucucuugguucucucuggccuucucauuuuccuccucugccucugcccccacguccccaaaggcccugaaaucuuuauguguuauuuuucuuuuaagucauauuuccucuccuccuucagcauaaacaugcuugcucugucaaagaaaagcaaaaggauagagcaaugggaaggccauugcacaagucuccaggaagcugcgccaagucccugcacacuccagcugguuggggaauggaacacaguucuuaagguagucugucuguuaaacuuuugugcacaaaaaggacagaaaauaaaaauuaguccagauuuuagacaaccccugguucuauccaugauccugggcaaggcacuuccucuccucaagguuucugacuguaaaggaggaagauagaucccagaggaccuuugcaccuuggaaccucacaaggugagagaagaugccuggcaguuccucagcacaggaucagauggccucuguagugagucagugcacccacuucuccuucacucugggagcgccaugucagggcuccacaaggccaugcacagucuaucgggucagucgggucagucaccguuggucacaaggggcaaaacucaguuauaaagguuacuagaauugguggaaggcagaggggcaggggagguuaccagacugaguucuuggagaugaacaagucaagacuagcaugaaucauggcaggaggaggggguaggcugguagaaggcagggagguccuagagcuuccgaggagaaacaguccugauggagaugcugccccaugcggaaagagaagucagggccuuggcgucgucuuuccacugaucuccaaacaaagucucaaagucaagcguuuugcagaggaucagagggcacaaaggcaaaaucaggaagcguccuuguccauucuguuuguuucuuuguauagcucuggcuguccugaagcucacucuguagaucaggcuguccucaaacucagagaucugcaugccucugccugccaagagcugagauuaaaggcgugcgccaccacugccuggucccacauuacuucuuguaguuaaaaaacuaaacaggagacucuagaaauaauuuacagaguuuaaauaaccaauuuuaacaugauuguaauccuauuuuauuguuuauuuuucccuguuuuauuuuaauaugguaaauuaaauuuuaccauagguaaguauagauaggaaagcagaguauaugggcuuaguaucaucuucaguuucaggaauccuccuaaauuucaaaccguauuuucuagacagcauccucugugaauuagaggagagucugugguaacugggagaaacaagagaaggcccuaaguuuagugaccugugaacuuccuuuugucauuugcauuccagaguuggugggacacuugaggaccuugcuagcuucugcacugaagauacuguuguaggccuuagguuuuaacauguagcucuuccuaccauucuuguauuucucaggauaacucucccuucccaccuccuccuucccacagccaacauuucaugcagguucuauucccgguaaaccuucauucagucuuuugaagaggaaagugucuuguucaucuguaucacugagggaccgcuggaaacaugggccagcacauaaacacagggaagcagccaugcuagcugaucggcaacuauagucacagaggcuuucaguuccgccucugaugccugugauguuaacccagugacuuacccggcugcugggauuuucuuaucugcaagacgguucuauaaaacacaagcuucuuaggcucuggucuaggugaguuuggucugcaguaauaaugaccccagaucacagugucuaacguccacagagguuuacucuuuauuacacguuuguccugagccacuucuaggcgucucucuuucaaacuuguggcugauagacugucguuuauuuugaaugcuguuguuccucuuguggagggagugggggaagaacaaaaaccaaguugagguggugaguaguaaucuaauguuugcuuggcucugucacauauaauauggcacguguucagggcuuacuggcuggaguuaguggcauggcaucuccuaauuucaacaaaaggaagaaggcugagcauaucauggguuugcacuaauugacagcauggggaaucuaauacuugacuucaugauggcuucagccgucagaucacacgcgcacauggugaaaugucuaguacaauacagcacucgacaauagcagagcaauuaauagaaaugguuacuauuauuuauagcauacuguucaccauucauuuucuuagcaaacuucuuaccccuaaaagugcagaaauagacaaagugguucuugcauugacuuagcagaaggaucauauacucacacucaugaauacauaucuacauacaugcauacacguauguauauaacauguguugguagauguauggguaugcaugcauguguaaguguguguguguuccacaggacaaccucagguguuguucuuuugguaccauaugccugauuuacuuauuuauuuauuuauuuauuuauuuauuuauuuauuuauuugagacaggcuuucucauugaucuggaacuugccaaguagacuagacuggaugacuggcaacugaguuuuugccuauguucaccucugagauuauuaaacauaugcuaccuugccuagcuuuacaugagcucugggauugaacucaggucuucaauguacacaagcgccuaagccaccucuugcgcccagcacaagcuguuaagaaguggagaugacuuagagaaguuaaauguagucagugacccugucuuccaaguuuuugguugagcacagucaucugaugcuucuguaagaggguuacuuugugcagugauagacggggcguuagcacaggccuugcaagucugcccacugucuugguuuucaauuuaaaagcaagcgacuuuaagcuggcauucauuugggucaauguagaagcagucaauauguauuauaugucuuugaugcuggucucuggaucaauugcaauuaguuugcagcagauugcauuaacauaucugaaauuaauacggccaguagucuaaugaaaaggaauugaccgugaccacacaguggcuguuuuuaguuucucucaaaugugcuuuucaaacuguacuuuuucuucuuuaguuaauggcuuuaaauugguaugucagcauaggccuaaucuauugauccuucccauuugccuuuuaaaagcagucccugauaaugacagguguguaacauuuaauguuuucuuuccuuagauggcuuuuacuaaauaacuuaaacucauguuuuucuuggaaucuuguguggaaugcaauagacuauuaaggccuugaguguguucacuuaucaaauuuguguuguuacuaauguuucauuaagacuuagaaagucagaaguaagacuauaaaguauuaaaaagcagaugguaugagcauuguuuguccugcauuuauccaaguauuauuaauuuuaaagagagguuauaauccauuugaauauuaacauuguaagcaauauaaaauaauuauauuaauauauagccuauauuaauacauguagaagggugggaggagcgaucuucagacuugaucaugucaaagcuugaauacuuuacaaguguucauguacaugaauuauguuuguuucaaguccuaagggauggcugugaccuuuuuaguuuagagguaggcacuuucuggaacuggaacauuccuugaaacaaaaggugggguuuauuccuuuggaguuacuuuugauauuuucuaccugacaaguaagacauccuuuuaaggaugucagaaaguuuagaacacacuacccuugaguagaagcucaucucuaugaggguccaucagggguacccaacuuuuuggcauuguggugagacaccauguuccacaaauguguuggagcauauuuauaacuauucugggguacacguggucagugagucucagugggacauaccuaugagccucagaggauccccguuagagaguucauccuaguuuggaggcuacaggagaugacauuuuaaggacccuucagagauucugaaagugacugaagcagcuucaaugacuuucccucacuuuugaaagugaucgaaucacagcccucaggcccucagaguguggucagucugacauugccuugcacagucauggagaccacuguagaagcuaguaggguauggauagcagguuauuuuuuuacucugccagcuuugaaaucuagcuaugauuaaauauuuaauuuguguuaauggauaaucaucucuuguaaguuccuuuacauuaugacucauggauguaaacauaaccaaauguauuccuuuuucauugaaaaugagauuuauaguuuugguaggauaugcuguugauauuacuggauaaaauacaaaaguaauuuacuggguugucaucuuguucuuuauauucuuuugacauaaauuaaaaaguaauugauagcgcauuuugaaaaaaaaaccccacuuguauuggcauuuuuuuuuuuuuuuuuuuuuuuuuuuuccauuuuuuauuagguauuuagcucauuuacauuuccaaugcuauaccaaaagacccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuagucuccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuaucuugugaaauaguuugugcagaauuggaguuagaucuucuuugaaugucugauagaacucugcacuaaacccgucugguccugggcuuuuuuuggcugggagacuauuaauaacuguuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugauaguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguuauuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggaagguggccggcugaccccggcccacacagggugcugccucagcgccucugugccucugccuguuccagaagcugucagguucucuggcgcacccucucaccuguucagacuaauuuccuaaguucggcgggucucggaccaagauggcgaccgcugcugcuguggcuuaggccgccuccccagccgggcgggcaccuguccuccgguuuggaagguggccggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcugcuguggcuuaggucgccuccccagccgggcgggcaccuguccuccgguccggaagguggccggcuguccccggcccacacagggugcugccucagcgccucugugccucugccuguuccagaagcugucagguucucuggcgcacccucucaccuguucagacuaauuuccuaaguucggcgggucucggaccaagauggcgaccgcugcugcuguggcuuaggccgccuccccagccgggccuuguauuggcaucuuaagcaagcugacauaauauccgacugcggcugaaugguagugugguaaugagcacucucagguaagagugcucaguauuggcacgugagugagaucucaucauucaaaacaccuaucuaggcaccacuagaaacuaaaauuaagaagagauucgggagccggaaagauugcucaggcauuaagagcaugcacuacucuggcagaugacccgaguucaguucccagcauccauaccacguggcucacagaccugucuguaacuuccaugugucugacccccuuugacucccacaggcaccagcacacauuuggugcacagaaacuuacacaagcucacauacauacagauuuacaaaaaauuugaaagaggaaaagaaagaagugaauuagucuguggcuccaugaccugcuggaguuaaacuuccuucuccuaccauuuucaguccugagucugacugaugguuuguauugcuuguuaagacaaugcuaagagcuuuccguguuugcaccuggugacugaagggaggcagagcuguguguguggaccuuuaucauuucuccaaaguaaccccugaucugaaaguacuucccagcucacggaaagccacguacccagugacagucccaugaucuucgcccgccuacuuccucugaugugagcaucugacacaagccuagaacaauaugaaaaccagaaacucacacagaugguuucucugugccuaagcuauugaacuuacucuguuuuuaccaucuugaggguuaaaaugaacaucuacuaagaguuuuacugugacaguuaaacuuuauuuauuuaguuuuugcauuuauaacauaauuacauuauuuuccccuuccuuuuccuuccaaacccuuccguaaccccuccuugcucuuuuucuaauccauggcugcuucucucagcaauagugcuguuauauacauauaugcauauauauuccuaacuauaaccugcuuauuagucuauauaguguuacuuguauauauauuuucagggcugaccauugaguauuggauauccaguugguguucuuaucuggggaagacuauuucucuagugcucagcauuccuuaauugccaguaguucuuuguguaggucucuugggcuuucuccuguccacaauagcgugucaauuguugcuauucuuguucugcccuuguuuaggagguccuguuggugagacuuauugggugggggguguagcuucugauauugcuagaagacaagacaucuuagcaaauucccugauccuuugggacugguuuuuuuuuuuuuuuuuggcuuucuucugcaauaauuccuaaaccuuaggugaggggguuguuuuauaaaaaaaaaaaaauccuuugggacugggcuucacaaccaguuuugauugguugugguuuucuguggaggucugcuugcaaaaagacguuucucccugaccauacauaagcauuuaagauguagucggggauuacacugguuuaguaagggugguuguaaauucuccuccaagauccaugauuuugcuagccauagauaguuggugagguuucuagaccuaaacaugauuucccucuuguugagcaagucuuaccuauagucagaggacuguugguuauugccagagccuacugcacccucaggguuauugugccauguugguuguugugguucauuggugucauaagccagggaagacugcuguuugcuuucuuccuguggaaccuuccgugguuccuugugguaccaugaaagcuaguccccagggcggaggccucaggucagcuccagcucagggguuccggggcuuuuuaucugaagugcacgguguccccagcaguagggauuuauuuaucauccaugucuggggccaaccaagggcaauagcaagagccuguaauguuuucagagucucuuggucaacccugaccagcaacuuaaaaggggccuucuuaugcuagguguagggguuuuguuagauguaggggccuuuggcucuaggaggcaacaucaucagcccaaaaugagagaauuucacuuaaagguauauuuauaauacagacuuauauguauuauaauuuucuuagguagauacuuaauaguaugaaaauguaaugugggaaucacauuaugacauuuaaaaaaauuuuuaucccuuauuaccuucucuugccccucccucucccagugaauuuucucaucuuccaagccuaguaccucuucuguuuccauaccacuccccaacucuguccaucaaucugucagucucucuuucuguacuuuuuuuuuuuuuuuuugacauuuuugaucgaaaaagccucauggcagguuuauuuagauugucucuacgcugaguguugcucauugcugguggauaguaccuguaagacgacaguguucuucuuccuguuauuaaguguccucuccucucucccuaggccggucacuuaaccccccgaagauggcugaaccugcaggaguaccagagcaagaagcucaugucagagcacggagugagagugcagagguucuuuguugccaacacugcuaaagaggcucuggaggcagccaagagauugaguaaguuguuccagggggugagcacugacugccaucagugaagacaggacagggcuucccauuucugucuuuguaucuuaccuggguuaucuuaccuggguuaucuuaccuggguuaucuuaccuggguuaucuuaccuggguuaucuuaccuggguuaucuuaccugggugggaauuuugaauugcaaaagcagaagaguacuuaaauuaggaaaacgugauucuuucucuugagauaguagcacauggggucggucaccuuguggaaauuucucucaaguuuuucuuugugcccucuucuaucaacuauagcuuagugguggaaagagauagggcagguagauuggacaugagaguggcauccuucuagaaaccccuuaaaagcuggaaugagugguuggaagagcacgggguaggcaggcggcaacguuagauuuguuagguaguccauguuggccuucgacucguaauucuccuacugaggcugagugcugacaucacagaugugugcugguggagccugggcaagagcagcguuucaaagcccaacucuuuuguccucccaugaccaguucuaacugucuaugaaguccucuucauuucugucucucugauucauuagcuauagagcaaagcuguguuucccacccaucauugucuucagggccuuauucauuguagucaugacaggucucagcuguaccucuagcugaugguggagaaucagauccugccaucuucuuuccaguguaauauuuuaaagauccucuuauuguuacuuaaauuaucuaguauaaauaaaauggaaaccacauaguauauuuaaaaucuauaguagucuuugaaaagaaagaaaguaauagguaaaauuaauuuugauaauacauuauauguaauauacccagucgguugcauuuuaucaugagacuaauauuaauaaguuaucaguauuuuucuccuauuucuuuucuuucuuucguuucccuguuuuuguuuuguuuugguuuuuguuuguuuaagauaguuuauguagcccaggcuggccuuaaagucauucuguugcugacgaugaucuugaacuuguuccugucugccucccgagugggaggauuauaggcuuguagcauuaucucuggcucaugugcuccaggacucaaacccaggaccgcgggcaucauguaggugagaauucuaacaaaugagguauccauaggacugaagucucacaaaucuuguucuuaucuuauacuauaacacgcucauuucacaugagucucacgucagacguucagcagauacugugucagcugggcuaucugggacaguguaguucuggacacuagaaggauuugaauguaccuacagccuuagggcucaguuuuuuccugcuagucuuggagaagcacccuacugugcucuguaacccaguaaaggaugauucccuagacuuauccaaaagggacaaguuuuguuuuagggguuugaaaaugagaacaaaaaaguaaagugaaguuggucuuagcuuuuccuuggcccauuuuucaaggccgaggcagaguccugguguugaggcagcagcucauucagugagcaagcagacaagcaagcaggcagguucacacucagagagcagcucauucagugagcaagcagacaagcaagcgggcagguucacacucagagaguaguugcucuagacugagggagcaucuaguuucugauguuggauucuguugauccgagaggaaauugaugacauuuaaaaggagaugcugaaauuguagguuuaaaauggaacaaacugauagugagugugaaaggaggugucugugucauugucacugggauugucuacagacagccaaggaaaagaaucuggccgaacuccacagugcuccuguucucaccacugcagagugacaggagccacaagaacacucuuaccaaauauguuugaggguaagauuaaagcugugaagauguaugucuuccugauggugcugagauuuuauauaugaaugagagagagagagaggcugggcuauaaaaccuuaagaggucuacuuugccuucucagguuuugacuccucaagauuuacaacuuuucaaaauggccccaccaguuguggucuucaugaaccuauggguacuacuuuauauuuuagcuacaauggacauuuugaaguaaaaugauauauuauuaaaguuuuugaaaaugugccuugauauuagguauaccuauguuccaguguagucccugcaucccccuuccuacaucucuuucuuucaugguaucugaacccauauacccggucgucuggaucugccauguuuguaacucucuuggaccaaacagaaugcuaccucucagcucccaaacguucucauugcuccacaucuucugugguccucuuuuguauuuagucaguuaccaaaucuugucaauaauuagcuuagcauuuuuacuuuauugacagagaagcaggcaauguaagguuaaaacacuugucaacauugugaaguuaauaaucaacauagacgggauuugcccccagcucuguuagauuagauacugccccucaugccuuuuccucauggcugacucuuggugaugcucuagggagaugguuugugugcgucagcauguuuaagauggaaaaugcguauuaauaaaauuagaagguuguauuaaaacuugauauagaaggaucuuagaugcaguuuauaagaccuguaauuuguggauauuaaugauucauuuuguuguuucucuuugggcaacagaacauuuugcugucugguuguagaagcuuguuaaacuugaacauuuguuaaaguggucaaugcuaaacuauuguuucuggaauacaauuuauaguuauaagauuuugaacaagauccucauugccuugcauugaaaacagguuuaugccuaacugaagagaauaaguuuggcuugguaaauuaagcuuuuaccauaugagcaguucacuuaugcagaaguuuacaagagcaucugaguaugcucuaaagaaggaccgauugggcuggagagauggcccagcggcuacagcugcauccacgccucauccaccugacuuugauuccugggaccaaugcuagaaguagagaacugauugcgugcgugcacacacacacacacacacacacacacacacacacacaauaaauaucucuaggagccuuaauaaggcauaucaaugcgugcuuucuuuucauuuggacuauggaauucagagguggugagagcaaacccacugugcacaggacugguguguacacugcccuuuaguucucuaagcugcacggaggauguugguauaacucagaagugcugugauauaaacacagauaaaacauggggcacugccacucaaucuucagaaucucuacaauuuguuccuuauugucuucacauugacugaggcucuuggcauuucauuaagcaggaaaaaguauauaugaaaaccuccaguuuuuuuuuuuuuuuuuuuuuuuuuuaaacucaggaaggagaauuaaauggagaaauuaaucuucucugagcuagcgacauccaucugagaugcagaugggagcucucacugguaucggcuagcuugggcugcuuucagcuagagcauguuuccauucaucaauauaagaacuuaacucuguuuuauauaauuacauccugaagccuggcaaauuacucgccauuaaggaauuguacuuccugucuuaagggagcugcuccccacugacacugaguggcagcugcuguugauccugagacaguuaaacacagcagccuccggaacuauugaggcuuugccaugcgcgguugaggucuuccuuuguacugagcggaucuuugucuuacagugacagucaaggcuagcuuugaucucugugaaguaaauacucauuuuagcagccucucaugagucucaggaucagcaaugcaaugauauaauuugaguccccuggguguguguuccccugaaguucaagaaggucugcuuuccagagcuagcagugcuggugccagaaugaaaguucuugggcugagucuaaugucuuucugccugccaguggccucuuuggugcuuuuaccauuucugaaccugauucucuggccuugaugaguacgugagcuuccuaauacuguuuuuuuuuguuuguuagugguguuguuuuguuuuugucuuuuuuauuuuguugcgagugccucuguguguauauguguguguguguguguguguguguguguguacguguacaugugauuauuucauguggagcaccuuuucuuuugacgcccuucccuccuuuccucuaccccuuuguguagcuuagucuugcacuugggcucugacuacugcuaggccagccuuguaaugaaggaucuacauccacaucccacagaguuaccuucugguuggugcuaguaagccuggcuuguccagaugaaaagcacucaacauagguccuggacauggagguucaccauagcaguguugugcugcaggaaguuaccaccuaugcaagcuaugcacggguuccuaagaguaucugaguugacauuaauaguuggccuaacuguauuccuggaaauaauuccauucaucagccuuuaaugacauuucccauuauauguauuuuagcagagaaaucgcucucuucuaaaauguucuuucucuuuuuucugguucuucaaauaugaaugggcuucuccuuggaagaccucagggcaggguuauccuuucaguaacugucuugugucccugaacagaagcaacaggagagcuguggagucagggccuccagggccucaggcaggcucugggaggcaggccgaggggacugacuguacuuggagcuucgguucagucuccuuagaaacggugugaacaugcuuuggaaaccugagcuggcguucggcagugugagaauacaacacuuuggaagccacaaagauucaaccuucuggcccagaccacaugccuggcauccugucaaaugugcgacuccauuguuucaugcagucuucacuuaaaccaaaggaaacgaaucagauuucuguguguccuuccgugugucucuauuaugugccuuucguggagucagguaucaacuuguuuuuaaaaccugcucauugccagugaacaggagaguuguguuccacacagccucaucucccagggccucaucuuccagaacuuugcuauacauuauuuacucugcucugucuuaguucauuugugggcuguacucgugaguguucgcugagugucuuagacaguugaaauugcagaaaacgugcuuggaggaaauggcccagggcucguguuguaggaccucucuguggauguuaggacuuuuaaaaagaaacuuuaaacacauaaaccucuaguaauuuucaagauguuuaaauacauacagcucuaauaauuuucacgauguuuuaaucuuggaaaacccagaaaaguaaaaagcaacaucaaaacuaaaaauuuuuuuuaaaaagaaaacuaaaaaucuucuuuuauuccauuauccaaggggaaccuguauuaacauuaauauuuccuuucauauuuucauguuaauauauuuuuucuuuccuucauuauuugauuguaucuauaugauuaaauaguauaauugcaagguaaugaauuugcuuauaaauuuagaaaacagugaacauuuuaaaaaaucugcaugcuuaucacuuaaauaguauuuuuuucuuaaaaguauuauuuuuauuauugcauaguguccgcauugaccaucauauuucaugcugugaaucuuuuguccuauugucauaucgguggaagauucguuagcauucccuagcccaguuuagcucagauaagaaugauccccacgugggaauccccacgcggcgaucuuauucagccccagcgacuuucacucccuuuauccucucacucugcccccuucaacaagugcuuccagagaugaccuggcaaacuugccguggcagccacugagggaggaaaggcauggcgagcugccaggggagaucugcuuggacuaccugccuuaccucaccuaaucccauugucugagacuggcuggcuccgggcuguguagaccaggcugguauggaguucacaaauaucugcuuuccuuugcugccugagugcugggauuaaagaugugcaccaccacagcuggcccaguauuuagacuuaaccuuuuucuuuuucuacuccuuuucucuccuuuccccuccccuccccuuucucuuccucuucuuucucuuccucauccuccuccuaguauugcauuuguuuauuuauuuguguguguguguguguguguguguguguguguguguguaaaagccauagcacuuauguggugaucagagggcaucuugcaggagugggcccuccauucaccaugugggcucuggguguccaaucauaagccaucaggguuauaggcaagcaccuuucccucuuuggccccaguauuuagacccaugagagaaccuuuggucuuugauuggaggcugaugugauaaugggccacaucaucaggaugcucaucccccucuacuuugcugguuauuuucagcauacaguuugcuuggcuguaaaguugugacuaauauguaccuaacagcugauuuagauuuaggaagaaagaaggaaagccuagugcaugccuuguagaugagagacucacuaaguucccuuuucucuucagagugaacaaaaccagugcuuugagcuuucaucagaagaauaaaauagcuauuaacaaugccaauagcauauaaaaaauaaaauuucucagugcuuuugugauagcagcuaaguguuaaacucaauuuauuuacauucucagaugacuugauauugaauauauuauuacucauauuuugcuaguugguauuuucuaggaagauggugguauaugaaguccaaagcugcauaauuuuuaaagaaaaugaaaaucacauugcaacagaauaaauauuaccaaaagaauuaugcuuuuaagaugcugugccauucuccaaggugguuauuauagacacugacaguguuuagcaugcucauaaauagcacuaacucuccaccugcauuuucuagguuaucuacaaaauauagaaacucuggaaauaaauuagaagcuuuaaagggaugauaccgcuucaucuaccuuagaaugaaaauugauguguaaacagccagccucaauuauguauuuuuuucuucauucaguguagaauaaacuaagacauuugggagccuguuauuucucucaaauuaaaugugaacccaguauugcaauuuuucuuuucucuuuagccuuuugagugaauguaauaguuacugcuguaugaggaaaaggaaacagauggggcguagcuaacauccaaauaacacuagaaguauuuuauaugcaaaauuggaacuucucagugucuucagcugcuguguguggaagaaaaagaagcagcuguaaauacauacauaauuucugucaguaacuucaccagcaucauacacaggugaaaacaucuagauucuuuuuggacacucgcucagacuuucuuuuuccccuucuguggaugcaguuuacagucacuguuggcauacaggacaggguugcaggguggcagggugccuuucacaacccaucacccuuuugcuccuucccauguccccugugugucccugucuugucaucuuuguucauaguuguucucuacagugcgacuacuugucuuuuucuuccauccuuuuuauuaaaaauauguauuuuucucacauaauauguuuugauuacaguuuccccucccuuuauuccucccaauuccucccaccuccccuuccauccagauccauccuugucucucauaagaaaacaagcagguuuuuagguauaguaguaaaguauaauaagauaaaaacuaacacaucagaauaggacaaaacacacagaaggaaaagaacccaagaaaaagcacaagaaacagaugcagacccagagacucacucguucacauacuuagaagucccauaaaaaacaccccacauaacugggaguuauauaugcagaggaccucuaggguaaagguagagaaaaaaaaaucucaauauauuaauaaaguaaaauuaaaaaucaaaauuaagauagaauaaaaaguaaaaaaaggaaaacccuguggcagccuucaaaggugccauugagucuguguucugguggccauucgcugcuggcauguuuuguuugcuugguguggugauuuaauucagcauggcucccauagacuuauagauuugcaugcuuggucaccgggaaguggguggcauuauuaggagauguggccuuguugcuuuguugaaggaagugugucacugagagcagaccuugagguuucagaaguucaagccaggcccaguaucuuucucucuuccugcugccugucaauccagauguaaaacucucucagcuaccucuccaggacaggguccaccuaugugucaccuuaacggaguaaagcucuaaacuguaagccagcuccaaauaaauauuuccuuuauaaguguugcuguggccauggugucucuucgcaacaguagaacauugaccaagacacuagugagagucccucgaagcaaacaagcuucauuugcaaugguuaugaauuagcucuggguuagggggcggggcauaugcccgcuuguucuuucagcucuaggaccccaucugguacagaccuguguaggcccuguucauggagccucaugaguuuguacgugcauugaucuuguucauuuagagggucuuguuucuuugauguccuccauccucucuggcucuuaugcucuuuaugucuucucuugggcaggguucccugugcccugaggggagggauuuaauggagauacuuuguuuagggcuugaguguucuaaggucuuucugcauguuaucugacgaugagucucuauguuuugucccaucuguugcaggaggaaaugucucuaaugauaacugagcaaggcacugaucuaugaauauagcacaauaucauuaggagucuuuuaauugcuauauguuuuuaaacaauuguaguauuugguuuucccuuaggucccugggcuuuuuagucucagauucuuggucacccacagagauauuugcucaaccauguucuuuguugcuuuauuuauaguagcuagaaaauuuaagccaccuagaugucucucagcagauaaauagauaaagaaaaugugguccauuuacacaaaagucuauuacucagcuguuaaaaaaaaucaugaaauacagagauaaauggaugaacuagaaaaaaaaaucauccuaagugaggcagugcauauccagaaagacaaacauggaaugaauccucuuauauguagauauuagcugucacgucagugacacuauaaucaguaagaagggacuuggggaagugggguggggcaugugacacacagauagauaucccuaaaaaggaaauagaugguuauagacagaugaggggaaauugaaagggaggaucgaguggagagcggaaggagagagaagaaugaggggggaaauucagggggaaccagcuaaaauuaaggaccauucgagagguaguaugaaaaacuaauacaauagaagcuucguaaguauguguguguguguguguguguguguguguguguguguguguuaucuacagaaaagauaaaauaggaucuaaaugaagucgcccaauaaggagggagacuggacguggcuuuuuaucaaaugaagcuuccaguaugaggguuggguugauuuaauugaguuguugaaagggguucccaugaaacaacccaggcuguugccaagacuauuaguugcucuccccaaacagacagcaaggcccuauugcugaagguaacacgucccacaacucucuaaacauggagaaguugagcugguaucuacaguaauccuucaccucuauauucuagguaugggaaggugaucugaugcuaccaaaggagaaauguaagcauuaacccagcucuaccccuguugguugauuugcaaugguguucugucugcaaaaucugcuagugcaguagugggaguaaccugcaacugucugaucugacuuaagguccauucuaugggauagacgcagugcuugggcagugguugggggcagugugacuucuuucacauugaggaggacccugguuugcccugauuucucuuuugagacaguuucuccauccuucuuuguuuagccucgacuguuauucuccugccucuaaucccugagugcugagauuacagguguauaccaccacacucagagcuaaggagucuucuuaugaaggaacaugauagcuuaaauaguaacccauugguucacaaaguguuuaaaugaggguugaagaaaaugaaaauaaguggaugggugaaggcuugcuuuguuucagggcugagaccauuccauucaucucuguuucucauccucuuacuuugaggcaggaccugaauugcagguaucuugacuguaguggagguuccaaagguaauuacugaauggaaacuuuaauuaaagagcaaagcaagcacugagccuuccaucagcaguggaaguuguggugugugucuucucuauguuauguacuuggguauguccuuaaccuuuguuuaauguggaaggcaaaaccaagggauuguuaucccuuggggcaauagugagaggggagcuuuggccugcugcuagccuuggcaggcuuuucucuagagagucuccucagaguggucuucaugucaagugccacaaaacagccuuggucacaauguagcaguuguuagaacaguugaaucugcuuaaacagcucauuagccucaucuuugugagcaccaucaguucacauuaauacaggcccuggucuacaguggcuuuuucuucuucuauuuguaaacugugcuuucaacuagggcaucuuuggaugugugcacauuucauuggaaaugugccccaaauauacucauucugagccuuuuuaaaaagucaccaaauccccugcuccuggacagggguagggagggugugugugugugugugugugugugugugugugugugugagagagagagagagagagagagagagagagagagagacagagacagagacagagacagagacagagacagacagagacagacagagagagaucugauauuagaucuccagcucugccugauuuuguuugugauaaggugggauaacaaggaaaagaugggaagacucacaccuuccauagcucuuaauucauugaacagcugcugagguuguaaggaugauggagagugugguacuucugaggcagucguaaccuaauagaggcacuguugcauggcccacaggaauacagggagaauaaaggcaugcaggaaggggugacugccccacugugacugugguggucagggaaaccuccugaaagaggugaagauggucuccuucuuggcuuuucguugaaucgaauguguuuaaugagcaggccuuguucuguccuuuaaguagagacauuggcauuucuccccuuccuguugagucucaggaaaaugauaucucaaaauaauuggcacaaaauuaauacuugcuuugagcaaagauguuaugacugcuggguuugccguuuguauguaaagcuuguuucuugguaaagagcaacugcacacugacaaaaugaagugguugucucaagaccggguauuuguaucugugcuccugaugucuuagccaagcaugccuuguuuugcuucuaugucguuuuuaaccucuuuaagcagagccccauuugacaagguugaggcuuucauuggugcaaauauaugcuagguggcagaacugugaugguugacgugcuuggagaauuuuguucuuguuuuguuuuguucuuguuuuugaagcaggguuucucuguuuagccugucuguggaacucauucuguaggccaggcaggccucaaacucagagauccacuugccucugccuccugagugcuuggauuaaaggcaucugcuaucauuacuugaccccugauguuuggagaacucaagugcuuugcuuaccucaucucgcugaagauugaauuuucguuuuugauaguaggccuugaauguagggcccaugaaugcuaagccagcguucuaccauaaacccgugucuagucuucuuacauuaaaacaaauuguaacaaguucucacaguguuacccaggcugaccuucaguuuguaauccuccugccucagccuccugaggaacugggauuacaggggaaugcccccaggccuggccucaugggaucuucaggagaccucuuggugaugugucauuauccuuaucuauaguucaaaaaagaguccucuaugaaggaggacaaacaucuuugccuaagagguucaggcauagagacauauucagaaacaggggaguaagagacagcacuguagccccuaggaugcaguauuguaccuauuaggcugcguaucaucauucaaacucaaaugggucucuuuaugcuuucuucuccccuaagaacaucacagacuugagggguucccacaaggcccuucuuuacuguuggaggucugccugaugccccaggccucccuuucugguugauuuucagucagcauuuucagggauccugguuccuuucgccuccaccaugacaacugcaaguaucacccauuaacuggcgguggagcuggcucuuuguguuucauguuccccaguauagaaacauaugugucuuggugcagggguuucuauuucaugguaguugggaauuaaaagggucuguuuugaguagugaaguaccugaaaaaggauaagagcuuacguuuuccauguagccaggauagagagucagggaguggggcucucuccuugcuucuguucggacugugcaacccaaggcuugcauuccuacaccaaggcacacaccuuccguaugcuuagugccuuugacuuuagcaaaguaguucuuacuggugggggcuucugcuggugcagucugauaaagcaaugcuauuucauugagaaagaggaauucaauugaaaaaauauggucuacuuauuugugguuacagcauuaugucccguuaacauuuucucauggauccccuguagaacuuuaaaauacaaugaucgauaaaaaguuaucuguuuauuaccuuuuuuacuuucacuucuauuuuuacucaugaaaaucuuuagaauucagaucagaagauaccagguuaagagauuuuguaacccuuggguuugauaucucuaacuucauucagaagguuugcuguugauguuuugguuuugagauagucuuccuauauagccuauauauauagucuuccuauauagccuaugccucaguucauaacuguucugcuggcuucugggguugcagguauguucuaucacacuuugcuuaagaaaggauuuuugaaugcauuaguuuaguauacaaaauuuaaucagaccagcaaaugcuuauagacuuuagggagagcugagauaguaauaaaauucagauaaagucaguaggacugagugagggaguugagggugguuucccuggggaggagauuucuaagcuaaaauagaagaugacugggaugaaggaagcaggugaaauuugucucaaauagagaugaggugcaggaggggcugaugcagugugagaaaggagaacagugagaggggcgguuugagaggagcagugggggcagggucugagaguggggagcacagagugucuaaguuucguagaaguaguuaaauucucuggguucuauuacaggagagauggagagcugccuguaguuuugauaagacccucucagauuuuucuuuuuuuaguaaagcuagcuggcagaccauuucuaagaucacggaguccauuuguuuuugcauaaauggccacucauugguagagauaggcagcuucucuugacauacaagcuacaguuuaggaccagagcugcuuuguuggccauucauccuccuuggugcugcaggcuugcuggagugcgcccuuuguagagacacggccacagugugagcgaacaagcccaggcagaaguguuucccaagugucuuccuguaucccuuuggugaaacucggucaaaggaccaggcauugcagugagaggaacuguagcauuacagggcagaguguggauccaggaagggcaaauggauugggaauggagguucaucaacccaagcacuggcccuagugaauucaauugcuuagcaguaagcauuuccugggauaugggacuuggagugaccaaacuugggaagucccagguagccauugugaaucgagaaccuuggugaagaagguggaggacuguugugucauccaagugcacaaagcuggcuuagaugauugaagucucacagaagaggacuguuugggacgugguuuggaaguagagcucaugggacuugaugcuauuugagaugugggugcaugagcaaaaccgugaaggguauguucagccauuugaauauguccuugagcaagauguaagaagacgcuguaaaguagaauuguaauuuuguaguuguuaguauaagaccauggcaguaaaaccgugcuugcaaaaucauuccacguuaugguuucaucagugugguacugaaagaauacgggaggaaugggagcagcaaauggagguuggugugcugcacgcagaccagcagagaugccaauaaauuauugcagaaaagugauuucuacuaaugaaauaaauguuccuaauaaccuagaauggcucucccacagccccugcucaacauaggaguuugaaagauccuuucccuuacgcacugggacauucaguuuccauauguugugccuugcaccacuugacacuacggaaacacauuuaccuguaaaaggucuaacugauaaaaugguagguuucugccagauuucuauccaacuacuuaaccucuuucccuguuagcagccucuuggaaauuugaccucugacuaaaaauccuuuccauuucuaggcugagagcucagauaacuuuguuaaugucuauaccuggcuuuucuaucugcauaaggagcuuggacuaauguuugcauuggagacuugcugugagcauccucuuuauaugaggucagugugugaggaucagagaggccauuuguguuacaggcucaccggauauuggaugcccuccuucuauuucuguuguaacuuagauguagacuuccuguuguccuuucuugauuuguaggccugagaacuggaaagccaguguccugguaaacuuuaaagguaaccugagauucaguuccaguauuuaauuuuugagguuuugaaauuuuuuuucuacauggguugguuuccucuacuugauaaauauaugaaaaggacuuuugaucauguaaaauggaguugcuuuucaagccuaaggcauugaaauuugccuugcuuucuacuuguucugcauggccagagccugcuuugucugugauggccuuccaucuguugucccgccccaugcccccuucuuaggucccuggcuuccuuuguaugccuuagcuucuuguguauaguuccugugcucuugacuuaguacaucuccuuucucuggguugcgaaggaagacuucggacagaugugcuggaagagcuaaacagucccuugggacuucuuauucuguucacugcaccugauuaaagaugacuaaauaugcaguaaugaguauauucugcauguuuacuggaauauaggucuguagucaaugucugaagagcggagauggcuuucuucaguaggcaggucucuacagcugcacaauaguaucuggaaguuguuguuguugcccuccuccuccuccuccucuucguccucuccucccucuccccccuccccuccuugacccuggauucagucauugucgcuguagacaacaagagagaugaaccucaugauaaaagcaaagcccagaacuuucucuuuccuuaauaucugaagucaugggcaagugagcauuuuuugauaugcaaaaaauagcagacugggccuagcucuaacacuguaggacuugagccagaagacuuuucauugagauaauuuaaaaagauaagggguuugcuuuagcucacgguuuuagaacuuucauuccauaguuagcugcuuuugucauuuccgggcaugcugugguagagcaccaugggaaaaggcuguaagagcaaaguuacuuauuuuauggugaccuggaaguagaaagaaagacaagaaggggccaggggccaagguaucacuuccagagacacauuuuuaguuacucgcuuuucuuugaguuaccguaccucugaaccuucucaucaucaccuaauaauaccauuaaauuauaauauugguggauaagucaguugcuuaggccggagccuucauguucuacuuauaccuccuaaugacuggauccaccacccgggcaccgagccuucaacacaugagcccuuuuggggaaaacuuuauaaaucuaaguauuuccaggaaaaugaaugugugugguaggacauauauaauccccucagccuuuagacuucucaccccagcaugcaaugauugugaggucaggagugagguguuagggauacaaauugaauauuguucuaguuagguuuaacuuucaacuggacacagccuucugagaagggaaucuuuauuuuauuucguuuuauauguguguauaauguaugcauguaugcaugcaugcauguauguguaugggugcuuugccugcauaugugugugugugugugugugugcugagcugucucuccuauccuaguuuuuagcuuuauaacaaagcuaagcauaggcaugcaagugaagaaacaaguagcaucccuccuuggcuuuugcuucaagguccuuuuuuuuuuuuuuggcauuuucagaaucaaacuuuaaugcuuauuuagcuuguagaauugcuuauagauuaaaauaugaccaaagcuucuuguagcacuuuggaacugugagaacuuuaucaacauguaagcuccugugauaaacaacuguaaucucccugucaccacaugaacacacaacucgcccauuuucccaauucuaugauguuuucaagguccuucuuaaguuccagcuuguguuccugaccuggcuucccugagugaauguaagccagagagaaccucuucucccccaguuugcuuuugguugugguauuugucauggcaacagaaugaaucugaacaaauauagauuugucgauuuuauucuguuauaauuacaguggucagguuagugcaaacaguuuauuucuuuaucaguguacaccuguauauacacauuuggugcuggauaauauaacuggguagguauguuuuggggagggggcuaugaaucguaguuagaaaagauagaaaauaaaugugugaaaaguuacaaaauaaugaugcaaguuuaucagagcuaugaggaaauaaaagggguggugagauagugaggggaggauaucgcgggacuaauguggagggaugcugugcugugacaugugacugugggccacucuuguaagaaaaugggaugcuugggaaaugagcauggugccuucagcacacaggguggcguucaugaaagcuaggguuaugguugguaggggaguggaaggaauucagguuguagaaauagguguaacauccccuaggucauuaggucuguaaaggggugugguuuuguucugugggaucucaucgcuuguaauggaggaauguuaacauuccugcuagaaucacuucuuacuuuaagcuauugcugguccauucaaaccuuaaucauuuuaccaauguuaaaugagcucucugaacuguuccuuaacauucccacuagaaucacuucuuacuagcaguccauucaagccuuaaucauuuuaccaguguuaaaugagcucccugaacugucucucagggagagagacaguuccccuucucuuacaggacuggagugucacaaguccauuguuacuuuaaaggcuuggugcaaguaguugcuccucacaagugguguguaaaaccuggccauauauuuaaauaucaggcaucaugucuucugaugaaaacauaggccgaagagcucugaguauaaaugcaggccugcucuugcuguugguuauuucagagcuuaggugccaaaugucuucaucuucgcaugauuuauaguaauguaaguaauguguuagagacuaacaaaucaaaaucucauuucagacgugugacacuaaugcuguguugacuuauuuuuucacguguuagauuucugauaaaauuacaggaaugcuuucuugaaaggaguaaccggaaggacgugugaggccucagauaucagcuguugauguuuucucacuaagaggagcccagcaguaagcugguaauguguuagaaguguagcagagcccgaggaugugagcacccagcagugugcaguucuggguagcagaggacuuaaagugcugggaugcuuaaaagaaaacagaggcgacuuuaguuuaaauuuauuguuaugauuguuuuuacuauuaaaggcauuuacucaauaauaaccagauguguaacagaagcgguggcaugagauuuucauuuuuaugcaucauauaagaaaucuuagacaaaagcuuauuguguuauggaaagugaaauggccuuuuguuggucugaacagcuguguggaacagaaugcuaacauccucuccugucuccugguggccaucugucuuuaaggggcugacagguaacuuacuaauuuuaagaggcuuguuuuagugaaaucuugguaaaugugcaaggaacauccauuuuggaaaauacugcagagcucugacauuuuucugaucuucuaaaggcaguuagccucuuuaagaauuucauguuuuaagcuauugguguaaucccugcccuccuggagguagaggcagggagauucgagguuauuuuucuuuacauaguaacuuugaggccaguguggcugcuguaagacucugucucaaaauguagauugcuugccuaauauccacaggccugaguuggauucccaguaccaccuaaaaucccuauauuugggaggugaagguaggagguagguggaucaggacuggcuacauaucaaaugaguuugagccagucauugacuauaugagaggucuuaaaagaaacacccccccccccaaacaacaaggaaacauaccccuccaacuccccccaccccccuuuuuucaaaaggacaaaagugcauccaaugcacgauguugcgaugugggcauuagugacaccuuucaaaaccguuucuuuuguuuugggccagauuuaguaauauuaauucuauuaguaaaauguaguuuacuuaaauuuucaucaccucagguuguuucuguugucuuccucuccuugguuuuguguguguguguguguguguguguguguacuugcugaccuagggacucacuaacuugccuaggcugcuuucagauagacucuggaaccaauagaagucuugaacuugugagcuuucuacuucagccucccuaguaguugggauugcaggccuguaagcuaguuuucaauugucuuuuuaauauaaaaguuaagcacaccaaauaagcauggaacuccuuucaaacucuguccuccuccaguccagcugucacugcacuuuccaaggguccuccuggcagccucucacacucagaagagaugugagcucuuuuucacauucauuugucacuuuuaagacuccacugaauuacccagauggaaugcagaaugagaagaaaugccacguuauuaugcugacugcagacacaaugugggaauucuuuaugauaggcccuuacucaugucuuacugcuuuauuuauuccagugugcuaagcacggcagcuuggccuuguuucucuccagguagaugagguggcuggaaauaguacuaccuguuuucauuugggaagcuuaaauguuuuuaagaugagugaucaugccgagugaauagaguuagcgucaucacuuccugcucugcuucucagucaccaggcacuaccaggaggcuuaaucauauuuagcugaguuccccagucuguaaaguaagguucacuggaguagaggagaaggaugagugagugcuguguguuugacuagauggcauuugcugaguguggcuuuucagaaguuaagacuuaauaaacuacaugcacuuuuaauuaucaucuccagugugacugagagugccagcgauggguguuaccaucagcagccacagaaaacgggaaggcccuccuccucuaagagaguacccaccccaggauaugggggccagggcgcuuuagaucacguccuguucccaccaccucccaaacuuacuuaugauucugaaauuaguuaagucggauuuugcauuugagccuaagacugucugagccucuguccccaucuaccagacaaggugucacuuucaaacuaaaauagccagaguauguucuagaauguugaacauuugagaaacucaaccaauagagcacauaaaaacaggagaucccagagacacccuuaccuucucaaaggacuccucaaggaaggaggcuucccagugucaggagcgccacagaccuugggaagggcacauuaguuggcugccuggugacugaauucguguuauuggauuuuacuacaaagauggcuuauuucuggaugcucaaaaucaaugucucauuaaucccccucuccuuccuguucucuccucugaccccucucucaucccucucacuuucuccccucccccccuuagccccuuuccuucuuacauuuccuccuuuccccuccacucucccucuuuucuuugugugugcaugcacaugugccuuugagugugucggucagaagacagucuuuggugucugucuuuaccuccuaucauuuugacaaaggaucucauuugcagcuuccuccaccagccuagauucuccucacuucaccuuccucaucccuauaaagcauuucauuugcagaaagagaauucuguuucagcaggaagagaauucuguuucacacagucuaggucauuuuagggcuuggugaguauccauugccuuucuguuguuuccugguguuggucagugguguucuagcuucuguccuguggaugugggcugggaaguuucgcucacuagcuuaaaccucaguggauauccuugaaaguuacauguagaguuucuugucuucuuuacagaaagaaaacaaacaaaacaccaaacugacuuuaaaaaaguagaagucauagguuucuuuuggagaggcuuugcaauuuauuuaacugcuugugugguuauaauaauacaggaugauuauuuauuuauugcuaauuuggguagggguugguugaaguuggcauucuugaaauauugagggaaaccuaugaugaaaauaauugcaacagggaaguccuuaugggugggagugaccccagggagaaggcagcucaucguggaggcugcaugugcacucagcucuuagaucuccgcagcuuaugucagccgcuugcagcucgagccagaugauggaguguucucguucuaaaaaauacccccugccugauaucuaagccuuagagaucauuuuuuaccaugugaucaauuuucauuaauauuccucuucuccauaacagcaaaaggaccagagaaguguugucuguccugaucauguuccuuccaaggcaaggccaggucagaugagaauuaguucagaaaagagccagaucuaaagcagugcuagccuaacccaacggguuagcacuggaaagcucuagacaggcaugggcguuaagucgucaggugucaguuaggucaguauaacaggaucaggccacagaagaggucagagugaggucaggucggaaccugggaauagaaauuggauugggcuuugugagcagucaaaugcagguauauaugccaugaguuuacaugaaagggaagaacauuuuacagacaugauauuuacuuuuugauuuuaagaaguuaaguuauauuuuuauaucacaaacuuaccuacaucagauguucauuucugugaccuguaauaaaugucacauaugcaguccuuagcauuguucagggcuagaacaguguuauucuccagggagcuccccuauggcccugcacugcuaauuaugcaucucccugucccaggugauuaugaacgcacuuuguaucuuuuuuuaaaauuuuuauuauguauuuuccucauuuacauuuccaaugcuaucccaaaagucccccauacccauccccccaauccccuacccacccacucccccuuuuuggcccuggaguuccccuguacuggggcauauaaaguuugcaaguccaaugggucucucuuuccagugauggccaacuaggccaucuuuugauacauaugcagcuagagacaagagcuccgggguacugguuaguucauaauguuguuccaccuauaggguugcagaucccuuuagcuccuuggcuacuuucucuagcuccucaauugggggcccugugauccauccaauagcugacugugagcauccacuucuguguuugcuaggccccggcauagucucacaagagacagcucuaucuggguccuuucagcaaaaucuugcuagugugugcaauggugucagcguuuggaagcugauuaugggauggauccccagauauggcagucucuagauguuccauccuuuugucacagcuccaaacauugucucuaacuccuuccauggguguuuuuuucccaauucuaagaaagggcaaaguguccacacuuuggucuucguucuucuuaaguuucaugcguuuggcaaauuguaucuuauaucuuggguauccuaaguuucugggcuaauauacacuuaucauugaguacauauugugugaguuccuuugugauuuugaacgcacuuugugucuuuacuggcuuaucuuuuuccuuuucuucuucccccccccccccccccccgcacuccucacuuccuccccuccccugcuuuuugagacagggucucacagcuuaccucaaacugucuucauacuucuaccuuccaaauggggagcauaggugaacuaccuaugcgacaggcuuuugaacaaugugaugugauguguggccagcgccuagcucuuucucuuuaguauaauaccgcugagguucauguuguuggaccuuucagucaguuguucuuuaugcuguugaguggcauucgauuguguagacagagcacauuucauucaucucccacuuggugggucuuuauguucuguauuccagugcuugugguuaaugcugcuaucaauguuuauguuugagauuuaaaaaaaaauauuguaacauuuuuuaaauugugaguuucuauuucaguuuguguaugugcuugcaguugcccacagaggccagaagacgguuuccggcagcugccacacauggguacugggaaucgagcuccugucugguagagcaguaugugcgcuuaacugaugagcugucucugccauccugaguuguucugcaggacaugccuuuauuucuuuuggguauugugguaggccaaaaaucugcucugaggacucuugcugcuggcauuacaccugugaauguguggcauuguguguugaaaaggacucugcagauacaauugagguugcuaaucaguuagccuugagacugaaagauuauccuggauuaacuaagggagccagugugauuauaggagaaaucaggaauucaaagaaguauaggaauucaaaacaaguagagcaagcaaggacucaguguacuggacugacuucaggagacacagaccucuguuccacagcucagaggaacacaaugcugcugauaauuagugagcuaagaagaggacuccgaaucccagaugagaauuaaaguccuggccaauagcuugauuuagccugugcagacuguggagcagaauaucuuaccacuuuauacuaaacuucugaccuauaagcauuaucaugcaauaagugacucugacugagugcaguugaagccaucacacuucagauaacuucuuauaacagcaaaaguaaaaaaauauagacagacccacaagaauuuagugauaaauuuccacuuuaagaagcuuuguacuauuugaguaauauuuccaaaggacccacuugguuguguugaaauuagccagugaggagccagagcagaagcagggagaccagugggcaaggugugccagguagugauguuccaaucaggguggaaucagaacggauagagguggcaugguggaaggugacacacaggaggcggugugguggaacaugaugggcauguguaaaugcacaacccaaacugagagguuucagauggaagcuaagaaaaaaguucauaauugacucaggggauaaaagaaagcugcuauaugauauuuucugcuuuaucagugcauauaauuaaccugcagagacaaccuaauuacuaauaggaguucaugggaaauugacagaagaaaccuaccauaaaugaauaaacucagaguggcuuugugggaaaauaguuguaugcauuauaguuaaagguaggguuuaggggcagagaaugccauuguacaggugcauauguaugucauacuuucugcaaaugcccuuaguaucuuuuaagcauuaaaacaacagcagcagcagcaacaacaacaacaacaacaaccaaaaaaacuuccaagugacccaagggcagacauggcucacaacaacaacaacaaccaaaaaaacuuccaagugacccaagggcagacauggcugcugaugugagaauuagcagugguuuuuacuuucuauccuggcauaaaucaguauuuagcagaggccuguccugagcucuugauccuccugcuucugcuucucugauucugcuggaaucacaggugugcaccacugcagcaggucugcaccacugcagcaggugugcacacugcagcaggugugcacugguacgccugacuguuugacuuugcuaauuugaguauuguaaguuaaaauguaguacuucagcgacuggagagauggcucugcaguuaagaacacuugaugcucuuuuagaggaccaaguuuagaucccaguacauacaucacaaggcucauaacuaauguaacuccagcccaagcugcucucuucuggccugcgugcucaucuaaccacacauggaauauacacacacggucacauaaacacacagacacacacacagacacacacacacacagacacacacacacacacacacacacacacacacacacacaguccauuauauagcccuggcuggccuagaacucccuauguagaucagucuggcggcuuugaccucagaacaucuugucucugcuuuccaaaugcugauauuaaaggcaugggcccccuuacccauccauuugugcaucugauaagcuuauguaauucuugcauauuacagacuuuauucuuaucauauugaaaccuaccagcaagcuuccuguuacuucuggaucuuuauaaucauuguucacuccuuagguucuuuaguguucacauuuccucacuggacagugcucuguuacccagaagccucucugccuuucugugcuugaguugggcaucucuuugggaugcuacuguguggucaguucacauucacaguguuuaucuucguuugcuucugcuuucuuacaugcaguuugaacuucauaaguucaaggcuuacaauugcuucucuggcauaaagaacuugucaugaggaaguucuuaguaguacugauugggucaaaucaaggaggcacaguugccacuugaguguacaccuuucucuucgaaacagcagagucucuucucucgaagaagaagaguacggugucuagagaaagccuucucaugcuuuuuacaaaagcuggaaagggaacuccucgugcugcaugaaguugugugguuacaccuggucgccacuguugggggguaaagcacauagcuauguguaaagcagauuuagucuugugccgucuuaauuugacuacauuucugaaguuugcucuugaaaugacuaccaugggaaugucugaggaaaguguuaucuagcaucuuuaugccuuaguaacacaacaccacucccaccucuuaccuacuagcacacccagcugcauuuauacacagagauguaugccugagaaccguguucccugggaaagggacuggauaggcacacauuuagaggaugaaauuuucuugagaaguugccaggcuucacugagcaaggaaccaugaaggugagaccagccuugguuucagcuccucaaacucaaccaaacagacaggucauaguuacagcaggucuugcucaggcuucccauaaguucuugcaaacaguucaauuguauuugacauuuauugggucauacuugacauuucugaguagaguaggcauuuucucuuccugacaacuuaguugugaagcugugauugacacuauaauguuaaauucaacuugcuucagaaucaggcgcgauguugaagggagagucugcucccaauguuaccugugauccauagguaauauucuuacugaaggaguagagaaaaugguuaaacaaagauggcuucugcugguuaccuggggucucaggcucucugugcugaguacgccuuuggccugccuguacgccugaggagauccccagcaaggaaagcaaaugcauccacuuuuaaauugugcuugcuuugacuucuuagcaccuuuucucauuuaaaacgcacguaugcacacauacacuccugcuuccaaacuaucaaguuuguuggagacuuuucucaaaaauaaguauagaaaagaucaguuagaguccacugaaaacacagucuuccuucucaguuuccuuuguagccuucagauaugccuuugaauggaaaaguacucauagauagccauagaauguccuuguaucauaccugcuguggaucuccauaguauucauugcguguaugugugcaugcaugcacauaugaacauauacaaaguugguaccagauauuuauuuaucuagugguguaggaugccuguacuucgccucuauuauaaccgugccucacaagccaucuuaguccacaggcucuuguucuaccuguauaaguuguacuggcuaguuuuaugucacuuugacauggcuagagucaucagaggaaguaaccucuguugagaaaauguauccuuaagauugaguuggagguaaggcuuuggggcauuuucuuaauuagugauuguugugggagggcccaaaccaucauggguggugccaucugugggcugguggucuuggauucuauaaaaaugcagaauaagcaagccauuaagcagcacccauccauggccucuguaucagcuccuggccccagguucuggugggacauggaugccugcccucacugcuuuggaugaugaacuguuguaagaaacugugaacaaaauaaacccuuuucuccccaaggugcuuuuggucauaguguuucaucacagcaauaguaacccuaacuuacacaguagugcuacaggaguugucuuaggguuucuauuccugcacagacaucaugaccaagaagcacuuggggaggaaaggguuuauucagcuuacaauuccacauugcuguucaucacugaaagacaucagaacuggaacucaagcgggucagaaagcaggagcugaugcagaggccauggagggauguucuuuacuggcuugcuuccccuggcuugcucagccugcucuuuuauagaaccggagacugccagcccagagauggucccacccacaaggggccuuucccccuugaucacuaauugagaaaauaccccacagcuggaucucauggaggcacuuccccagcugaagcgccuuucucugugauauccccagccugugucaaguugacacauaaaaccagccaguacaggaaugaacaugcugguugccaaguguuugaauggaaagucuucugauucuuauaucuucagauuguaccagugugcauuuauaagcauagccagugacucaguggcuccuaacauuaguggcuucuauacgagguuguauauuauugaucuggaguuuuuaauccaaauagccaugccauugucuagagcacuaauaauccaugugggguuuuucuauagcagugaucuucaacuuagugacugcgacuccuuuggggguugaaugacccuuuuauaggauaucagauaguuuacauuaugauccauaacaguagcaaaauuacaguuauaagguaguaacaaaaauaauccuaugguuggcucaccacagccucaggagcuguauuaaaggguugcagcauuagaaagguugagagccacugcuuacaguuuuagagaauuuuuuaagcuacuguuuauuuggagcugaggacgaagccauacacgcgcucagcauacacuugauuacugagcugcgcuccagccccauuauugaguuugcauucuuuaagagccagcuuauugcuuuauuugaacucuucuuuuaccucuaaguccacucuguaaccagccuaaggacuugggcagcuuccuuuggauuguaccuauuacccaaagcaauccgugugcugcuauaaacaauuaaaagcccaauaacacuuuuaguggaagaaguuucaauuucuuuugcuuauuaauauccccaauuccuuuguaugggcauuucccaguggcuuuuuugcuauuauuuacuauguuuuguagauuguuugguaauuucauaaacguacauaguguguccuuucuuuccuuacuaccucucauugccccuucucaguuccccacgacaccucuaagcaagaccccugucauauuuucuucuucauguauuacccuuuccuuuccuuuccuuuccuuuccuuuccuuuccuccuuccuucuucccuucaccuccuccuccucuuuuucaaccuccugaagucaguuagugcugccugauugugauauguugaucuugugugaguaaccauagcugcagugaguucaugagagcaauggucaugucguauuuagaaaacaacauuuuauauucuucccuaucuguagcuuuucuauucuuuccucucccucauuugagauggucccugagcccuggggagugauuugacauagauguaccuuuugugggugagcauauagcagcauauagcaguaacuuacucucagcaguuugacuacuuaggagucaucaugcugucucuuacccauugcagaaagaagcuucucugaccaagguugagagcagcacuaaucuauagggcuauguagaaggcaguuugccaauaugcccaguucaaaaaacaacaacaaaaccuagacucccucuagggcccaagauccuagaucauggcuucuuaccagguccacaguucuguccuauggagcaaccuucagaucucaucagaaggugauuguuugccucuauaaacuucgugccacuauuguaccagugggcacaacuugucugucagguugguacucaggguacaccaguguguaauaucuuuggugauuuuucuccuccaucagcauacacaguaccuucuggcacuauaaaagcuuauaaaguaguggguuucuauaauuguguguguguauauauaugcauauuuaugaauauauauauauguauauauguguguguguauauauuuaguuaacuggcuguuuucccucuuugcccaucuuuuuauaaauaaacaaacaaaaaauaaguguuaucauucuuguaugugauucugcuugcuuucucccgccucugucuuauacuugcaucuuuagcuagaugucuuuauguguucuucaucuucuuuuagcagauuucuaugcuguucuggagaaugcauucuuccuaagacuuguaaccuuugagaaucuguagguauuuauuuaauacuagcuaccaauuuuuguuuuauuugagaaguugguggcuauaguuuguauaaugucacugaaaacaaaagaaaaugaaauaaaacaugggugcaggacugguggucaugguuuuugcccucucucugucucuucuauguuugugacugggccagaccuguuaccuccuaaagcucuuuauuacagguaacacuaacaaaagguucauagucuaugauaaggagugaaauuucaucauuacaaaaccuuuucagauuuuacaaaguaguggagagauaaaguuucauugucucccaagaaacuccaacaaggaaaccaagaaucagugagccuuuaggaggcagagguccaggaaguggaagguacagggugggucaauaaguuuuagucagcgaguagugggaaaguuuguagaaauaacaggcucggagugaguggggaaagaugguggagugagcugcuggcgaggggacagucucaggguguaucagggccagggaaauguuggugagugguugaucuuuguuccauaggugguuugggaucuuuauuacauacagggcuggaccacgggcaaguggcaguggagggagagcuggggugugugaauaucuucaugaauggaacuuuacauuuauggcaugcgaacguuuauggaauggagauaggcauucugcgauaguuuccagauuggucauagcacucauuagcuuuaaucugagcugcacauagcagugguggaguagcaacuccuucaccguugguucuagcaaccagaagucugacacugaugccugguagcuguggccuuuauuggaaaccuuaaggggaaaaugagcucuguccccugugggaugccagccagucaaaguguuccuugcuauguggguguguaacuccuaucucugcuucuauuguuacauugugggaaucuuucugaagaucacucugacuccaaugagaucggaagagaggacaugccacugguggacucaagucaggacaguuccugaaaggucucauuccuggguccaguaugcauucucauuuuauauucuaaaaccacaaggugguggguguggacaagcaagcaagcaagcaagcaagcauguacagaacuguauauagcagucagaagguugguaagggcagaagcccauuguuucugcuguuucucuaggucuuucugucucagcuagcaaguuaagucaugcuuggcaaauagacaguguaggcaguacuucaguuaaaucacuaaagaaaucaacaaaucaguauuuaguaauuggucuuuucuaccuuauucuacuucaaugcccuugucaucccuguuucugagucucaggucacccccaucuuguuccuaugaggacacacaucauuagaguuuuaguagucuagugugaucacacccggaggucuuuagcuuagugcaaagaccauccuccaaguacagucaggugcacaagcuauagguagacauguuuuggagagcggcccuucaacccagugaagguagugauguaaguaaauagccugguaauguacagacuugguagguaagccuuggagauuauagacuacggcuagguaguccuugacuuagcuuuuauuguuaacuugauagagccucaucaucugagaggaacgcuugauugagaaguuggccuguggagaauuaccuugacugucuucguugauguaggaggccccguucaaugucccuugaccuaguuccugggcaggugauccuggggcauauaagaaagcugagcuggagccagcgagccagugagcagcaguccuccauaguuuaugcuucaguuucuugccuugaguuccggcccugacuucucucagugauggauuuuuauuuggaaguguaagccaauaaaucuuugcugcccugaggugcuucugcucaugucauuuguuauagcaagaaagcggaaacuggaacauuccugaaaggagcccauacuugucauuugcagguauagugcuauuucuuguuuuuuguuuugagauaguuuugcaagcgcagcccgggcuggccuggaacuuaccuuguuguucaggccugccacuuucauccugcucacuagguucucacgugcugggauuacaugugggcacccccaugccugguuagcagcccagcuuacagauauuccucagcaucugauucucuaauggggagacagauugugaauaagagucaggccuuggggaccaguauuuauuuagcauuacaauucaaagcaagagaccaaaccucaaucauugucugucuguuugucagucuguguguauauguuuguguaugugagcauauauacaugugugugugugugugcgcgcgcgcgauaacgucaccuugaccuauuggauaucuuugaggugucacacugaaaguaguuagaguucagcuaggauuauugccaggcaacuagaaccuuuccuaccuguugaagcaaagccagguuagagagccgccuuugagaaucccuugguuugugauuuaaugauaguaagcucaguaaaauauguucccauuucuccucccaguuuuauguguaauguguaagugauaacaccuuaagaaugauaagcgauauuacuuguuguuguggagugcagcaggcagacuaggauuauuguguaagucacguccauuuucaggguuugucccugaaaaacaaaguucuaccugcucuuggcauuaauuaaauuagguauaaaaaaguuauuucucacguaaauuaaugccacuugacauucuaaauucuucugcccuuaaauucauaauugccucauuuugccaugauuuauccauugugaacuuaggcccuguaacuuacugagaacacaguuguaaauggguuucuuaaugaggaagaaaaacauuuaguuuaaggaugaaacagcuuuauucccagcuguauuuuaauaaugaauuccacuauuccuugccuucccuauaacauaauagaacuuuuaguucuucauuuuugagcaaauuuuagaauguacugauauaaacuuuauucuuuggaaaugugauguauuagaaacucaugcgaagcucaguggaggucaugccagcuacuccuggaugcugucacagaguucuagcauguaguugccaagucugcugaagccuucuuggacaucuuccacucuggugucuuggaugggcuuccuugucucugcugagggccaagccaagcugcgcagucuacauuucaggccacucccacuaauuuuuggcagacagaccagugacagcaagcaggaaaaggcuaaagcuaugauccugugcugccuggccacucuuuucucucugaacuucccugguauggguugcacuaaacacagucagaguuauaacuggaaaguuucaucuuucauaaccaagcaaccaguucugcuggcuggugcuuccuggucaccauggcaacuuaacagguucaccucauuccuuccucugaggccgcaugcccugacuguucacugggcuuucuuagaauuucccuucaaauaaagaacuaccgugcacauucaguauaugcuuuuaguuuuaauacaagauauugugcgacauuaaaauuccauuacuuuguuuaaauucuuauuuuggguaauuagauuuuuuuaugcaucagcuuauucuugauuagaugccacucuuucuuuaccucccaaugcacacaaaaaucccuuuauguuauauuugauacauagauuacuauauauuuaguauguaauacauuuauguucucuauuauuacacagauuauaaucaaucaucuuaacccccccccccacaaaaaaaaauagaagugggaauuugaaauggcagaaauuuaaaauguuaguugaccaaaucagagcuaaaagcuaagagacaaaggaagaguaaaaaguuaguaccagccaggcagcuggugguggugcaggccauuaaucuuaguacucuggaggcacaagcagggaaaucucugaauuugaggccagccuggucuacagagugagucccaggauggccagggcuacacagaaacucccuacaaaaaccaaacaaaacccaaaacaacaaugauaaaaguuaguaccuuuuugcuucuccuccccccccccccccccccacaaccccccaacugcuuuuaccaguuucuaucagcugcugcaaggcacuuuuuacauugcaaauuuggcaguuuuccuuauucuguugcucuuaagaaaaagauaaaaggaggccaucuuucccugcccuggcccucaguuccuugggugaacagagaagagauuuuacuguuaaaacuagaaguaguugacaaagugugauguaccaguagcacuagcuuggcuguuacgugacuuccccuucuguucugaucagggaaagauaucagacagagggucuaauacagcguuuccaccgccagauuucuacuguaagcaucaaugaaauuaugugacugugugugugcucuucagcucuaacugaugaagcuagagaagaaaucgacuuccuaagcagauggggaaggcacagagcagccuucauucccaaagggagaagccaagaggaagaaaggcaguguggauaugagggaguuguaaaccuagcagagugcccauuucaagauuuuucaguuuaggaacaguccucuguguuucccugaugcucucuucucuagcccuguggaaacugaggucccguguccucagucugcugggaagcagauggacucuugaggaccugaguggcagccugccccaggaacgcuuaguggaaaaaugugaucgugucuguucaggagaacaagaaacgggaguccuguuugauggauucucaugcuuagacuuuggagucuacagauggagagucaucuacagaaauuauugucacaaucuaauagucuuuuuuuuuugugacuauuagaaggauuaugugcagagaguuuagcagccuugauacggaauauccucagggauauuuugugauuuuuguugguuucauauugucugagaaaugauuagauuaaugaaucaauaaaugagagugguaaugcacuugcuugggauuucaggaauccagagagaagguguuggcaggggacagaauugcacagcucaccagucugaugucuuucuuaaauagauuccuaauauaguuuaauugugacacucuuaggucucauuuuggaauuauuuucuagauagugcuaaauuuguuccuaaugcuuucaguauucacuguuucaaagcuugacauucugggaagaaugaguaaaaguaaauuuaaugagucagcacuuauguucaaaaaaaaaaaaaaaacaguuguagcuuuucuuuaaaaacuaaguugaaguuuuaagacagagaugacaucauuggucuuugucuugagguaucagggauuuguggacaaucagggagucuucuguuucauccuuucccuacuugccacuuugaagucucugagaaaaccugucuccucaaugcuuccuuuaggacuccuuuuguaucuccuggccccauggcuuuuucuggcaugugaacauccuugucuuuaguucauucaagaccaguggugaguuuguuugauuuguuuuuguaaauuuuaacaggaucuuaauggucagaccuuucauuauuguagucccuucuuggcaugcagcaaaagacaaaagucagaaaagauggguguccagugugucuucauuuaacauuuuggugaaauuucaucuguguaaugauuccugagagaguugaucagagcugauuaacacaagccuuuugucauuugcccaggacccuaaaaggguugucaucagcauagacauuuaguuaguuaguuuuagcuuuguaguuucaaguuaaguaucauugaauuaauuuuccagaaugacaguuuuaaaaacuauuuucacaggaacaaaaagacagauuuucuuuguauauaaauaaagaacacaguuuaugcugaggauggaagucuccuuaaauaaaacauugucucucuucuccuuggacucaacugggaaaaaucaauauuagguucuucaaaugcaaaaaagaugaaagggaaaagcugauguguuaacagggcaagguguguccuuuuccuggggcuccaguuuuccuguggguuuuaaguagucucucuucaaaucguguggauuaaaaggacacagcggauguuuacuucugugaaaguagaaacaaagucugguuccuaugcagguuguuggaggguuuccuuuuuuuuucuuuuuuucuuuuuuguccuuaaacuucugaaauuguuauuccuuauucauucugcacuuauuuugaugaaugaaaauauaauauuuacuccuuucucuuuccuuccucuaguucucccauugccuucccucuugcccugcccaaauuccccagcuuucacacugaucaccuuuuuuuuauuauuguuacacaccacacacacaugacucacgcauaaacccaaauauauaaaugcaacuugccgaguguuuuuuuugucugcuucauagaguucuuacuacagcuaccucugcaagucaggauguauauagcauaggagguugcaacuagcagguuuggaauggaguggcgggcggcauggauugccuuauuuuauuugccucugugucugcagcgccugaccugugacuggcauauggugcuugauaagugcaaccacacagcauucuguucaagcuuugacugauuucuuuaggcccaaggacuuacucauuacuucuuuuuucaaaugccacaguuugacagccugauacuuauuguuaacaacaacaaaacauggagaagaagaacagaagcagcauuagauagacugacuaccaguuagauuuuguuuaugaaauggaaaaauguucuaaggcugcagaucacagggcgugcuuuauaucaauuacuaauaucuguaucugucugucuuaccauaucaucuguagcuuucuacugaaauacuaggauuccaaguuccagcugcuuuguauggcuuggaagagagagaugauugugaccaaugccauauucccucaggcaaggauuucauucagcaugcuugucucguaugguggcugagaguuccuccucaggccauuuguucacuccuguagugacauggugaugcaguugugccuugcuuggguagcgaucuauguagguugccaaaaauagaaauuaagaucaaauauaaaccagcuccagaaagggggaaaaaaacaauucaucucaacacuguguuucuaacacacugaggguaaugcuacacggggcacacuguacaaauauggagagcagccugcuuuguuuauaaaaguaagcauguauuagauuggucagaguguaauuucuaaugagauacauuugauguuccuugaaugaaggaguaugauucucaggagguuauucuuuuauuuaccuucucuacacuuuuacagauauuaaguuggugacaggauggucaggccguuucuucuugguugccuucuacugagaguucacaugcuucagggaaagcuagagcuucagggaggccugcucagccucaguguuuccccuguacugugcccuucucauggacaugugcuggagaucaggacacgggggacauguuccugcuuuucauaguucauucuauuguaguucuucaaguaucuuuuaauguaaacaucuugacggaucacauucaagacucauccucugguggcugaagacuggaaacucagcaaagaggaacaguagagcucuucacaggucugaggccuuguucacucagagcagguagccugguucugagcacaccccacuauuguccccuuuacaggugcaguuccaaacacuucucagagacagugccugcucacucuagauggguagaaagaacagguguuucuaguaauuucucauaacauugugaaagguuuugaaaacaaauuuaaugcaauucaugauauaaaccauaacuauaaguaauagaguauaauaaauccauuugaaggcaguauaaguuauaugcauuaucacuuaaguaauaguaagcaggcagccauuuuaguaauuugauaauuaaaguauguuauauaauuuugaggaauugcgguauuaaaauaacauuuccauuaagugccugucuaccucuaacaagcccacccaccuuuuugugacucauaaucuuucagaaguagaagguaccaccucaacucagagccagacauuuaaaaucaagucauuauaaaucuucugcagccacaugaggugacagauguuguugcccccuucuuacagacaggacaaccgauauugagaaauggaugaagccugacaugcucuugaccacuaacugugauacuggcuucuuuauuacagaaaguuggagcaaugucuugccaauuaguuucuaaaucaaggaagcugggugcauuaacacaacaagauuggagcacucguacagugccugaagccucagcucauggagaggcuuuacagggauuuuacuggagccgaggugucaguggguucuguaaaguauuguauggugccucugccucccacuggccuuuacccauuuccccaguacacaugcugagggacagccuguuggauggcucaauggguaaaggagcuugcuguccaacacaguggaaggggaguucugauggcuacaaauuguuuucucaccaucucacuacuuacuacaugaauauguauacacauaaugcaugaauaaguaaauguaauuauuauuauuuuaauggugaugaauggagguaaaaaauguaaaaggaguguguccuuaauagaaaccaagccuuaaguaggagcagcuuguuggauggcagagcaacuccuuuauuacaggaaacuaggcaagugcuugguauguuaguaucuaaauguaagaaccuggacucuuaagguggacuuacagaccgagcaugaaggacuaguacaguguacauguaggacuccuuccugugaauguguauaaggaaucugucuauauuaaacaaaaaguuuguuguuuuuauugauauguauguguguguguguguguguguguguguguguagacacccauggaggccaaaagagggcaguugugaacugcccaacauagguccugagaagugaaaucagguccucuggaaaagccacucccucccuuaacccuggacccaucucucuagcccccauuuuaaacucuuggaaaccaggaaugcagggcccuaggguaaccauggugauuagaucucuuuaauguucuccauguucuuaguaugacccacugaaaagugaaaccuuccaaaccuucccguugguuuucuaggaggaggaaaguagacagaggaggcuggcgugugcaugguaauugaaaauggcugguggugaggggcgauguaggaacagcuguuuccuucugcuggaggaugaagauacacagagucucccagccuauuguuguuuacacggaaacaaccaggugaggugcugcagcugcuaaguuuugcauuuuucaccagauagaagaaguauguuuucuuuuauauuuguugggaacuugaacauuuacuucuuguagaauggcagguuuucugaauguuggcaacauuuaauugaaacaaagcaaaacaacaacaacaaaaauauuccacuuuuuugcucuuuuuguuuguugcaugggagucaguaauagugguauuuacaggcucaguugguaacgugccuguguuguaagagagaggaacuggauuugaucucuaguacccuguaacaaaaagcucuuguggugcccauaaaauuggaaugcuaguuuuugcgguggguggggaggcaggaccaagcagggccaugggacucuuugaugaguuccaggcuaguaagaguccuggucgauggugucugagaggacagcccgacccaagguuguccucuggccuucauguggcacuacacauauaugaacaugcacacacacgugcauaugcagggaagaaaagugcagagugcgggacucagcucaucguggaagcugguaaccucccuugcaccccagacgucacaguggaggcaaagagucacccugacacaguuguuacgugaccucacaggcacacaguggcguggcucccccaccaccaaguacaucauacacauacacacacgagaacacuacauuuaaacuguauagcccuuagcacuuauugacucuucuuuguuguuacaaaauuccaugcuugagaacucaagggaggaaggguugguuuauuuccucgaggaagggcuuaucuaggcuccugucuuccaguuuuuugucacugaucacuuggcuacauuguuucugggcuuuugucuggugagguggcaggaagagugugguugcugugaguucugcugcaggcaucacugcuucucagugagcagcuuccugagcaagcugugcccuaagcgugcugccccccgagagggcugcgcccgccaugagcugcuucuggaugaccuuggucuaccuuaacacucuccucacgcugaggauggaacgaucacugaagugcuugcuugggaaggacucggggugcacagagcacucucugaggaucucuucccucagaccucaccugaggugcuucuacaguguagauguugauugugguucuggugguccaggugugaagagggcugguccuuauguggucugugguaugcagaucugcuggucuuuaccuucuuguagagagcucaccucgguccccgccuuugcaccaccgcuuuucucccugagugugcaucucugucccagguuccccucuuaaaagucuacaugaaugaucucauuuuagcuaauuguccuucagugacucagucuaaaaguaaugucacauucugaguuauagagauuuaggauuuuaacuuaaaaauuugggggugggguacaauuuaauauauuaaagagaauuuguuuuuguuuuccauucuuaaagauggcauccuguguuuuagcucuggcuugucucacacacugugucacccaggcuggccuugaacauauaaucuuaauuuucaccauuugaauaccgagauaagagguauaaaccaccauuuuuggcuaauauucuugcuuuuuugaagcuguauaugucuguguccaugucugugucugucagucagcauauaugucuguaacuuaaaauuugaacuacaacuuuaaguucacaaaaaagcuaaagaguuuugccuuggcguguuaauuuuccugcuugccaguguccccacaagaaugcgacauuugucauagcugauguaccuacaccgacacagcaguaucacccacgucuacaguuugcauugagguuaaucuugauguucuagugguuugggcaaagguaaacauuauuuauaccaaauaguaauauuuguauuacuuuuacuaugauuuaaaaaauucuuuauagaccuacaggauaggccuauauauauauauauauauauauauauauauaugccucaguggguaaauauugucuuaaagucaacaacuuugaugucagagagugacaugguaaaaggaaagaaccauuucugagacgcugaccucugacuucaacacaaaggccaugguaucacccaccugcccaccaaggaaaagguguuuguuuuuccuucugagauuuggucuugcuauguagccaaggaucuggcuugagcucagggucagucauugggguuccagccuccacgcccagcucccacugagugugggaguaguuucauauaguuucucaggcuuuuaccuauuacacucccuaugaagacgucaagaugguuucacuuucauucacaccagacucugaagggaccucugcccucuuguucugacucuucagguucuucugccacuccaguccugggggucccuggggaggagacuccucaagaaaugaaguaaacugauuaaucaugucucagaaaagcaguuaggcggcuccucagaagagauccacauugauguugugugcuugcucauaaagucaaauuuagagcuaauaauugugaaacacuaauacaaccaaagcucuuuguuugccgucacagagcuccucaugaauagggucuuauauuguuuuguuugcaauccccuugauagauuugccaaaauuggacccuugaggacugacagaauuauacccuguguucugcacucaguuccacuccaggcuguuuccagagggagcaguguuuccucaucccagagcaauggcagcuguggcaggaacaaagucacuaguaggccacaggaaaucaacugguucucaaggaaacaaaacucugcuuuucaucucacaucacccauacaaggcccaaggcccaauacuuucgaaaaaacugcucuucagacacucuccggggugagaguaguugagauccagugugcuaaaagcuugcugggguagcagacauuacccagacaggccaggagucccauuacccaugccucagacguacaaauugggacauccucuuucuagagagcugcaggugcuguugaaguuucaauuuucucucuggcauuuaaaccauaugaauuuguguaugugugugucaaagaauagaaaauuaguuuuaauuguuacuuaugaggcaccauauggcuacacuauaauuuuggcaucccauggagcugcaugugcauauggaaaaugaaauuaauuggaaaucacacccugaaaucuauuauuaaguuaauauagcuaacagcuugugggguguccucucacucagcaugauguaauugcacauaauaacaaguaguuauaagcucacauaggaaacaggccuggauacacagaggucaaagggacaggcuuagaaaggaaaaacaucaauaauggaugccacagcaaacauugaaauuccucacuguccacagacccaggaaacauggcgcaguuuguucaugcacaaguggauugaucagcauucuuuagacuugcacagcaaagggacuaauuuuguuguucaaaguaguguggugagcuaagggcacgcucgcuggaauuagcaacaguuauuaaagucagaggcauccagauuagaugggcaucgaaauccucuguaugacucuuaaaggccuaaugagcccauuuguaauuuuugaaauuuugauuuauuacuuuggcauuucucaacaauuacaauugcaaagacauugguauuauuguauuguucaagcacgaagccuggaaaccacuggcuuaaauucuguuagcucuguagcacaugaaccuacagcuggugaacauuggauuuucugaguuuguuuucagcuuuacauuagaauaagauaaguuacagauauaagucuagaggauuguuuggugaaaugauaagcaauuuauaucuuguauuuauuuuaagaagugugucaauuuuuaguucugccucuuugaauuuguuuaucauagugaccaggauguggcgggaaauaaaaccuucguguaauauaaauuugaaugugaaaggaggcaaaagguauuaauucauaaauacagucuucauuagaaaugagguauaaucucuauccauuauaaauugauuauaaauggcuguccacuuuaucauauuaguaguuauuuucgaaacuuuaauuucugguaaguucauaaguguguguaugugugugcauguauguguguguguguguguguguguguucaugcacacacauuccacuaagugccuauugcaagucaaagggcagcuuuugggaguuuguccucuucuuucacuguaugggucuuggcagcaaacacuaaaugcauugggccauuucucuggcauuaaucauauuaccaauucuuaaagugucaauauuaguuaacugacuugcuuugacuaaguaccugacaaaauggaggaaggguuuauuuuggauugcaguuaaaggaaggcuacaguuuguaugguggggaaagcauggugguggcacgaugaagcaggaagugcuguaagcuguaagucuucgacccccauccaucccuagugaacagcuuccucugguugagguucucacucuuaggguuucacaaccuuccacaauugcacggccccuggggauuacauguucaaacacaugcuccaguggggaacauugugcuuuggagucacagcaacaucaccaaccuauuagacuguaugggauuaaauuguguagauuugacccaaggaaggaaacucuuucucaguuuuauuuguccagugaaaauguggccauaguagaagcugugccuccagauagaucuaaaaucauaguugggagugguuuggagcaaauagcagucuaguuaccugaaaacauuucuucaguagcaagaagccugucucuuguccuaugccaguuuucuuuaacacguugcaaccauguagugugaucauuugcucaccuaucucuucugacuccagccuccacauucuugauuauauuacauucuuggaugcugucauguaaaucacucaauagguucccuuccccuaagggugcaugcguugguaccccagcaggucuguuucaucaucucagagacacuccuggcuuccucagcacccgaguccucaaaugccucuccauucuuuaaugauagucuuuggaccuucacuaccguggaccuaauuguggacuugugacuaacuuauagccagugugauuuggugucauugugacucaggagacacauguggaggguucugaugguugugggauuaugacaccaacccugggacucuguguaacaaauaagcuuuuauuaaaaauuuucaaguuaucauuuaaaaauguugauccuuuaccugcugaauuuaauuuaauacuauacuuuugggacaauauaaaaugaaaauaauuccgaguuuacuaaggaaauaaaauuuuaaaauaggcuagcaccaaauuuguuaaaguacccuaaggguguugaauuucaucucucuaaaucacauggcaaaaccauagaaguaugaaauauuguuauuacauauaaaggauucuauggaaugguguuaagauccuuagggaagaaaaaaguaaguucuaaaugccuccaaaguaaaccagacaacuuacguacaaugugauagacaguucugacuucugucugcuaaaaccagguagaauucagcagacauaggcagagcuguauaaccugaaugagcccaggguauuucaaaucuucuccgaagggggucuccauuuaucuugucaacuguuaaaaauaauuuugggggccagagcaauggcuuaauuaguugguaaagugcuugccacacaaguguagggacuugagcucaguucuuaggacccggaagaagcuagcaguggcagccaugcacuuguaucccagugcuaucugcugcuaauucaagaacagagaaagaccucgucccagaagacacacacacacacacacacacacacacacacacagagagagagagauucugcaagaaacaaaaauugcucaccuggcugagaugaagauguuugugguucaugaccuuggcuauaacaugaaaugugaagugugcccuuacagcuuuuagccccaggagaaucuaaaauuugguaaacagagggucaauacuuguuagugguuagugaccugcuacauugguuuucuuguggguuugcacugagaggauuugguccuuccuccagugacuggguagauagcaguucugcucucuguaccuuguugaguaauugacauuacuuugugacuuuuauguugaaggauaaaguuuuugacauugauuauaaauacuauuauagugcuuuaaaguucacagaaucuuuucaguuuauuagguaauugcccaugcaacuuaguacucacaaagguuuuacuugugguaucagacauuugaagcacuuaaaagaaaauggauauacuagauuuauaaaugcuguuccagauguuuaagggaaauuaaauccauaagugguacugauuacugaagggaguuuaguguccaacuuagguugauugaaccuuaaucaaaggcucccuugaaagugaauuaaagguuuaaauuuagaaguaggacaccaagcauuggaaugugaacucagagguuaugaggggaaauggauuuucauguauuuguuauuuuguuaaaagcaaguucauugaaagccaucuguaaguucugcuuuggagcaaagcuaccccaagaucaccaaacacagggcauacauaggaccugguccuggcuguaguggcagcaaagauggacccaugguagguaagcuugcacuccuggcagccugcauauauaaguagaugucuaguaacagcacgugggcaaaguauggggucugucagucgucauucaugaccugcuguugcgggaagccaggcagauucacuugagaccuccauuggguggcaaguguguaggaaagauugaggggcacccaucagcaggauccucagugucuuugccauuucagugucagcggugaccuggggacggagguuucugaguuaugugguuccugggaggauuagaagugacauuagguacacccuguauugauugucacccugugcaagcucgagucacaagaggggcaguuuguugcugagaaaaaggcugagggguuaagccuaggaaaugucugggcccgaucaagggauugagggaggccuaaaaccuagaguaguuggucuucauuauuugcuugcuucacugcuuggcacugugcagucacagagcccgagagacacuuccugcuacuccccaccacccaccgaccccuuacagagaaagaaacugagguuuagggagcuuugguggcauuuccagcucucagaguuaaacuagaauauguauuuacagaaugugaugcaagacuguuggacacaaggcugucucucacacacccaugcugaccacucucugcuguagaaaagccgccuuugcccuguagaguugcuguuuggcuccaguacccuggcuggcuacugccuuuugcacauugaacacacaguacaugcagcagguaaacaugguaaaggagugggcuuucaucuucuuacagaauguuucuuucuguguguaccugaggguauauauguauacugcaugcauuuaggccucuaaggaggucagaagacaguguuggauccucuggaacuaaaguuacaggcaguuguaagccacccaaucugaauguugcgaaccaaaccugggcccuuuucaagaagagcaagaagaguuuuuaccugcugaguccuaucuccaaacuugaagaauguuccagggcuugcuuuugcuguaaugugggugggaaucuuaauucacagaauauuugccauugucuuagugccuuuaccgauugcuuagauaagauacccugaaaugaguacuuaggagauaaaggguuuauuugugcucacaguuccuuguuacagucauucauaccagggaagcuaaggcagccagagugugacagucaagagcaggaagcaucgcauuggcucugcucuuacauagcucagaaacuccuuccuugggaauugugcccaugggcaggcuuucucaccccacuguaaugaagauaaucagccacagacaugcccacagaccagccuaacaaaccucacugcaauucucucucgggucauucuagaugguucaagguaacaguuaaaacuaaccagaccagccaugcauguaguaaagggcguagucugcccuugaaccuuuacuauuuggggauuccaugauggagggaugagcacagccuauuguguagcuuaaaaugagcgauuuugugguuuauguuauugcuccuugugguaucuauuuuuuucguuuguuuuccuacaaaauaauaguuuucauuuuuguacccucauaccuguauggcauuauacuuuuuaacugucucccucacccucaagcagucccuccuagcacauaugcuugaauaccuuuaagguuccuccuucccucuuguuguucaucucuuuucuacuuugauguccuguaucuuuaucugucugccugucucaucuauuuuccauccacccauccuacacuaauacaucuauucaucuauguaaaccugcauuguacuuguaaaauaaaauauacccaucuuucugaaucugaccuauuuuacuuauagugaccucaaguuccauuuacuuuuacuuuccauuuugcugaguaaaauucuauuuggucuacuuaccacauucuccuuauccauucacugagaaagcaaaucgaucaauaaaugggcaauagaaccaaauaguguguucucaaggaagaaauauacauggccaguaaggauuugaaagacuguuaacacccuuagccauugaggagguguacauugaacuaccaugagguucuaucucugcggucagcauggcuguugucaaggaaaggaacagacgcaggugagaauacgagaagacaggauggaaauguaaccugguaugacccucagaggucaguauggaaaucuucagauucucaaacggacugccacaugaccccgcuguaccuuugaagaacuccacagcacaccauaaagaugcuugugcauccacacuuacugcugugggguuuacaauguuguaucuuuucugcauuuguuccuggcugccaguuuugaagaaauauccucuguuccgagaucuuuaacacguuacaguauuucuuugggguuugauguuaaagaauugaguucugaucuuacaaaaacaguauguacugcagaggauggaugggaaacuaacugaguugugguauacuuggaauauguggucaguguugacuguggugugaugugcuaacuuggcuucacuacaugccagcaagugucaaccucuuguuugcugucccaccauguuccauuuccugcaggcaacuacagggcuucagaccucccagaaccaaaguugcaaggaacacacucuucagccugcccaugagacccauaguggagcugcuccagauggagugaagggaugcauucuuggccagagcacguggaccaaggccacuugugcuaggugauugccauggguaucaaaauuuaccauuucugaaggaucgaaggaaguauaacacauaggugucuugcauauucuugacacuugcaaaaucagcauauuauuauauaaucuaauuuguagauuuauuuauuacaaaaauuauccaguggucaguauguucaucaccauuaccaucaucugccauuuacaugauacaggagauaaaccagagucaggauaagcaucaucagaagaacugcucaugcaucucuggugugcaaguacuguauuggucaacuucauuuuguagcaucuaaaguccaggcucuuauuccugaccaaagucagugauucagcugcuuacuaagauaugcaagggagcucugauccaaagcuauaggccccauaggcaagaacauuugcacuccacucuaauccuuauggauuauaaaguagauaauccacuuucuaccuagaagggccauaagagggauggaacuauguggucacagaaguugaacaauucugcuuggugcugagacuauugaugcuaggcaccaucucaugagggcuugcuacuccuuuuugucgcucauaagggaucugguggcuucaggcaagguacccacaaaguaccugcauggaaagccccccccccccccugauuuuugccauuguagauacaugcucccuggaccaaggauauccuguuggccuuaaaacagcaguacagcuguugcauugugucuuaggguuuuauggcugugaagggacaacaugaccauagcaacucuaauaaaggaaaacaucuaauuggagcuggcuuacaguuucagagguucaguccauuaucuuucugguggggagcauggcaacaggcaggcaaacuuggugcugaggagcugagggcucuaaauauuuauucccaggcagcaggagacuauuccacacugggggagcuugagcaguacuagaccuccuagcccacccccacagugaagcacuuccuccaacaaauccacaucuacuccaacaggggcaugccuccuaauauugccaugccccacaugagucuaugggguccauaccuauucaaaccaccacaaguuuaaagcaacagcguuuuauuccugucuuugucuuuuccucuacacccgucugagauaggaagagguggugcuaagccagggaugguugcacggagucucugcagcucaggaaucugaguugaucuggcagacaguuuuuaaaaugguauuucuuccuuauuugagugauuuguggcaaauuuucacugccuguggugguauuauggcguguggggcuguguuuaacagcgaccuucugccacuagguugagcuagcacucaucuucaguauacauguauacacauagguacuggugcuuaauggucugugucugagaccauaacaagccuucucuuuuuuucuuuccaucuuucauuuaaaucugaaaaguuuuuuucccccugguuuuaaauagucauuaguauguaggucauaucaaaacucuaaagaagaaguaaaaaugacuugagcccugguaaauacugcagcucuaugcuuccugucuuugagcuuuuuagaguaucuacagcaguguuuucuaaaguuuuugggacaguaaugcagucuaguuugugaugcaaauauuucuuuggcuuuuaucuuguaaauacugucuggugauuuucuuucauaaacccuguaggguuagaaaaggucuguaguucuaaauaggcuucaggcaggugacagugacuucaauggcacaggaaaacauuuguacagucauuuacaucacucuaucacauaugcaucaggccaccgcugcaggcauugccccagcuuuucugaacauugugagugugcucaggagaauucauuccucauucaaaguggaagagcauaugauaccuggauaggcaagacuugaggaaacauggaaggccaucuauugaugauagaucccauuaagauugcaaaacaucacugccugaaaaagucaucucuaaaggcauugauuccucuauagucuaaaaguuguacauguucguaguuuguuuuuuaauacuucuuaaagugauacuugcuugucauugacugugacugacuuaaguuucaagcaggauucuguuuaacagucuuggcauggaggcaccccugaauucgugccuuuuuauuagguacccacagauaaauaggucagccauuaguuuuguacuaaggugaaggguuugauauuuuugugacagcacagacucaagaagaggguuaagaucuuugugacugucagugcuacuguuaaucccacccucccucccuuccucucucucucccucccuuuacucccccaucucuccuccucccccuucucccugccuguguucaucccucuuuucuucucucauccaagucaauauuucauguaguccacacuggucuagaauuuauagucaaggaugacuuugaacuccuguucuugccgccucugcugccucaguguuuagauuacaugagcugcuguaguauuugggagcacgugcagaacaugagaggacagcguuguugucccuuuccuuccuuugaauggauacuggggaucaaauucaaguccucaugcccccuuucaaauauucuauccugagaguccuuuuguggugcguuuucaggaauaguaaaguccuucuuggugggggcuuggccuuccagcauggcacauugaaugauagacugcagagcuggcuguuggacuguauuuaaauuucacgucuuccuaaagaaacugagcagauacuaaaccuugauaacugauaucucauuaaagauuuuaaaauuuaaggacagcucuccugguuuuucacuuuacuuaaaaaugugugagaaaaaaugugcuaugauagauggagagagauguuauaaagccaauguauggaaguggaguaguguaggccucuguggugaggguguagauaauucucaaaggagcaguugagcuuucugugcaauuggaaacuuucuguuggcagggucaguguggagucucagucuucagaugcucugugacugcauuaagacucaggcacaagaguguucuuucuuaugcagagauuagccacugcugguuagcuguggccccgagaaacucccuuaacuucaguuggguuguuucacagguuaaauggagacagugcaugugcuuacuacagaucuuauuccuagggugccucuaauagugguguuaaguggaaagggauggacucauuguguuuaaccauugguaggcucuaggaucaccuaggaaacaaaguucugaacguaucugugagggaguuucuagguuggguuaauuaggcugggaaaacacaacuuaaaucuagguggcacugcuccauagauugaauaaggaggaagcuagcugagcaccagccauccucucucugcuuauugucuguggaugcagggugaacccgugccucacaccccuacuccugugcccuccccacaacugcgagcugauaucaccgugcaaaggaccucgccagcaugaaugaauggcuguagauagagggcccauugcacaccacacugucuccuuugcuuuguuuguuuguuuguuuguuugcuaguaagacaaucuuccucugcuuggugcugugugugcccuuacauuagagauugcaaaccaugaacucguaaaguacaaaccaugcggaguuggagagugguuuuauuaggguaauuuaggccucuccucccuaucccccaacuuccuauuacuguggcaucacugaaagacucgucuguguccugaagucagugcuaaguuuuaaacacugguuuauaaagauugauccuuuguggaaggaagaaaagagaaaucuccuuuugggggugcuaucugucguuuugacagaaauccuaggagauugucuuagggcaucagaaucuucucuuuuccaugugaaaucauguucauggaucacgcagacugucccacaucaugcugggaggcaaaacccuuacagacacgaggcaaaacuugccuguuguucuguggggggggcaggaagagggucggggcuguuguucaaucuuacuucccuucuuuaacucuaccgugaauuaugguggcaauacuuuggguguuagugcuuguuuucguccaugaguguuucuggguuuugcugaggucuugaaugucacauaguuaucauuucuauuaauguaugucaugagacauuugaucugucagguaauuugcauaaaagacugcagaguuuuuucugaagagcugaugcugucuucaggaccuucaugcuuuguacauagacagagguuggugacuguuucacgucugucguccagcagugcuuggcagcuccagcuaagcuucagcugggucagugagguccucgguguuaggagauuguauucucuuuucucuagaaauuauguuuucugguuuacuuugaauaacuaugagauuacucauauuaauuuauauagaggaacaagacuuuauuuuugagauguaucuuauacugaauggaagagucuuucuagaggugauuuuuauuuagcauuaaauuuuuaucaucagcaagguauuaaugguuaugcaagcaacaaauaaugucagcucuaaggcagaagaguauaugagcuuaccaccacaauuuggaugauacacacacacacacacacacacacacacacacacacgcauacauaaugaaucaguaugaaaaauaagugauuuuuaaaaacuaauuuugggaguucuguaaggaccaagaugaaaaaucuuucccuugaaaacauaagcauguuuuguguuaauauuacauuaagaccuuuauaaucaauaaacugcucaauguaguuuuaucaugcccucauaguaucugagugaagggguuguuuuucauaaugucuaauaaguugguuaucacacucaguauaaaauuuuagauuuaaguuacauuaaacucauuaaguauuucuaaauguucaccuuggauagcuuccuguuugaaucucaaaucccuguccuagaaaugaaggcgguaaaccaucaagguagggacacaggaguaggaggcaaagaagggaauaagugggugaacuuauauauuagaaaggcaucacaugcuugcauaaacuaucccagugaaacuuguuacuuuguauuauuaauaucugcgggaugcagccgcaugggccaagaugguuacugccuugcccgagcaugcgcagugaggcugcaugcaugggcugccugccagauccggaccugucagccuaucggugacgaccugagcuugugccuggagcgugugugaauucugauuggaugaggugggguggugcuagaugaggucagucugugugaguauaggaguuuuguuguuuagcccuugcccuaaguagaagcuaguaguaguaagagaagcuguuguaaggggacuagaaguagaagcagcugcuguggaagagagcuauaaaggaaaaagccacaaguaaagaagcuguugcgugaacccuacuugguguuguucuugucuccaugggcaacgaggacugcagagaccaggacaaauauccacuaacaacaguguacauuuacaucuguaacaaaaccugucuuacagacuguccuaucuuuugcucccauuuaaacuugcuauuucaggcaugugugguuaaagucugaugguuugcuguuuggugggaggcugagaauccaucucaagaaaacgauguggacaguuuugaggugguugauucucgaguguccuggcucacuguugaugggcugugucagauaugauuaacauuggaauaaggaugcuagugggcauacagaaaguugucacagugucuuguucuucacaugaccuacuuacaaccuguagaguuacauaucacaguacagaaaguauuacaguaaugacuguggauugaugacucucacuuuuacucuuuggaauccuuaggccuaaugaaaacagcucaacuccucugggaacuugauacuuaagccuuaaacuuaacaacuucucuuuuuagguucuuaauaaaaaauucaucuuuccaugauaacuuucaacuuguuucuugccuucuguugucccuucuccuugccaucuggcaguagggagaucuacagugcugggauagaucccagcagcaucagguaggauucugugaagccugcugagaggugauccccacacagaaguuagacagcacucuacacugaaagguuggauguucccauuaugcuccaguuggcgagccauggaaauuagacuucucuuaacaaguccagugcuaugggcugauauaggugcuuggaguaacacuguaugggcugcauuugacacagggcuguguuuuaaaagagacaaccugcaauaaaacucaguuugguagugcaaguucuuaaugccagccaacuguguuuaaaaaaaugguucaaaauaacauauucucaggcaaucuuuuuguuaauucauucauucauuuuugagacaggaucuuacuauauagcuuugggacucauuuuacagaccuggcuggucucaaacucacaaagaucugcccugccucugccucucaagugcuaagauuaaugguauguaccaauaugccuggcucucaaauauucuugacaaacauuuuuauugugggugugagcugucucaugaacauuauuuuauauaaauuuguuuucagaaugccaccucugaagagcaaagugagccauuuuuauaaaacaugccuaauaaaaacaugucuuauuuauuucgaguguuuuuuuuuucuuaaugauuuuaacuuuuucauuuauauuuaacagugcuuccaagagcauucacuuuguagaaugagacuugggggaccauaaaccugguacaaaaauguauuaucagaauaaaucaaaauaacacuuacagucaaaauagagguaacauuuucagccagcagaguaaugcaagaccauaguaggacuuccuaagcaauucuauauaacguucucuaaguuuggagauuauuugagaauuuuauauguaucucuagguugacuaugucuaauauggcuuuuuccccaucuguauauaaaaaucacaauaaagugauuucuaucaaacugcguuuuaugaccagaaacuuacugggauaggaauaaaauccagugggcacauugcuugcugaggucaccacacauaaccuuuaggaguaaagaugauccacgugggccaacugcagucuaauccuauggcuauuaauguauguaugcagucugcuucugcagacaguuuccugcuucuuacacugugguugaguaaacucauccagauuacgugagcuguacaugugggcuccucuguaauucuggucgguaccagacaggaggcaauauucagaaaaccagauuugucugcgcuuuuacuuuuggaaaaucagauuuuacaaugaaaggaaagaaugucaguaagugaaaugaacuugguaacuacugaaggaagagacugguguccuuugaguagcauuuggccccuuaccaugcauuugaguaaguacuaguugaauuaaaccccuucuugagucucccucaagacgugaaucuaauguacuacuagaggcagcucaguucccauacucaguauuuacuuauuuuaaugaacauauuucugacugguauacaaguugugggaaauagcagacugaguagacucccuuuuccguuugucuauuugcacugacuuggagguggagcucucagaauggcucaguggcagagcacauccuuagccugggcuaggaugggucaaucccuggauucuaucugugacacuccaaaacaaaacaaacccaaguauuaguguccugauauguggcuucaguuaccaaaaugguugcaugacuuaucaccaggguggcauggaaaccucugacacgaggacggagagugacaggccaguugauaaauuccaucaagguuacagccauuucugggucuuggagguugaugacuagaacugcuuuaaucagccuuuggggugccacuuaucaguagccaguuaggggugcugccuggcacuccaguugugcuguugaaaagccgagagggaagagcgucucuccugagcaacaagggcauugaagaugauaaugacagugggguacccugaggcucuaaagaaugugaaggggcuguaauuacaccguugagcagacagcaaaacaguauuuucucuccuugaagucuucagaagacaaauaggaaacaucuuucccuaccauuuuuggcagucacugagaguaaucguuccggugauagcccucauacuuugugaauacaccagccauggaggucaucacuucagguccucuaccgaguuuugucuucaugcuguucuagcacugugugcuucuuuucagacaggcaucuucuuccauccuuuuguguaccucuacaagaguuuuguuugcuuauugucuuacagcguugauaugaaacacagggcuugcucuccuacugaggcgcgugcaccccuagcccuagaguugggcaucuuaguccagguuucugucagugcaguaucacuguguauggacuggcugcugucccgugcaguagccuaaugaacagugaguuaacuuggcucagccgcucuucuggggaguucugagagugagcagcgaccauagcuuguuuguacccagcuuauggguggccaccuuguuuuaagucagggaucggcugcugaugugaugguuccuguugauggcagaagcaagagucaaaggcgugacagggcuguguuccaagaaggagcugugcuuuggcugagccuugucugugggaggaaagguuuaugugagagacaggaguccagcagggaaagcagcaaaugagcccugcagcugcagccucugcacgggcuggcugaucacugacccuaugccuucagagugcucugucucguuauagcucccuagaacaaaaccuugguggaucuuugaccuucagucuuugccugauugacugugagcaucaauggcaaugacuccuaaacugaagcagccaagaaugcaacaugaacuuuggcaguuauuuuuaaagcuuuuauccauuuguuugaaugcuuagagugcgugugcgugcgugggagugcagcaggguguggacuugaugcuggguguuuuccccaguuaguccccaucaguucccuugaugagccuggagcucacugauuuagagaggcuggccagcuccugcacuccagggacuuccugucuuuacuuccccaucacugggauaauaagcuugugccauugcccuuacuuggaugcuggggaucagaacucagguccuuaggcuuacagagcaaacgcuuuaacuacugagccaccucccucucagcgugcucuccucugauccuuaaaacaauccugacuguuguuucaaguaauaagcugagucucagaggccuaugguuaacaucaccuaucugagcaaggaacaccaugguagccuaauggaagaugauucaauucucugauuuaaauaaaggugacacacaaacacaaggccagcuguggccugagaugcauggcaugugcauuuguuuguuuguuuguuuuaacgcauuugauuuggagcauuccuccugcccccaaaucgggaaagggagcucuugcuugcuaaagaccccauuuaucaguaggugacuucucaccccacuucucugccaggccuauagacacacuugaguuuauaacucuggucugaaaggucgggagcagggaguuuauucuuucuuugcaugagcugagaaacaaauauucccaaacccuuuuccccuaggagauuuuuuucauuuugccaauacuuuaugaaaaauauugcuugcuuuuaguuuuaauucauuuccuucuuucuuggccaucccugucaauauauagaacaacuacucagaaaacuguuaguuuccaggaauccaguuauuaaagucagccuuugugucuugucuguaaacccuuuccguacccagucccaucucccucugacaucucaaagcucacaguuagauccucugccacaugggagugucaugacacaguacaaguuguacugugucccuagcuuuaucuagcacacucagaagacaagggaacucgagccuggcuuucuccauaggugugacuaucugggcucuacacugguggauguauuugacuguccucuguaaacaagcuuuuuuaguuauuuugaaguuucucauugucuucauuuugaaaguugauuuaggagcuuuuaguaaaguuguguggaagugaaguccuauacuauuauuucuuuuuuuccuaccccuuuaaagaagagaugaaauaaggaaaggauuucaaacaauuacugucuggauuuuucuuuuucagaugcaaaagaaauuguuuuaaaagcccagaucuuagcuggaggaagaggaaaaggugucuucaauagcgguuugaaaggagguguucauuuaacaaaagaguaagucugaaugguuuagggcccauccugauccugacugaaaggguucuugagggucuagggcuggggccagugugugguaccgagaggaaagggaagcucuggcagguggccuuucccccagagccuccucucauuagaggguuuuauaccccgcacugaggaagauuacacuuccccucucccagacaaucugugauacauccuaagagugggaaauaacacugcuugcaacuguaauaccauuuccaucaucucauuuccaugaaaaauauuaugugguuccugugaccaguggcgucuuuguggcgccuggucugauaguuuaugcuugccuguaucugaacaucuuuccagcaucuugcagccuuuccuuucuccccaucacagucuuuucauugauuguggucccuguuuucccucucauuguuuacuguuucccagaucauccauuaucaguuucuauauaagucucuuaugcauccaguauuguuucuuuauauauuaguuuggugagggaaggggugugaagcagaguucagcauuccuucauucauucacucauuccuucauuuguauuuggcuuucagugacaugcaggcuguaaauggaaagauaugcauucccuggguaauggggggauguaggcuagagguggacucuggacaguguggaucugaggagguggggugguaauccugcacaguagggaugugaggagguggggugauaauccugcacaguagggaugugaggaggugggguggugcaguaguccugggcaguguggugugaagaguuaggaugguggaggugacccuugauauugugaacccugcuguaucaugauuugcaauuugcccuaauuguuuuuuguuauccccucuuuuuuaucccuccuagcccuaaaguagugggagaguuggcucaacagaugauugguuauaaucuagcaacgaaacaaacuccaaaagaaggugugaaaguuaacaagguaauguggcuauucuuagucauuucgaaugcacuuaaaacaaaagaacagaggcuagacucuacuuugaccgauucucaugaaacacuguucuuugacaacauacugguuuuguuuagggagugcugugucuuggaagaaagaccugaaggacuguguacauuggccguucaccaaaacccagugaggugaaugaccagagcagcaguuuuccauucaaagcacagaugcagucugcuuggagcugacagggcuuggcagggcagccuugcacucucuaagccucuugcuuucccauguagccucauccucaguccuuucuaguagaagugccuuuuguagugguuugucuuaaaacuaccucaugcucuacuuuuaagccacucacggcuauauguguauuauuagugaagacugcuuguaguaagcauguaugccauguguacccaugugcaugcauccauauggcaccuagacauacauaugaagaggagguaauggccugccucuggugugcagagaaaaauggccugccucugcugugcaauugugaaugcaggauccaaauccaggcccugccuuucccuccugccuguuuucagccuuuuguuccugucuucaugugugaaucagccgaagcugucuguuguguauaccacagugcaaggugaugaccaugcagagacucauguacacaaguguaagaccuguguagcagacugugaacucgugagcagagcccuuugagugccacauggcaacccugaagacaguauggcuggaaaggggcagccuaacugggccccauuuuuuggcccugcucuguugccauagcaucagagacuugcagccucuaucuugugcucugcuaggggguuauucagugguacagucuacuuuuaguuuucuuagaacuuuagaaaguuguugacauaaccuuagaaagcguguccuucguaagucaugguagacuuaauccuagccaaacuagggcacagaaaaacagaagauacccugaggaggagacucuucuguccuuugugccucccaggcuauugagaaagggcacccuaggaacuugaaaucuccucaggaaugucaugcugggaaaagggaaaggccacagcuugcugcugggcuggggaggagcuggucugccaggaagguccacacaguucugagaacccgcuagagcacgcugcagaagugccuugaugucauagcuacucacaccucuugcucuaaacucaugucagaacccaaaagauggccuugugcugucacuggaucuccauguuccucuucccagugugacacauugaauggaacaucuucugcuucucacuguuguuuguuuaacuggccuguugagucuccgugcugagccuagcuuguuaggaccaccagugcccuggaucaucauaacauggcucuaguaacaguaggacauugggauacugcuagguauuagugucaucuacugaaacgccaagccaucucagaugcuaaggaguacacccaaaagcugaguguuggucggucuggcgcaugcaggcucugucagacucaggguugauugguuccuguucagaccggaacucuacuuuuacuuccuuuacaucugaugaugagcagucacgugcauaacuuacucagaauuuguccauagauagcauaauuagcacuguguuuguagagaauugcuauuuuauuggacacauguaacuguagauuagaauuugugaaacuuuuaaaaagcauauaaaagugucuacucaaagcagauucacaguacauaguaauaaaauucuacagaaaaguggcuuguagcucagucccugacucgccggagauaagcauguucuugagaaucgaggcaucaccagaaaaaaauaaaaaacagagucauuuauuuuuaagucuauuuuuacuguaauucaagaacaaguaacaauuccaauagaauaagagucagaaugaaagaauuaggcacucccagcuuggaaggagcugccgugcucuuuguccucuucugacgcccaggcugugucccaucucugugacagcgcucauguguccaggcugugucccgucucugugacagcgcucauguguuagugcugcuguucugcuuccucucuugggauuggguuuuugagauaagcuuucuuguagcccaggcuagcugcaaauuugcugugcagcaagagauggccuguacuugugauucuccuccagagcaggcugagcaauggacugcagaguuacaccuuuccccaagucacagcaccuggugauguguccuuaucauugucuucaucguugucgucauccuccuccucauccuccucuccuuccuccuccuccucuucuuuuuugcuagaaggauaacuuguagucacugagaguaauuaguauuuaaccagcacauuuaucauauacauuuguuuuaaguguuucauagacagugugacagugaagauucagaauauccugacuuuaggaaaggcuggaggcuucauaccugacuguuccuuucauuuucuuuuucuuuuuggcuguccugggacucacucuguagaccaggcuggcuuugaacgcagaaauccgccugccucugcgucccaagagcugggauuaaaggugugcaccacuagugccugacauguuccuuucauuuucaagacaggcaucuggagaauccauugauggccccagauauagugacagcagggcccugcuuuccccuuuccaggauauguaguacucacugcauugucucccuugagcuggguugaguucagggauuaaagucaucagacaguguccuucgggcuuuucgcuagagccaggauacagaauauauuguguguagucuuccugcguuugagaaccugcauagauugauauugacacugagaugcucccaggccccacauguggugcugaguucccugauaucaacaacgguguuucuugcagauucucuucguccuuuugcuuuuguguuuagugauguuucagcuuuuccuggcccaugccucagguuguuaguagcgugcuaaguaggaguguuauaauuuaaauaaauuaauauauaccuaaaugcuuugguaauagaaaauguugaaugcugugacuaccacaaccugggugugcucaccaucuagagaagagaaagucuaaguaaagucucucucagauuuuaucuuuggugaggagagggucagauuuccauuguguuucuguauaguuggaaggccaagggagcucugaguuccccuuuaaaaaggcacaaaccccacuccuacggucuuuaccauacugauguuuuccucucaaggaccugccuuuaaauagcaucucaguggaaaugaggguacagcacaugaauguugagggacauaaaccuuucuagaaauguuguagaaauuaaauuauacacuguaaccuuugagaaucggcuuuuuuccagugauuuauggagauuguauccuuucauuguuauauaauacucuguaauaugcauguuccuuaacucaucauauauuaauaucuccauuguuuuaagcugcccuuuacacaucaaagcauucuauacauuuaugaacagauuuugguguagauaguucuuuauuugggggauaaauuuugaguuauguguaguuguaugaucagcugauuuuguuuuauuuuguuuuagaaacugucaaauauuuggcagugccagcugugaugugcagugacuggggcucuccacauucuagccaacauuugguagucauugcuuaaaauuuuuagccaguuuuguaaauaugcagugcuauuucucucuaauuuaaaauuucacagcccuugaagcuacagauccagacuucauuugcucauuugucauuuguaggcugucccugaaggcugcgcuugcugucauuacauuaagagggaccgggggucacagcugcacacuccucagcagggaccaugcuuuuccgugaaaggcugaagggcucagcuucgaacuguugcaugugugcugugucagcagguucuguugcugugauuugcaucaucaucuuaguggaggagagcuucauggggaauaaaaauauuuaguuuugaugaagcucaaaauaucucugcucuuuuguggacugggcucuugguacauucuaagaacaagguuuucuauuaagauuguagugguuuuucuuuuucuucuguguguguugguuuccaguaacuuuugauuaagguggcagccuuaggcccugguuuguguuuuucccuguggauguucacuuguguguuuaccccuuuaaagagcugugguuuuccuuuguuguauugcuuuugugccauugucagaaguuagcuggcuguauucauggaguccccugcuacugccacuuaauugcuguagcauccgguacguuuuacacuguggacacugcuuuucucauuucauuccuuuuuuucucagugugcuguauccuguucuuguaccuuaucagaugcuucuuaaaauaauauugccuuaguugauagaaaaacaucucuugcugaacuuucaauagaaauuguguuaaacugcuauauuaguuuggggaaagucaguguuugcuauguuagaccucaguguccaguaagaaaguggacacuguucuuagcucugccuugauuucugcucucacaguuacauacuacucagaauauaggguggagauauuuauauauuuuuagauuuccaccuaauguuuucucccuuuuuucaguagcaguuauuacagggauuggaguuuuauuuucccauauucauuuaauuuuacauguacaacaaguuuguuguugacgguauuacuuccugcugaugcuugguagaugucugcagagaacccugugguccagagacucccucucccgugcuugucggcauuccuggguuacugguuccugcaguuacugguuccugcagcauccagccugauuuacacgguggagcucagcauggugugcuucccuuagucucagcuucccaacacugcuuucuccuuuuaaguuuucccauucuuccuguuuucuguugacuuaaaguuuuauuugaauguaguggaggaguaagcaaaaagugucaauuccauauucucaagagcuaggcuacaggcuuauagaaauuuucaaauucuuaagcguauuagaggugcuauuuaauguauacauauguacacacauauagacauauaucaggcauuuuugucugacucugugccauugcguuacauguugcucaggagaggagugggugugaggcagcacuccgcagagauccacaagcacugucaucacuaccagcuacugcucuguaggcaauagaaaauuggaugguuucauagaaucuuaacucucugccguuaggucaugaguaguuugcacauugcuauucaacuuagacuuaaaauuugaauaacaggauaugagggagggaggagaaacuuaagauauuuugaauacacaagcagcucaaaugugcucuacacaaaguuaacugaacuuuucauucuugugaucacaggugaugguugcugaagcccuggauauuucuagagaaacauacuuggccauucuaauggaccggucccauaauggcccugugauagugggcaguccucaggggggcguugauauugaggaaguggcagcuuccaguccagaacucaucuuuaagguauguuugauuagcuggccauguaacugauuuuuuuaaaaaaauuuuuuauuacguauuuuccucaauuacauuuccaaugcuaucccaaaagucccccacacccucccccccuacuccccuacccauccauuccuauuuuuuggcccugacguucuaguguagugacugcucaacauuuguuguggagucugaggcagggagcacuggaccuauugcggagcugugaggugaagauguugaaucucgucaggcagaauugaagugucuaguauucuuucccuucucuucucuucucuucucuucucuucucuucucuucucuucucuucucuucucuucucuucucuucucuucucuuuccuacuuuuucuuucugcaucauuuuuuucuaucuagucugaccuaagaauuagccaacaggguagacuccugucuuaaacagugguuauggucuagacacuuugucuugugggccuggguguggguuagucuguguauuaguuagcuugcugugaccaacuccugucaaaguaacuuaaggaauaguuuauuguggcccauaguuugaggguacaguccaucauggcaggaaaggcagggcagcaggagccggaggcagccggucacaucguguugggaagcagagggagauggcugcuggugcugccgcacuuucuccuuuuugaccagacugagaugaugaugccucccacucugagggugagacuuugcucuccaguuuucuuagugcagucacuuccucacagacauaccagagacuuuugcgacccaggccccaucaagucgauacuaaacuucacagacuguccagagaagaacaggcauucagacguucguauuuugaucuguuguuucuguccuugaaagcuucagacuaagaucaguuucagagagaugaguagucagauucaaguagggaguaagucugucacaagccuuuagccucaguuuaaaaaauaacauacgacuaccuugguuuuuauccuguagcaucauaaggauuaaguggauugauaggaaaagaaaugaucaguuaacauucucaucuauagcagaaaaaaacccauuuggaauaguaaacccaguuuuuaaucuugguucuuaaugcccaauuucuuuagaguuuucuacaggaaacauuauuuccuuuagaaaguguuuuguuucccguuaaguaggggaagaauccuauuuucugaaucugguuuucaauagacuguacuaacacuucaaugauuguucuaaaaauagucccaucagaauuacauagauuaacugcuuuggaaguuuaauugaagcuuuauacacaggcuuacucauaaugucuagccauuuccaaaauuaacuuuaucucaaacagucucauuugcuaucauaauucaugaacuaauacacaugaauagcauucauuguuuuuugacagaagaucacuuuguagagugaaaguauuauuaauaauuuucaaaugaauaaaguguucaagucuuaagauaauauuuaaccugugugugacaacuccaaacuuaacagcaguauuaggcaccaaagccuuuuuuuggaugccuuccaaaagaugucacaaaaauuaacugacuaaauauucaucaaugccaucuguguaguaauuaaaagugaaaacuggcauuagaucgucuugucagcaugccaccuugaagaauuauauaguuuuuggaagagcuguuucaugauggccugcuaauuaaaacgugccccauaggcagccgcaguagccucgcuuggagucgguggaagggugccacacuuuaauuacuuacuugccagaaaguacuuuaaaucuucgcuuucagguuuaaaucuucuugcuggacuucugaauuuuguucauuucauauauuuucacuaggagcagauugacaucuuugaagggauaaaggauagccaggcccagcgcauggcagaaaaucugggcuuccuugggucucugaaaaaccagguacaaaaccuuugggagacagcauguuugccuuguuucaggaaauauugcagggacuuguuuaauugcugcugauguuugugacugacacaagaugguugugucugaaacuuucgauaaauucuuuaugaucaagaaacuauuuucuccuguugcaagaggugauguauguauauguaucugaucgaaaugguuuguguguguguguguguguguguguguguguaaaugucuguguauaugguguaaauguguguguguaugcagauauauuauagagauguguaucaguaugagaaagaguuguauacauauauauguauauguguauauauuauauauauauauaugauagcgugugcuuauaguuuuaugauguguguaugauuacaugcauacagugugugugcaugcauacauauuuaugugagaaguaucuaugcauacauauauaugagggaauuuauauguuugugugcugcagguuuauaaugcauauguauauauguauauguauguguguguguauuugugauuguguauguaugugaaaauaugauacaagugugcccuguaaaucgaugauauguauaugaucagauauacauguauauaauagaggucuguauguuugcugcauguaguucaugaacuccaugcuguuuggugauauuuguuacugugguuuugagacagggucucauguaucucaggcugguuuuaaacuucugaccucuuggugcugccuccuaggccuugggauuacaggcaugcaccuggcaccuuggagaggugauccuggggaucuaacucggggcuccgagcgugcuaggcaaguacucugcucacuaagcugcugccccagcccucucucugacugaugggcuuuuaauguuuccuuacaguacugcuggugcugcuuggcacaugcacacucauuaccuuaagaauuuacuuccagcaucuguauaauggagagagugacuacuaacugagagguguauuguaggguuugaguugagugcuguauagagcaguuauucacagugcugcaagacccccgacuuacuccuaagccccacaagcaagcaagauuaucacuguauuuauuaacagugcaccuuacuuaaccaguugcuauucuuuugcagccaaugggcauuugaaauguuauugauggcaugaaggcaagguuguucacucagaacaaccaaaaauauauuaauuuaauagucauaucuuuuugguuugaggauggaacagugguacuccgagcuuugguggggcagaauuugucaugaauauccagggucugccuuuguuccaauccaugacaggugacaauguguggaaacaggcgagcuucuucccacagcuaagucagaagaauuuccugccccuuccugcccucucccuccuccuuaacuacaagaggcuucuuuaguauauguguauucauuggcaugggccugcccaauggguaaauaauaaguugcuccacagugcccagggaggauugucuucaggaccccguaagauacagcaaucuaauucauccucaagucccuucuagagaauggcuuaguauuugcuuagaaccuacauacuucucucccagguguuuuauaauuugggaauaaugacaagaaaauaagaucuaggugguuggacaguugcaauagucauuuagaauauuuuccuuaguauucuauuuguuuguauaugugccacggugagcaugaucagaggacaacuugcuggagucauuucucuuuccaccauguggaaagaaaggccaugugggucuagggauugaacuaaagucaucagguccaacaguaaggaucuuugccgcugugucaucucaccagccuuacaauauuucccuucugugguuagguuaacgcuugggcaugagaccugcagauagaaauggcacuucccugagcuuaguugaacauucuuguuccaaugcaacagugauuuuugcaucaucuccagaauugucacugguaaugugggcaaguaaaggaagggugcaguggggcgaaacauuagauguguucaggggaagaaaaggcaccgcucauuugaaaaucaaauuaaagacuguugaaaaguaaaggacucaagguaguagaagacaucaggaccuccuggacuauguccuaggaagagacaacuaaguguccccucugagaccggaagacugcuacgaaggcaguuuguucaaaggaaggugcuagaugagucuugggcucugugcuguagugauuaguuucauguuauuagacugaggcuguuaacaauauauaaaacauuuuaaaagauguauuuaaagacugcuuauauagagaaauuggucccugaagccauuuggucccauguuucauuccaaguuuauucaaucaccugugcacauccucuguauccgcacauguguguucugucguggacuggacucagucggucccucaacccauggggaaccagggccccaguaugcaggugggcaagaagucaguguaaagugacagacacugacacagagagagugcuguaucugaauguaauuucucaaagcaaacaucagacuuacaguauagaagagaacaaaaaguuaggugacauaucagccaagguacauugaaguuauuugacauaaaacagaaaugcauacauaaagacugacaggaaccaggcaguguuuacaacugagauaagaucaguccuaucuaaagucagauauugacagaagccagguaaaagggcuaauaugccuaggugcaauucugguguauuguauaacccagcaccaggggguuuccacucuugcuaaccuuuucaugaauaauacaauacuuuaguuccuccuuaaaccauaacccuccuucuuucuacuacuauguaauguaggcugccauucauguuuguaaugagaauucuaaguuuacuauuuugaacuagcccugagauuucuagcuccuauccaguaaaauacugcaagagagcaugcaagaccuuccacacuauuacagggacaaaucugguuauggggcaccagagacucuccaggagacaaguuuccaugaaacuuuuugucucaggacugcggccaagcuuuugggcuugccaugcagacuccacuggagugggugugucauguuucucccauuugucgauagucauccuuguuagaacccuaauccccauuacaucguaccuugcuuacuccucuguuggcacagcucacaguaauagcauacagauaacauauacagguaacauacauuuggcaugagcaagacuaaguaaaucacauauguaggcugucuacauugaaugcuucuaggaauuaacaguagcugucauaauguggcagcagaaaaaaacccagagugggcaaaucuguugacccaugguuggaaagcuuagcuucugaacacaguauaaagcucuacagaugauaauaagaauauuaaauauauccuaaaauacccuugcuaccuccauaugugagagaaaauuaaggguuauuuguaauucuuaaaugacauaauuauacuucgccaguuucugaaugugauaugucguagucaguaaggagccuggguuaccaggauauuuuuauguuuuuaaguuaucaaggaaagaaaagaaagaauaaaaccuuugagacagggucauagcugucacugggggccgacaucuuuguggguuugacucuuuauuugcccauugagcaggcacugauuguauguuacuuccuuuucuuggcuguuuccaaaguaccaaaagauagccauuguucucuugggauuuguggacucguggccaucauuccucagguguagaauacaugaacugggcagggaaggggaggagggcaggcagaagugggcgggaggaggaagagaagcagaaacagaaugagaaugaauucgagcuguccgugacuugggauuuauggagggguacccagugugcuugcacaguaaggguggguggcccaugagcuccuggaagcugugcauaacguguaacgucugauuaaggaugcugccuuaagucaugaaggugccaugagcagaggaggcaggcaagaaaggcaaacgguucagcaauuuaggucacugauccuaucaugaagagaugauccuagaaacugaaggagcacuuggacaucuggcaauggcugccuugguaaaaucuguauucucugaauuuuaccacaguuuuuugaaaugguuguauuugaucuuacuuaugaaccaaaguuauuuccauuacuuacuuuguucuuauugauaaauuacucauuaaauaauuuauuaacuucaauauagaaguaacuggcacaggguguggguaaguagggccuuuccacaugccugcacacagcuguacugccguacauggagucacauguauauguucccagaucccugagaggcugagucaugaaccccugagauuauggauacaaggccaagcccagcaacauaacaggguccaaccucagaaacaaagauccaaccucaaagauacugcugcaugcugcacagcuuaguccuaggcacucagacacacaugugggacaacaggguugggugagcugugcucccucagacucacaucaagaaggcccaaagccuagcaucaccccagaaaugcagggaguugacuguauggcccagggaggaggaguuagcuugccucugaaugggagaaugcuguaggagagcagucuguggcuguaaacauccccgaggaagcuggaauggugggggaagugugcagcuauacucuggcagcauagcucauggaccaaagauaggcugugccauuucacaugagaaugaggcucugugguccuugacguggcuuugcccaugcacuugugguuucgucugguccucagauaucagaauuugugggugacuggcuuuguaauuuaauauaguuuaguuggcuuuuaaaaguaucaacacugaaagcaagaaacaauaaaguaaacuagaaauauugcuagagaucuuuuaaaguacuuccaaaaugauucugaccuuuugaaagucugcaaacccagaagccaugcgacaugaguggugugauuguccuuagauuucccugcagcaggaggaacacaaacaugguugaaagaugaauguauuugcaguuuuuauggaauaaagagcaaauuuuauucacauaaaaagacuuacuuuaaauuaaugauuaaaaaaaccuauaucucaacagaaacguuuacaaaauucacagaaaagaaaauacaacugugucuuaggagcuagaaugaugcuuaaacucauucauuguaugggauuuuuguuaaaacuacaaauacccgcugucccucacagugcccggcaugaugcagaugguggaugggugugaguggagucuuccugcacuggcuucuggucauucaggguagcuucucuucuuuaaauagacucguucauauuuaaaaugcuuucagggcugaggggagagcaugagguacuauggccaauccuaagaagccaugcugaggaaagcacccuggccuuguuuccuacgcugugaucccagugccauggagguggagacacgugcauguguacaucuugcucacugcucagccaagauaugcaagcuccaggccagugagagaaccugucucaagaaccccccaaaugggcauuucagaggaacgauaucccaggcuucuacagauuauuuauauauauaucauccuagucauguacaaacacaugcacauacagccacacucaugcaaauaguaugcacauaaccauauauacauacaacaaauaauaaguaaaauguuuacauccauucugcacugcuaugggguuuaccccauaaaugcuuagucacauguauuacauaucuacagagacaagaaagaugacauuuuaaguaaaugaagcuauuagaaacaauccauauggucauuauuuaggugauaaauauaaugaaugauaguauagcaugcaauaaaauaugaucucacaauuaaagcaguggccuauuucuccugcccgugaagguuucuauuaauaaggauagaggcuuuuguuguucugugaagaugggaagugugcaucuuaguguguacauaagaaugugucucaggcaaauccaaagucaucagcaucugugucagaggaccuggaagcugugacugggaaauagaaucuugagcaacccugacaaauggggagccuuauagcguuuauaugugcuaccuagccauaaaauauuucagaguaaaaagaauuugucuuguucuaguauaauagcaaaugauggcaguccuacugcccagggugggugaggcagaaaggucacaagcuugaggccaaucaaggcugcauaacaacuugaggguuagucuggaaacuuccuggaaccugaccucaagaugcacauacauacauacauacauacauacauacauacauacauacauacauucauacauaugccuuacacuuuggaugcauuucuuuauuuuuguacauaagauuucaacuaggauuuaauaaagucuacacauagaccugaacuaguuaagauucaaauaguaugagagcuuuaaaguugaagugcuuuagucaaaccugggcuggcuuucauuauugacccagccugaacucguauuuagggauuucauucguagguguuauaaggacaaggagaguuaagacugaaggagcagagaggucucagcuucucccuuccuuugccccauuuccucaucuccucaaccccucaaccaggcagagcuucaagccggcuggcucagcaacucugaaacuaauccuauaggagugaaaugcuguuaugccagaaaggggcggggucacacuggcucugauggcacauacugcagggcuggcauggugggcgucgguggcaacagggaaguaaaagaaggccaagaaugaguuccacccuucaugcaacuguaguugcucacacuugucaggguggacucuccuggagaguugaugaggagcagccugcccugggagaagcagugauuguguguuggcugagaaggcagccuggguaauguuaggagacuugcauauaaaagcucucuguggucuuugccuccaggacucacuuugugcaguggaggcugcaugguucugaggcugcucuguuguuugagaccuucaucuuucugucucuugguuuccaucagacacucaggaauuucugugcagauuauaguccuggauugaugaauauaauaaccauuuuauuccugcauaauaaggaaaaccuugucauuauaaacccucaaaagccuguuuaccuuuuuacuuaaaugaagccuguuuguauuagugauuguagcuuauacugcagucuaacaugacuaauagggacaugauaauucacaaaaggauuaauagcacuuuuaggcugcacagaaaauauuuuguuuucuugauaauggucucucuuagugucuggaggaaaguugagcagucuguucuaaugaauagcaguggaaauuaaaauaauuauguuuuacaauuuuucccuuuagaaaaccuaacugaaaauaaagacauaauuugcuauuuuuaagauuucguuaaugaagcaaaauaaacuuuguuguauugcuuggguguaauuccaucucacuugaucaugcaggcugcagaucagauuacaaagcuguaccaucucuuccugaagauugaugccacucagguggaagugaaccccuucggugaaacuccagaaggacaagguaacagacagcagaagaaagaauugcaaauggacuuuuauaauuauucauagaaacuguaaaguaacuugcaaaauaaucuccaaaagcugcaccagcuuugaguucauuucuuuaaguaauuuaacuucugaucauuucacgcgcucccaugaugguauucaacauuugggugugcuauacucaaaugccacgccucccaaggagcuacuuccugcuuggcuucagcugccaugaguccgugcaucagacaacagagcccucauuuuucagcagucacugcugauagaaggauuugaguguggguggguaucacuguccuugggcuuauagcugcaccuccuuuuucuaaacuuggugaucuugaauuugcaaacugugcacaguuuuaccuccuguccugaacaggacgucuaccaucuugacgaagccacuaucaucacucuguaguuaacacacuugccuuguucgcuuuaggcaaaggaguuguuugaaggaugcuuucucuuguagcaauauuguaccacuguuguaugccucagcaaaugucaccacugcaggauuucuugaauaugaaugaagauguagacauagcaaaagcuuggaacgucuuagaguaguccugaggagugggauggcagauagaaucauucaagccagaauguaagugccaagacuuggacucuuuccauguauugugaccgccggcuuugccauugaguaggaagaaggagcugaacagauguguacagagagcacugucaagaccaggcauuuuuccuuaguagaggcuuuguaggcaaagucagaaaacccaaaagacuaucuuuggaacucagagacaccucaggacaaauucaaauucugcaucugucauauucggacuacacaucuauacacauuccugcuuaggcuucagauuaaaaacaacaaaaacuuuuauuaguauuaauaaaauugcuaaaaaugauacccauauuacagauugauguauugagucauacauccagagugagauauaaaguggagccuuccccuauauucaugaaaggacauugcucuucuuaacuaguacaagaguuugccacgaaaaccaguguccagcuaauggcaagcucuaaggaaguugcuaaaauacaguauugcauggauaaccaccaaauuguaucuggacugaguuuuauaugcaaauuguguuuauuuaaacuuuauuuuuuaagauugauaugccuaugugccucagugaauauauaggcccugaggaggccaaaagugcucguccguugguuccucuagaacugaguuacaggcauuugugagcaaccucauauggguauuggaaaccauacuuggguccucuguaagggcaacaauuguucuuaacaacugggccuucucucuaguuuuuaauuaguuuuuaauugcuaugauuauaaaaacauuaaacuuguauauagugaggaggcagacaaguugugccuguuuuugaacuucuaugccaggcucuaugcuagacuuucacaaguagcccugcaaaaguaagagucauuauucccgucauuaagaucaggcauuuaaccugacucucauggaaagcuagaucugcaggauagaauggaaacccuugccucucugcucagugugcaagguugcccugccaugcugggcuaaguagagccuguuuuuucugguuguuguuuuaaaccaguaguuugcccuuguuagcgugaccuagaaguggucucagguuuugagagcacgagucacauucacacugccuucucaaguacugcaggcugcuacucaaugcaugaugguuacuuaucugaauuugcuguaaaggcucuuuaauauacugaggcaagcaugguugugaugcucacuguucccagcggcaggagagucaugucuuucagagcaucauggaccauaaugcaagacuauggcugaaaaaaagcaggagguuggcaggauagacccgucugggaaguacuuucuuugcaggcaggaagagagguuuguucauagaacucacacuaaagacaaagcauccacgaggcucagugggcuacuugaugaguuccaggguagucagagacuccggcuccaaacauacguggaugacacuuaaggaaugaagccugagguuaucucugaccucucggugcauaugugaucaugugcaugcaggugaacacacuuacaagaccgggagaaaagacagcuuccucugaagugggagacauuuugcuguaggauuauuuuauucacacuguagggacagggauuauacaagggacucuucuuggaagguguucacaaauuuuacaaaggcuaaaguuugcuuuuuaauuaauaagaacaugaaacuuuuuaaaaaauaccuuuaaggaaucaucacaaaacacaucuuguauguaugguucacuaaagcagaagucuuacauaguauuuuuaagaccaaaauuaucuuuagcuauuaauuuguucauuguaccguaaaaguuuggcuauugaguuauaaucacaauaaaugagaguguugguuuauaacucuaaugagcaguagacaaauuaaacccaauuaggaaauggugauuaaugaucaguugugaaaguuggcucuucaucacugccguguccugcaaagcaggccucuauuuaggagcuauaaaugcagucauuuagaucucugcaauguugauaauauuuauaaucucucugcuuaaaucuuuuccauuuaggugacuaacaaaacauuucacaugaaaacguugauauaauuauugucuuguaauuuggaggcuuaaacgcuccaaaaauuaaggaucacauaaacguuuugacuuaaaagcuagccacugugccauccaucucucugugcgagacuuagcucccugucucauugcuuauccgggaacauuuuuuuuuuuuaauuugcuuuauuguuuaucuaccuuuacagcauccuguugauggcaguggccaucauuaauaucaaagcugcugagucgccagugggaaagauguggaagaguuucagccuaagaacauuccuuccaaugugguuaacagucuuuauugagagggcaauuugacacugaguuuuauugugguuuaaggacucuuuugaggauuauaaugguugcuagugaccuaugaaagccuauuaaccuugccuuagcuuuuguuuaccagugguuaauucucuuacacacuuaacaggaguucaaggugcagauugccccgugguguguaaagaaugaggcuucucucuuacugucuguggagcccaaaucuacucccugagccagcugacggaaggaaacagcccugcuuucucuggauuguucucacuugcccaggcucugugcuggcagcagagaugguacccaguguugacuguacuggucuagcagccauagacaacacuucaucugguucucauuagccuugguuugucacgaauccagcccaggccagugguuggucugugcucacaugguuuaagagaaaggucauuuccuagugaaaacuagagcauuaaagugaagcaucucuccaggaacgaaucagucucuguugaaacaaaaguagauaguugcuucaguaaguaaagagaaaguuaaguacuuucuuccccgauucauuugaacuaacaucgauucaguaaaucuguaggcaagagaacauacacacacacacacacacacacacacacacagagacaaauagauacagauauagauauuuauguagcugaccgacuauccacuuauucauuuauuaaaucuuuuuaauauugcaguauucaaaauuuuauuuuuccggcccacccagggauucugcaacaccuuuuauuccuucuucccucuccauuugugaucacacguguuacuuuuggugucuuugaacaaagggugagguccuucccccaggagacauuugucagaaguguugcuuuugcccucugcauggugacuguagggaggacugccagcugcccuacaguauguagaguggucucccucaugugccagagaggcaaauucccacuacaauuuagcuccaagccuacgugcuuccauucauugaacuacacagugagagcuacuuaaagcaguaaggcugggugagccauaguuaacugacauaccaaauuccucucuuucuuccuuaagauuccccuaaauaacccccuguugcugccugcucacagugccccugcugugcugcggcugcugccugcccucuguuucuucauuauauucaaggcucuguuuccaugaucacuuuugguuuuuuuacuuccccuagcccaucucgccuccuaucuaguuuuucuucauaggaucuggcgaaaaguucuaaacaguauacaacucuuagaacaucaauauugaauggaaagcaggacuccuuuuaaagcaucagcauuuuaaagccagcuuggcaaggcgcauuugaauagcacauuaugguuacuuaucacaaaucaaacacagcacauugcuucaagacagauuauuuuccaaacuaauuaugacagucguacuuccugcuguuuuucuguuccuuuaugucuuccaucugaagugcauuuuuuucuuuuguuuaacucagcugcacgcucuugugugggagcucuagggucagaggccucuugcugccaguucuggucuccaucaaggcagcugaauuagcagcuugcagcaucucacacacuaaacaaaacaacacaaacagccuaugaauauaaguaccuuagcuuucuuugauauuuguucagaaguaaaauucauuuguauaaucuuucaaccauguaacaauauguuuuugaugguggaaauuguuuuauaaauauuaauaggcaugcuuuuucuccuacuuuauacacagauugguguuuguucaagaugaauuuucuguagaauugaaguuucaguuaugugacacugaaauucuuaaugucucagcuaagugccauuaccucagaaaacagauucccccccccgcgcccccccauaguugugcguuguugaauuaagugagaaagcuaggguuugagcagauggggcaaguuaauuuucuugcccugauguugacauagccaugcgcccaccuguggcccagcagcucugcauguacaagcaggagucaugcaugaguccaucagugugcguuguuuaguuuguucucauuuucagucuuccugauagcaggacauacuuaagccaaggguguucuugacuagguaagaauauuauagcugugggugacuaccaaucuguuaaagcaagauagauaagauagaguuguguccaaguagggauugcuacaaagugucagucaacauaugggugguuguaggcuuuguggucuauacugcaguuaccaccuuugcuauuuuccugugaagaaguccggacacauguaaaugugcacacacauguacauagaaaaacagguggugagcuugagugacauaauuugacaccucugaugcagauggccaugugaaacuuuuugugucuuuagccacuguggccauaugcaaauguaugguacaauuugacuauuaucaaaagucucacauccuuuaacuaaaacauuucugcccugacaguuacucuguuaaaagugcuagucauuaaaauucuugcuuuugagaaaguucuuaauguauuuaaacgauagcuaaucaaguaccucagggagccuggacacaguuaaaucuccaauagacauucauuuauaucuccuuuaaauagaaguuuagggauauuuugggaaugagacagacuauaguaauuucuagagaugaaaagcagguucuguaaacugagcuauaaugaugggaaacuacacaugcagaaaguaccauguugguaaucaugcuccccugggaggcuggcugccacacauagcuucuccuuccuccaacaccacacaguaccagcaacucugaucuuguuuauagacaagggcucugagcuuaagagaacuguguggccagggcuagcugcuuagacuacagcacuauagcuguguccuugaaguauguguagcaggcuucucuccuaccagaccacuucugugaccguuucucugauggcagcuagguauccuacucuucaguucuguucugacacuggaugccuauaaugagagucagagucacauagucaggguccugucucauaagacugaugcccuccauugaugccagugacaacaguauuggggaccacgguucaccugaguguucucacgaccugcucuucaguuguggcucauugcauucagggaaacacuuacuacccguugacagaagcaaaggacauuuuaaauuauuuccagggaaguccgagggcuguagagcucuguauuaagaacagagcuaaaaugccaaguauuaaaaagaaagauccacccaguaggcccauugcuuagaacguuacaaguguuuuaugaucucugugccaagaauuggaguugaaaacugcugucuuuaucacuugaaccccacccuaccucaccacucauuuuuuuaacugcaaagccauuuuaaaggcucuggcucuggggacuuuugggacaugggacauagcuggcuggaauaauucacuagaaguggacuuuugaagguuuuaucuauaccagguuccugccucuuuuuuucugcuccccgccuacuuugguaugaacagccguaaccacaccguuccacugccacagcugggcugguuaacggcaccuugccccuaggauggacggaaaucuccagcaaagcacauccuuccuuccucaaguuauugccaucagauacguuguccuagucauauagcaauaacugaacagagcaaaguauaugagagaggggguagauuagagggaaggaugggggagggagagagaaacggagggagggagagagauugagagacagggaccuaaacucucauguuguacaugcuuagaccacacuggauuuaacuugaaaucuuccucacucagccuccugaguauggaauucacagcauauaccaucaggcccagcuuggcucugacuacuuaaauauccauaccuaacuucauaguugugcaggaauuuuaguuucccaaagcucuuggaucuacacacauugaucuguucuuaccacacagguaacaaguuacuguagcacaaagggacauucuaggugcucacacagaccuuguguucaagcccuggacugccugucugguucucaggcgcucaccaaccagaagcuccugucugcacuuugcaugugcagcaugacgcagagagaaucuuuggaaaguuugcucugcaggccuuugguggggacugccugcugaacuuugcauacaucuccauuaauuauccuuucgcuggagcugcuugcaacuguauucuuuauaauaaggggcaaaguuuagcuuggaacuauuuugauuuacugguuuauugaucuugaccaagaauucuuuuauuugcaagucuucacuuagaaagucaauuugguagccuuugcccauucauuuugaaggugucacuuacaaguaaucuugccagugaguaauggaggagcuaaaauuacuaauaaauuaauuagaauguauuuauaaacccaguggaaagccaagaaugaaguugcuuuucuauugaucauuauacuggucauuaacugcugagaaagugccuuugcagggagcaaagaacacaggccaauuccuuugguaauugcaggauuccuucauuacaaccucaccauuguagaaauauaauuacucauucacucucuguguucauagugugggcagugguugggcaguuuguggcaagacuagggacuuaagcagauaucagcuuccauguaagauuuucucuugucagucaggauucauuuauggaauuuuuggccuguuuauuuuucuuccaagacaucuuaaauguuaauauauacccguucugucagaacugcuccaagaucuugagucaugugcaagagaaccuggaagaaaucuuccugguaccugucaaugccgggugccauaaagcaccaguguuuucuuuucuuuguaagcaguagaauuaucuggcuaugucuguuguuuuucugugagguacugggaaaggaaggcucccauuucagaugugaaguacuucucagcaaagcuggcacaacaucuguaaauguugaccaaagacaucugcuuguucauaucucggguucaauuagagaauguuaagauggcacgguggcacagucaacaaguuugugcugcaaggaaaauaauaaacauguuggaguccagauaccacagauguuguccucuuucccaaagccauccccuaaguguccucuuugcauccuuauaaucaaagaagcgugguaguccaacccugccuuagagcgagcuuugcugugugcagagcuguuuggguacaacaugagaucugcuucuagcagaggauguauaacgggggaccagugaugucuggcguuugagcacuggcagaccugagaagucauaaccagagacaucuaccuggguuaaguuagucuguagacuagggugggaauugcauucccuguucuucucaagugaggaagccaaggcccaccaugaauagagauagucuuaccaaggcuacaguguuagugauauauacuagaaaugguucgaagagcucaauuguguuuucuccccaaaaauuaaggcagaaaagaaagaaaaacucugagacucagauguguaaaucuuauuccugcaauugucauuucaaaauguauguguaugguaaaacauucagugcaccuuaaauauauucaauuuuaauugauccugagaggcaucagaauuaaggagcaauuuauaaauuguguauucuggcacagcauucacugucauuaaguuuagaaguuuuagaguuguaagaggguauugauaaaauucacauuuugucauggaaugucgggacagaggagaaaaagagaacuggcauuauucccuuguuucuuccugcauaaacgggaaaggcagugcucaccuguucaauccaacuguacauagguaaugcaguuccagcugugacuccagggcaauugugccaacugagccuguuguggaugccggugaccuuuguugucaacugagcagagacugacaaaugugaauuacugucccucauugcuguaauggaaguccccucagaccaggaccuuguccuguuugucucuguagaguaagaguucacaggucaagaaagcaucagugugcuggagugugagagaaugagaguucccgccuuccuuacuccuguaccugcuggccugaguaagucaguguauugacuccaaagagacucagguauggccuccuuuucucuuuguuuaguugucuguuuugaugccaagauaaacuuugaugacaaugcugaguuccgacaaaaggacauauuugcuauggacgacaaauccgagaaugagcccauugaaaaugaagcugccagauacgaucucaaguauauaggacuggacgggaacauugccugcuucgguaagugcuggcccugaggcuggaguuguauacgauuuaugaaaugcuauuuacuaagagcuguuacaacagguguuuucuuauagcaucaaguagaaaacaguuucaaaguccauuuugauugacagucacugauuuaaagcaguuuuucaacucuggcacugcugcacuuuugaauuggaugaucuuuuauucuuagagaaccguccaggauauuagguucagucguauuccucuccuccagaaauagcugauaauuguggaaaugaaacaauacaaggaaagugcccagaaguuuccaggugucagguguacaaaugcacuccagauaagaacugcugagaggcuggagagacggcugagaguugagugccuacugugcacaugugaagaucugaguuugagucuauggcacccacauaaaaacugggcaugauggcauauguugauagccacaguagagugagagugggaaguagcuggauugaggggccuugcugccuaccaguuuagacaaucggugaucucuaggcuuauuagugagagaucuaucuuaaauauaaaguggagaaucaguagagaaacacacccaacaccaaccucuggccuccacacacaugugcaugcguguauacacacauaugcauguauguauacacacaugcauguguacauacacacauaugcccauguaaauauauuauguauuaagaaccauugauuuaaagcaucucaacuuuuuuuuuuuuaguaaaaguaacaacuuucccuaugccuucagcauccaucuacuaggaacgguugauaaacuauacucugagacaaaaguacauuuucagaguguauuaguucccuuucuguggcugucacaaaacauucuaaccaaaagaaauuuaggggaagaaaguuagcuuacaggccaugguccauuaccacacuugcaagcucaauugcuaguuuauucuuauacagcccaggaccuccugcccagggaauggucucacccacaguggacccuccucuaucagucaucagucaagccagucagaucuggauagucccacagcuuagacucccuucccaggugauugacuguaggcuguguuaaguugacaauuaaugcuaacuagggcacagaggagggagcacaggauauaaauucuaaucaauucacuaacauuucagauugaaugguaaccaguugccaaaauacuuucauuaugccaguuuauuaaucaaacaaugggcuccaucacaguucucuaauuuagugaaaauggcuucugcagcugagauaagaugugucuguagaggcaauacaauuucaguuauuguccauggcuucuaguguuugugauuuguaugcuuccggcuuaauugcacaugacuguguuucugcuagaaacaauucauugcacuagaaacugaggucuucaucuuaauggaauuaaaauaaaaaagauuuguugcucauuaaaacaacagcaucauuauauuaagaagugaagagucuucaacaguuugcuguucaguacaauggaaaauggcauccuauuacaauugauaccuaaagugccugcuuuauaugggagcgcuaucugcauagcauagcucacuuacacccucuuggcugcuguagguaaaugugcucauaacauguguaggcaugggaagggggcaauucaggguguguuuagaacaaauuaaauacagauuuuucuuggaugaauguuucucacaaacucugauuaagaacacugcacacuacuuggagaucuuuuauuacaaauacccuuguuaugaugggcaagacuuacuuuauuugcugaggugccuggggacacauuaacccaccccaggauacagguccccacucccucuuuuuaguauccccacauuaauuaaggcagucccaguuaccaggucugucugggggaaucccaggguacuuuacccugagugguuugcugaguuucuaugccuucucccucaucaccugaggaagguaauucuauaauuaagcauaagaagcaaaagaagugcaguuggucaauaaccauuagcucuaaaagacaggaaugcccuuguaaauugcuacgguaguuccuaagaaaggcuccuaacucguacuuuuguucuagguugaauauuggguuaguaaauaagaucuugucuuaaguuuugugauuacuuuuuaaaauuguuuuuagauauguguguauauauauguggcaaguggugaggaggguguuagaucucuuggggugagccuaggcugggggguaagaacugaauucaggacuuguggaggagcgggacacgcucuaaccacugacccaucucuccagccccuugguauugcuuuuugagacagaauugcacugugcccacauuguccugguacuuccuauguaguucagaguggcuugaccucaggcuuaccuucuuuagcuuucugcgugauagggcucugggauguuaguguaagcagugugcuucuuacacuaccuuacaggggaaggagcaucaaggcugguuugggcccuguuguuucucuuuagagcugcugucgaugagcucaucgacauaaugcaugccugccuaaggugaggaaagaacagaccugucagacguugguuuagucccgaagguugcacauucagagagcaucuccacagggacaagcuaaguauugcuuuugguucacauaauuugaauggcuagccacuccucacagccauaauuguucugcccauccuccuaccugcagccuuuucagaacucacagccaaauugguuccucuccuuaaccuuuuugaguuauugaugaauccuccucauuucucuguuuguuuguuuguuuguuuguuuugggauacacuuaucccaaauuuuaaccauaaauuaguuuaugaguugaaucccaauucaggguacagauuggccuagaaaugauaguguucuuguuuggcccucaguguucccaccccauuuccaugcuguuuguuuaauguuuccaugucacggaccauuugcauuucacagugaauggugcugggcuggccauggcuaccugcgacaucaucuuccugaacggagggaagccagcgaacuucuuggaccuuggaggugguguaaaggaagcccaagucuaugaagcauucaaacugcucacgucugaccccaaggugagguuucuuugguugggagagggcacaguauucagucgccugcuuccagaugauacaagagugaaaaagcaaccuaugcuuuacagccucggguauaaauucugcuaucuauuuauugcucuacaggauacuuugacuuuuguuugguuaaaggcuuauuagcaacuucagggugucauuucagaaacugugcccacagucuugggaggggaagagaacacaaagacagugucgaguaacgcugugcugucgacugccguguaugugggugauugacaccaagccucaguccuguguuuacaugacuuagagacucagccucacauuccucuuguaaggauccugaagauauuaccagaguauuagaaauguauauaauuauagaaucacaggucacaguguauaauauauggaagaaauaauagccugacuguuuauguaggugcuuuaaucugcagccuuaauuaugacaguuggggacauacagauuaaguaguaaauuacuaaacguaguuuucuaaauucuguuauuuauauaaaucuuuucuuuuuaacagaguagcagagugggauauaguaucacuguggccagcuaggguacugcaggugucuaaugaguucuuggcuggucccuugcuuuccuguaauuguccuuucuuggucaucagggauaauagaccuaaacucaacucuuauauacaaugucucuauuuuuuaaaaguuuguacuuuucauaguucucauuuaauucucauaaguagccuuggggcuaacuguaugcuauauucauuuguauuaaacuucauucaagaguuguuauccgaauaucguuagagcacuuaauagauuuuguugguuacuaaauuauuuggaaacauaagaauucuaggccagcacaaaugaaaacaagccagaguucucccucaccccccaacuaggacuugcacuacagcuggcuuccugcggguccuucucaggaagaauuguacuggcaguugccuguuugcauucacacacauaugguuccauauauucaauaugcuugucggucuuucuugugcguuuacaauugcuaaggaugaucuaccuuacaauuugcuaacucuuuucuuucaauucacagaacgauguuaacaugucauuacuuacuucucuccaguucuccaguguuguccaggaagagcaaagccagucaguguaguguaaggcacucauccaucaaagggauuugggggaagaucuguuccacagccgguguuguuuaggguguuguuguuuaggguguuguuguuuaggguguuguuuagguuuguugcucaccguggcucucccauccuuuugcuggaacauugccuucuucaugcuuccuucuaagagcagagucauuuuccuccuagagauccccacaugaaggggcacucugaggugccacaagcaugugccugucucucugacccaggagguagcagaggacauuggucagaaucaagcucuguuuguuaacacugugagauuacuugccuuagagauggacagccacugaggggucaggcuaccaagacaagcagcauggcuggucuuugaaacaucucaguagcuauucuugaauuuuaacuuuauaaaacuaaaggguguaaggaauuuuacaaaaugacaugcagagccauuuuuauuguuuuuguuuaaauagucucuuaaaaaauuugacuuuaccuuauggaauauuuucaaguacuuggaguguuucaacucuuuugagcuuggcugucauccugggauggauaaagggauguggaaguuauuuuccucauacuauaucaggaaaaugaaugcauagcucaucucccagaacauuuuccaaaccuugaaauuucuaagcugguuaaaaaucauggaaauuaauuuguguuuuuaauccuuguucgguucuugcaagucagagaacaguagaggggggaaaaaaagacaguacaaaacacaaccaaaaagggacagaugaguugacuugauuuugcaaagaaacagcuuguaguucuggcaguaauuauuucugauagagcccuguccaccugccucgaaagagcgcuuccaagaacucacaguuaauuauuucaaaguauugucuuguuagauaauaagaauuaauucacugaaacucagaauuacgaguggcuuguuaguguuaaaccaaauccagacuuaacaucucuguguuugucguaacacaauauaacuuuauugguauaguaauaaacauagugucauuuaagaaaaaugcgacaaauucuguuucuauccacagugugagccacaccucugaauuguacauuucuuuuucucgccuaggauaccugaaugcuugauuucauguuuuaauacaaacaucuguacaagaaauuuacauauuuguuuauagcacauagcacugaacuccuugaauugucuaaaccaagaguccucaguuauucagcugauuucacaugaagucuaucauucagugucuuguucuuguauuuuccaucagggcccaacuggagagcagggugaugggguuugccugccgcuggggguguaggccuccucugaucuucaucuccauuugcagaacuuugaacuggauucuuaaacacagaaguagauaugacagaaagcagaguuuuguuguaaucuguuaaaaauuuggacacauuucaaagaaaagucuuauauagaauguugucuuuguuuuuguuuuugguuuaugcuuuggcuuguauuucuaauucucaguuuagaauuccauauauagcaucuggccugugugaaguaucuugcguaaaugaauaaagcaaaggccaguuggcacacuuccaucaguaaccccucuucuggcauguguuaacugagucuguuggccucuggggaccuucuugugagaaacaagaauagguagguagccuuuaggcuguuacagagaaaguagacuucugaucacauuaagaugucacauaaguuggaaaugcauaauuacuagaagaguuaaggguuuugcaguauuuccuaucauucucccuuuucuaccaagagaaguugccgaauacaacaacgaucaaauaauggccgcagugaugucaagacuggcuggcucuuccaaauaacaguuaauagucucacgguggcagggcaucuaaaagugucacucuuaucauggagguuuuauucuagcauguaaagaauuagaggaaucacuaaaugugagaagcagccuuaggaacuugauucagaaaaacaaggugaacugccuuccacagagauuggguuuucccaguugcuguggauagaagcuauacuuuggugagcugagccccauggaugcaggaagcugaggugcagccccuuccucacugugccaacacuucuccucaccgcugccaagggagugggaauuagaaaagaucaucuugcugugaagaaagcagcaugucuguacaguccuuccuacaaauguccuggcucauuggugcgcugaggugucaugccuugguuuuccugaggaaauguaauuccuggggacccauugucucaauagucugauaucugaagggaggggugcagauuucccucucaaauuucuucauuccugucaggauaguuacacucaagggccucauuauagaucagggaucguccuccaagccacagaauguaaagagacaagaagccacuccaagcugucagcacacgugacugauggacuguauagguaggugugucgagucggcugugggcacugagugugaagccagagugauuggaauccugaccucugaagcugccaccuucuggacaggaaaguuacugagcaaacaaauaucuaaugggaaacaaauaccaaaaaacaggccaagcaguuauguguggcaaugacaucagggccugcuaucuccaucuucugcagaaagcccuuucugcuaguuuguccugguaggauuggagucugggguuuauagucuucagcaaggaugcuaccagugagucuuuccaacaugucuuuccacuaggagcuauccuucccucuuuucuaguucuucacugucuuucccaguguccugggcagcagggccuacuggauugcagugaguuacauuagaaguaaggcaggguuggggaggggagagagguggggaguaguugacacugcaguucucacucuaauuuggguggccccgucuugcaauuaaagaacuuuuuaguaugccuggcuauuuuaucugcauuucugggacccucuccagaggauacuuugaccaccuuugaggucuuacgaacuggagcauaucgaacgcacauagcagcauccccaaggaccaguuggcauaaauccugguuaauuauuuuccucccugcuuaucuauggcuccuuucauuaaucguuauauguaagcauucuuaaaacauccuuuuuuuuuuuuuuuuuuuuuugcaauuagaacuuaguagagucuucuugagcaaacacugagguaacuuguaguaccaggaggcuuuuaggcucagauauaguaaacagaaaucuuagaguuuuaacccuugcccuucuggauuugacuuacuugagaucaaaacaaaagugacuucgguauuucaguguguccuugugacccagggcuguuagaauuuggauagcagguaagagaaagucuaucuuguauuuagggcacuguuagaaguuucucugcauguuguaaccuguguucacugguugucuuuuagaaauggagcuaauucucuauuaaaaaccaaacuaagcaauuaaccccagugcugauaaugcuaaucagauuauuugauauucaccaaaggagggaacaaaagaaauauuuuauauucuccuaaggaagacgaaggaggaaaugaaaaaauucaaguaaagaaaugugcaaagaacuuagcccuuauggucagaaucugugguucugauuuucuguucagauacaaccuuaaaagcacuauguagaaggaguugcaggguuugagaagauggcauagucaguagagcccuggccaagcaagcaagaggaccugcauucaagcaccuaguccccccauaaaaaaagaaaacaaaacagccagccagaugcagcaacauauaacggcccuuccagcucuggggaggacagaggcuccaccugcauauauaucuguauacccacauacauaugcacuuaacauaugggcauguauacacacagaguugugacaauuagccaaacauuguccaaugcccuagcuguauaagguuucaggaaagaaaguaauggccgccaccauccuagauguauguuuucauguucacuuuccaacgcaggagccccugaguccguccaacugacaaccaaaaaauacuuaugagucaccugugauuugccaggcauaggccaacuaagaacugcauggcugccuauaaucuuaugcuugcguucccacagagccuuacuuacugguuuuuccuuuuacaucaucccuuuaaaacaguggaaggaggcccacaaaagacccagcacaguguccgucucucuuaaggucaugucucauuguccagguucaggaguagcauggaaucaucuguggagccuuaagagucagcgugugggcuagguacuaccaaaguggaccccucacuugaaggcuguugaaauguagacucuuguuuucucaggguccagaccacgcccggauaguacaacucccugauuuuuuuguugcaaaguauuuuauucaucauuuccuuaggguauugacugaugucagugaccucccagccuauucaguguaagacaaacacucaaagugugauggggccugucaucaacuuguaaaccaguucuaugaauuguuuuaguguaccauaagcacagaugcugagcacaagcaguuaagacacuuuuacuggaaagcaccauuguugugacaugcaaauggaaggugaauuuccuuguaauuuauauguugccucuuauaagaauauuagccugucacuguuagugaauuuguucaagauugauccuucaccacagauuaucugagcaacauugcaccgugacuuuacaugagugauggccgucugagaggcagcaugguaagccgguuuguuggacgaucugauacuacagucauuugauuagaggcugugguaaucccguuuuccacuugcucuugccucuugcucuuucuccugauuguuucuuuuguuuccuuggggcuacuuuucucauucccugucauuuugguggcauauucuccccauugggacauuccccaauuucgcauguaagcgcagagcccacagaguaugcucaagccugagagauuuauguacuaucucccuggcauaguagguuguuuuuaaaguguuaggcacaggcucuucagacugggcaccgaagucccuuuaugacuuucccccagcggcuuagggauagggcugccugccuuaggaucgugagcuuguauaaugggccaggaggcugcacuucuggacaccuccaaagcugugcaagauucagcacucaaguuuucucacggggccuccugugcacucaucaugugugcaucagcugggaucuccuuuacaugcauaucccaugcaugaccuaaucuagacucaacugucucccugauccagaagcagagcuagcauuuauucuaacaaacuucagaggacgcucauguuggcuuaagcuugaguugcagccucagcucuguuuuguccccuuacauuagagucuacuuuccaucauugaugucacagcccguccucccugagguagguuucucugaguaccagcugaccaagccacauucaccucagcauccucucccacagagcuccaggcucaacucuguuaacacucauuugucccccucccagugugcugugacacccccuucuguuuuauuuuuuucuauuccugugucauaucugucuuugaaauucagaggaaauuaccauucgaaggugccuuuucuauccaaggagacuggaggggaucuuacacuuaaugaagguucaucagugaguucagagacuccuucccucugaucaguucccgaauggagaacucguguuuuccuugucugugcagguagaccauaauaacaggcugugucagucucaagugacuuucuauaaacuuuaugaaauuaccucgucucaaguguagucacugaaguggaucuuauucacuuuugucucuguuaaguuaccgucggcugcugcuuuccacccgagacuucuuugcuauuaugugcucugugcauuuacucucuaagcacuuuucuucuucccucuugauuuguaaguguuuggcugugauucugucucucgucuuuucuuguuacagaguacaaccuucauuuguuacccggucccuuuugcuauuuggggaaagggaaguggucagauguuucuguguuugaaaaaugucaugauaaucggcaguuuuaagaugagauagugaauccucuuuuauguuuggucaaggaaauugauuucuaauacuguguggcagaggucuuugcugaguuuuaucuuaagauaugugaauaauaaaaaaaaaaucaccauuuaaaaaaaauccaauguaauguuucuuuacccuaauggacaugcuucuuuuacaaauuauaauuagcgcgucagcacaggacucucuguagcuucuugacccaugucugucaaccauuauauagaauuuggaauugaauucuuuucuguccugucuucagugugcaaaugagcccucggugcuguugccuccauuucuauacuugugauaucagauguucaugcaucugucacagggugaaggagagaagagaggggauauggccuuguuuucauucuacagaucucuaacucaugauagccacacgcaguggcgacccaugagaggagcagacuccaaacauacccucacaaaggaaaaacguagcccagauuggucucaagcucucuguguggcugaggagggccuugaauuucugaaucuucugccucuaccucccauuugcugagauuauaagugugcaccacccuaccaaugcauguaguguaaggggcuugaucucagggccuuguacaugcuagggaagcccucuaccagcugaguacauccccagacuugcagagcauacugauaacuaucuuuagcauugaaaaucccuuaagguacccgguccugacccuccaugagggaugugcccccaagccucccucuggaauucuuguccguacagugauggucauagggucccuucucaguuuuacucaaugaagugggcuuuugcuuucacacuuguucucuuucuauguacauguaguaggauacauauaacaugugucugacccaagcauacaacauauauucuauguccuuagaccugccuggugccaccucagcucaccaggcgugcugaguacgcugguuggagugcuguacugagucaggaaugcugagucagacauggucccucuuuagccuuacucaggcuucauggaucaauguauagacucauuaaaauuggagaccugugaauuagagugaacauuggugacauuuuauuaauuagacacagauuuuuaggagagacagagguggaauuauugaaaugcaugucguuauccuuccuccguguguuuugguuuuaugacaugguggauuuuaaagugaaaaccaaucaucacuguagacugugagaggagacaaauucaugucacaagucaguacauguggugggcugugcacugaauugucuccggcuuagcagaucgugugauuuaaaggcucugaacugaagucucucuuuucauuguacacauauaauaggguggcuucaggcuggcaaguuacgggaccuuggagauccccagcuaacaucugugccugaaguccacccccacccccaucccucaagacugcuuuaagaguauguucuuuugguuuugguugauuccucuuuaaucugacgcacaggcuuuuguuccuggaagacaaaugcagaggauauuuuucuacaauuauuauuaacaacaaggaaauauaauuccauuuucuuacaaauuuuaaaaaugaaauuuuuguugguaagccuuugauaccuuauuucuguuagcuagauuuaguauaauuuuuguuucucuguuuugcuaaaacauaccagaauuauuucuacuccuuuaacacaucagaguaguaggugccuuggauccuaggugauguuuugugacaguuguuugucauuucugccauuagcuuauaaggcacugauagaaagcugaggugcugauuugaacucacugcuggguagugugacaucuguugguacuugucaucuuuucugaccagcacaggacaugaggcuuagauuccagagauggcagagguggaggcugggucugucugcacuaguagguccauagccagaagggacagagacacucgaagggaugguguuccccccacccccuuuuauucccugagaggagguuuugcugagcaaagaagccaggggcucaaaagaccugcaucauaaguggcccugacauaugcauggacauugcaaaccaagcagaguucagauaucacagacuucagugaaacacugagggagggcuacauucaaccaucgaguguguguuugaaucuaauuuuaagugaagcuucuuuuaaaacuguuuuaaauuuucuugugcuauagaauuuuggaauugaaugagaccuucaaaaucagaaagaaagcagcaucauaaggcaaguuaaacuugagcaaauacaggaagacuuggcauguucuucugaaauggagccaaguucauuauagcaucaguuaagccaagacccagcuccucaaaugggagcagcauggagcuagcacgccagcaucguuggggauuguagcagcacgguguacucuccagcauguagauguauauggucuggaggguuuuacucuguuagaauguacccauuccaucucgaaggacucugaccgcuggggaaaagcacucaguugcagaggucacugguucuguugccuuacauggagagccagucuucauuuggcuuuuggcaagucuuaaggacuucaugacugaggcugcagauacucagaaacuguaugcagagaacagccucuuucuuucccacacgcaucucgauguuacaaggaagcugggguggcacugaccuuagcucacacugcaauaaugaugcagugucuaucuaguccuaaaggcuuuacacucauggucagaagcuccugcguggcucugggaagccuguuuagaaccacagagcuugcgugaucgauuugguuuuuguuuuuaucauucucuaaaaaaaauuuauuucucauauauauucuucacuaguuaagaaauaacacuguuugaauuuauuuacuuaguuuuuugguggguguggggugaggaagaguaggguacacaggugcugcaaguguacguguagaagccagagggcagugugugcaaguuaggucuuccuuccacuguguggucccagagaucaaacucaggucauuagguuugacagcgagcaccuuugccuguucagccauaucuccuggcugucucuagcuuuuuugaaagcuaauaaauuucagaauuccuuauccacagcauuuguguugucuccuaaauaaugcagaucuguuauuugaugcacugucaugacagagguugggacauacagaaggacacagaagacaauggaucacucauugguccucaguccuucuguaacaguuaauaagaugggcacucucucugccuccacuguuuccuucuguugcugugcacagggguuucuaagagaacuuugauucauuuuauguuuucccacugaacaacaaacugauuuuuuuaauuacaucauuggauuuuuuuauauaucaagauucuuauuaccuguuucagauuccauugugcuuucuuguauuuuacucauuucuccaugcuuaaaauauuuaaaugguuuucugucaccaucauaugaucuccucugagucuuuucaugguguauguuucuaaguaagcuugggaguacacacuuacagucauccuuuuacagauagcucuauugcaguuuccccuuuuuaaccuagcaccuacguguaggggaauuuuauuucucucccuaaaugucucuggugaccacauaucuaacugagguugguugucuuguuacuuuuguugaugugacaaagcaccaggcaaaccauuuaagaaacaaaggacaucccuugcaggauggggguacagccaucauguuaggagucacaaggcagcuggccaugccguuuuacaguuaguaagccaagaaagaugcuggugcacuuauucaggaaggcugagaccccgacccuaauagacuugugccagucacaguagugugcaugcaucuucccacuggaguucaucuacguaaucccuccuguacacacccagggcccagaugugcccauaaaggggucuaacuguuacaggugacuccugccauucccugaagaguuuagaagugauccagaaaguuaaauaggaacccacuaagauguuacuauuuggauuuuaauagaugucuucagagggucuaugcacagcuaaaucuguguaccacccugacaguuggguaaaaacaaauuauggucaccaaggauauuucauuauaagcuaaccuaauaaguauaaugcuaaugggauaugaaaaugacacaauuauaauucuauaucuuauuauaaaucucugacuaccagauguggagauuggggcuaaaacgugacacuucagugcuugacccuuuucagaagccccuuuuuucuuucuuuuucuuuguuuuuguuuuccugagacaggguuucucuguguagcccugccuguccuggaacucacucuguagaccaggcuggcaucgaacucagagauccaccugccucccaagugcugggauuaaaggcguacgccacuacugcccagcagaagucccuuuuuuuauggaaaugaaaacaguaaaauauucauagguauuguugugcaacauugcuuuuggugugucaaaaaagaaaugugauuugaccugucauucucaggcacauguuacgagcauucagaaugaacaaagucagugguagagauaaaucuguuuauaauguaacauguuccuguugcucucucuguguuuauuaagugcgggcuguccaacagugugaacauacacaugaaaaguuugugagaguuuuguuuguuuguuuguuuguuuguuuguuuugaaguguuauuuugggcuugggagauggcucagcacuuaaaaugcuugcuauacaagcaagacgacccacgcuuguaugcccaaaacccacauaaacacgaggcagguaagguuccuuuaguucuagccucagaaugcagagccugggcuaggggaugcucuagaacaaacugacugcccaggcuagcccuauuggcaaccuuucguuuugauugagggacccugucucagagaauaggaggauucugcaggaagauuccugacaucuugacuucugcuucccaccucugggagcacaugugaacaugcacacaugcacaggcucacccccugcuugugaaaagaagaaaaagaugguuucauucauuuguauguauaugugugugcgucucuuucuucacaugugaccucugcagaaagaaguucuuuguaugucuucuuuuuuuuuuuuuuucaugaucuugagugaauacaggguagauaugcaucauggauguguuugguucaagaaaacauuuaguuggcauugauaacugggcuccuccgaaacuguagcauuucucccuggagccagagugugucuuuuaaaaggaaaagaagagcugaacagggucuaaguuuuuccacauggaaaucgauagcggcaagggcagacccacuccauccugucagaugccaucuugauaagcguggcugcuuuccgaguuaguaauggcagaacaucagauuuugcuucccucacaagacagagcuauaaauugagaaguuuauuuuuuccuuccuuaaaagcugcaaaaaagcccuuuagauacauggaggccgucagugcaaccaagccgacucuccagcaagcccuuucaguuaccugguauaugaacacccauuucauacaaucugguuguuugguuuugauuuuuuauuuaaaguaccuauaaaaagcuaaccagcauaaguuugguuuuuuaggguagaguguuuugacagagaugcaacauaaaggcugggcaggagaugcaauauacagaagccucagccuuuggucuuucucucaccacaauuagcaacacaaccuuagagccuacuugucaaagucuaucaugcuggagaaccacccagagagcuggguacagcacauacugccaggugccacucuggauaauuuucuucaggucaagaagccaaaaauugggcaggaaugaguguauuugucacagucucaagaccugacccagacaggaucuugugaacaaauauuagggggaguggcaagggacuaggagaggcuggcucugacccggcagacaggaaggugugggaagauggucugucagucugugagccagacacaaccagaagaggccccaaguuuccuaggacugcaucucaccggguuccauuaaguuggaaauuacagucugagcccagcuaccgcuggcaagcaaucuacuauuugguggagucucaacaguaagucuugaguuacugcaaguggggugagcagagagggggucuguaaaguagugacacaugagugaacaaagggaccgagcaagcagagcagagaaaaagggaagugcagcagcugaaggccaagagaagaacgcugaggaggcuaagcuuaggcugggcuccccucagggugggugaacgaccaaauuaggaguuugggauuuuauucuuagagagaggaguggggagaaagagaaaucucacaaagacuugccacaccaccagaaugaccaaaucuuaggagaggguggggucugcauugugggaagggaacagaggaaauagcuuacugacgugaucaguucuuccuagucuggacaucccuggccacaggcuuucgaggccuuggguuuucuacaaaucccugggcuuuugagagcccuccgaucuucaaaacaucacacuguggauguagccacauagauucagauagcuucacagagcuauaccacuacagccaaaccagcugaaagccuggccuaucagucucguuucuuuuccuauauauuauuacagaaacuguaugcacacugacaccugagggagaacucaagcagaguaucucuuaacauucagagguaacaaagguaaauacaugaguagaauguucauaaauauaguuaccaguaaauucuucccuaccgaucccugucuccccauagcucuugcuggggagauggcucaguugguaaagugcuggccauguaugccuguggaccugaguucccauccccugcauccauguaaaggccaguuaugaaagcuuuaacugcaucucugaggggcucuugggggcuggaguuagaaagaucauaggggucacuagccagccacccucgcaguuggugagcucuagguucauugagggucauugucacaaaaacaauguaugguauaacuaagaaagagaccgaguguuaacccuuggcaccucagugugcacacaagugcacaugugccagcgcacgcaugcacauggacacacgggaaugugcaacccagcauguuaagaaagugggaacacaaguuugcacuuagauuagggcagguuuucagacuccucucucaguccuuaccacgccuacuuugagccuagaggcucugagacaguucucgugucugcuguuuggaccagguuuuagcugagugaauaaagacccaaugguuaaaauuuagaagugugucccuuggcauugaggguacucccauuucagagaugccagacauagaugugcuuguuucagaggagagucugcacauccacuugugauucccuccccccucccccaaggucuucuguuccucuagccuugcauuuccuguccuugggaacuaguaagcccugacuguccaggcggggccauagcaucugcuguaaguagcgaagugauugccugucacucagagcaugcagagaccaggaacuucugcgauugaugcuugacagaauaauuagaaacgugucacuuugcaguaaccauuugagcauuccuaaaggaauaggccagggcaaggucucugcugucuaguccugagguuaaauguucaagaaggcaaaacauagugugucgugggagaaaauugccuuggacauacaggcagagauggccguccugcuccuaaacaauggccccgcguagccagggcuccugcuauuucucuagcucccaugcuguguuaauuccucugcaagguugguuuacucuaucacagggguggcagggucugcagguguguccuugaccuuuguagggucaacauggccccugguccuggcaucacuguuacugucucaaguaagaucacugggacccagcuugaccuuaauaggcaaggggggaggaaaguuaacggagagaagacuaaguuaacuuaugccugcgucuccuuauuuuauaggaaaauaaguuagagaaugggaguguaucuuuggaagaaaaaucugucuccaagucuacaucuuuuauuuucacuacuuccauuuuuuacguuuauguguagggguuggguguguagagaucagagaacaacuuguggggagccuguugucuuuccaccauguagguguagggauugaacucaggucuucagguuuggcaguuagcacccuuacucucugagcuaucucaccuuacugauuccuuuuuaaaaggugaguuuuagggccagcaagaugacuccaucuuguaaaggagugaguaccugcuaccaagacuaaguuaacuuaugccugcuucuccuuauuuuauaagaaaauaaguccugaacuccauucccagaccucucagaguguaaggagagagccagcuccuaacguuguccucugguuggcacacaugugcucugacuguauaccaaugaauauauacaaaacaagcaaauaaugaaauuuuucuuuuuugaucuugaguuuuaauauuaauacuuugacgucaggguuucuucugguggcucugagaaaugcgacacugguuacagcacucuuuguaagcuuacaggagaaugaggcagagaagaaucagcacugaugggccugcucugcucuugacuaacgugcagaauagcaccugagucuuaaaauucggugaguggugcaugcugagugccuggcaugcugaaaaacuguguucagggaaggguuaaaacaucuucauccuguuugucuuuaacuaaagcaaucagaauguuggccgcccccagcuguggcccacagccuuccuuccccuuagguuuccucuauggauuuaguuuguuauuacuuacaagcaaguugauccuccaucuucugcugauuucuuuucuuauuuguuucuuuucuuggguuuugguguagguuguuauguugcagagaaugcguucaaaguuuucaucccccugccucggccuccugacuacuuagaauuuaggugugaaccaccauaccuggcuucaaaugagucuaaaacucuuacaucuagagacugagcagcaaguauuguaaagcaagcuguccuacagcuccucacuuuaucagcgcagacaccacugucugucucagaccacacacagccuuaaugcucacugcuucccuggaagccucccagguucugggcacgggagauaccugucaguucugugcuucucucaaauaggggccuuguuggcccucagagaacacugggugaugccuagaaaucuuuggggcugucaaguuggggugagugagcuacugauaucucgggaggcaaggccagggaugcagccgaacaucccacagaacagcucaucauacugaagguucucagcucagagccgcagagcugcgagggcuugagcccucggcuuuggugauugauuucuguccuugcugugaugccuacugcaugguuuucaaaauacacggggacggguguucaagcccuucuuccucaugccaagccuuucuuugugcugcuucugucauagcuauauggaacccaauuauauuuuauguuuuauacuugccagaacuccagaguuacuuaaauauauaaucuccacuuaagauucaaacagauuuauaaaguuggcagaagaaagugaaacgagcuagcuuccaugaucagucuugagccuuguuugggguguuaagcucauguaccauguggguaauuugcuaauggucauauuuugguuuuaguuccuuccaucucagugcuagggaaagaaacauacaaagacauucuauuaaaagccaacuaaaacaaaggugcaguuuuagucauagaauguucuguccuguauauauuuaggauaucuuucagcaggaaagaacccagaggacaggauaccuggggacuucaguaaagcaagccagaccacaaugucgagcucuggggcaucagguaaauugcucagacccugucuugcuucuugccccuugcaccccuucuguggugugguaccuugcauacaugugcagggcagugugcacacacauuuaaaggccagaggacaaccuuggcuuuucucuguuaacagggauccuaucauuuccucugccuuaguuuaccauuucacuggccuggaauucgaugacuuagcuggccagccagcucacccaggucaucugucucuagcacuuggauuauaauaaacucaugcccccuugcccaguuuuuugagggguugaugugugauaguuguguuuuucuuuagcaguucuggagcucuaacucaguccccaugcuuguacagcaagcuaucucucuccccccaggcccagugaaaaguccaagaagaugcucgcugcuacagucccagucagugaguucccugcagcuggggcugcuuggcgugggucuuucuuugcuucuuccuguauugugugauguuuccuucccaaaagacuguggguuguuuuuacaaucaagucagcaucacuaagguucaaagccagggugacaugccagcuuuccuaauaucuucucuggacuucuugaucucuaguuguuaaaauaacauuuuuugcaaacaaacccaacuauugguucauagauguagucagcuguaguuauuguacauuaaagcacuuucacucuuugaacuugaguuuuuguuuuguuuguuuguuuguugguuuguuuucuaacauuauauugaguuuacauuauuuucuguaaaaugagacuucuuuugaacucaauggggugaugauaacgcccaggguggcaggguggacagaauuguagugagcagcccuaacaaaguccucccaccucuaugacuaguacugccuucauggccuggacuucaaagcuccacaagcugggcgugguggcacacgccuuuaaucccagcacucgggaggcagaggcaggcagauuucugaguucgaggccagccuggucuacaaagugaguuucaggacagccagggcuacacagagaaacccugucucaaaagaaccaaaaaaaaaaaaaaaaaaaaaaaaaaaaaaaaaaagcucuauagauugguuaucuauccaugauacuaaagcacuugccauauagucugcugcugaguaaacaguggcauugauaccagcuucugcugucacauucauuaucaccauuguuguguggcuggcuuuagccagauuggaauuuuuacucuaaacuccuucaagauuaacuuugucaccacagaugauuuugaucggucuaccaucggcuacgaaugcccugaaucgggugguuuacuaucaaggcauuacuuugggagugaaaaaaggggacucuugggauauucagaaucauuuuuuuuuucuuccuuacuggcugcccgucaguggaaugcaaguccuuugauacuucaaaccucccauuuagcuggguagccaggauccugugacuuccuucuggccuaugagagauaaacaaaagccucaugugagacuuguggcaagauuaucuuuaagaaguagaggcacccaaauggagcccuucugauucuucugugcucuucccuguggcuugggaggcuuuuguuaagcaagagcuuaugcagccuuucuggccuagaggugacauuguaaugauacacuuuuaugauagaggagguuggcuugggucuuuccagcccuuggagguaccgucagcccaacuuaccucuauagcuaacauccugauacaguccuugacugccaggccucaauggccgugccuucuuuagcuuguaauggaguucuuauagugucuuuauuuuuccauagucaaauccuucuccauuauagcacagauaaaggacugaaguuugacucuugagcaacuccccaagcagaagcuuuccuaauuaggauggauggauauaagcuguugcuugcucuaugaggcagguuuagagaaggggcagcuggccuuugcaguggguuuccugccugcagcagccuaugugugcccaguagcuccacccacagcuggugguauuguacuaccaguacacaugcugugaaguuuacuguuaaguguggugguuuccugacggugcuaccaauauucccuuagagcuuuugucccacuuuccuucaaacagauggugguagguuaagucgagugggcuuuucauauccauucaguagagaaaguccacagagcguaugucuacauccuagaacaccgaggugaaugccuguccuucuauucaguuguacuuuguucaaacauuccauggucccuuaacuagcagagaaagaggaaacuguaaagcuaggacaacuaauucauguuaaaacaugcauacuccaaacagccgcccucugaaugguucacuggccaccaagacagcguggaggccgaauuaagagcauuugaauaauugacuuucuaugugaauaaauuagaauagauuagauuugauugaccauauaacaauuuaaaucccuaaaaccaaaaagccgcuuuucucuuucuaggcuacuuuguaauguugugugucaaagauaauuaaccauguguuuuucuuguuggaggaguuuccuaaacaaaaaucagcugacuucagagaggauggaaauauuuacccaugcuauuuccuuuuuuaauugaagaucucagaggacugagagacauacugaguuguugggagcccagccagaagaauagcaggcucagagcaucuuggugugcaucaugucuccucugaccuguggugugguccuggcuugggauaauuugagauucccaaagugcuuuguuccuuucugauggcagauguaagcuuguaugcaauacacugugcuguccugaagaccauacucuagugcugcagaaacaggaggcacacuguugagucaggagucauggugaggaaucacugguuaguuagacacaaugguaaggagacacugcagaguuagacacuauggugaagagaugcaaagccaggaauaggaaauguccugcccucaucucagacuugagccgaaauguguuggcuggugugcagauuuauuauuucugucuguucugcucuugcuauccaaggucacuuaugcuacugaguauaucucucagcuggcaugcuggauagaggaugcaugccucccucucccucugcucuccccaaggcccuuuccauggccuuuccaacagaguaagacuucucacgaggcaccuaaggcuuuccagugaugaaagcugacagccaggcuuucuagagcauuggcauggagcagcuguagcacaucuucuagggacuaaaacaguuagaguagaaagggcugaaggacauaaucgaggugauaggguguugacaucagccuaacagacgacuccacagacaugccaccgugucugaugcccacugcuggcccagugaaugucagcacacuuuucugauaauaggauuagauuaauacugaucacugguuuuauugucuuucuaaugcaaagaagacauggauggaagaaacuuggaaauuuuaaaugacuuuauuuugcugcaucuaacuuuaagacacacuacuauccacaguuucaugggacaucugcuauaaauuaaauagcaucucuaauuuagcaauuccccaauuccccaauccaaguagaucugaguuggguccagagauuuuguuucucaaaaaaaguauaaaauugagaaucaugaaaugagaauuguucaaguuggaauggauucuaguaucuuccccaccucaacccgcaacugaauaauuuguacauuucuaaugccugucacuuagagcaggcuauuuugggaagaagaaacuuuacaaaucucuugcccugcagucuugaguacuguccuguacuaggagaauuuagugcuguugccguggagagcaacacuuaggagugggucuaccuuguguuucagagcccacagucaugaccauuagcaucccaagauggagcccaggaggcagccagcaccacugcuggguuagaagaaggcaguagggaaagcgguggguccugagcuuuccaugucugcuuauuaucagggaaucuuaucuggcuuacuuguacauuuuuucaucuuguaaaaacucuuuuccuuauuugugauguuaaccuugcauuuacacuuuucugcugucuacuacaugaaagcauaaagaaaugggaauuagacucgaucauucuuguccauguuaauaucaugguggguaucagccaagaugguucauuugaauuguuuuuccccaggaauuuuuuuuuccuuccuggcaacuaugugcguuugcuuuugaauauucagaacuggcugucuucacgaaucuuucaaguuuagcuguuuugcuugagagagacaccaugguguauucuugcuaauguuuuaaacuuaguauuauuuauaguuucccccugagaagucugaaauuuaaaauuucucuccucccugacucugaugcuuuaucaucuagcuugcaauugauucaccacuuugugcuucuaauggagccuggaaucgacaugcccacaugugaggucagcuaaugucugugccccugcagaccaggaacagcacaguagcuacauucccaucaucagcuccaucuucagcacuagauccagcucaguguuccagugaguaucugcaugaggcuuagugcuggacucgauaggcaaacaucuuguucugucaccuuuaaggaacacuaauuuccuuuguggaggaagcuguuuccccucuguaguguuacagcucuuggauguuguugugcccaccuuggccggcaaggaagacacaacacggucggauucuucucaacagccuuuauugcaggaaugccucgaugcugcuacggggacccugggcacccagggaggucugcuuauauacucuccagcacagggaaaggcuuugaggcccccugggauuggucagucugccggcaccuaauuugcaugcaccugcucgggagguguuggcgccagacuaggacuuacaccugcacugauguuguuuaugacaacagcacaccuggcacccagcgccaucuuagaguuagcguccuacaggauguaacaggcuauagcaucugugcacuacuccguggcugauuugguuaaaggaagaguccugugcuauccgguuuauaauauuacacuucacuagccagacuagcuaguuaugucauuccagaguggaacccugcugaagugucccacaagugacgugcuccugaagggugaggacagagggcaccucagcauaagcaccacagcagugacuuuugaaggacaaaguuaaguaacaccuuaacuuugaagaauguugacugaaggacccacccacauaaaucucugggucaguggagcagcagaaauggaagaaagcccacccuccccagacccuacuacugaucuuuccuuuccuuuccuuuccuuuccuuuccuuuccucuuuccucuuuccucuuuccucuuuccucuuuccuuuccucuuuccucuuuccucuuuccucuuuccuuuccucuuuccuuuccucuuuccuuuccucuuuccuuuccucuuuccuuuccucuuuccuuuccucuuuccuuuccccuuuccuuuccccuuuccuuuccccuuuccuuuccccuuuccuuuccccuuuccuuuccccuuuccuuuccccuuuccuuuccuuuccuuuccuuuccccuuuccuuuccuuuccccuuuccuuuccuuuccccuuuccuuuccuuuccccuuuccuuuccuuuccccuuuccuuuccuuuccuuuccccuuuccuuuccuuuccuuuccccuuuccuuuccuuuccuuuccccuuuccuuuccuuuccccuuuccuuuccuuuccccuuuccuuuccuuuccccuuuccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccuuuccuuuccuuuccuuuccuuuccuuuccuuuccuuuccuuuuccuacucccuaauguauuugcuucauguguuccuccacccaguuccuggagcacagcgcaguauaucccucuaucacagcuguccucacacuacacugugaaccuggaccuguuccagugagaagguugaucuccucauucccucccaucagaagcauucuuugcugccaaugugcauaugaaacacaauguguuucaagcaccauauucucaggagcaagaagaaauuaaacuuuguauccaguuuuggaagucagucuccuuucucagguagaaguuuuaaacucuguugguuagauaagcaugaagggugccuucagugauuugugccccagaccuaagcuuugccaggagugagugccugaccugcauggggaccagaugaccucugcucagagagagggaggugaggcaagucaggucugccuucagagcccagaccccacaagguaaccuguaaaaauaccuuccuuccucaguuugcagguauaguaugaaacacagaaaauaagaaaaugugcagcaaauaaauccuaaaauuuaaccugaugauagaaacccuacaaaccauaggcagcucgugggcuuugagaggggcugauauguuuauuggcaugacauucuugaauagugguuaaauugucauuuauagaugacauauuugauaguauuagggacauauuuuuccagguuucuaauaacaugaguauguaagacuauaaaaacauaugauaguuuagaaguguaugcucaaguacuugggaguaaagugcuaugauauaagcacucacuuuaaggaauucagcaauaaaaguguacauguguguagagagagcgcuacaucuuuggaaaagacuaaauaguuaaagacacauggagaguauaugaauuaucuacagagcuaguuaagccucucucucccucucucucuuuucucuguauaucuaguauuuucuguaguucaaaaugugauaaauacugcuuugcagcuacuagcuuccccacaagucaucacacaguuucuccccuuaucucaggcugaugauuuauugaaauuucuugaguagcuacuauguauggguuugcagguacugagguauauaggugauuaagcacuugaggcacacaugacuuauuaugguuuuuuugcaauuuuuauaauucauauaaaauccuaaagguaaaaauguccaucaaccuaggcccgggaaggucuaaagcaguaugugcuggucugaggcuguugucagucagccucugacaccucacccucuuuaugggcuuugcauaagaacgugugcguuagaagauaacuuguaaggaauuuccacaaagaaagugccuggcguaaugaccuuggacucuguucagguucaucauguaccucuggguauaucuagaaagguuuucacaaagacugcuagaguuuuguuugaguggguauucacaaugugugcauggcucggacacacaguucucuagaagcagcaacuucucuagcugaggcauuucagugacuccuugguggcaaccaguuucccacugccuggaauggcuguguugaaacauuguuuuccugcuuucuaacucauagccaaauaacaagaacaaaaggaagaaagggagggagcaaaugucgaaugaacuauuuuaagagaauuuccuacuguugguuaagcuaaagauuuuaagaacacccaaaaguagcuuugugcuaagaaaacaugauacauaugugcuaauacugagucugaagaccugaagaaguucccuuuuguggaagaugcuccccuguagauuaguuaaaucuaauagaguuucauuuuguuaucuucuaucauaacuguggcaggagaacuauuugcaucuuaguugucuuaagaggugcuuauaacaauuaagauuuuauauuucacuuaauuuauauauuuuuuaaaagcucagcuuguaaguacagaugcagcuugacguauuggugggguuacacccuaaaaaaucaguugcauauagaaaauacuguaagacagggaguauaaucaacaugccucaccaaccaagcaugcaacuuagcuacauagcccaccacagaguagcaggucuguucccagccacaguggaaccgguggaacuguggcuccuaccuguaacuacuauagcaagagaucagauugcauguugcuaacccaggaaaagaucaggauuuguaauugaaaguacauuuuucuauucacugaagguagucugcauuauuauaauaccacaaaaacguaaggugaauaacccuaaggauuuauuaacuuauuuauuuaacucucacguauggaaauguuugagcacaucaucgaagauaugauauuugagguaaaguuaaauaaguauaguuuggauaaaagaaaaauuaaaagauguauucaagcaggcaagauagguuuaaauauuuuaggagaaaaaaauagaugaacuaaauaaacauuccugaggaaaaaauagaucauguauuguuaugcaggucaauuaaaagcucuuucagagauggcuagugaccaguguagaaucuucucugccuucauuauuuucauuuguaaguugggaccaauaagcccaaccuuguagagcugugggaagaguuauuggagaugaccaggcaauguccugaacauggagcuucgagugugucuugcucucaaaacuaacucagaaggagaaagugugcaggguuaaagaacaguaaggaugucagaaaaagucauaaggaaucauaguuuuagcuauuugccuuuaaaaaccaccacaacaagaagcccuauaauuauauauauaucuuaaauuaacuuuucucaucugggcuguuaguguucccuccaagagucaaagacaagaucaugggcaugggaagcccucuuuugaguuguugauuaagguuguccaagagauuuucaaaacacacuuaugaacuagaacugaccugaaugccuccuuccagaggacuagcuuuuaugguaccaaaaggugucauguaacgaaacguuccaaaagaaggaagcaaccaucaguccuauccagcugcacaaaaaggaccagaaggcacaguagcccgaaaggucaggauuggcacacauauuguggcuucaaccaacuacucuuuaauuagucucaagacuugcucaacaagguggaaaccaugccuggcacugggaacuagccagcuacucagugcuagugaaaucggggcucuuggaguaaaaacuacaaccgcuacuuuacuaagccagcuugucccuaaucaaugcuccaaguauuuguuguuacaccugcagaugaguguaguccucaucccucaucaagaaaacuucucuuugcaacugaugggagaccacuacagaaacccacaaccagucaaagugcaagucccaccaaaaccaugacugccuaaaugggaacugagcaagaacaagauccaaaguagauggcagcaaaaccucccagccuaacccuacacaaaaacuacaggcaacuaaagaaagcugagugggggggaaggucuuucccaggcaaggauguaccucgguuauacaacuccaagugaucagucuugaaaaccuacauacaaguaacauuauacagacugagcagguuguauuuagggauacacacacacacacacacacacacggcaacaauuaaugaaagggggacauacauuugaaagagaacaaggagguugggggguguaaucuuuaaaaagauuacagugagcgagcacagugaguuggggccaggcuggagcauguuguacuugcugugcagaagacgugggacugugagcagugggguguguuugucagguuuggaagagcugucuacgugugugcuaaggacugcuuagaaucguauuucccgagugcugggguaggcauggugacuggugagcgcucuagcugauuaaaugugauacagcugugcugcucagguacagggcaccuaacaagccacacaacaaguuuacaauucucaugagcuggaaccucugcccucgccagcugaggguucucugcucaguguuuucagcuucgcuuuguguuuaaaauuaguuucagucaaaaauugaaauuuugaaaaauuucauuuucucuucaauuuuuuuuuacaauuuuuuuaaucccagcacucgggaggcagaggcagguagauuucugaguucaaggccagccuggucuacagagugaguuccaugacagccagagcuacacagagaaacccugucucggaaaaaaaaaucuugacaaaauuuucuguugcuuaugggguuucuucacucauuuugucucacucacuaugauaaacgcuaucaaauaagauucacuaauacuucugcacuuucccuagucuacuguuaucuucaguuaaugggaauuaauacuuacuuuuuuuguuguuuucauggcuauacuguucacuuuucaaauaaaguauuuaaaguuuaaagugcaguaaacaauaagagauuuaguaguguaaggugauucagaguugcuauaggaaaauugagguaauuuuggaucuaauuucucaccaaaauuaaauaagucacgcucugcggaaugaauacugggcugggccuuugggucucugcuggcuauaguuaagcuccccaugugcuaaguggccucucuuguucagauuuucuuccaaagcccuugaaagugagguccagggcaaagcacacaaguuaugcugugucugggaucagagugcgcugcccauccagaccuuggcauggaccagauucugaugcgucacaguacuuuuucuuuguaggguuucguagaagaacuuagggaauaccacagucuacuaucacuuacauaaaacacauguacaacaauacauuucuauaaaacccagcaaaacacccaugguagaccgcauucucuguugugugacgggauugcuauaugaacaauggcauuucacauguucuuuguuugggguguguuuuucuuuuuuaauuauuuuucuccaccacuagaaucaguaacaaagauggaauaacuagaguguacugaaccacauuaucuaagaaugcugcaaucucacacauaguguaaacaacuuaucaauugguccccuuguuaggauucagucagcuuaugguaaacuugccucugcacuaaccgugcgcagguuuuguugaugcugcuguucucugaauacuguagagcaagcaccugcauaguguuugugagaggaauuuagagaugacugggaacuugggaggauguccuacacuucauaccacgggccugagccuccguguaucaguaugcugcggagucuggaacugaugagccucugaugcugagggauaguugguuacgguuucccagacucgguuagaauugauacuaaacauauaucuuaccucauuuauuuucuggcacagucuugcuugcuauguagaucagagaggcuagcgauuccguuacggcauccuuggugcugagguaagagauaugccaccaguccaaagguggcaucaugccaccuuugauguguugcuguguuuguucacuuguaugugugugcauguauacauacauacauggcgugugccuguguguaugcguguguguguguguguguguguguguguguugaagagaugguagaggaaagcucaccucugcucccaugcacuuacaaaauugucuuuuuuuauauucauucagccacuugcuuuuuuguaaucacuugauaacauuuacucuuguuggaauucacuuugaagugaauuuugcauuuaauugugguauuuuaugguacuugcaacauuauuacauuugggaaaugagguagaaauccuacaggcaagcaaguaagaugauuuuuuaaaaaaauuaacucaguuuuauugacccugcauuuuagcaugcaucugagaguacuuccuguuagcauccgcaucugagaauacacauuaaguaaaacuagccaaccagagaacaaugcauuuuugggaacuaauugcuagugaugacuguuucuuaacccguuucuuucuuucuuucuuuuuuuuuuucauauuuaacuugcuaauagaguuuugaggguaaaggcccuacuuccacucagucaacacucuaggcacagcuacccaucccacuacaccaauuaaggcaaguacugggguuggggagauggcucaguggaugagacuugaguuuggauccccaacugcauaaaaagcugagcuuggugcugauagccuauaaucccuguacuaggagagagagacaggaggaucccagagguuccuuggcaagccagucuuccacaagaugagcuccaaguuccaggagagacuuucaaaaacuaauuuaggaaguacugaagaaggauacccaaaggcaaccucuggccucuacacaugcacacucgggagcauguuccugcauacacaaaugcuuacauaugaauauacuguauacuuaugugccuacaugcacacaucacacacacacacacacacacacacagcucauaggcaggcaaguaggagagcaauguccagccugccaggcuuugcuccuccugaaaucaaggaggcucaagaggacuggggaaggccauuggcuuauuucugugucuuuagcuaaaguauaaguacagaaaugcagggagaaacagcagcuuucuucaaaacucaaauaaggaguugauacuuuuuagccaaagcagcuucucuaaaccuguguggagccuugauuuuuaccaguuuaaucaaauuauuuacugaauuauuguauaaacuauucuaucuucuuuagaaaucuaucacaggaaguaugugaugaguagauaauuugggauuaauaauuuaucacugaauauuuaaaaugaauuuugcuuaaaauauaauuugcuugacuauuuugagugaaauguugugauaaccagcguguuugaaguaugugacauugugcugucugucugugagaccugcacauacauguuaccagguuauuuuuuauuuauaugagugacaauuacaagagaaggaagucuacaaucugggcuugugcugauauuuuguccggauuaggacugagggaugauuaauuacaaggcauuauuucuugucaaguggugaauaacuauguuuagcuuggguaucgcuguuuacaaaugggaaaacccacacugcuugccaagcaguugauuaaaacaaugcauucaauucaucucauacucucuguaggagagaucuguacauuuguauggguuggcacuuaguaauuaaaccucuuuaaacauuuuaauuagacuucaggccacccaaagcccuccucucaucuggaaaacacuuuuagauaucagcaaacacaaaggugugggcaagccccagucauuucccuugagccugaagucuggagcagugugcauauaggguuuuguuuuguuuuguuuccuaucugaaaagucuguuagaacacggacuuuugagccuuacuuucaaagaacauuugaucuaggaguucaucauaaaaugugcauugcucacuaguuccaagcugauauagguagauguuucugguccagguaacaaacuggagaaggacaguacugugggauucaguuguggguggagaccugauuggucuuuauuuacuauuuuuuguuuguuuguuuuguuuauauucaguucauuuccuuuuuguuaagucuagccugugauuuaagacucuucguguuaaauauugugugauacuguucucucaugagaaaaaugcaaacuuugaggggaaacggcacauagaaacuagauaguggagcuguguuugucugguugcaucucucuucacccaugcuaggaagccauuuguaaaguuguuuuucuuggcguguuucauacccacccugucuucccuagaaguaagcauugugaagcgauugagcucuugcauucucuggcaucuaguugugucacugcaguuagguaacuccaggucuugggcaucucuacuuucuaacgauaccuuaaaauuugguacccucacacacuguugucauguauaguuucugugggucagaaacgcaggcacaguuagcuggauuccucuggugaagguagauccuccuuggguccccacauugggugccaaaaguaucaauauacaacaaaauucucuccugaaugacaguaagagguaguuuauucucagccaaauaugagugguuauagcccagagucaugaauucaggacacccugagaguaauugcccaaacuuuuauagucacagacuagaaagcguaacuccugacauuugucaugagauggacaacucacagcaaagugacgagaucuuugcuucagguuucagauguuauuugaugacauucucgguuuggggaccagugucagaagucugacauguuaacauaucccaacuuuuucaucugccucaucuuugaaaggaaguuagaugcauagguagacaaugaaugccgacagcaacccaagaugauuuuaggucuagauugaaacucucuguauucaggaaguuuuaauuauuauucuaucuugcagaauuuuuuuuuaaagugcugcuuuuuucuggaaaccuccauuuacaaacuccaguaguucuguagugcaggaucagaagugaucacgcaucaagucugcaugcucuguuuauuagaagugaacuaagcccacugugggagggucuuguucugauguugcccaggacagccucaaacccaccucuaggcaaauacugacucuuaacuccugauccuccugccucugccgccugagugcuacacuuuacagaucaaugcagaccuccacacuugggccuuggccugcuuuguaagauacagaaaaguaaguuccauaucuggaagacaguaugaaagaaucgaugaacaaacccucaagcccaucacuauauuagcaucacuuucuucugugaaauugguauuuuacagagauuucagaggccuuaauaguggguacucacuuuggugacuguugcaaucuuucacugugacagucccauucuuaagauuuacacaguuguccaaacuuccugcugcaugagcuugcucuccccacugaguuuguauuuuacacaaugccguaucacaagaacaucuuuuuauuuaaguuguggaaauauaacaugaucaugaaaauugauuauguagaagugaaaauauaaaugaaucugauaauccugugauguucaucaucaguguucaucaauuguaucaccaaguacaguucauucaaggauggcuauuuugucagguuucuuaaaaauuaucauucagcggcuacagagauaguucaguaguuaaaaguccugacugcucucgcaagaaccagguggaauucucuagaacucacaugguggcucaaucuuaacuccaguaucaugccaccucgugccuucuuguggcucuugcaugugcuaagcacacauguagugcaguuauauuugcaugcagcaaaacacacauauacaaaauaaaacuuauuuucuaaguugugauucauuuagcaagugagaucuugccauacgaaagcacauaauacuuagacugggauaguauuuacaaccagcugucucucagauggcccuuggugacugauaccauaugcuaauguucacauucuuaugaaaccccugccauugcuuguggacugugucuaugauccacuugugacauguggagaggaaauauuucauaaagccuggcauuucugucaugugggcuacugucugcuuucuucuaacaugguaaguuuuuuguuguuauuauuuugugugcuuaugugcuugguuaaauccucucucuguccucaaaaauacacuaagaaggauuacgcaagaucacaugauggcagccaugccuuugcacauugguauugcaggguguagugugcucuaguucagccugucccuucucaguuaggauaguaucuucccucucagcagagaacuguuuaacaggaaacagaacagauaauguauuucaauucacaucacauuggaaaacauuauuugggaaaaaauauuguacauuuauaauuaaauacaaaagaaauauaagauuguuauucuggaucauauaauauuuaaaauguacaucacuuaaaauuaagaaaauuacauauuuaaucagaaucagugguuaauuuucacguaccacuuacaggugacuaauaaccuauaaaugcacacuaauguuagugaagacaacuuaaugaggauccaguaauaggcaccagcuuuccuagcccucacugaugauuauuuugaaggcugaagguucuagcuagugaagauuuuuuucacugugagcuucucuacuggugggauuuuccugaauggcugcgacuuuucuguagucauccugcugggcuaacuuugcuguucagcccauucacaugugaggugcucuacauguccucgugagucucccacugagagucugcguugggacacugugaccuggguguucacuaaaacguuggugagcaggagcauuuacauugcuuuuagcucuuugagaucaugugcuuuccccucagcagcaggaguaaggaaagauucccuuuuguaugugugugacucugucauuagaggugguguugcaguuaggaaacagaucagucuuuggagcccuguguuuauagaaucaccuaaagcgcuuugcugagacuucaacucauccaugucuuuuugcagugcucaaaaccaugccucguuguuuauaucugcucauuuuagaauugauaagaucggaugaguuauuuucccaagugacaaauauaugacuucaaaauauaaaucuuugugcugucuuuuuacaauuucaaggagcacauuugguaaaaggcagauguauacacucugaagagaaaccagaguacaagggagggaccucauuuggaaaacugguuucauauguguguguguguguguguguguguguguguguguguguguguguguguguguguguguguuacagaagcaaugagagccuggccugauagccuaaaacucaacuggaaauggacacugcacuguauuaaaugguauugcaaauuccacuggacuauguaugugucuguccccaaaugagguuauuuuaagugaaaaaguugagguuagaaaaaaaccucagugguuaagagcacuuacuccucuuacagaaaauucggcuuccauucccaacacucacaaagcucaccguccagauccagugguugacucuccuggccucagcaggcacugcacacaugugcuugugcacacccccaggaagaacauucauacaaacacagagcugcaauugggaagagcuuccuugucaguccuuauuauuucaaaaacuacuacuuucagaauccaguuuccccuuuuuauuaaaaaccaagucacaccauaaaagaguguuuacuggcuucuacaucacugcagccagggccagggauaugaggacgugaaguggggcuaaauaacacauucuuuuaucuguaagagacugcacauacauucuccccacugggcccucagagcuucuacaguuugagcugugcaauaauuuuguauuuucacuuucucugacuuaucugacguauauaaauaaaggccacaacuugcuuuaguaaucaaaaacccauuaucgccuguggcggacaugaccauuaccaccauuaguaaccguucauguuacuauugcauguuuuucugcuccaugccaaagcagcuugggugugaagcggaauaccugguuuguuaccuuuuaaguguuuugcugaaaaggaaaaugauuuaaagauccuggcaucacuugcuccacaucuccaugaccauugcaagguagggcucagcacucgcaaguauauggggucuccuuaacaucagggcacuggucuggacccucugucagcuacagcuccuccacccagugcugagaggugaguguuccacuggacaagcaagaggaaaacuuguagucuuuccuacaaaagugagaaguacagauaaauuauuuacagauuuuuguuuguguuuuguuuugagagaguuucuucugugugaccuagccugaccuugaacucacgauccucuucucuuagccucuguguauugggaccauagguaguaccuggcugguguauauuauuguacucuuguucacuguuggugaaggacucacccaacaacuggcaggaagagugcacaggcacagcugacauggcacauaagcuucuccuggguggagaagugaauucucuucauucauacacacacacacacacacacacacacgcacacacacacauauguaaaaauuaauagacauaaaggaaccgguccuguuaagccuuuccuuuauguuuaguugacuacuaucccagccauuguaaacugcaucacccucccucuccuaucccagugcuggaagauaguucuagcucauuuuuauugggcccccauacauguaaugcauauaugacaaucuagcugucuacccucagcuagccuccuguuucagguuccugagagcuaaaggaagauaugcaccuucauacccagagguuauuguagucuuacccucuguucacuuccuuucacagauuccuguguagaugcuugggcauuggccuuucaaagagauuucuacuaauuauuucuuuguucgauuugcguaugcagcaagugcguaugcguucacacuggacuggcaugggccugcaggaucagugcuccccagcuuuuccuuuccaaggacuuugucaacauugaguguguguucuggcaucuuggauuugcccugguggguuauuuuuaauaaugccaaaagauacaaaaagccuuuacacuuaauuaagccaguuauuaagccaacauguagacaccagcaaagugacuauauucucacaggaaugaauuaacuagguaucacuaugcaaaagaaauucccugggauuuucuucuccaccaguaagugcuagucuucuggcuauuugaggguuugcuucauuaaugcaagaggcagcucuaccccacacucacugucucugcagaccuucauucucuucagaaagaaguagccuuccuuccccacacagcagcuuuuaaguggaggucacuguaccuucaucguggccccucccgcuuucuucuccugguccaaagccuccaucucacccacuaucauuuugaucccuugaucuuuguuccuccuagcugaauucuuaccagaaugucuuccuuucaaccuccuauuaccacuggugguggaauaagaauagaaaccuuaacagcuaaacauuuccuagagccaggugugauggcgcacaccuuuacucaggaggcagaagcaggcggauuucugaguucgagaccagccuggucuacaaaguggguuccaagacagccagggcuauacagagaaacccugucucgaaaaaccaaaaauaaauaaauaaauaaauaaauaaauaaauaaauaaauaaauaaauaaauuccuaguucacugagcagguuuagggaagccaucugaagugguuucucuggaagguaacuugaggaguuuaaauaugguacggagugauguuuacugcaugauuuuuauagcagcgcuuuuuugaacguccaauagagaaaauggccagaaauauaucuggccucaaaguacagcgauggaaggccagacuugggguggaaucucaccuguuaagaugggccuaagauaccaggaaccuugggagacuucacuccucucucagugccauucaagucaguaaacgguuaacagucccuguucuuuuaaagaaaauaucuuauuagaaucuuuugcacuugaugcccaacucuagccccuaagcacccugccacccugagcucuaccaaagucucucccguuccuuuuaaaacuauaguuuugaugucuugcaaaggaccguccauaucgaaggcuucucugccuuacucuugggaagucaaaagcugagagguuguuguauacucuuuauuucugcauucuuaccacguccagugcaguagcagggauggaccugucuggggucaugauggcagacagucaagacauauggacucauggagauguugggaucagguagccugggcuuccuggagaagcuagaguacccugaaaucucgagugguuguucuauagaguugaacaggauuccauagagcugaacaaggagguggaauuauuacuauacauggauaaacaagaagaugggguuucuaguguauaucuaggucaaggaaauagcuuuagcuaaugucaguaggggagcagucucuguggagaggagcagucuucaugcccuaaauaccuuggggagaaagccacgguggacauuuucuauacacacuaucaaaacuagcauuugguccucugaggacaacuucacuaugccccugagccugaggcucucaggacuuccuugauuuuaaagcccuucucaagucaugagucuaagacaguaaacagccuaggucuugagccggugaccuauuugauaacccgcuuguaaagggucuaaccuugaaguuaucuuaaaaucccaucuuacagcaauagauucagcaucaccugagaauugguggacagcuuuuaaggaaaaguuaguuuugcuaaaaugaaaaccucacuaauagcguagagcaugcauccgugauugcugugggugacuggaaccauugcuaacaaucaggacuguauuaaagaaaaccuauccugucuaccuauuaauacauacaauucuuuguucaauucuggauaaggccaguggguggaaagagcugcauucaugaauuguacuuaaugucauuuuauuauuuuuaugcauuuaaaguaaggcgaggacacauggucaaaaugucuuuugccaccuauucuaauuaacagaaaaggaugucucaugguuaaggaauuggguuuucauaauagaaauguuuugauguuggagaaaaaugugucuuaaguguguucuuuacaaucuuggucuuuuuuuacuuagcaauuccuuuuucuuagauuuagcagauacaaauuucagaugaguccuuaugcacagucugaagaaaagguuuugaaaugaggaguguuaguucuuuguugagauuauauuaguauuuugagaaauaauuagagcaguuuuucagccaguguguccauccuuguuagguauauuugcugucaaaucugcuucggacaucaugagacugaggauuauugacccugguucauaaguagugagauaaugggaacuguagggguuuguucuauuuauuagcuagcuuuauuaccucuagagaaaaacguacauguguaugaguauuuuugcuugggugucuauacggguauaugagugugugugaacauccaacuuccauaucuugucuuuaaauccaucauuuuccacuuuucuuuuaaagaguaaaacagauagacaacacgguaggugaaaauguucucugcacuggacaaugaucugcauucaaccuuaggaacccauguagagggaggagcagagagacagcugacuccacagcguccuccacccaccucugcuugagcauaccccaugacaguaauaccuccacauucuaaaacuguaaaaagagcaagucuugagaaaccuuuucucuuuguucuuauuaaugucuacugggauuggguuuaagaggguacuccauaaagguuccagguccuuguauuucagaauaaagaauuagaaaggucaguagugguaggggagaaagagaggugggggagagggggggagagcaacuuacuaagaaagacuagacucccaaggaaagcacaggccaagugggauaaagguuagaggcuccauggucagguuugguguaguccugcauacagcuucauacacugaaguuuccaccuaaggguguauguuucacuauccccaugaccugaagcuuccucuccagugagcuggaauccagugauccagguacuuuucaucaguccagaggaaguuauuucuagcugaguuuuuagaacuuguuuucuugcugugcggauuguguuaaggauuuaagcaggcaccauucucagccacucccccugcugaaggugaauucuuccugacauuugugcuaugcuuagaaauagaauccuucucagaaguugugccuguguacuucacgaaacacaauugguaaauuguuauguuguauguuguaucaaggcaugcuagaauuccucucugacugcacauuaaacucuugagcagguuauggugguuaaaauaguugaucucacuuaucaacugaugagauguagaacugccugagaaaugacucugggccugacugugggaggugauuuuagcuggauuaacugaagguguugggcuggucuugcaguauauacaaaagagaaagcgagcauggcacaagcauccauuuuucuauucuuccugauuguacggcauguguccaacucccuuauguuuuugauggcaugacuccccugccaugaugaacucuaacauaugaaccaaaauaaaaucuuccuucccuuaaauugcuuuaucuuuauuuuuuuuucuuuauggugugcauguguuuaggugucaagguauucaaaagaauuaacaaagaugguuaauauucugcagguauuauauagaaacugccucuuuuauuugagaaugauaagggaguauugugaugcccaauaaggauuuauuguauuuuucauauuaauugcgguucucuagagaaacagaauccaugggcguagaaaaagauugugaauaaguuauugaggcccuugauuaugaaggccacgaagccccacugucuguaggcuggggacuuagaaaucugguggugugguguggugugguguggugugguguggugugguguggugugguguggugugguguggugugagggcugagagcagaaccuuggcaggacuugcaugacaucugaagugacaggaauguaagacugggauccuggacaagcagucagacagggcaguauucauaccuuuaccuuuuuguuuuccuguccucacaggcuugucugauuccccacccuaauugguuuggguggucagcuuuacacuggcuagugcagaugccacucuccuccagaaggacccucacacacacccugaaaauguaccagauaucugagcaucccucugucagucaaauuaacacauaaaauuaacucucacacuuagcaaaggucauuaauucuugggauaauuaagaagauugaguggguccacugauaugaacuagaucuuguuuuauguucccagaauggugcuaaauacaagaugacagcaucaaauggcaauaguaaacucuguauaauuagaaagauaaaaugaauucacgagcuaguuagaaagccaugcaucauaguaaucuuauaucagggaguuugauaccagaggauccuuuaaugauuuagugcuucucuggcuaaagugagggagagagauaacuuugggccaagaccuuguuuuaggguacagugaaugagcagagaccuaaaggcaagagauguguuggguggaaggaaggaaggaaggaaggaaggaaggaaggaaggaaggaaggaaggaaggaagccuuucaggcuggugcuccuuuggaaaagagcacugagaagauuguuuagguuggagaaaaaauaacaugggaaccaagguaucccacugaguaugaaguggcuaaaucacugaggucaagaaagcucuuuccuuucuguaucucuccuuuccuggguccuaggauggcucaucuggagucauccguccugcagcacuaguggugaggguguugacagggaucagcagugauuagcacucgcugagcuuggguuguacgccagcucuuacacuucugugggugagugcacaucaaggcagugcuaguauuuauuucacagccaagaaaagaggggcaaagaaggcaccccuaacuggcggcccacagccauacagcaagugcguaccaccuuaaaaccucauccuauaucccaaaauacuuguauuagcugagggcacugagugggaaggacaguaauaacuguagccacuccccagggcgauaaugggaauuacauggaauccuugagaccgugugaacagaaauaaagacaucaagaugaucaucagacuagagagaaagaugugcuggggcuuuaucuccacuccaucccugcucuucuuuucggugggcuagauucuccccucgcuagacauuguagagauugaaggauuauguucuauguaaauuaaaagacuacuccagguuggugguccacuuuuccucagcaacaagaguuccugagaggccauucauugguugguugguugguugguugguuuauaagugaaacaucauuugcucuuauuacugagccaauucuuaaaggucaaaaacaaagaaaacaaaccauagaaucuguccaucccugcaguuugaauguguagugugcuuuugaacuuuuuguguugaucacauaacuggcuguaaguuuggcauguccuuaguuguccuguccaaacauagcagcauagugauuggugcuuuuaguuaaauucuauugaaugcuugcuucuuagacaacguuaacaaacgugguuauuuccugauguuaugguaggaugcuagaaacuuagccucugagagccagguagggcuacagccucucauuccuguuuugcauuuacuugcuggacuugcagaaacuuaauuccuaacuuugaaguaggccuaccuggguaggaugcagaucuuuauuguuuuuuuccuaagacuauguuaucugacuccucaacauaaugcaaaauagucuuuuaauuagauuuuuaaaauuauagucuauauuauguaaaaaaaugcaauuugauucagagaugugggaauaaggucaggacaacagaaggcuacagcucagagcugagccugauauacggaaguggugggucucuaagugugguaagaguuguuuugugguggacaggaguuugggcuaagggcucccauagucauagauugucauuucuaauuagacauuaggcagcuguaggacagaggacaacuuucucaccucaaagcccucugacauugacagugaacuucuuguaaggauagaaucccaaugaugugcucaacauaauaccugacgcagagugaugcccuuagaaguuacccaaaucaucacugacacacgugccugggguaaggccaagacugcugcuguacagaaggaccaauccuuguaguuuccacugcuuuuagaauugggaauauaugugcaucagcguauaugcauguaaggaauauauaugcuucuuucuucuuugcuuuuuuaacagucccauaccuuagccggauucuugauugauauagaaaaaggaccauagcuauauacaucuuuuuccacuaauuuauuuauuucuugaguuuacaucccaaucacagccaccaccucuccucauggugccccacuuacucagccccuucuccucugagaaggaggaggcgcuccuggguaacaccccacccuggcacaucaagucacugcaggacuaggcguauuuucucccacugaggccagacaagguggcccaguuuggggaaugggaucccagaggcaggcaacagagucaggguaagcccccauuccaguuguuggggacccacaugaaaacuuagcugcaccuccuacuacauguguacuacauguguacuacauguguggggagggccuggguccacguuugcucuuugguuagugguuuaguuucuuggaguucccagggauccagguuaauuuacucuguuugucuuccuuugggaucccuauccccuuggggucccucaagcccugugccaacucuucuacaagacucccugaucucuuucaucuaauguuuagcuguggguuucugcaucuguuuccauaggcugcaggguggauccucucagaggacaguuaugcuagacuccuguccgcaaguguaacagaguauuaauaauaguguuagggauugcuuuuugcccauggaugggucucaaguugggaucaacuauauucauagcagcucuagagcauccaucuucuaaguggaguagucaguguggaauccuuucacccuucaguaggcauuuacuuagaagggcuggcaguuuuacuauguaguacagaggccucucacucuacacacucacuguacugugucaguggugcuucucucacccccuugacacuugugcccucauguucccugaaguuggagauaagaacuauaauuugcuaauagcagguuaaauugguuuuuagaaagcauuguucuagacuuuaccuccuaacauauaaugaucacacagguauugaacuacuaaagaaaaucucaaacaacaggucaaugcauuuugcucaaggggcaucaaucuaucaccugccuguucgugucccagccuuacauugguuaugaucucagacuucauucaauugcuguguccuuuucugaauucagagccucaaguaaguacucugucauuccgacaaguugguuucuagguggcuauaauaguaguuccagcugucucagggagccuugcucucugccuauaguucccucuguggugguuaaucuagaucuauuuccuuuuccugcuguuucccaucuacucugaauggccucaguaaccaucucuaagucaucaccaacuaguuugcuuguucugagacuuagcugaugcuauagacuacuggcacaaacugggucaacaaggauuuuucuucucauuaacaucugucacaagaugugaaacuugaagacccacuaagauuugauguaagaugauuuguuucuugugaccucauuagcuauguuaaagcauauccaggggcagacguucacagcuggaggagcacaggguuauucuguggcucaugaucuggccuuggcauaucaaaaucaacggcagaguccgauagucagcgucacaugcccacugcagaccacguucucugcuccugccuaaugagcaagcagaagauccucucaagagggaauucuaaauagagagccauguggucagaccaugcuggccuggacuuccagguugcugugugguauggauaauucuucuggaaauucaagauaagagcucuugagaugucuuaauuuauucuucuaaacaauuaguagaacaucggauccuugguauacuugcagaacauaaaaacucuguccucuuccuugcauggcauuuucugcugucggcagcuuauuaguugcuggguauguacauugccugacacagaguuuguccuuggagcugggguacaguuacagcucacacauacuucuacagaauagggcaguagccacccaaaggcagccuuaaguggcauaugguaguauucucugucugauguuuguguggaggguuuucuagucuacaacuuauuugacacuacacagcuaugcuaucauggaugcauuucuccuaacagucuucccaacuagauagauuuuuuuuuucucacuaccuuucauaagcacaaguucuauggugauuccagguuguacauugugggaagccacaugugccauugcaggguggcgcuggcuaccgcuggccaccacgcauacauaggcaguaaaguuuuuucugccaagaugagguuuugagaauuaaccaaaauuaaccaaucagaugagagacaaguuaaccaaucagauguaggcaugcaaaugaggugguaagcauaacccaugcacaaccaauccaggugugagacacgccucuccuaggucuauauaagcagcaccaguucugggcuuggggucucuucaccucugcaaucaagcucucccaauaaacgugcgcagaaggauccuguugcaguaucauucuugcuggcgagucgggcgugagcaagaguacauuccuguccuguaaggaucaauuugugaaugauuauaccaccucuccagaggcagcucuuuaucaaauugaugugagcuccaguuagcagaggccaccaugccagaaaggauggcuucugggaagcagagauagguuuguaauucuggaagucuucaacucagggacccaugcucucccauggcucuaguguguguuuguuuguuugcuuguuuguuugggauagagucucauguagacuaggcuagccacccuuguauccagggguugccuugaacuucugacucuccugcuucuauuguaucugagagcuccauccucagucucucucccauggcuuugaaggaagggcucuugcaguuauguuuggcaccaacuacauucaaagaaaggcaaaguuagggacauauggcagccaucacugucacguggacuaggagguuacagcagcaguuaucaaucuaguuugacagcuuaacacaacaaugaaagcauuuguaggcagacuguugugugccucuuuggccauuaaauagcuguggaccuugugaccuguuuuaccucuguggcucagucuucugucuguaaaaaguaguggucauuagaguucaugagaguuugguaaggaacaagugacuccucgaacaaacacuguguggcagugauagcugacaguuagccucugcucuguuucaucauacugaauucuggaaccagcccuguagagugcauguucuucucuccaucuaaaagaugcaggaacugagcuccaaggaagcuaacuaauccacacuucuagggaguggcacaaucaucacuuucauuucaaaggucaaaaucagccuacugcaugggugaaauguuacagccccucuguguaucucuguaugugccccgccucuucuuuuaaccaaguauucauugugcuuugcaggggguuucugagaaugaagguaaagggcaacugucugagugguuagucugaacaguggaauaagccacuugcacagagacaaguuucagacucuagcagcccgaccucucaugcccugucagugcuaagaucccuugguucaccgucuccuuggcauucccacacucuguaaagugccuuucuccucaguggagaugugaagccuacacagcugugaguuuuauguuaaauugcucagccuuugcucuuacagaaugaaauaaccucagaauccucccaacuauuauuaucuaagccuuacucaaacaucagauuucccccaggacugggaaaauaaaugaaggggaaauuagauuuuuaucucuucuccuauuuuuaguuuugagaaacuuguucaguuccuuguucaaaagaauugugagcaucaugccccaccauuauuaggaauguguuuuacacugagugugcugcuggguaaauuuauaugcauuauucuauguuugaggcaaacguuuggaacuuguuaggaauaaauuguuuaagggaagaaaaucgcaaguguaccauuuuuccucucucccuuguccuuguuugacaggcagaagugauaacugucccaaaaugagaucauucugguacuucucagcauugugcuucucaaauuauaucuaguguauugucaagcaaaacacugugggaaagguuaacaaaugugcuaaguguccugaauauugaugcauuauugguagagcaucaaagaguuaaggcuguacuguuuuuuaaagacaagaaauuuuugcuccggauuuuuaucuuucuuauucuuugaaacuuacucuucagagaaucaaaaaagcugucuucauuauuucuccccuuccuauucacaagggcuccauuuuuaaguagaagaaaugauguugguucuccuaccaggaccaacacugaauuacacuggccucuaguggaugccugucacaauuagguucuguguugauugcuuuucacuauaacaugcuuuuaaacuuaggggaaauuuaucuacaauagcauaaugauaauuccagggggaggucagaauugaugucaccaugaaaguuauuaaacuuuguaugcguaacuccagacuuaucaacacacuuaacaagcuuagaucaucuucugcagucuuuaaaaauggagagcugggagagggcucuguagaauaagcagucucaguucucagcaccagcaaggcaccuuacagugucuguaacucccacuccagggcucagucaguguguucuucucaccuacacacacacacacacacacacacacacacacacacauaugauguacaugaauccgugcaagcuaauacacacacucacacacacacacaaaaguaaauaagcaaaucuuuuuuaaaaggagugaaaacaaagagagaauucugcaguauacauguaaauucauguuguacuggaaaaggcaauccuuucagaaguauuccaguuacucuucuaagagaaagaagacacuaauaccaaauucucuuacacuguucaugguuccauuuaaacagaaaaacagaugaagugacuaacgugaagcaaagcagccucaccauggcauuuucccacauaaauuuaaggcaaccauccuguugcagaauggugaaugcccagcaacacuagcaugugcaguuuggugcauaucaacguaacacagggucugcuucgacuuucaaaggcauccaugagugacaacacucuucucucccuugaccgugugccauacaaucaaguccuaucuauauucucuuagaagaacuacuuaacucuaacuuaaaagacuauacucugcccacccaagucaacagcauagccuugaauuacuuguugauucugcuucugggugucuuaagcagucauguaagaaacuagccagguuuuggcucguccaaaauuuugucugucuggagcugaagggucugcuuccaagaugacucacucggcagcugaugagaggacucaguccuuugcuaaguagaacuccgucuagugccugcaagaccugaccaugguuucccucagugugaguggcuuuaacuuggggacuuuuuccagcuuugugugaagcugacuaggugccaccuccaccuagacugucacaagaagcacaucauaucuugacugugaucccacuagagaagaaaaauuaaacaccacacuuuuaagggaggaccacugagaaucucugggcauauuugaaauaccacauuugucucaaguuuaaccauuguauuugaauauauagaaagcacuauuuaggcuaugguaaggauuugagccaaguuagacuaguugaguaacugaagguaccauggugaaagaaugugggacaaaauaaccugaugucauaccuuugcaaccaggcaggggugugaccuugaaucaucugauauuucuguaugcucucuauaaaaguuauaaaguaauuacuuuucuuauagcauuuugguaagauuuaaguuaauacauaaaaacaauacagaaaccacauacaaagugccuggacucuaaugacugagcagccuggguagaagucacuaucuucuagccagcugauaagaacuguggccugcauguagcucacacaguguggaagaacacauuaccaaucacaguguguggcggaaacugagauuacaaaaggcaugagcuaggcaaaacaguaaggaccuggagaugcccucaacugcuguaucugaagugagaacuuagacaugaccuucaugguuaccuuacaaagauaagagaacuucagggcauuguaucucugucaauccaauauaguucuacuucuaaagaaguaaaacagccauuaaaacuaccuguuggagacaagagacccuuaccgaaaaccacaacuggucaaaauucagagaacaguuggcuguggggugcgcagccacaauugauucaucucuaacacagcuccuucaccuaaggcuugggcaacaucuuggaauaaaggaacucacacacacacacacacacacacacacacacaccccuaacuacacaaauacagccugcucagucuauuuaguguuacuuuuauguguaugguuucagagcuaauuuguauugcauagccaguuagguucacauuccugggaagggaggacuaucuuccacccucagcauuccuuaguuggcuguuuuuauuuauuuauuuauuuauuuauuuauuuauuuauuuguuuauucauucauucauucauucagccaggaaaucuccuauaagguguuuuuagaaauaacagaguagcuuuaugcaugauaccucaauaacauggcugccuaaacaugaccugaagaaguauaccaccaguagacaugccaacaugaaaagggaaaaucucagaggaccccacccauaaauaguguuaaccuaacuggcucuauaguucaaaucgcucugaaaucauauacaugacaguaacacuaaguguacugcgcagguuguauuuguauaguuaaggaaugugugugugugugugugugaguguauacguguagcaguguccuuaauaggugcuacucaguucuugcaaaaaccacuugaaagcuuuagaaguuagcuucuguuuccuccugcguggguugucuggguucugaugccauccuguaguauauguugucauugauaguaacagcucaauacacagcuuguuuaacaaagcagaauacuguagucauugagauaaaugggaggcuguggaaguaaguuccuccuucauccguggucacagagccaugcucucacucagagagcaucuuucaggcugcucuccauguugcccagggucuuccugcaggccugcugggaagccacagagguuuguuuuuauugugcccaucauucauuaugcugaaaggaggaugugagccaccuugugcuuggccuuccuuaggugucauuuguagcuaagaaaccaagagaagcuuuuucggugcugggaagcucgcuucacgaggcaggguaucaucugucguucauaauggacaaggccaggaauaauacaucauuuggcuuguuugccuuuuucugccuuuaacuugguuauagaugcaguuaaugagcaauuguuucagauccuuaacuguuagccuucucccaagaccuagagaaaacaauugcugaugacagcaauguuuuccagugccgauaauuuuaagacugcuuuugcuuuuuucuucuugucacaaaacucgugacccucauuuguuauacagaggguuuagcuaaacaaaagcauugcuguaagucuuccaauucuaaaggguuuagccuucacaauacaggaauuuuuccuaaauucgggggcuagugaaguaacaguucacucagcucaggguguagaggagagccuauauuuagggaugaacugauaaugauggugagguuugggguucggggcucucucucauccugaaaucuaaaaugaaaugaagagaagugguaacccgacugggcuggugagggaaugaagaaaggacaagcagacacgagcgcgcacacacacacacacacacacacacacacacacacaacacacaacugggucaggugaaugguguuugcugcuggagccacaccuucugcaccacaagcccagcacgguuacuguaugcuacacggaggggccagagucagccugcggggccucuguagccuagcauuccuccucuaaacauccagaggaagcuacgguugcucguuccuguucacacuggccaaucaucagcaaauccuaacaagcagggggaaaggcuuugcugauuucaaaccugacccauauagggacaggccuugguccuggucauggcugugcccucccuguccucagugcacauucacucgggaauuaaggccacaaaaguugggcuauugguggaagaggaugugaccacuugccuuugacccugagagggaaugagcuguguuucguuaguagcagacuguggggaaugcuuugccagcguaauuugcucguaauuugcuccagauacgcuguggugacauuugcugaacagcugaguaaauagaucaaucaggcuuccacacaacaaguuacagcaaaguugacagugauaucaguaauuucagaguagugucuucaguagaggaugcuuuuuuaugacaggaacauuggaugcuaaaagagcagccugguacugcgguuuccccuccuucuaguggugcguaugagcccgugcgaguccugucugggcaucucaagguacccuccuuccccagacucagauggaguguuggccuccaucaguacuguuauuuguuucauauucuguuaauaaauuuaaauuuauaacccgaaacacuguuaauaucaguggcaguuuuucaguuuaagacucuggacuugggcuugcuauaagagaucauuuuauuuucaugaacaaugaaggaauuuuagguauugcauaggagacugguugcuaauaagagauuuguuauuaaacuaaauuucacaaaaaaaauaccugugagauuuacuauaaaugcaauaauaugggcugaagagauggcucagugaguaaaggugcuugcugccaagccuaacaaccugaggucaauccccaggauccauauggugagagggaagagcucacucccuaaaguugucuuaugacauacauaagccuguaugcucaguggaagacuuggugucaagagaauaaggcagaggaccauagagaaagagcccgauguccuccucuggccucuaccugccugugugcuggugccaguacccaccacacgugcaaccaggcauaccuuacauaccauacauacacacaauaauaaucuuagcagaaacuuuagaagaaguaaucuguaagcuguugggguuuuaaguagacacaauuuucacucuucccugccagguauucaucugcuugguguuuuaauaggaguuccuaucaagacauuguuuuuccagagaucugacugaucaaacuguuuuaucugagcagcugugugaacagucacagucgucacauuccaccuucaucuugcauuagacuuguuauuuacagaaacaguggguuuugcuauuaacuaaauuuaucuucauuucucugugcugugaaaugugaaucugugcaggccuaaguuuuggcucugucugcuuagcuauuuuuuuuaauugaugucagucaugaauaaagaagaagaaauuacccauagaaguaauuguuuuucuuuucuuaggaacaguuagccuguggaggccauuauguuguggggauagacagauagacugccuguuuauagauuaauaaauggguccuucaccaaguuuccaguugugugaguguuuucuauaucaauuccccagcuaauggugauggaguacacauguucacauucaucaaggugacauaagucugagaugauuggacaauguuguucacaaagaaugagccaauaaauauucuuaaucuguaccaguguagcucucauacaaauaaaauauagcguucuaguuucauuucuguugcugugauaaaauacccugacaaaaaggaaggaacuuagaggaaagaguuuuucagcuuacauuucuagguuauugcccaucaccauggggaagucaagccaggaaccucaaacagcuagacaccugacauccacagucaagaguggagagaaaggaauggaaacauacugcuugcuuacucaucuucauuuuccacucauaaaguucagcacccacugccuaaggaauggugcugcccacaguggucugggucuucucacaccaguuaacuaagaggguucaucacagacgugccauuaggucaacccaguacggacagucccucauugaagcuuuucuucgaaggugauucuaaguugugucaaauugacaaauuaaaacuggccauggauuacagcuacuacuucauuaggaaugacuguucuccaugaaagggacuaccuuuuacguuuggaagccauuuuuguuaccagaauauuucuuuuccuuuugaccuagucacuuucugaaaagaguuaaugggcuggaaaaaugauuacuugagaauuugcagaagaguccaagcccugggguauuuauggucacaugaccacaguguagaagugaaggccagaggacaaguuccagaaaucaguuuuccccuucugccuugcuuugaggcaggagcucucuuguuucucucacuguguugcaaucuccaaacuagcugacacagaagcuuccagcuaauucuccaugucuaccucuaucuugccagaggaugguggcgauugcagauguacuaccacagcuaacuuuguacaugugcuuuggggauuaaacccagguuuucagguuuuuaugguaagacacuaaaaguccauuuucuuaaaagucuauuucuugugauuggguuuugucaguuugacagaaacucagacauaucugggaaagugggaaucuaaacugagaugauaacuccaaaaauguggccuguaggcaagucuauugaguuaccuucuugauuaaugauugauguagaagccugcaccaccacacuguauggcaccauuccuggacagaugguccuguugcguaagggagguaggcuaugcaagagcugaggagcaaaccagugagcaauugcccuucacaugcccuuugcuucagucccugccucaaguuucugcccugacuuucuucagugauggacugcaauguggccuauaagcugaaauaaaagcuuuccuucccaaguuguuuguggccauuguguuuuaucacagcaagagacaguuaacuaaaauaccauccuaauguucauuucuuaggugaggcuuacaugucuguccuuuuuuaaaaaagcuuuuuaccuauugguaaacguuguuacugucucuuuguucuucuuuuuaugccuagaugacucuguggccaaauuauacaugcaguuagcucuuacaguaaauauuacagacacgccaaacagaaacccaggcauucagguuguccaagugguuuuuauaauugugguucuaacucugauacuaguucaaaagaauauaggaagugacucuguaauggauacuaaacacaucugcuuuauucuccaaaucucuuucuuuuuaacccaagcccaaccaacauacguaugcccagaggaauuuccuuccuccuugaaaauccuuugaauaguugacucagccaugguuucuguguuugcugacaaauggagaaucagcuguaggccaugcaggucaggguauucuugguugcuguuucuaagugaaaacuuucuuuagauaacauaaauuuaacacaaguaggaagaaagggcaucucuguagaugaggcugagguuuuuguggcacagaaccacaaauaucccaagucuuggacacuucauuagaacacucaaguaagcauuuuuccaacccauuaccucuuuucagagagugauuaaauuaguuaguuagguuagaacacagagaguuuauggagccgcucagaucaagagcccaagucauuugaccagaggaugaugcuguuuggggaacauuaccuagugugugaguuuagaauuuuauggugcagcauuuacauuguuuucuaccuguuaagcugcuguucgaguugcaagguugccuguaccuacauagugcuagaaguccauaugcauuuugcuuauaugcaccuaacauaaauaaguaaugagauuguuggugcuuauguaacuucagagcugggcaacaacuguauaauacagucauuuuaacucuggugcuccucagacagucacuguuagcagguuggaggccucccucacagagcucagauacagccuaaucaucauuaucaauaccaaacagccaauuacaaugcauaugaucaccaugucuucaguauuuguucagcuaccuuguucugaaaaugaguauucauuuucucucugaagauagauuuuugucauuauaguuuucuuggucauaauuacaaauuaaacaguaucaaaggcauaaaucucggucagaagagggucaucgggcugcacggaaggaucugcacgucggauucucccucuagcucagaccacagucagguuuugaagaccaagauguacuuuucuacugugaaugcuaucuuuagcucuuucuaaacagacacuguacuucaagaaacucugggaaauucuuuuacaaaugaacaaagcauuuuagguuguagagagccaagcucauuuggucuuccccagagaagagcacaccaacuggcuguccagugccgaauggucaucccugagcacauacaugcaaguaacauugacuacagggcuauauuuaggaauauacaaguauaaacauagauggaugcagcaauaauuagugauaaaaagaggccaugaauuugaaagagaguugggggugcugugaaauccuuggaagaagcaaagagaaaggaaaaguguaauuguuauuuaugaauuuuaugcuagauuuuauucccccaauacacccucugacuguuacauaucccauaccuacucccuaccgcccugucuacacgaggauguccccaccacucacacccaucccacaugaccucuaaacuuccugguuccuccagucucuugaggguuagguacaucaucucugauugaacacaaaccuagcaguccucugcuguauauguguugggggccuuauaucagcugguguaugcugccuuuuuggugguccaguguuugcuagaucuuggggauccagauugauugagacagcagguccucuuagagguuugcccuccucagauucuuuccaccuuucccugauucaaccacaagggucagcagcuucuguccguugguugggugcaaauaucuggaaaugacucucucagcugcuuuuuggguuaugcuaggucccuuuuugugagcgcucuauagcaauuuuaugaggucccauuuaucaauucuugaucuuagagcaugagccauuggaguucuguucaggaaauuucccccugugccaaugaguucaaggcucuuucccauuuucucuucuauuaaauuaaguauaucugguuuuauggugaaguccuugauccauguggacuugaguuuguccaaggugacaaauaugggucuauuuucauuuuucuacauagaaacagccaguuagaccaacacuauuuauugaagauguuuucuuuuuuccauuguauauuuuugacuccuuugucaaagaucaagugcccauaaaugugugguuuuauuucugggucuucaauucuauuuuacugaucaacaugucuuucuuuguaccaauacaaugcaguuuuuaucacuauuauucuguaguaaagcuugaggucagagauggugauucccccagcucuucuuuuauuguuaagaauuguuuuuacuauucuggguuuuuugcuuuuccagaugaauuugagaauuguucuuucaaugucuuugaagaauuauguugagauuuugauggggauugcauugaaucuauaaauugccuuugguagguagaaugccaguuuuacuauguuaauucugccaauccauucucuccacuuucugagaucuucuuugauucuuucuucagagacuuaaagcuauugucauacagguuuuucacuuguuugguuagaguuacgccaagauauuuuauauuauuuguggcuauugugaagggaguuguuucccuaauuucuuacucagccuguuuaccauuuguauaaaggaaggcuacugauuuauuugaguuaaucuuauauccagccacuuugcugaaguaguuuaucagcuggagaaguucucugguagaauuuuuggggucgccuauauauacuaucuacaaauagugauacauuuacuucuucuuugccaauuuguauccccuugaugucuuuuuguugucuuauuguucuagcuagcacuucaaguacuguauugaauagauauggagaaagugggcauccuugucuuguucugguuuuagugggauugcuucaacuaugacuccauuuacauugauauuggcuguugguuugcaauaaauuucuuuuauuauauuuagagaugggccuugaauuccuaaacacuccaacaauuuuaacaugaagggguauuggauuuugucagaugcuuuuucugcaucuauggagaugaucauguaauuuuuuuucucagaguuuguuuauauaguggauuauguuaauguauuuccuuauauugaaccaucccugcaucccugggaugaagccuacuugaucaggaugaaugaugguuuugguguguucuuggauuccguuugcaagaauuuuauugaguauuuuugcaucaauauucauaagugagauuagucugaaguuuucuuuuuugguugggcccuugugugguuuagguaucagaggaauuggggcuucauagaacgaguuagguuguguuccuuuucuuucuauuuuaugggauaguuuaagaaauauugguauuaggucuucuuugaagguaugguagaagucuacacuaauuccuucugaccaugggcauuuuuguuugggaguuucuuaaugacuuccauuuccuugugcaauauggaccuguuuagauaguuuaccugcucuucuugauuuaacuuuguuaugugguaucugucuaaaaaacaucuauuucaucuagauuuuccaguuuugaugaguauaggcuuuuauaguacgaucugaugauauuuugaauuucuuccauuucuguuguuaugucucccuuuucauuucugauuuuguuaauuuggauacugccucugggcucuuuagggguuuaucuaucuuguugauuuucucaaaaaaaaaaaaaaaaaaaaaaaaaacagcuuuuguuuuguugauccuuuguacuguucucuuuguuucuauuugguugauuucagcccugaguuugucuacuccucuugggugaauuugcuucuuuuuguucuagagcucucuggugugcugguguuaguguaagaucucucuaguuucuuuaccagggcaguuagugauaugaguuuuucucuuagcacugcuuucaugugucccauaaguuuggguaugaugugucaguauuuucauuaaguuccaaggaagucuuuaauuucuuucuuaauuucuuaccugacuaauuuagaguagagaguuguucaguuuccacguguaugugggcuuuuugucguuuuugcuguuauuaaugaccagccuuaagccauggugaucugauaggaugcaugggauuauuucugucuucuuguaucuguuuaggguuguuuugugaccaauuauauggucaguuuuggagaaaguaccaugaggugcuaagaagaagcuguauucuuuuguuuuagggugaaauguucuauagauaucuguuaaauccauuugguucauaaccucuauuaguuucacugugucucuuuuuauuuucuguuucaaugaccuguccauugaugacagugggguguugaagucucccacuauuauuguguaggguucaauguguguuuugagcuuuaguaaaguuucuuuuaugaaugugggcgcucuugcauuuggggcauagauguucaaaauugagauuuuuaucuugauggauuuuccccuugaugaauauggaguguccuuccucaucacgcuugauaacuuuugguugaaagucuauuuuauuggauauuaggaugaugacuccaacuuguuuccugugaccauuugcuuggaagaccuuuuccauccuuuuacuccgagauagugucugucuuuguuauugagguguguuucuuauaugccaaaaugcuggguuuuguuuguguauccagucuguuagcuuaugucuuuuuauaggugaguugagucuauuaauauugaaagauauuaaagagaaaugacuguugguuccugauguuuguucauguagguggcuugaugugcuugugguucucuccuuaugacuuuguugugagaugcuuaauaucuuguccuuucuaggugcagauaucucucuuguauuugaguuuuuccuucuaggauccucugaagggcuggauugguagauagauacuguuugaauuugguuuuguccuggaauauuuugguuuccccauauguguugauugagaguuuugcuggguguaguagccuaggcuggcauuuguguucucuuagagucuguaugaccucuggccaggcucuucuggcuuucauagucuuuguugagaagucugauguaauucugauaggucugccuuuguauguuacuuggccauuuucccuugcagcuuuuaauauucucucuuuguucuguggguuuaguguuuugauuauuaugugacaagagcauuuucuuuucuggucccauuuauuugguguucuauaugcuuucuguaccuuuauggccacuucuuucuucagguuggggaaguuuucuucuaugauuuuguugaagacauuuuuagguccuuugagaugggaaccuucauucuccucuauuccaauuauucuuagauuuggucuuuugauuguguccugaauuuccuggaugcuuggguuaguuuuguacacuuugaauuuuccuugacaguugugucagucucuucuacuguaucuucuacaccugagauucucucuucuaucucuuguauucuguuggugaugcuuacaucuguaauuccugaccuccuuccuagguuuuccauuuucagguuugccuccauuuguguuuucuuuauuguuucuacuuccucuuuuacuuggaucgcuuuauucaauuccuucaccuguuuaccuguguuuuccuguauuucuuucagugaguuauuaauauccuccuuuaaggacugugguuucuguuucccugugugcagcagaacuccagggaggcuuuuagucugucaggucaguuguccugcauaccuuuaagcuguggugucuacugcucugagugcagcugauccucaacugcuuugaguacaguagauccucuaggaugggucaggauguaguguccucacaggagcagaccagcuaggagucugccccagcagaaaggaccaggugggaggggcgaaagaggaguagucuaauugcuuuauuuuugaaaauuauaaaagacaucuucauuuuaauuaaacaauaaaauuuaaaagcaauauauggacacuagaaaaugggacuugagaauauguuccugauaccugguaguggagccaaaacagaauaggagcuccugccuagccucagggucaccaaugauagacagcaagaaagagugggacaagcacaggacugcaggaagacuaccuugaaacaaagcugacuccauuuccugcaucuaugggaacugaauuguuucuuugaagccaaguuccauauauuugccagguuacugcuggcaccaaagagaaccagcacaugaucacauugauccuccccaugagaauguuuccuguucucgugggaagaugucagccaggaaaaaagaauuccuaagagaauaacacauagaugacggacaagugaguccuauuuuucaguucccuccagauguucucagaagucagacuuaaugggaauuuggcuccuuaacaaagaccccaucaaaugccccugcugugcucauauugacaaagguggguugcaguacuuguguucgcuuggauugguggauuucaagugccaaaaugcugcuugcacugcauagggacaaugagggcacuuuucuccagcugaggguuuuaggauguauucugagcacacuacaagaauuucccuuuuuuccugaaauuaaaaaaaaaguagagggaaauggggaugguguuuuugaaaaaccaaugucuggaaguuugguuuucuucaguggaucuuuuguagcuauuuugugcauggaugccuuaacucaaagaaagugcagucagcccacauugagaauccacauuuaagaauuaauuaagccaaccucaggauaaaaaucuuuuaaaaaguauacauguguacuaaauauuuacacacuuuuucuugccauuucauuuaaguaauaaaauguaagaaguauuuaccugguguuuguauugggucagguguuaucaaugaccuagagaugcuuuaaagaaugcaggaggacacagggaggugauaugcaaaugugucauuucacaggagaaacuccaacaucugcagcuuuucuccuucagcagggcuggggaggggguguccuggaacuggucccugugguaucaaaagaugacugcauguuccaacucugagaaugcaucacaggcugcagaacagaccugaccugccuacccaaauuucagcacaggcaaaucgugucccaguugaacuaaucugucugcuuauuuguaagauuacaacaaagccugagauuggauuccucaccugaaucacuuccuuauugacugaauccauuuagacuccccucuaauuuagcagaguauucuuauuaaacccaggaguacaaacaucaauuaucuaagcugcaucuaauuuccuucaccauuuauguuccuucauugguugccaauggauuauaagacaugauuagaauucagcaggaaaauaucaacaaaaaugagaauccaguucuagaaaaaacagaugcuuagacaagaguaacaguguucagaauuaaauucuguguuuaaaaaaaggguccuuaucucaaccaauauaaucauucuugcuugaguuuuaucagccugaugcccacugcaguggcacuaaauuagcauggcaaauuggaauagacagaaauagaaagcagcagcugcuuuuccaggcuucauguauauacuacaguguguguguguguguguguguguguguguguguguguguguguguucuguguguugauauaugcacauauuuacauguacauguuuacaugugcaguugugcucaccugugcauacacuugugaaggccagagcucaacuuugguaucuuuucuuauucuccaucuuaguuaguuuguuagucagucagucauucagucagccaauuguuuauuuguuuaagauagucucucacugaacauagaacuaacuguuucaacuaggcugggugacaaagcccuaggauccuccuuacucugcccuuccagcaucacguuuauagguaccaugugccaugcugcuaugccaaacucaggucugaauacuugcucagcaagcaccuuacccacugagcucaaaccccaccacaaauugcuaaugcauauuuuaagugaagcguaguaacagaaccauacuccaaccugcuacggcguauuuuggauacagcacaguaacagaaccuccccagccugcugcaucaucuuuaaacacagcacaguacuuaaccguuuguagcagccauugcaaaauggccaugacacacagaaccuuucucuuuguucacuuccagcagugcucaggaugggaggagaauaaagaaaagcaaagguucuguuuguggacuugugacugguauagcauuuguucugguuugguuugguuugguuuaguuugguuugguuugguuugguuucuuuuuaaggaguaguagauuggaauggacaaacuuaugcuauuaguuuuauuagauagccugggcaccugcaguugucagugauggcaaggaaauaaugcaucgcagaugccuuaaaaucugaaggguauugucugagacaucagaggguucaaggaagugggcugagggcacaguggauuugaggagagcugaaacaaaucaugccugucucaggaguuagcuuacaagcugaaccggccccugcuuguuuuuauuaaacuucauuggaaugcagccacacuucuucauuuauguaguacuccugacuguugucccaaugaccaaguuguguaguuguaaaagaacugggcucacugagccuggaagguuuacugcuucauccuuaauagaacggacuuauuccugaugcacauugcuagcugucugcccuaagguugcuggcucuugcuuguggcucguguaugaaaacagacacugguauuucucgugacuacuaugaauggcauggccucccuuauuucucccugagccuuaguuuaaccauaaauagaaguaauaaaccuugucuugugauuuuaauauaaauguguaguggauucuggguauguaugcguucccugccuggucugagugaggucuaaguaggugccugaaauccacaagcuucucaaccaccaagagccuuuacgguuugaugcugggugugggcagccucucauuucccacaccccagcaccugguccagcucucuucacuucucagaggcacaguucuuccaguaccucagccuuucccagaugugcccacuucugguccucgagcccugcucuugaccaccugugucuccuugacugucuguagcccuagcuucaaugucucugcccugagaagccggucuacucuaccaucuuacccuuggguucucaugguauuuguuuccuccucuccauaaccuggcagcauuuacaauuucaaauacagaugaagaccacguuugccugguuaaauuauuuuccugccaaucuggaugguuaaaggaguaccuagcucagaguggacccucaagaauauuuauuaaguagauagcuuccucacuuuugagcaauggcaacacuggcauuuaauaaaagggauucuuggcacuacuaaagaaaaagaagugugguuuucagcccagcauacuguuugcauaaucuggcacacagcguuuaucucuuugagugucaggcuuguuuuucauuuguaaagcaggguauuauguaccuccuguauugaugguugaauuaguguuaucaauaagaagauauuaagcccuacaugucucauagggccuuauaauuuugauagcucucagucauuaagcuauagccucagugguuucccuccuuucuguuuucuugucuauaaauugaggaugaaaauuauacccgccuugugugauacccaugugucaaucauguggcauaauaaaccuuccaucuucuagaaaauagaauaguuuuguuugugaaaacuaguauguucauccuucaugaaugacuucccagaaagguguauccuaaaacaaaacuuuacauguaguugaauucacaacucccuugcagcucuccaccacuauaugugcacuugcacuucguuauuaccacuuggcauuugaagacaugcucuucagagcaguagcuguaggguaucccguaggacugcaagaacauuccagacaagcauguaugaguucaguaagaacccuccgcugcagcaaagggguucauuguuggguucuguguuuguuguuugcuugcuuuguuuauuugggagcuuaacaaauagcaauggcugcagcuuuuuuacuuucaaagugcauccuuucaauuauggacuauaaucugcagccaguguguguuucgcaagcucaaacacacagagacauuugagaacugacguuuggauggcccaaccaccugcacagcugccagcaguuguuccggacucuacugcuggggcagcugucugggaccuagggaccagugcucucucugguaccuucaccaccuucuuagaugaucuuuacuuuugugcaacaguaaauagcagcucugaggacucucacccgaaucuuggaaaugccuguuacuuuaagcacuuuggaaucugcuaggagcagcucugaauauuuacagagaccuacaagaggaaagggguuguuguucuuguuguuguuuuaguucuuggugccaaaaaagcagacaguaaaaaguuaaaaagccgcuuuugcuauuaucguggaacagcagcuugugguuguaaaaugaaugaaucugugaagcacccauugaaaaugugacaugcuuuauaaaugcuaaauaauaauaaugaugucacaaggcuuucauuuuuaaacugucuuaauuucauucucaguuugagcuugcagauuauaguacuuaauuauagaaauuggcccagagugaaaccuuaaaucagauuuccauuaaagugcaugacugcagcaaauuacucuauaguggggaagaagcugagagcuggaaggccugcuggaagaggaucuccccaccaaccagaaggcaccucuucugccaggacauaugggacacuguguccugagcagagccagucuccuaaaaaaggcagccuguguauaucuucuguugcuuuuccuauagaaaagcuucccauggaagcugcugucaaaccuuaaugucacuuagcucuggauuugguaggaaugcgccagcaaauccacucuccuggcccuagcccugauucggccacguuguccugcauggccucagguuaccuccaugucaggccugacaugccuccaugaguuacauugggugccauguuugccucuguccagguugcaucccccuccuuaaagucccuggguugcaugcuggcuaaauguguugcuuuccuuuuagauaaagguugcucuauaaggagaaccuauguuaagguugggcucaugcugagcacagugagacacuguuaugugaggcucaugagaccugacacccgcugagacauucucagcuuguaguuggcgaucacuccagggcauucacccacuaaguagaauugucacagggucacagacaucacuuccuucucacccccuccgcuccugccuguuuagauaaauucaccuuaguucccgugagcugauagaacagucacauaguuuuagauuaagcgcacugagucccuguaacucagagcaucccugacacaugagcuugcccuuauauuauagaggucacagguaccagucugugcuuacuggaaugcccaguuuuuccucauaaaugcuagugugugccucuucaguucugucucaaggcccaugaaggaauuauugcuugugaacacuuuuucuucuauuguucugggaaguucccuuccaucccacaguuauuuggaaauuagugcuucauuaagcaucaaugcuaacagcauuuaaugguugccauuagaaagcaggcuucugcuuaccaguuagccugcugugaguggaaaugggagguuucuuucuugggaguagcccccagucccuaauugacuugaaaauauugcuuauuugcuucauuacuaagcuguuaccauucuauuaaaguuuagucacugugccucuauuauauauggggaaagguuuccuacucacagccuggauagucuguccaauagugucauugccugcugggaaaaagucaggagcacguaagcugagagcuguugccagauacugcacguguaucaucuucuugaaauccugcaggggucugguggaccagggacuauuacucucgucuuacagaucaggaaaccauauucaagagaaguuauauagcuuaaccagguuucagccuuagcgaccagcacggaugagcaaccaguagaauuuuaagcagggccgucacugcccccauagcucucuccacuacagagggcccacucacuguauuuauaagcagguucuaggggcaucagaauaggaaaaauaagaauuccuguaauggcacauccuagagauaagugcuguagaaauguaaucuuuucuuuucuccuuugcuauucgcaguuaauuuaucauauggaaccuauaggaucuaaacuggcaugcugcauguaaauacaugcuuggcaauuucuguagugugcucucauugccacugcauuguugggauuuugaugccucaagccugaugaauaacucuuuucuguggguguuaucuauuaaucuaaguaaugaauucuuuucauuaucucguucuuuguguuaauuauacaggauuuucuuauacccauuuaucaaauuaagacaaguacaauauucuuuuuaccccacaugccuguaaauguggaaucuguacaaacaggugaacaugauggguuucaauuuaaauuucugaaaaauucuuguuaguaacuugacucuuuuuuuuuaaucuuuugucuuuuuuugagacaggguuucucuguauagcccugcuguccuggaacucacucuguaaacuaggcuggccucaaacucgaaauucaccugccucugccucccaagggcugggauuaaaggcgugugccaccacugcccagcuaacuugacucuuuuuauguuaccucuuuaucuuuucuuuuuuaaaucaaaacaguuguugucucagauaguuacauuaugucuggauuuugagaaugugcccuaagaagcauggcaagguuguagucuuuaccuuuuacuacaaacagcacauacuaaguucugagauuugaaccuguuguguuaggcacaagaacuacauaucauaaaagaaaaauagaugcaugaguuuuuaaaugacacauuucguuuuggaaaaggaaaaaaaaaaaaagaaaacguuauaccaguuccaaauauuuaagaaacccagagggcggauacagaaguuggauucauuuuggggccugucucaguucauaagacuggaugguaauauggguuaauaaugauauguuguuauuuauucauuaccgaagcuuaauuuuugugacagucuugucuguucuuaguauuucuuucucuguguaaaaacugacagaaaccaagaagccuuacuuaacaaccucuguuauuugacuagcuguuuugaggcuguuggcuaccacacucugacagcacuuccuguuugggauuucagguggaagccauucucgucaauaucuuuggugggaucgucaacugugccaucauugccaacggaaucaccaaagccugccgggagcuggagcucaaggugccacugguaguccggcuugaaggugagucacaggaguucccagcacuaauuuuccuuuccagcaugcucugggcucacacacuuccuaagcuccagaaaacuggguuaacugagaugcagcaggcucaguauuacaauggucuggacuuccagcaggcaagugcaguugcaguuccucagacacugugggccuaggacuacccaggcucauuugccaggcugguuccagagagcuaaagcccuuguauuauagaggccauuguacaaauacccagcauaugugaucucuuuccucuuacaugcaaagcuaugauaggaucaguuuauauaauagaaacaguaagaaauuagcaauagcuagaaauaagauagaaaauaacaacauuauggugaaauuaaagugaauuugauuucuuucucucaaaaaagacaaguaauauuuucaugauuggcuacuguaagcuacugauacugugggaagagaaaccacagaucaaaggagaugauaugcauauguaugugagucuacuuguauauauauugucuuuuuaagucuuuaauaagacugguaacuguuuucagcucccuuacuuaccuagcuucucuguuauucccauaagacuuugucacaauguauaugaacaaugucuaaccucagagacguguauauggacucaggaggaggaacgccuuuucugacuuuuguuuuguucgaaauggggucuccuuaugagcuccaggcuggccuugaacaugcucuuuggcccagucuaaucuagaauucaaaaucccccacuucagcuucccaaguccaaugauuccaagugcccagccccacacccagcugggauguuuucgucagcuucucauggagccaugagcuuucuucccugguacugcaguacaggugucagccaguuuuacugaaggugcuccgcugugaacuaggaacaugucugggaaaguucucauaaccugcucuuuucagccccucggugugucucacacuaaguucauuucacccaugcacgcugcauaaccucaugcucugauaacuuuuuucaguuaugucccaaagguuauugcauuucaaagcacaaaagccccaaguccauguuuguuaggaucaacacugcuccugauaggacugcauuuaagguguugggaagcugucaaguauacagaggcagaugcaacuuauugagaguuuggguuuucaguuuaagauauaaauuuuaucuucaacugcaaaacaguuguuauccucaaaaugacaaguucauuucacuuauauuugaggaaauaucaccagauaaccaagucugaauagccacaguauggugauuggucuuugaagugguuacaguguuccauggggauggcaaugacuccggcccaugcuuggguguagaagcacuucuccauagagacaguggccauaguuagccaaguagcugagcccauugcucaggugcagaagcaccuucaguaaauugauguaaacuguuugauugagugcucaagggcugaggcauaauaaaauuaauuuucuuuuuacucucuauugcuugaaacaugguugguauggagaguguguggugggguaucagugaccacuagugccuuccuuccuuauacaucagccucacccaccaucacaugacgaucauggcagccucuucauccaugccagugccaacccagucuuacugucauucauuacugcuaccacugcaugacaguuuaacagagaaaaccuucccguauuuaacaaucauuuuaauaugaaaacuccugaaagccauccacauugucauugcauucuggucauaacauucagcagccccacuggguugguuucuucaguaucaccuuaggggcagcccagauugcccaggcucugugcuggugcuguucuccuagugaugaagucugagggucauuugauagcacuguauaucucauccccugauggagaggccagaggagcugcagccugcuuaaggucucccuuuucucucuucucucucucugcaauacugccucuuccuuaccugaaacugucugccuugugaccuaaaaccagaacauccuggacuugauagaaaugcugaccccagagaggaggucgggcagcaggcgcuccaggcagcaacguugaguguggacagcagaacauuccacagaauuaacucauuguaggaguacagagacauaauugauucccgugaaacuaauaaaagccaaugauuagugauaccacaguacagaaagcuggccaaggaguuaacgaggccaucggcaucaguuauaauucugauuaaaauguugaugucagacugguuuuagauucaaaaugaccccugacccucguguuguaaaagccaacugaggcaggaaucacauuaguaucugacacuuggaaauaauuagaaguauuccugcaguggauucgcuuucuuccagcaauccucacugggcacauaguauuauuauauauacaauuauuauuuguacauuucuagaaauugcuuccuuuucauuuuucuugaaaacuugaaaaugagcaaggcugauaacucacugugcacacaaaucugaguuugaucaucuggacucacauuuuuaaaaaaaaauagccaagaauuguagugcacauuuaucaucccagcacugaggaggggagggcaggagaagcccugagccaccaaugcagccagcuucaugcguuccaggccaaugagaaauccaucucaaacaauaaggccaacaagacccgagaaacaacagccaaggguuuucucuggcccccaccugcaagcauacacacacuggccgccaccuacaagcauacacacacacacauacacauugugcauguguaccuacacacacuugcaucugcacacacaagagcaaacaugcacauacauacacaaauugaaaacagcccuugucuuauuuucaugcuauacuuaguauuccagaguaguuguuccaugauaccugggagguaaguauguauguaaagauaugcaaauuaacacacccaagauuaucuccguaaauagucucugauguuuguguuagaagucuguuugagauaagagagaaaagcuuugaaauuucugagcuuguuagacaauccuuuuucuucuacagucugugccugugguuuuuaauuagaacucaguuauuaagaaaugccacgcacaggucacagaacuuuaaacaucaaggaagaugaguagaaauguagaaaguuaacaggagaaaugaaguagaaaaaugacaggguaaggcagugagugcacuaagcaugaaagaggccuugccuuccugggaccuguuccugucuucuuggcaguggucuugggggccccggcugcaucacugaaaauuuggaaacacugagguaucacacugucugugucccgaacgugaaagugauggcucaagacaagcccaaagauaccagugucuccccuaacugaaguaggcaaggcuaucccugguggccuuugccacuauccuuucuauacucuauggucucucuugugucccaagaaccuuuuaccaagaggaaagaagcaaugaauuugguauuucuagaguaguaccagguuuucucuacuucugcuauacaaauuggcaucuugugugaucagcguucuuggguaaauguaggcucucacaucaacccagcagaugugcaacccagagaaagcauguggaauaucuaagagacaaacagcucaaccaacaccaaaaccagacccuccccaaacugcaugguuaucacacacuaaacacagggagcagaaggaauuuugcuuugacucuacucagcggucugaccauaaauaacaaaaugcagaauuuggagaagauacaaaccagaaaggacccauaacaaaacuaagugagaaccaggccagaacucugcgagcuaaggaaacccagacuucugugaaguguuugccuuggagcugggugcuuguggcucagccgcuuucaucaucauguuccucauuuaacuuguaauuguauuuuuaaucuaauucacaaaaacacaauagcuauacauaccauggaaugcugaaaacauguauacguuauguaauguuuuaaugaagugaagcuauguguaccucagcuacaccauucuuuguggugagaacagauuuuauucuggcuuuaugaaaaguauaacauuguuauuuguaguuaucuugugcaauuaauacccaaugguuagccugucucuguacuuauguacucucuaagcucccuagucuacucugcaaucuguuuuuccuaucuaccuguccaucuauccaucaucuauauauauauguauauguauauauauauauauaucuucucuccacauguaauauauguguggauaugucugucauccuuuuuacucauuauugacuacuguaauuaggaaguuuagaaguaugucuuucaaaaguaauuuuuaguuuuaauuuaaucuuuaauacauacaaacuguggucuguuuuguuuugauuuuugagacugguuuuuugagauuagcuauguagccaagaugaccuuuaacgccugaucuucugccuuuaccucuagagugcuaggauuauaggcaugaaugccaugcccagccccaaaugcauacuauaaacggggaauuuccacguugaauguggaaggauaagaucugaaugacugacaggaaggaagaggggauuauuagaagaaagucggcauccauccccgagaguuggaacucuaggagcugaagcccaggcccugcauagcugagaggccauccuggagagagugggggcugcacagcagucugugagagcagaguggagcaugaagccuuuaucugcagcacuggcuggagcuucggacugagcaaggacagggagaaaaccacaagaaaacaggaagcccaagagcccuaaguccaggauugcagcgggcuguggucuaggaagcugggaagaaugaagugagagaaccaucucaccugggaugggggaugguguauggaaagcaguuccucuagaucuggaaugaacaugagucccugcuggcacuagcccuggcucaguguuguugaagccucagacacaccagugcagaucugucuaaccuacacaacugugagaacuccaauaaucaagauagcaaguguucccaaagccagauggccuguuuaguuaguagcgucuguuuccucuaaguaaaggaagcagcuugcuuguuuguuuuuugucuauguggaagacccagaaccccugucuacauucacccacucacauccaugccaugacagcuuuggcccacacacaguacacuggaaacaggcuaaaaacaucagguuugcuucgguagaauuuugugaaccaaguccuuguacucugccguauacugacggcaagcugucuuuaucuauggaagcuuuuucccugcucuuuggaaugauaacaccauaaccccaugcauucauuugccuuacuaagcaaaugaauacaugaaauguuucuaucagccaagacacaggauaauuuuguuuuaaaagacuuguggguaauugaacagccaguuaagagguagagguugagccuuuguaaacaguuguugcuagcuagauaaagagcaugguuucugaugagcguccugaaauguacacagacauucaguaugguaugggguacugcugagaaauggacacauaaugacugacaguuguguggggugucacaguuguguagcgucuggauuugcuaacaucuucagugucuuuuuucuccuuuaagaugcauucuuucuuguuguuguccuguuuaaaucugcaccacaauccuauauuugauggauacuugaggaagaauuuccucuucucucaggugcacauuaugauucugaguugagcuuguuaguaacaacagcuaauaauaaugacuguaagcccacaaaguuuguaggcuggaucacauuucucgucaccaggucuuucaauacaauucgucuacccagcaacgaaagauuugucucagcaaugcaaauauuuuuauuucuuuccccaaagcuccucaaaagccagaaucccaccccguuuguuguuccccuuacugccaaauucucccccgcuuggugcuggaaacaggaugaguggcauggggaggaaaagggacagacacacauacagaaaaacugggaugggacaggcagucugauggaaggcaccuucugugcccagaaauucaguacgguuauuauguacaacacauguguaguggcugcuuuuaugucagcuugacccaggcuagagucaucagagagggaggagccucaguugaggaaaugccucaaugagauccagcuguaaggcauuuuucuagcacaucuuccuuugguuacucaaggcaucucuguucccagggugaccaaccauucuucucaagccuuccuaggcagucugcaccuugcauugcucccuaccacccaggguccuggguccucuuucaucucuccccuccauccgcauucucuggggacacauccugugugggccaacuuucacuguggugaugccccaccccuccucugccucuacucauuagcaccccaccuuccccaaugacccuccuucuucuuaguguuucuucagcagcucgcacugccuguggcaugggagggacucuaguccccaggggugccaggucugaauggcuaaguauacaguaaugcguaaaccucugcugcuccugauaguuacaccaacuccacaggugcuagccucaagcguuccucagaacaggaaaagcuucugugggucaaaacuuuuaaucugcauuaaucugcucucuuaggcauuucaaguuucccucaccucaccucuagauagauaaugugcauaaccagcauuucugccauuuggaugucuguggccuugucauaucuguaagcuaagucuucucaaagaagauaacuccagcauuaugcaguguccccaagcucucugggcagugaggugauggagggagguagcugugacagacuaauccucucuggccguuguuaugcaaaggaacaguuuuaaggaagagugguuaaagcagaguacucauuaggcccacuguaucuaaugcagacucccugucugcuuucuggauauugucggugggaccagucaguucaugucuucaugcaacacuguaguuauucuaauuagcagccugcuauuagggagcagccugcagggagauuuagucccuuguuuuacagaugaugagucuacccugccaauaagaauguugaagagacaccccuggagacuauuccuagucuaucccuauagccuccaugacaguguuuuaggacagaggacagauagcuuucgcccuaugccaccuucugcucauugacuguggcugcugaaagcgcugugccaauaaaauccugaugcacuguagcucagagaaagagguuccauaaucaugauuguacacuacagaugucaaaagagaugcuuuuugagccaaccauuugccauuagugaaugaaaccauacaggggacuuucuccccuagaaauauagcauucuauucuauugggagcaggaaguaaagugggggcuaaaaacugggaaagaaccaaguaagauaauuucuuacuuuguacagcccaucagacaugagcuggggcauucugauaagcuuuccugugaagagucagcucuuguccuuugaggccauguaucccugcugcaguugcuuagcucucugcgguagguaguguugaagcagcucuggacagugcccggggagauggcugccccugggucauaauaagucuuuugguacaaaaacagauaucagaguaggucuggcuuaugagcccuaguuugcagaccccuaaguggaaaagagcccagcaacaagaccuaguguuuuagaaacuccuccuauuauccauuucuaauucuggcugugggcucagccuguaaauuucuuauaagagucaaguuagaacuugacaaacaauaucagcucuucaaauacaguguuuuucuuaaggacaaucuuagcaguagaguccacacucaggcauuuccccuacuuacagucccauaccguaaugcagugguauggcuucucaggcagucuaucagucuguuugugcugcucugacaaaacaccuacgucuggauaauuuaccaagaaaagagcuuuacuuuguugccacaucugcuggcgucugcucaucucagagagccuggaugacacgcguggcagagaugcauuuggaagaaaucaucuggcaagccaaggggcaagagagcaggcuggcuguccacaccuguggcaccagcacacgggagauggaggcagaauuaggaauucagagucagccuuggccacaucggguuugaggccaaccaagaccgcauggaaaacaagacgagaugaagcaagugcagcuucacucuuuuugugacaaugcacguucuaaccagcauuaguccuuuagguaaguccuugugacauaauuaccuuccacuagaacuccccaccacugugcuaagagcacucauacagcacaugagucuuugagggggacauugccuucuauagccaaaccauagcaaggacgacugaaggucugggucagcauuguggacugauguaaaagaaaggccuugcagauuuuaagagcucuucaaaagaucuguccuacagcaugcacaagacaugaacaagcucaugacagaccaaaccccaccauggagggggcagggaagccugaagcccacuccuaccuagcucagaagcuauuggcaacucauggcuucgagagaaugagaguaacacguccaaaaggaaggccacacauccaagacuaugcaggcagcacuuccuggacuuggcugauaaaaagaaagacaaguuagguggaugggaugggauggacaggagaggaauugggaagaggagacaaaacacucuggauaaauccucaaagaacgaaugaaucuucuaaaaauaaagaaagauccguucuguccuguagaugaugggaguaaguagacuaaguacugcagccaguuuugcuugccagaggguucuuugcauucuaguuugauauuacaguugaacauggcuugcauuaauauuuaugcugccuuuuuuagggauacauaauugaaagcaaaagcauaugcaccuaggaguggcucucagugaacacgcauagacuugaucccgaaccuugcuuuuguggucagaugauugcaucuuggucagagacuuccugcugcuaaaucuggcuacugcccacagcaguccucacccuguguaucuucuuaccauggcugugaaacagugucacagaccacuuuuuaucagccuuaauuuucauagaauguguggguagauaagauccucacccaagggugaagaaucuccagucaaauggacagugacuuucucaagucauucagcuucuuaggaauaaagccaggugugaaauuucaaccuccucucuuguaguauguagggggaaaaacaguauugaucggggagguaagauggcucaguagguaaaguguaaccaaagcaugaggguccaugauuccaguauugugcugaccagcccgucuauauaauuggugagaugcagauuccaugagagaugcugucucaaaaaauaauaugcagaguaauagaggaaggcacuuggcauagaccucuguuuuuuucacaaguacauuacaugcacaugggcauaugcacaaacugacauauauacaaguagcagcaucauaauguaaggcacacauuguaaggcacaaacuagcuuuccaauagucugaauaggucugcucuuaguaaauguuagcagugcaauuuguacuagcugucacaucugaacccuuguuacugacccuauguaucacugccauuggcugccaggugguguucaaccugagacuugaguuaucuccaagaaggggagggguacgggcacagugggaguuugaucucuugauucugugcucagaaaguucuuuacguauuguggauauuagucuucugucgaauccauaguagcuagagauucucucccacuugggggggcuuccucucugcucaguucauuguuuucuuagccuugucguuuugguuuaaugaagucccgggugucaguuguuggccuuaauuucuggacaaauagagucucguuaagagagcccucucuuacaccugcauccuguuaggugcugccuguuuucuugcagcagcuucaguguuuccacucucacaugacgucuuugaugcacuuggaguuaauuuucauguaagguaacagaugcaggccuaauuucauucuuuugcauguggacauugguuuucccagcaccauuuguugguguuuucucuccaaugugguuuuggcaucuaugucaaauaccagaugauucuaguuguauguacucuuauuugggccuucuauucuguuucauuggucuacaugucugcucuugugccaguaccauauggcuguuuuaugacuguaacuccacaguauaccuugaacuuuagaauagcaaauuuuagaaugguuuuguucuguuuacucacggcuguuuacucaauagcuuuggcuauuggggccuuuugugguuccaugaaaauuuuaggauuuuuuuccucuggugauuugaauaugaauggccccagaggcuucugucuuugaauguuugguccucaguugguggagcuguuugguaaggauuaggacuuggggucuuaguggaggagguauagcacuggggcuggguuuuaagguuuauaaaccccaugauauuccaauuugcauucucucugcguuggaucaggauguaagcgcucagacacugcuccagcgccaugacugccuuucugcugcugugcuccugacauaauagucauguucucacccuccaaacuguaagcaaggccccaguuacauccuuccuuuuauaagucuccuuggucauaauacuucuucacagcgcuuucucuauuucugugaagaauguuuuggcaauuucgauuagaauugcauugaaucuauaaauugcuuuuguuaggaugaucauuuuucacaauauuauuucuacuaauccuguccauuuucuaguuuuuccucggugucuuucuucagagauugaaaguucauuguggugccuuugcuucuuuucugaguuuuauuccuaggugcuuauguucuuuggagcuacuguggauggaaauguguccauggucucuuucacaguaugucuguggaaucauuccauuacuaaaggaauaacaagagagaagagauuccaaacauuggcuaaacaacagugcucugucugaugauggcuggaaagaaggaacaggacccacggacaccggaccccaggaaccuacugcuuuguagaguguguccuguuucuacuccaaggaaagaaaggaagccuccgagcagaacugagccuugucaggcccugugagccacacugucugugucaccgcccuagcucugguguugcagagcacagcaaucagcagccugugagcgcaucagcuuggcccugcuccaucaaaacucuauuuaugggcacugaaauuugaauuucauguaauuuucauguaucacaaaauauuauucugauuuuuugcccagcuauuuaaaaauaugaaaacuauucuuagcuuacaaguagcaugcaaagagacugugggcugcauugggcuuaaaagccagcgugugccagcccugauuuagaacaggaggcugaaucaggccugugauagcucacugauugcuugaccaaguagauucccuaguaccugagccucaguuucccccagugagaugaagugaaggcuuagcuuaaagaauuaccagcauucuuuuuugcauggugcucuaugguacauggccagcgugugguuuugauuucagauaaaucugaacucuacucuuuuucuaucuuccaacuuucugggagucauuaggucagcugcuaaguuccugguaccuuggguacuuuaucugugaaguugggcuaaaaugauguugcuuuuagauuugcuuugagaauugaguuuuaugauauuuaagaaccaguaaucauacauagacagcaagcuuauacuguuuuuaauauuaucuucguagucucuuuuaaaaucugguaacauguagucaauauguacuuaauaguggcguuguauucuuuuaaaaggagcaaaaaccugaaugaucaggccagggaguugacuuaguuauaguauagagcccgcugcacaaacaugaggaccugaguucagaucccaagagcccauguuagcaggaggggcagcagaguucacaccuguaaccccugggcugggcugggcuaggcugggcugggcugggcugggcugggcugggcugggcugggcugggcugggcugagcugggcugagcugggcugggcugggcugggcugagcugggcugggcugagcugggcugggcugagcuguggagguaacagugaagggagguaagcaggugccaguuucuggccagccagucuggccaauuugguaaauugaccucuagguucagugagaaacccugucugaaaacauaugguagagagugaucaaggaauaugcucaguguugaucucuggccuccauagacauacauguguacacacacauuuauauaaaaacauacaugcaugcauauguacauacauacauacacacauacgcacaucugaaugccuauaaaagcaguaauucaagagaggcgucugcacuggacaguguuauccucugcuccugggguaaaggccagccugaguuggggcagggcagaggcugcaucucuucacucaaacccugucagcccugcccaguguccucucucuugcauggugaaagcacaggguggauugauaaauuaccccugcaucucuguuuacagcucucuuccuccacccaguggcaggaagccacuauagaccacuuggaagcagagacguuuuuaccugcuucaugugcuucuuuuucucaugucugcuagcagccgaguaggagucugugcugagccagugcccccuuuguuucucuacacgcugucauucucaaggccuggaaguggguagguagccacauggccagacagcggucaagaagccagaguugagaagugacagccagcugagcugugcggguugaucgguuauguguaugggugguuauuagcauguuguccugcagccccauugagaagcauggcagcauuuaauaaauauuaaagcauaucagcagcaccauuuaagugugggaaagugaucaguccccauccuaauugugugcagggcauaaacacacucuuuagaacacuuaauuccaugucagaguuuaaaguggcugugaugguuucuacuuagaaauaaagucagaaagggggcuuggaauagaugucagccauggaggucagaaagaagccucaaacgcgccaauaacaccauucccccaaagauggagacacucacaagcauuugcccagggcauccucacuccccaugaccugauuuuuacuggcuccuuuuucuuugcaaucucucuucucuuuccccuccagcugcuuccucaaccagaaggaggaagcaaaugguaguaauugcuggccaggccaggaugcgggcaaagccuagccaugcaggggaagagagggagacaaaggacagggcaagugcggaggccacauggcaagcuccccaauuccucacccugccuuucucuccucacaugcucauccuucucuggcuuguuccccaugauguccuccucaccuguguccuggguuggccuccccccagccuccuucugaccuccgucugcucauggcggcucucucuggauucacuucucagugcaguccaguuuauuccugggcucuuugaguguuacaaucccuucacacccugcuucuuccaagugugauaguaugugcuuaauaauuaagacuguaauuaaaguauaacagcaaguauaauuaaaauucgcuuuaguagauccugaaauuauaaagcaauuagguauuuugguguggcacugaagaugccgccaggagguagagggaaggcucccuucaccguuuccccgacugcacccaucaacauaacucgagugugaggacucucuucacuuggcucaccacaugguaagagaauuguuugcagcuuagagccugcccuggagaguagccagggcaaauggaaugccaggacauggagucacugccaaggccucuggagaacccucagcucuucaaaaugaucagagaaggaucuguccaaaccucuguccucaggcaucaucguuugugacuguggcuguccuuacccagucugucagcucacauguaacauguagcugauacugcaagauucccugagaagcaaacccagcgcugacagggacguguagcaggcugugggaaauaucacuaagcugccccacagggcucaucccuguugcgauguagagaucacugagugcuccagcagcacaucugacaagccugcuguagcuggaacauugaaggcaguggcagggaaggaggcccaggagacugggagagacagcuucgagcgagcgcaugggcaugcagggcaaaggccaguggggcucggugugccugccuaggcacuugugaauuuuaacauggagccuucuuauuccccuugagaauacugcuccuaagccagaugcugcagaugauauuaauuaagggccugaauuauuuaugcugucggcuccaaggaaaagcagcuucauaugugaguugguuuccuuuguuuguuuguuuguuuguuuguuuguuuuguaaucagcauuuguuucguccuuacgcauggaaaauucagguaauagugaauggagaauucugaguggauaguucucagaaugagugaaggaaaccaugaauaaagaacaaacaagccaacccccaaaauaccaggagaggggugggagagaggccuggaacaguuauguuccacagguuuguggaggccuggggagcugggugcugagacuggagaaugcccgaaaggaaaagcucuuguacuuuuucuuucguuuggucucuggccgacaggaaggcacccagggaagguaucccagucgacuccuuugugaaaggggauaggaaugacacaucagacuucagguccagaggugugcuucuagcccaggccuuauuuuugcuucacucugccauugcuccaugacagccacaccugcagguuaauguacagauuccuuagccucugaccuaaccaugaugcacacccuguccugcuucucagccucuggaacccagacucagcuuaccaaaggagucagaauggacacugggguccuguaaugauguaacugagcuuuacaucuguguuacgucucugucugugcauagcagaugaucccagaguuugaaagugcuaaagaagggugugaauaucauacggacccgaggucaggaaucgggguggggccuagcugaguucucgcacucagucuucaccagguugcaggaaagguguguuccgcaggaccccacggcuugcuaagagguaguucacuuucaagcuagcgucuaugguuagcaccagaugcuguucccugguugccucauggcucaguagcaguuagcuagagggugcuugacaagugggcuuuguacauaggguagcuugaaacauggcauuuugccagcaaaugguagaaauaucaaagcagacaaggcagacagaaagcaagguuuuuauaucucaucucagaagugaugucccaucauucguagauucuuacacagugaaaggggacaaguuacacgagcgagcguguggucgcaggaggcaaggucagucacaugacugucccagugcuguuuuagaagcucccugugacaacauuaaaaacaauggguugggcauagaaauagcucaguuagcaaaguacucgccauucaagcaugacgaccugaauucagucgucagaaccaacguaaaauagccaggcauuagugguguccacuugugaugccaacccuggagaguggagacauuuggaucccugggguuccugcuuugugacuccaggccaaugagaggccuugucuuaacacauacacacacauacacacacauacacacacacacacguuugauuccaauuaaagccagccccugaauaacaaccauucugucaagaguuuagcauuauugaaauuuccuuccuguuccuauaaagucuggaagggugagugagucagaugcugggcuccaccucauuaucaagugucuagcugaagaagucauugccauccuuagaaaggugccucccaggguuauccuuaccaauaguguagcugaaaguaaaacagauguaaacaucacuuuauuuccucagaugaaauggugagaugagggcucugcccaagcuguagguuaggcuguguccagagcuuuuccugcucuguucuaacucucccuagaccuaggccuggagacuucuaaucugaucuuacagguugaccgauucaguccagcuuccuucaguuucggacuaaauugcucugcuuggccuuauacuaacuuuuggcaaucuguucuaaucugcuggcuccuucucauucucuggcucauucugucuucaccugggucuagcuugucuucucugcaaccugugucuauaaaacugucccuguaaaacugucauacacauacacugcaucaccacacccccuccuuucucucucuccaguacugacuuacuucauccauaaacacaggacaguagcacuuccuuagagcucguguugaaaaaucauaugcugcaucuaaguugcugggcauuauccuggcaugcguaaguacagagugaucaguagcucuaaggaagaucauguuacacggagauaaaggagcugggguuccaccccagcacagagacaaugauauggcugugagagcaggugauacuuuccucaaaugacaucacgcccaggcucaagcaggcagccuuaaucaauccagugggugacacacaaaagcuguggaaguaggaggggcguagugggaauuguauugggugaaggagggaugugagagggguuaacugguucauaguaacuaaaguucauuauguaaguuuaugaaacugucaacaaauaagaaaauuuuaaagaaguugcagggcuggagagagaucucaguguuaagagcacuuguugcuguugcagaggacgugggguugauucccagcaucuacauggugggcuaugaccgucuguaacuccacuuaaagaggaucugauguccuccucuggccucugcagucaccaggcaugcacauggcgcaaggcccuaugugcagggaaagcagucauaauauuuuuuaaaguugaaacucaagguagucaagugguuagguaaacaccagucucguaaugcauggcagaggugagaacucuggcuccuuccccuagucacugcacccaggggcccuuggcaggugugacgcccaguguucacuucccacugcugcagcagaugcagugucccagcgccuccucagcagcacagugcgcucaccuggccacugucugagagugagccgugcugaccaagugccugcuguuaucugugcccacauagaagggcuuguucuccauggccaugccuucagagucuuuguuauaaagacaucaccugguagccgguugggagcacaggagccgucccguggcaagcuuaggcucuuaauagcguucucacgcccggccaggaaagacgcaacaaaccaaaaucuucugcggcaaaacuuuauugcuuacaucuuugggagccaggagggcaagcgcccagcgcccagccccaaaaacgaaagccccuucaauaaugaaaccgaaaccccuucccuauuuaggagaguuauauuucgccuaggacgcaucacucccugauuggcugcagcccauggccgagcugacguucacgggaaagguagaguacaaguagucauaaaauacccuuggcucaugcgcagauuauuuguuuaccacuuagaacacaggaugucagcgccaucuugugacggcgaaugugggggcggcucccaacaucucccccuuuccuuuuaauaagagcaaauaggccacccaacuaaugagaguggagauagaggucaaauccccaguguguagguaaaggagccauguacaggauuagcucuuaggcucacaggcuuuuacccagagcaacccugaccugcucccgugucguuuuuccugggggaagggaacuaggacacugaaccuucaugaaagaugacguaucucccuagaauaggcucauauaugccgcagagccuuuuuacugcagugcuuagccgugcaacucucucgggcugcugaagcacacucacuuuaucccgugcaaugagucuagccucgugagauguaagagcugaguggccagcgaccuauugccuaagcauagauauaucaggggaagcuccauguucuaguucugcaagcgccugggcaauaaccaccuugucucuccuaguuugggccuuaagcuuacagaccaaucaaagaagcaacacuaauccacagcaaaguguaucuccaaauaauaucaaucccacccauucuuuaaagaaagaaaaugcugaggagauccaauuggguaauccuuuggucagggacagguccaagcgcguggaguugaccugaagucucaauucccgaaggaucuguucaaauucagccguccaauucuguaacauauacugaaaaagacuuuuugacaaauuagcugcccuaguaaauuuaacauacugaauggaaauaacacacaaucccggaaacuuuuguucacaucccugcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucagucgucuggaccuguccagacagagccaaggcugucugaaucaaggccaaacccaguucccaguuagugguaaaaaagcaggagaauacuugagcauuauacaucaccgucauugggaguggaaaugucgacauuaucccccaacgcugcucucuuuuuauuauugacgcccuggacaucaccaagacgagggacaucaguauucccuuggucagucuggauuuuucgggugagucuuucugguauccaaaauggguugucuucauucugugggaaaacacagauagcuccccuggaucuuaucaaaauaggauccgggccauaccauuuauuaucaaggacauuuuuccauuuaaccaucucauugggccuaucuggcucuguacaaugacguucagccgcaguauggccaugagcaucaauauuuaaaaaauugaguguaaagagugccaaagacacagacacucuuggugcucgggguaaaaucucuucaauuccccucuucuguuuuauaagauagguuuugagggugcgaugcgcacgcucaacaauacccuguccuugaggguuguauggaaguccagucaggugggucacguccaucugacggcagaacuguuggaauuuuugagacguauaagcugguccauuaucagucuuaaggagucuggguuucccccaagcacuccaugccucaagacaauguugaaucacaugugaggcuuuuucuccgguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaucacuuuaguggccuuaucugccaaaucauuucccagagccauggggccagguaggacugaaugggcucuaacaugaguaauauaaacaggaaaucuucuagauaacaaaacuaauuguauuugcugaaaaauauuggcaacgcuacuggaaggcuuaaucacuccagccacuucuaaaagauuuacugcauuaaccacauaacaggaaucugacacaauauuaagggguucuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuucuaaacauguaaauauugauuucucucaaaggaggaaauaugcgugacauccauuugucagaccuguaauggccugacgccacgaggguuuaccccuacgugaguagauaaaauuugacaacaaucuaaaggcauuauuaaguaaucagaaucauuucuaguagaaccaaucucucuggcagcucuaggaauaccagaggaagaaaaaacagccauguaggcuuggcaaaauuauuaguugagcuauuuuguccccuugugauauagaaaagacaacuugaggacaagaacagagaaccugaaguuccccuuuacaauccugaucuacaacuccaggguggacaauaagaccuuguaggcugcaagagccugccucugucauuauuguccaguggcuucaccugcucgggagagcgccuuccaggcccuaauagccuuuucaucugauucagaacuauuaaaaacuggcuccuugagcucaccuagugaugaguagaggcuccuucuccuagaagccuccgcugauugaucuuuuuucuuuucuuuuuccuucucuuuccuucuaaucucuccccagguauucuuaccugaccuaaacuuuuccucggguucaagacccguggaaaggccuguaugcuuauuuuguguaccauauuuucucuuugcuccuacucucucuccccgcuuuacuucugauagauuguccugaauuucaucuagaauccgcccugccuuaaccacuugauaacaugugaaaaggaacaaaagggcuucuaacacuagagaaaauucaaggccaaacauaccuuauaaagcuauuuuccacuuuacuucugauagacugucuugaauuuccuuagaaaguucaaggccaggcuuaccucguaaagcuauacuuacggguuaccgccguuccccagcugaaaaguucugaauucaugcaguugaauccuucuuaacagucugcuuuacgggaaccuuuauuaccgcgacccgcaguucugguucuggaaugagggaucuuccuugcgccggugaaacucccgucccgaguuuccucccggguuuuuucuucccggauuuuuucucgucccggaauuucucgucccggauuucagcaccaauucuuaaucgcguucucacgcccggccaggaaagacgcaacaaaccaaaaucuucugcggcaaaacuuuauugcuuacaucuuugggagccaggagggcaagcgcccagcgcccagccccaaaaacgaaagccccuucaauaaugaaaccgaaaccccuucccuauuuaggagaguuauauuucgccuaggacgcaucacucccugauuggcugcagcccauggccgagcugacguucacgggaaagguagaguacaaguagucauaaaauacccuuggcucaugcgcagauuauuuguuuaccacuuagaacacaggaugucagcgccaucuugugacggcgaaugugggggcgguucccaacauuaggccacuucucaagccucuucucccagacgcggggaagagacaggcccagugcagacuuucuuccuucaaacuuacugagcaggugccugagaaacauugugcguaugcaugaucuggaagaaugcuuauuucucauuuuggagugccagggacaauacaggaagugucuuucuaaugagaguucauuaaagugaaaagaagaggggcugaaaaugucagccgggcauaucugaaaagccagagcuuggcaguaaaaagccacauguguucuacuuaaauuguuggcaucaaggagaccgggcauccuggaauugcaguuguccaacuugacugggugugccccugucaaacuaauuuaucaauucccauuguucccccuucuaggaacuaaugugcaggaggcucagaauauccucaagagcagcggacuccccaucacgucagcuguggaccuggaggaugcagccaagaaagcuguugccaguguggcaaagaagugaugcucucccuggcucccaugaagaagggcaugucccugacuacugugaaagcaauuguuuucucacugggaagggacacacacaaggaucaucaugugaaaaauauuaacucugaacuuucucaaauacguuauccagagugccuaaagcugaauuuauacuguagucauuguuuaaaaaaaaaaaucacuccuuacaauuucacaucuucucuugcccauucaguagcagggucuaccagcucugggccacagucaguuuagccaaauagugugcauacauacaguauuuaaagccagaucuagguucauucacaagggcauuuauucuacauuagaaaauuuuacaggacccucaaguucagacaggcugauauuuaacauaguggcuuccagaaggguacagcuaagacaccugagcuucugugaccaguggccuccacuggccccuaauuccaguacauuaagaaagcccaugaacauuucuaaaguguggcuuauauugggcaucccguguugauauauguacauugcacacauuuuacccugugccuuaauguugaaucuacuguuugccucacacuaaguuacuaccagaagccuuagucaugggugugagguggaagguuucauuuugugucagaguugcugaauguuaaucuauuucauaaagagucacacuaaugaucuagcugcugguagcggccaggcuuuucccucuuguccccuccaccucacaucuaucaguuugccacagaaagaugagagaugccauuggacagaaugugaccuuccuaaugauguccuuuuuugugacaggaauuuucuuaacuugauuuuuuugauuuaauuuugauaaauuuauaguccuauacauuuuaaauaaaauuguuuuucagugcuacuuagccucacaguucuuguuucugucuguuaucuguucuugugaagacacuagccucugugccagaggccuagcucuaguuaagaaacugcaguugacccggauuguuccagcgccacagugccuugccaugugaccauuucugugguggugauucagugaagggcuaacauguacacauuagacacaagcccaggaaucugucccugacgguggucagggugguguggugcagucacgcacugugccguguagcaggggccacgucgguguaacagucuucccauccguacgccccggcacagcgagccacacuuuauuucauguuagccucacacaguucacagauugauaaaauaaaaagucuucacuugauaaauccacaugugccguggagaaauaaagaaacaucgacuagaucaaauccugcgucuuuucucaaacaugacaaggagugaagacuauugacaaggucuuuuuaaaucuccuguuuucugauagcugacuaacuaguuugcacaguuaaauagaaguaaaugugcauuuccucaguuagcaaacaauaaaggaacugugucuaucuuguauauugauguuucuaaucaaccaguuuggaggggaaagaaacgaaagcauacguguaguuauuuuauagaaggguuaauauuaguuaauaauaggcaaauaguuuuucucuucaaaugagcuuccuuuucucucucuuccuuucuuucuuucucucuuucuuuccuucuuucuuucuuucuuucuuucuuucuuucucucuuucucuuuuucucucuuucucucucucuuuuucuuuauuucucuuucuuucucucugucuuucuuucugucugucugucugucugucuuucugucuuuccuccuuucuuucuuucugaagugccaauuguguguguuuggauugcucaaauccccgauguuguaccaguaucaugccuguauccugaaguguguggaacggacccugcaauacuuagucauagagaaucugcugcagcuaugcuguugguuccuaagucccccuaugugcccuacucuggugugucccaugucuugaauuucuuaacagccuguaacuauauaaaaauauuaaaauaguuaccuuucaguc

SEQ ID NO: 3251 - RNA, 39256 nt, Mus musculus
uggagaccugccaagcgccuggaggagcagccagggacuugcaccccggugucccacgucccggaggggauguaggcggguguccccaguggaucaggcugugggucacaggguguccguaaccuuggcugauggguguccaagagugccuuccagacucuggucgcuggguguggucaaggcauuccgguccgcccuugagccccgggccaaggugucgcggcagcucccgggcgcccccuggcccggcuugggcgccggagguuuccgguucgcggcugccggcggugacgucucguuacucccaagcugccgccacugccgccgccgccgcucccuagucaagcugcaggugggccccgcgccuuccccgccuguuccuggccggcgccugcacccccgugggcccgcagccugacucugggacucugaucccagcccgcggccuucagcugguuaccaggaguugaucgguggcuguaggcuagggagaugcccagccaggccugcccuguugccucgauccccaugcuggggcggaguggcuucuccaggcacaccugggagccgagcgucuccuaagacagcugcuuccccaagcacccggggcaggguuggcugcugccgggcgcgaggggcugacuccgcuacacaggggagggguugacguuccgcagacaaccggaggaucgccacagcaggauugccacuucggcgccucaggcagccgagcucugucugagcucugucugcuugccuaccuugggacuugauagucuuugagucccagaugcacuucaucuguccgcugcuggcucuguugcccagcaaugcccuaagccauucaugugguaguccuaguaaccccagcucucaugguuuacggcguucagauuuuuaccuuuuuuuccucuucucuuuuuagguccgugaaaauccaaucaagccacacacgaguggagcgcgauugaccguuuugugcaaaaagacgcgguagccuaaccuacuaaagcuuucaucccugccaagucuugccagagaacucaacuccgggaaggcuuucugccaggcccugaaguuguacuuucaugcaccacagggaaccaucacccagcauaugcaaguggguacaugcccucccuugcaaaagccaacuuucugaucugcuccuuuagauuuuccccacggccaaggguuacuuuuuuccaugaauggucaaguuuuguuaaccggcagaacgcauugcagagcuguggauuuggauacccgaaauuuaggaccuagugcuccaagccgcgaccuagaagguuaguccaagggcuggguggccuguugugauccugagguuggcacugguccaggcagccccgggaaucagagaacaggauuacugcaaugagaaccaggaacaggcuuugguccuaggaauguuuucucugcuaauuauccuguuggucuggauugagugauguggugugaagcgggcuaccuccuuccugcucaccacuagugucugcuccguggguuacuauguccaggggacccugggcucugacuuugcuuugagagacuuaguaguguucauucacugaggagaaucacgcaucuucaucuccgggcuucuggcuagggauuugcuggucauuuuucucucuacguuguuccuuuauauuaaaauaguaacuagucucuuguggcaugcucuuaagguaacguacuuuauuuuucucagguuuuaggcuagccaaagcaucagcagcuuccggaggggauucugaggacuaaaaaggucaguauuuucauuauuaagcaguuauuguuuuuuaucaauaugcauuuuuuuuccagaggcaggguuucucuguguaucccuggcuguccugggacucacaacugccuggcacucaguauguauuuuuuauuagauauuuucuuuauuuacauuucaaguuuuacccccuuuucucauuuccccucuaaaaaccucccuaucccauccucccucccccugcucacuaacccaccaugcauuuuuuuaauuuuauaaaauugcuaguaauuuacuguuagaucaaggccccuuggguuuacaagggauagcaacauagccuucagggccuccaaagcaaggaaccccuuuaauuacuuacugggcaaaggauuuguucccaugaucaucacuguuuuaaccuuaugaccccaauaggccuggaacuugaacagagcauuguauucauaaacaucagugaaggcugauuuugaaaguugugugguccuuccagucuuauaagggccccacuuuacuauggaaugcucaggguguguucaguuaucuuuuagaagagacacuuagggaaaacuugugaucgguaaaggcggcagaguggugugaguuugucagggauggauaggagaaacugacccaagaaauuuauccuuuccugggggguugagggugugagcaggaauccaguaaauucuuaaucacugucauuucgcauaaugucaaugcuuuguucaguccugauagggaaauuuuaaaugaauucuuuccuucugaagcuccgaggaugcuagccugggaggggaacuuacaauaaacaguugacaggaaaaaaacaaaacauacagaccugaccgagugccuaauaaauguaagacccugaggggcacagggcagcugagccuugugaacaacuuuaauaggugccugggccccccguggagugggagaugguucaggcuagggagggcgagggcugacugacgccagagaauucgugcugcuaccuggaguugucaugcuauguacaaggauacagacgucugugauccucuuucuugggcacacacagggaugauaugagauaggaagaccugcacucacuguuuauuuauggucacagaugcaaauuucuuccuucuuuccuuccuuucuucuuucuuucuuuuuccuuuuuuaaauuuuacaagacaacagcauuuuggggccaucccuggacuugaaaaguucgcuggucucucugaauaauccacucugaaaugugcaaauauucaggguggaauauauuucccacacuuguauaccuuguuccugguacagugcuuggcacauagcaagugcucaauaaauauugggugaacaaaggaacgugauuugguaacauagcaaaauauguaguaaucauacuuagcaauuuagcuuuuaaaggggguuuauuuauuuacugcaccaaacugcagacugagcacagggccccaugcaugcuaggcagcaacuaccacugggcuacaugcccaacccuaaaggggguuuuaagcuacuguuuuauucuuugugaauuucacaguacauccaauguauuucagauauauucacucccaacaaccuucaaacucuauguccuaaagggagauguagaccuggcuggcuuugaacucacagcgauccuucugccucuguccaagugcugggauuagauguacgccaccacuccugucuaaaggggcguucuuuugucaagacagggucucucuguguagcucuggcuguccuggaacucauucuguagaccaggcuggucauacucaaagugagcuuccuguuucugccuucugcgugcugggauuaaaggcaugcgccaguacccaguuuaaaagggucauucuuagugaagauguuuucaauuggcucuguaggucugcagguugcuauguuaaugcugcuugucuuuggaguauugcuucaugaagucccacugaguggccaggacaaggcucauucugaggcugacgaugcgccuggcaaggcccuguaugacuacuccagccuccgccucccugcggagcacauucccuucuucuugcacaauaacaggcauguugccucugugugcagggaggauucccacuguccauauaagguaggucucauuugauucauacccuuucucuaguguuuagcaugcuauuuuuuuuuuaguucauuuuauuacucgcauccucguauuuuuaaaguuaauuuuugagguuagcacacagagacaaugauggcauugucauguguguguucucucuuucauacaagaauguguuccaugauggcauugucuuaaguacguucauaccuuguucccauucauucagggguucagcuuaggcuggcucguucaaaauucugcuucauuagcuauagcuaaagcuggacuucugccuucaccaggagucuaucacuguuuucuuuucauggaauauuccgaagggaccaaaauugucuucaaccauagcccgcucacaagaaggaaaccuaucauuaaaaaccccugagaaaauuaacuggucagcuuaagcaaccaguggauagagucugaacaaccggaaguuuaugagacuucaggaggaaaagaacauuuucucaaagugaagaaggccacaccucuccuuucugcccuuaggaggcuccuuagcccuuccuuuccguagucacaccucagccuuggcucuaauugagugagacugugaguuuggaaaggccucaaacagagcccauaaagaccucuccggaggccuuagagaucaaagcggggccauuguaagacgcuuccuuucccauggugcuggcaccggaagcauauggaaucugaccagcauagcuccugggccuugcaaaagggcccuggccuccaggcuggagagcucugaccuugcgcuguuucugcucuucuugauugaugacugaagucacccagcuguccuuuccguggacuucuuuuaguaacagaaauuccaaagaaugugcuuuuuuuuuccccuccuaguuacugauuauagaaucaguuugcuuccugagagugacagaagacguuaccuuaagauauaccucaggaaacccuaauucagguuguccuggcaggccagcugaagccugggcuuugguuauggagcaggcaugaaggagugaauaaacacaauuguggagacucuugagccugccccucucagaauguuaugagacauggauauguacuguuagauauauacuguuaaacauacaugugagcguccugucauggacagucagagagucuccuuuaaccauccgaagaaaugagucuguucuaaauguacacauuucauguucuagaaacacuuagaaaaucuaaacuacugcugggguuaugagaaguccugcgcaccagaguuuagauucgguucccccguuugcagcuaugucgacuugggaugguaagucuccuuacggaacccccuccucacuucugaguucuuugaaguacaucuugauugugcccuaaugcccagcuagacucucaguagacaguaagaccugcagaugcuaauuugcuuauccaggucaugaauccaacccaucucacaauggaaggaguaucuguuauuucgucugucugggagagaaacaucaucgauuguagaaccccacccccaccccacccccauauaugcuaagaagauaauaguaucgguaguuucuuauagauucugaaggaauagccauccaugcucaaggaaagucgaauauucuagcacauacaugauuuguuggguaaaaugaacagagugaauaauacuuuauugucuucagguccaaaugaaccuaacuucauauauuucuguugugccuuuuuauuaucaaggaauaguaugugaagaacucauuuggaguuuuauguacauagugauaauuuguggguguggguguguguggggggaccauaauggcauacuuuaaaaaguaaaaguucaccagucaugguggcgcaugccuuuaaucccagcacuugggaggcagaggcaggcgaauuucugaguuugaggccagccuggucuacagagugaguuccaggacagccagggcuacacagagaaacccugucucaacccccccaccccccaaaaguucuagcaacuuaaaucaauagaaaauccaaggccagaaaaaaagaaaguaggugaggccgggguggaguggaaagauggcuuagcaguuaagagcacuuguugcucauuguaaagguccuggguugaguccuacaaagugguucacagacaucaauaauuccaguuccaggggaucugaugccuucuggugucuguaggcaccaggcauucauauggcggcacaaacaaacaugcuggcaaaaugcuaauauacauaaaauagaauuuaaaagaaaagggaaaaaguuacaaaaucucuuucuuugcaaauaggaccgauacucuggagucagcccaggacauguucuggaggcaagcugacuuuggauaugcgcgagagcgacugggagagauaagaacgaucugccagccagagagagcagugaguguccagcugccugaaucagcuugcugagggucacuguuuacuauugcuuuauuguuuaucuugucacaugaagacgagacggcucaaugaugcagagucucucuguagcccagccugaccgcagaccuguaaucuuucugcuucuccaucuuugguacuggacuaacagguggagacuccaaguggagcuguuacagucagagccugggcccugaacagcucuaacaagcgagucgugucccacuuaucaucugcagaaugaaaacagacaaguacuaguaaaaaaaaaguagagaaagaagaguuauucugugugguuacauugggacucaagaauaacacuucacacacacacacacacacacacacacacacacacacacacacacacccucuacaaacacuacacacagccuaucgucagggugcucggugagcuugagguuuagguagagggcaauagguaugugucacacagcagucccagucgggggugguccuguguggucauacacccaccuuucuguuggccucagacuuuccugcaggguagucuaacaaguugugaaaacuaugggaaaugucuuccuaggagagaaguuacuacccccaacuccagcccuauaccccccuucccccccccaccccgaacuccaucccccaaucucuacccacaucucccaaucucuacccccaucucccauccaugggcuggcaccuggcuucaacccuuuccuucucuggacaugaaauuccugaggaaaugccaguuccuuagggacuauuguuucaauaaucugagaggcauuguucccaaauaggucauuuuguuuccucuggaaggcccgcccuccucuucacagaugcaucagauagugauauuuugaggcgcuuaaacuauuuuuuagauuuagaccucccccgcccccgcugcagccccccacacaugacaaagaagagaaauugcaucuuuacagagucuuuguccguucguuugggacaggugcuguggcugcaccauuacugaucuguauuuguuuacucgugugugcaguucaguuugaguggcgugguuaguacagcagggcagaccgauugauauauuuuucaagaaugaaaaauagggcccucagaaaucaccaacuuccccaagguuacacagccaucucgugaaauuauacaauacuuagaauugaaaggggugugugugugugugugugugugugugugugugugugugcgcgggcaugcauaugcaagcaaauucugucuaagcuccuccccacaguuaccugacaaccgccagguaggccugacccacuauaaaaggggcugcuugcccccuccucucucucuugcccucuuggucucuuccuccuuccuugcuauuucccugauuccauucccaucuccccccccacccccucucucccugcgcucauggccagccucuacuucucugcucgcuuuuucucugccucuacuacucucuuaacuccccucccauguccuuaauaaaaucuguucuacauuauaccuuuguguggcuggucccucuggggaagggaugccuuggcaugggccugcugaggcaccccuucccccauaccucaccacaccucuauagaacauaaccccuccucucuuuaucuuuuuauaaacacaucaguguaugugguguguguguguguguaugcaugccugcaugaauguguguguguguguguccaguggguaggacacauacacugccagggaaguaguuuuuaaguaguagauaugaagauaggucuuugccuacagaguucagauccugacccuuggauaaggucuucagccuguggcacaagucuuauucuucagccuuaaagccaggcuaucuuugcagcaugcgguucuguguauaaaaauucucaacacaggaccuggcugagggccugaguugaaauucccaguauacacacaacaaacaaacaaacaaaccuggauguggccauucauaggucuguaacccaguauuguggaaugcagaggacugcuggagcuugcugggugccagccucacuccagguuuagugagagacccugucucaaggauacagacagagagugauagagcaggacaugguguguccuccucuggcuucucuguaggugugugcaaggggacaugaccccccacacaugugcauaccacacacccaccaaacuaaguauaugcucuguagugcucuuggagggcaccgucuuuggggcuuuugucaguuguaccaaaggggaugaaggcuacaguuaggagucagagccacaggcagcugugauaguuguuuuagcucauuugacuucagucuagcuucuccuguuggaagacucucucucucucucugugugugugugugugugugugugugugugugugugugugugugugugugacuccaccuugcauagcugucucaugguaguuucuggagggcuuuccuggacaucaugugccuugcuauguaacuugccaucagcaugugacuccuucccuuaguucuuugagaugcuaugacaaaguacuguagaugagaagaguagagacuagagacuagagauccaaguucaaggugccagcacagcuggguucuguggagacccuuccuccagauuacagacagcuggcuguccuuggaucaguaugggguagaaaaaaggaagaucucuuuguggucuccuuuagaauggucccguguuagugagucuuccugcuguaguccacaaaguaacugacaagaagcagcuacauuuauuuuggcucacaguuugcagggauucagucuaucagagccaggaaggcauggacucagaagcuugugaccauguugcugcagcuuucaggaagcagagcuggggguggugguggugguggacagugcuaucaagucucuggaugucucugacugccagcaguauaaauaaugacacaagacuucuaaauaguuuaaagcuuaggccuuuuacuuggcagucuccccacuagcucaucuaacuuaaccuggcuaucuugcccacgaccagcgauguggcuagcucuauaccuuucucugcucugcuuuggucuaucuggucccccucugugucugcucuugaaucauccccacccccuuauucuccuaacaugugucugucugucugucugucuaucuaugaaauuccgccccuauuuucugcccagcuauuggacacuagcucuuuauuaacaaccaaucagcaucgagauaaucccugauccaauucuagauugccuuuaggcaggugaguaaggaaguauauuuaggaguuggagagauggcucagucguuaagagcacugacugcucuuccagagguccugaguucauuucugagcaaccaugugguggcucacaaccaucugugaugggauccgaugcccucuucuaguguguuugaagacagcuacaguauacucauauacauaaaaaauaaauacauuuuuaaaaaggaaguauauuuagaaaauagaaaacucuggugaugagauauagaaaugacaauaccaaaauccugccaguauuuagcugucuaccaguauagaaguaacuacugaaaauacagagacacaccuucauacaaacuaagaaacaucauucccacaaucuaucccucccaugagucuucaucuccuauagguuccacaguuuucucaaacggcaaccagugguucacauaugaagucuguaggggacauuucaucgucaaaccagagcagguacuaauaguuaugaagacucccucccauaaccucaaaguguuccgcuaccuacuacccucacacugacagcugggauugaugaucgauuaaucuuuacauuuaguuuuaauuuuuuauuuauugauugauugauuaugugugugcauggcgugugaggucacuugcaggagugaguucucuccuuccgccaugacgguuuucucugucuuucuuuuuuuuuuuuuuuuuuuuuuuuuuuccauuuuuuauuagguauuucgcucauuuacauuugcaaugcuauaccaaaagucccccauagccacccaccccuucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaaugguguccgcauuuggaagcugauuaugggauggauccccggauaugguagugucuacaugguccauccuuuuaucucaacuccaaacuuugucucuguaacuccuuccaaggguguuuugcucccacuucuaaggaggggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugaugcccuccagguccauccauuuggccaggaauuucauaaauucauucuuuuuaauagcugaguaguacuccauuguguagauguaccacaucuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauauccaguuuucugaggaaccgccagacugaucuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugagcauuuuuucaggugcuucucugccauucgguauuccucaggugagaauucuuuguucaguucugagccccauuuuuuaauggggugauuugauuuucugaaguccaccuucuugaguucuuuauauauguuggauauuaguccccuaucugauuuaggauagguaaagauccuuucccaaucuguugguggucuuuuuguccuauugacggugucuuuugccuugcagaaacuuuggaguuucauuaggucccauuugucaauucucgaucuuacagagcaagccauugcuguucuguucaggaaucuuuccccuguacccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcccuguaguaaagcuuuaggucaggcauggugauuccaccagagguucuuuuauccuuuucucugucuuucuucaugucuccaggcuuuggcuucaagcaccuuuaccccuagagccaucucaccaugcaagccuuaggguucagcaugaacuaacuuuucuucagggaugcaagcauucaguucacugucaucuuuuacugacucgauucccagacacuaaccagguuaagauuccagccccucacucacugcacauuuuaggggaaaaaauuaaaugggguuuaauccccaaagccccgagcccuaacgugccuucuuuuucaguacauucuagcuugguugcagcagaagcagguggugguggcuguugacgucucaucugcuuucacuguugacacgggguccugcacaguuuaugggcucacuugcuggagcgccucacacuugucucggcaagcuguuuguucagacuugccuuugggugucucuuacccugcagccuuccuugcuuccuuuggcuccucuuuagagaaggcuuuucuucuucuucuucuucuucuucuucuucuucuucuucuucuucuucuucuucuucuucuucuucuucuucuucuucuucuucuucuucuccuucuccuccuccuccuccuccuccuccuccuccuccuccuccuccuccuccuccuuccuucuccuccuuucuccuucuucuuucuccuccuccuccuccuccuccuccuccuccuccuccuccuccuuccuucuccuccuuucuccuucuucuuucuccuccuccuccuccuccuccuccuccuucuucuguaguuagggguagaaaugguucuuagaaauuuuucuuuucuuuucuuuuuuggugggagguggagacugcagugaaucauguauauaguucuugguuuuaaaaccugaggguggaugagaugacuuuguggguaaaggcacuugcuuccaagccugauaaccugaguucagucccuggcauuuguguaguagaaagaaugaacugacucuugcaaguuguccucugaucucugcaggugugaagaggcacaugcauacaugcauauaaacauguucauuuaaagcuuuuuuuuuugucugaaugaagcaguguuuggugauacuugucuguguucccaggacauggaggcugaagcaggaggaaaauucagaguuugagguuaggccgagcuacauaaugagauccugccauauauaugcauauaugcauacauauauacaugucacuucaaauauacauaauguguguguauauauauauguguauauauauauauauauauauauaguaguauauagaaaaaacagggucucacuauguagcucaggcuagccucaaauauuugugugugugugucugugugugugucuguguguguguauauauacauguguguauguaagauguguauuuaaagugauaaauuagaggauuugggaaaucuucuuaguaagcuaaaugcuuggagaccugcagaaggacccuugacagaucuuggaaaggagaaaacagcccaggagcaguggaggccucgcucugcuuagggucacaccgcugcugucagcgcggccagcucagugaggccccagugcugauccgguuccccccugacuguucuccucucgcuuguauuucagagcgacucaagucugguuugcucccguuaccuucaguauuguagagcuacuggucuauaccuggacuuaagaaacaucaagagaaaccacgacagguacuuacaugugguccccauuaaagcugauggcacucugaaaugugcccaggugcagggcucugucuuggguuugucuuguaguaaaauaguugaaggauuacagagugggugaggagugggugacccggguccuucaccugaugaucauauuguugauuuggggcauggauauauuggguuccuuagaagagauguuuaagguaaauuaugcagcauguguuuguaaguuaaauuccaaagaggggcuugggggugugguucuguuguagggcgccugucccguacaaaccaggcauggugggugauaugugcuugcaauccuggcuuccagaagguggaggcggaggauaaagaggcucaugguccucuuuugcugcagagagaguuuaaaauuacccuggguuacaugagacccugacucaaaauaaagcaagaugaaauaaaauaaauccacuggcuggagaccuggcucagccacuaagaguacuagauguuuuugcagaagagcuggguuugguucccagcacccacauggaaguucacagccauccaugacuccaguuccaggguaccccaccugauguccucuucuggucuccaggggcaccaggcaggcacacggaacacagacauccauggaggcaaaacaccuguacacaugaaaagaaaauaaauacaucuuuaaaaaaacaucuguugaaaauguuguuaggaaauuaguuucaauccagcaacuugagucaugagaacauuuuccagcucuuucuuucuuucuuuuuaauucacuagauucaaggaagauuuucuucaggguggugaaauugguggauacuguaaacuugacagucaugcacuggugucugaagggcagcguaaaaguccccugcagucuugguaacgugauuuuguuuccuaaaaauaugucucuaaaguaguuguguuuguuuugguguuuauagauuuuauuuuuuuuuaaauuauuuuauguauauuagcacacuguagcugucuuuagacacaugagaagaggcuauagaaucccauuacagaugguugugagccaccacguaguugcuaggaauugaacucaggaccucuggaagagcagucagugcuuguaaccgcugagccaucucuccagccccuaugcucauugauuuugggugggacuguagaauggauauaaaguuuccugaugugugcaggcuucugaggagugguggguggagauggacuccucaguuuaauuggaacggaauauuagucuaugaaaauuuuacaaagaggguauuagaaucugcuguucguaaaugaaagaacaggcauuugacuugaucuauuauuaacucccaauuucuguauguguuuuaggaaacacguuuuguaagugugcuaucccucccgcagguauggagugugguuaaugagaaagugagcccacccauggaacuuuuguucagagcauugcuaacacccuaggcacgcccacuggccucaccccaccuucucucugaagcuacccaaacucuuaacaucauugaugagauuuugaacuuuaaaacuuuauuguaaaaccauuugaggcucauggaaauuuaaacaacaugcaggaguucccauugguccauucucugcuccagcuuccuggaaugauaaacguuuuauuuaacuauagcgcuguuacccaagccagggaacagucauuauuagagucuuauuaaccacacgccuaugaguuucucccaugcuuauacacuuauuuuuuuuccaaauucauacuuuagaaaauguauaucccaugucuagggacaugugaccaccauccuauuuaggaugcaaaauucaugggagcccauauaauuucauuauaauuacaugggcuacucuuguauaaaguuaauuucucaggucauucaugaugagcaaaauauuagcaauaauaaucuaaucuucccucauaugguaguggucaguuugcuaugugguuuacccagggccuucacugguuguuacagagagccaugccuucuguucuacaaggcacuuucauuccuaguucauguuggggucugauucucuauuauagcuccucagggccuaacuguauuguuuaucgcuggguaacacauuaaucuaaacuaugcccuagggcauaguuuauauucauuauuuauugcuguuacaaauuauucuaaaguagagcaaaugacauuuaguagcauagccuguucugaugucagagugagagcagcucagcagggccucaagaggcuucagucaggcugugggguuugguggggcuaucacucucccuacgccaagcuugggcugaucucugagccucggugucugucugacuauggaccagaggauucgguuaucaccagaugggucucuugcuagugccacucacacacagcaugguggccauggcuuccuccgagcauaaguguguauauucuguagugcuguguaaccugacuucagcagugacaugcuauuguguccuguugguuagaaguaagccauugaguuacgaccauauucagagggacggaggcauuaaucuccacuucuuuucuuucuucuuaaaaaaagguucuuguuuuuguuuuugaaacaagaucuugcuauauaaucccaggaugaccaagaauuuaugaucccccugccucagcuuccugagugcugggauuacagaugugggcuauuauauuuaucucacuuuugaaagggcgaaguuguguagcugaggugauggcucagugcuugcgccugaaacaugaggaccugaguuucaauucucaauauuaauuacauaaaguaauccuagcacaguggugcacgccuugauggcucacuguccagucagucugacugagccugcaagguccagguucagagagagacccugucuacaaacaguaagguggaaugugauugaagaagacauccuagcacuaaacucuggcaucugugagaugcaaggagagcucauuugaaagagccagagggaggaaagguauggaaggagggagggagggaaggauagaugaagagaaggagggagggaggagggagauucaggaauguguuuuccaaacggccaugguguuuuuacacugugcugugaacgauucuguuugauauacuccacaugaccugugaucucacagauggcugcggugaccuuuacucagagccauagacauuccucuucacgugcuggugucugccauuugucuggcuuccacagaugugcccuagucccagggaagcuuuucugucuucugcccuuaugaggcuuuaggucauuuuggaauaugaucuuucucacaauccaagaagucucugggcaaguuccuauggccccaucuuuuccuuuaagcccccaaaugacagcacaccuuguugaaucucuauuaauacaucaggguuuuuuuguuuuuguuuuuguuuuucauuuugugacggcuucccaauugaacugucugaucugacauguuagccugaaauuugaaaucauuuuugcuccugucucaacauuaaacugggguuuagagccaauaauguuagcaaauuaaggaaggugcucugugggacugucuuguacuagaacuaaaaucugccucaugaacaggucccagguuaugguguugcaacagaacguuuggaagaaucacuuuuaaauuaucucacaauucacaauuccagguuugcugagcuacaaggcuacacgcagcucaauuucaggccuauagaagaugcuaaaugugacaucguuguugaaaaaccaacguauuucaugaaauuagaugcaggugagaaaugacuuuguauuuuacuuguguauugauugauaugucuguuuuuuaaagauuccuuuuguuuuuauuuuaugugugugcauauuuuuucugcaugcaugucugugcuccacauucaugugcucguggaggccagaagagggcgcuggauccuccuuucugauagugagcugcgauuugcaugaacugacccaggcccucagcaauaacaggcagugcucucagccacugagcugucuccuuugccccacaucuauuucuugacaugcuugcaguaguuuucugugaaugugcugaaaguggugcaauaagcacugacugucuuuuuugcuuccucuucuaagguggaugaacuggcuacgacuucuguauucauuauuauuauuauuauuauuauuauuauuaugucaggguuuggugucugcagaugggauggaugccaagguggggcggucucuggacagccuuuccuucagucucugcuccauuuuuuuguuuuguuuuguuuuuuuguuuguuuuguuuuguuuuguuuugucccuguguuuccuuuagacaggaacaauacucgguuaaagauuuugagacagguggauggccccaucccucaacugggggccauaucuaucuacccggagguagucucuucaggaucuaucuaccugcuguuggguguuuuggcuaaugucauccucacuagguccugggagccuaucgaaucccuggcaucugggacuuucuagugguuccccccuccccugcauauuucuauucauucuccuagccuucuggaucucuuucucuccugucccuucccauacuugaucccauccccccuuuucucucccccuucucuccccacuuagguccuucccucccuuugccuccaaugauuauuuucuucccccuucuaagugagauugaagcagccauacuuuggccuuucuucuuguuaagcuuccuaugaucuaugaguuguauccugggaguucugagcuuuuggacuaauccacuuaucagugaguacauaccauguacuuccucauugcuggugggauugcaagcugggacaaccacuuuggaaaucaaucuggcgguuccucagaaaauuggaaauagugcuaccugaagacccagcuauaccacuauugggcauauacccaaaagaugcuccaacauauaacaaggacacauguuccaccguguucauagcagccuuauuuauaauagccagaagcuggaaacaauccagaugucucucaacagaagaauuuauacagaaaauggauacagaaaauuccauuauguacauuuauacaauggacuacuacucagcuauuaaaaaugacaacuucaugaaauuugcuggcaaauggaugaaacuagaaaauaucauccugagugagguaaucaaaauuccaacucaauuccucauagauauagaaugagaaauucucaacuucaucuggaauaguaaaaacccaggauagugaaaacaauucucaacaguagaagaauuucugggggaaucaccaucccugaccucaagcuguacuacagagcaauagugauaaaaaaccauaugauguugguacagggacaggcagguagaucagaggaacagaauugaagacucagaaauaaacccacauaccuauggucacuugauuuuugacaaagaagcuaagaacauauaguggaaaaaagaaagcauuuuuaacaaauggugcuggucuaacuggaggucugcauguagaagaaugcaaaucgauccauucuuaucuccuuguacgaagcucaaguccaaguagaucaaggaccuccacauaaaacuagagacacugaaacuaauaaaaaagaaaauggggaagagccucgaacacacagacacaggggaaaauuuccugaacagaacaucacuggcuaaugcucuuugaucaacaauagacaaauggaaucucaugaaaccgaaaaucuucuguaaggcaaagggcacugucaauagaacaaaauggcaaccaacagauugggagaagaucuuuaccaacccuacauccaacagagggcuaauauccaauauguacaaagaacucaagaaauuagacuccagagaaccaaauaacccuauuaaaaaugggguauagcacuaaacagagaauucucagcugaggaaucugaaauggcugagaagcaccuaaagaaauguucaacauccauagucaucagggaaaugcaaaucaaaacaacccugagauuccagcucaccagucagaauggcuaagaucaaaaacucaagugacagcugaugcuggugaggauguggaaaaagaggaacuuccauauucuuaucccuuucaaauucuacaagaaacagucacauuuauguaagacaguuccaucaaagucaagaugaaagaaaguugugugcauauaccuuuuguaacuaaauuuacccugucuaauaucuuuaaucacuuugauuacauuuaaguuucauuacuuugugugugugugugugugugugugugugugugugugugugugugugugaauacaaugcccaucauuuccauggccaacuuucuguaaccaaacaaacuuaaaacucuuuuggaaguuaccacuacaguauauucuugaaaaaaaauuagaauuguuuucccaucaugccuuucagcucuagaucuuggccugcaagcauaacauuaacccuggcaacuaauggcccccggagaggaaagagacuugcuaucuuaucccucucauuauaagagaugaggcuuauagagcuauguccuuaucaaaaugagugaguggcuuggccuacagugaacuacagagagcccucugccacgacuacuugggaauuaccauacuuuauugaucaugguuuuaaugugcucugccauccaagguuauaauucucggguuacaaaguauuagauucagaaaucagacagguuuagcuuuuugaaauaaaagcaaacuugaaaugcuuuguucaauguucugaaucauuuuuuaaaaaauacgcaaaugaaaaaguggcaaaaaaaacccuucccaugaaagagguaugugugaacuaugaaacacaugcagaucauaugcaacaaaguacguaugcagauugugugcaguaaaguauguaaaauagcagcgcauaggcugagacagaggggugccauugcuucccuguauugguucugacccuuagcuucugaaugacaccaucagccaauuccccuuugcuucuuaacucaccucgggacaagggacaucauagcagaacuuacccacccuacuucuacagcuugaagccuguguuuacuucguuuuaaauccuugugcagccagacagcgguaugcauacuguauuccagagcaaacguuagggacucccuaaauguuacaggccagcuaugguguguguagagcucacccagggaaaggggauauucacuaaugcaagcuuuucuuguuaacuugaaacuagguacuuugcuaagauuuuucugagucauaaaauuacuccucuuggggacagcaucauggaucaguguguaggggcacucgccaucaagugugacaggcuguuugaucucagagcacacagagucggaggggagagccagcuccuguaaguugcccucugaccccacacauacacacacacacacacacacacacacacugggguguacgugcacauaugcacauacacaaaccaaccaacaaacaaguaaaugccauuuaacaagagacguugaaaguugucccuuacuacaguucgucuaagaagacuaacuccuccaauagacucgcguacucacuuguucuuaguuccuggcacucuguguuaucauuugcuguagggaugaagucaggguauuuuaugguugcuacuuuugaaagucauugguucucauucaaagugugguuucacucaacauuuucauuugaaaauguguguuuuguuauuucguaggaaguuauuccauuuguauuuguggauuuuucaggcugaguucugagucccacauaccuaaaucaagauggguuggggauuuagcucagugauagagugcuugccuagcaaucgcaaggcccuggguucgguccucagcucuggaaaaaaaaaaagacaaaauaacaaagagaguguacuuucuuucucuuuauuuucuuucaucucuuucuaccuuccuuccuuccuccuuucuuucucucucucucucucucucucucucucucucucuuucuuucuuucucuuucucucuuucucucuuucccucuuucccucucucuuucucucuuucucucuuccuuucuuccuuucuuccuuucuuucgagacaggguuucucuguguagcccugacugccuuggaacucacuccauagaccaggcuggccuugaacucagauccaucuucugagugcuggaauuaaagguaugggucaccaccauccugccuuucucucucucuuccauuuauuuauuuaauggaaguauacacaugucucugcaagucacagaacuuguuggguucagaggacaguuugcagcaguugguucucuccuuuuaauguggguucuagggauugaacucaggucaucaggaugucuggcaguugcugcccucaguuuugugucuuucuaauggcuggcauggcaauugaaaauugugauagcuauggcugcuguacucugaccuacuaagcuccugauugucuucaugaaggucuuacugugugcgucaggcacuugaaaaugccaugcucucugacuuuauccuaacagagcucacacugcacuacaaccauuacccaauucuagaagcaaagcuaaagacuaagcacuuuuaacuuaucuagugcucaagagccacuaagcuguacuucaaccagguucuucuaacaccagcguucaugcucugucaacuagaacaugagagacucaccucuuuuaacuaauaguugaccaauauuuccccaaaaucaguguaaacaggggcuggacagauagcucagccauuaagagcacugccugcucuuccagagagucuggguuagauuccuaguacccacaugacaguuuauaacagucuguaacuccaguuucaggugacccaguacccucuucuggucuucaagggugccaggcgugcaugugguguauagucacacuuguuggccaaacauccauacacaaaaaacuuguaagaagaauaauauaaggaaugauuaaauagggcaaaaggagacaagaauuuaaaacuacuauaacguuaguaguugagauuguugucggugccucugugcacaggugucauuugguugauuuaaaaaacaaacaaacaaacugaauaaucagaaggaaucguuagccaucauggccugauaguuucccgugcugugcuaaauagaccuaagugccccccacccgaccccugccagaacauaaugcucucuugcaucuugaugcacaggagagaacaaaucccugauuuccaaauaaccaacccagcaguaagauuuuuaaacucaauacuucuucaaguugaccgguacccgaaccuagcccauauuuaggagaaacguguuuucuuguugauuuuggcuagaaguccaacuaacuguaugcaggucgaguggaauuuagaaggcaucggguugugcgucuucucuuguuuaacaugcucuuucuuucccaacaccagguauuaauauguaccaccacuucugugacuuccugaaucucuaccucacucagcacguuaacaauucuuucagcacggacguguacaucgugaugugggacaccguaaguaagcacccacucucuccucuggcgacagcucugucuuccucuuucacugugugccucuggcuuugugaagcagaguuuucuaagaugaguguuuaaauguaugccaaggcacacauacaaucacacaugcaucuaugcguucacauguguuucuuugggcccccugacauauauacaugcacccugucagguauguacggauguaugaucuuuauuuugguuugguuuugauuuuguuugggcaaugucucauguagcccaggcuaaccugaauagccaaggaugccccucugcuccucuugcauccgcucuagauugcucagauuacaaguauggugcuggagauuaaacccagggcuucaugcaugcugagcaaacacccuaccaacugagccacgucuuuucccauagauaagugugauccuauaugcuuugaacauuguuuggagugaaguaguggaggauuuccucccguugggcauagauugaguucccaaacacagagcuccagugucugccucaguguuccucugagacaagaggccucugugacacaaagugguagugauucaguuuaauuugcccuuugaauuuacugcucccgcuccaaagugcaacccagagccucgugcaugcuaagcacucccccacagggcuacacuucagccccaauccuuugcuuaauagcagcuuuccgguuauagccagcuucaagcuaaguggucuuguuuuuuuuaagcucacuaucuagggugaaucauaucuaaaugagaagcaacgcugucuggaaauggcuggcaugcaccaucugcauuuccagcgaguacgcacaccagcuaauucauaaaguuugacagacaaggagaaagcauuugugguccauacuucauagacaguaagcucguaguacagcucuguggacgguuguggguugaccacggccaucucccagaacucuggcgugauuuaagguccuuggaaaacugguucugccuucuuggcaugugcuugcuuucuuuaucucuggcucuauguaugcuuccauuucuggccugaguccaguuuuacugacaguuuagcuucauauuuuggcuguguuucuaugagcaaaggggacagcauccuucucauuuccuucuuucuuucuuucuuucuuucuuucuuucuuucuuucuuuucuuuucuuucuuuuuuuuuuuuuuuuacuuaagcgggccaccucuuucugcaaaacaucucucagcaauucugcaagacuuuuuuuuuuuuuuuuuuuaaagcccuuacuaagaacacacucuuucaauggggaauuuggaucaggauuuuuauuaguguguuuuacagauaagauaccacagcagguuuuaagguaacacacugagggguggagucaaggacucuugcucugggcugggaaggcaccccuuauauaguccucugaagagcuugugagguagagagacacuuaucaagugcuuucuagaagcuucuuuauaccaucucgcaugccuguguacaucguucuugaguggacugaguuaaagcgaguuagcuucuaucugaccuaccugcuguaugccugcuggggaaaguccaugaaggcccuugucaaccggacacauaauuugcaggcagucugaccaucauucugguauggauaagcagcguucaugugucugagcagugugcuuggcugcccccguguuaccgcuguccuuugcugguccucugacuccucccuuauaaccuuuccucuuggucagagauguccuugcuagcuucccaaucaaguucucauaugaacagcaaugcucagucgcuccagaauucagugcuuagaagucuguagguugccggggaacaguacugugugauuguauuguccacaguugaauuucuguuagcaaagccuuaagucggugguucucaaccuaugggccaagaccgccuuggauggucaacuggagucacccagaucaucgggaaacacagauauuuauaacaguagcuaaauuacaguuaugaaguugcgaugaaaauacuuuuuugguuggggucaccacaacaugaggaacacuuaaaaguuugcaucauuaggaagguugaggaccauugccacaguuagacauaggcuuuuaagaugcuauuucacaagcucagugccgucccuuugguacugagcuccuccacaaagccaucagccuccaaaaucauagaaagccacuuuuuuucugguguugaagauuuaggacaucuuugccauauuuuuuuaaauauuguuuuuuuuguuuuguuuuguuuuuuuaguuuuauuuguuuaaugucugagugaucugcugcauauacaucugcaggccagagauagcaucagaucccauuagagaugguugugagccaccauguggcugcugagaauugaacuuaggaccacgggaagagcagccagugcucuuaacugcugagccaucucacuagcccuuuucuuuucuuuuuuaauuauaaagcugaugacugauucucauaaggucaacaaugcagaaguuugaaagguuuuuuuuuucuuuaagucucuucuucucucuccaauugcauuaucccccaagggaauaaaugaaaauacagccuuaaacaaaguuuuaucaggguuuguacaaggcucucuaugcauaucauuuguauaaagauuuauuuauaucuuuauauaaacuaugauuucuuaguauaagggcaucuuuccuuguccauuuuuugaauggagcuagcuuuuucucaucuguuggauuuccugcguguguuccucucccuucaccccuucccccauguuccucucccuucacccccccccauauuccucucccuucaccucccucccacucccauguuccucuuccuucaccccacauuucguuucucucugguucugagcuauguacuggaugcuaucagcaucuuuucuacaugccguguucucccugggucuauaggagacuagucccaagauccacucuggacaccugaauccauagaugcucaaguccucuguguuaagugguauagaacugcauguggccacgcauaaccugcuaggugcucugaaaucgccccguacaggcaaacacgucauacuguaguauugcagagcaaaggucuguaugcauucaguaaagacgcagcuacuucucugagcauuuucucucagugugagugaacccucagguccugagguugaccgugaccuccucuccacacccucaccuucacuacaccugugggcuaaguccuacaagugggguuugugugucugaggcuauggguguguucaaauuugagaccugacaggaggaagguuuuguuuguuuguuuguuuguuugcuugucacuuugaaaaauacccaaggauucaucagugugacgugggaagauguuccuuccuucuuccacugcuggauaauuugaauuuggaggauauagagaugaaguuucuagaaguggcuauuguugaauaauucccaaguuuccugagaagggucuagucaaaaucuauuuuauuauuaacaacauuuccuuucaggaggcaccuuauauuaccuagaguauuuuaucucaaggaauugccuaaaauuacuucuuauaauuacucuuuauuuauuauugugcaauaggaccaugucacuguacacaguguugagggucuuuauugugccauugcuggagaaacacuaaagcaaagccuuucugugucaccaaaucugacaguucuccauacccuugaaauaucuacaguaggaaaagccuaaacauuucaaaaccuaaaaaaaaaaaaaaaucuauaaucauaaaaagacaacauaauggacaagaaacuacagauuuugaguguauccccauggcuugugcuuuuucugucucugggcuggauucuucagucugagucccaucauuugggggaguggguggguaggggaguggggguggguggcuacgggggacuuuugguauagcauuggaaauguaaaugagcuaaauaccuaauaaaaaauggaaaaggaaaaaaaaaaagaaaaaaaaagucccacuuaaaaaaaaauggaccacgccucucccuuuaccuggcagaguucguaauuaccuucuacccuccagggaagagacgaauugauaaauacguuaggacagguucccgccgagaagcagcugucauggaguauauaggcaugaagucugagaccacagaugccgcuugaccccaguccugugacucauuaggucuacaauuuagacaaaguauuugaauuuauauacagcuuccugguguauaaauuuaggauaaggacaucagcuagcucauuagaacugcaggguuguuugacgaauuacuaguuuauagugcuuagaacaaugccugggacuggcagcauuccagauauuguuagcauuauagguuguugcauuaugugauguuauuagugacauuauuaacuugaaugagguacugucacaugauucauuauucaacggggaggauaugcauuugauguuuaagcuuucaagccauucucucgcuuugaaauuuccuuccaaaugcaauguacuuauugugauggacuuggcucagugaucauauuaucauguguagaaguggugucauauguaaggguacucuuaagcauccucuuggggcacuaacuugguguuucuaccuucagagcacuuacggguauggugaccucuucuccgauaccuggaaagcauuuacugacuaugacgucauacauuugaaaaccuaugauuccaaaaagguacuggaaaccuggugaaaugucuuuaagugacugccaagugcaagugacuaacucauauaguaaagauuuaauuugaguuucuuuuggcuguuaccaucgcucugacuucauggugguuuuguuguuuguuuguuuguuugcuugcuugcuuguuuuuuugauuuuuguggcuagaauuuuuauaaagaaaccuuaaaaccuuagaaagguuuacuuuguaaaaugaggacugcucuuuuggcuugaagggugcaucccuuacugugauguccuauaaagggcucaccuuacuaugguguugucuauccugaaaagggcacagaccuugcuguggugucuacccuaugaagggugcauaccuugcagugguauccuauaaagagcacacacuuuacugcgcugccuacccuaugaagggugcguaccuuccagugguguccuaugaagggcgcucaccuuacugugcuaucuucuaaacugucuuccuucuuagguguguuuuaaagaagccguguuuucguugcugccccgcaugcgguacgggcuguucuauaacacgccucugguaagcaucuaagacauccuuacacuucuugcgaucaccugaagucccagggcagggguguuugcuggcgugugaacuggugcuuuuguuuuagaucucuggcugucagaauacaggauuauucagagccuucucccagcaugugcugcauaggcugaacaucacucaagagggacccaagguaauggaugugcuauggggucugagguaggcuuggguauucaucucuaaugccaccuuuguagauaaacaagcaagccggaggcagugcuugcuaugauaacguugcugaaucuguaguccucugaauucaggagucaguagccaccgcagauaagcuaaaggguacuguaagaauauccuuuauucuccuuguccguugucuauuucuuuacccaugucucccuauuuucucccauuuaacucauguaaucccugcuaaaaacaaucuaccccacaaaccaacaaagaaguaguaguguaaugaacagguuuuaucuuccauggcuaaaguggaacacuuauauguauucauaaucagcauauaauaacugcacacauuucuagggugcaguguuauaguuugacacauggcacaguauaauuauccaagcauuuuuguuacuucaagcaucaaucuugccuuuguugugggagcauucuaaauuuuuccuuuuagcuuuguuagaaauaguauauuauugucaagccuauuaacacuacagugauuuugacagcaaaccccaauucuccuauauccauaauguguaucugauuucuuucuuucccguguccacuaucuacuggucuauaguauucuccagcauuuaauuguggacaccuaugagaucagcuccuuuagcuucugcaucugaccaagagcaugugccugccucauguuaacauaauguuaauccaugucccucuauacugcaauaugacauguuuugucccauguacaguugaguauuaauucauugaauagauguacuuucuuguaaaguagauauauauuuuuauuuccugagauaauggauaaugguuaaggagccaggcuacuauucacccugucuccuuagugaguuucaccucucugggaaauugcauuugagauuuggguugucuuuuuuuuuauuuuuuuuucuauugucugagcauauccaauauuauuccaacuuuucauuuugauugcaggauggcaaaguucgaguuaccauucuugcacgcagcacagaauaccggaaaauccugaaccaagacgagguuagugcuuugguaugaacuuuuaauagugacuuugccuuccuuggcuaaugcucucucucucucucucucccccccucucucucugcaguagaaguuuuuauuugaagcuauuaguuucuagagauacauaauggccugagccuacugaaaacuggcuuuuagcuucuccaaacucccaacccauccagaugugcucuacuguacauguucaccuacaucagcgcuaauaugggcaaaaccaaagccaaacaaaacugugagucuugucuggacugcaacagaaggguaaaaaauucccccuucaggcaaacuaguaacaacaugcaaacacgccuuuugagagaugauugguguugccugguauuuccguagcaucuggcaauacauacauugaaagggguuccaucugcuugaguggauaaaugucucagaaacugcuccugggcauaauucauuucagcugcacaaaaucauacauugcauccagccucauacugggcagguaaucaugggagccuugacagugagacuguucuucacuguuagcccucucacagcagauggaugcaaaaggagguugagugugccuaugagcccaggcuaucaggaaagggcaggccaggggauagccucaaacuagggggaagaaaguucagggaaaggcccagugccagcaccugcuauggugcaggccugauacuuucagaauccaugggcagacgguacaaacgcuacuccuaauggcaagcccaagagcaugcugcuuguccuugaagcaggauauggacuccaaaggguaugcacaagggcaauggugcuuugacuacauuuugaccagugaacagagaauaagacucagauauauauauauauauauauauauauauauauauauauauauauauauauauacacacacacacaaacacacgcacauacacacacacacacacacacaaauauauagcgcccaggcucaccuuaagcucauuauguaggucuggcuggucuagaacucccaguccugcugccucagccucaggaguacaaccuggcucccaggaggucugguuaaaugauaguuacugcaaacuuagccugguacaauguuuguugagacacugcuguguggcuagaggcuagagaaaggacauauucuggggcuugcacgcacucgugauuucucugaugggagucucccuuguuaaaugaagaaggguccugcugccuaauuaguucucucuuggggggaaaugugacuguagagaaacacuuccaucuugugacugcccgugugcuguccaguugugcauacaugcguaugaacuggggguagcaauuagacugcauucagugauucggaugcucugcuuacgguuagagaugguguggucagaaguucaggguguuguucucucccuuccucuccccuucucucucuuucuuugcuagggauugaaccaagucgagaucaaggcauuuuguagccacggacacugcugauguuguguaggguugccugguagagauguaagccgucaaugucaggggcucucagaaucacggugcugcuuugacagcucgcuguuccugcucucuuacuuucugccugccagaaucagagccaaagagauuuuagaaauuacagggaaauagacuucuuuucugccaaaacuuuaauauuuucacaggaugguccccaguguccuagugguuucuuugaaaugagacaauggguggaaagagccaugucaacauagcgucaggaacauuguguccccucauucucaaagcaccaggugcucugaaaugauaagaaauagggugaggaagucaagagauacagucggucagcauuugaauuuaaauaaggucuaaaaugauagacauaaacgauaugugaugcaugcaaauuuuuaucugcaaaaaaauuaagaaacguuaggaguuggggagauggcucagugggucagggggcauguugugaaagcaagaugaucuaaguucaaaucuccagcacugacuuagaagccaggcauggcugcaugaguguauaaccccaguauugggaaccagcaacaugcagauccuaggagcucauuggccagacagucuacccaaaacagugagcuucagggucagugagagagccugacucagaauauuaaaaagaagggacuagaaaaauggcucaguaacaaaggaccuacugugcaggcauguggaccugagucuggauccccaccauggggaucaggaggugaggugggcagcagggugacucuccaaagaucacugagcagccagucuaaguaaauuggagcuucuggguucagggagaggcuuugccucagaaaagauuaagaaccauggaggaaagacaccuaguauugacguugggccuccaaauauauuuacacauguacauguccacacagccacacugacauguacaacacgugcacgcacacacacacuacacacauacauacauaccacaaaaaaaaaaaacaucaaaauguaaagugauagagaaagacucugauguccucuggcuucuguauacaugaauacugguaacuugcaugcgcaugcaugagugugcaugcacgcacgcgcgcgcgcgcaaauacacacacacacacacacacacacacacacucucucucucgcacaugcacacgcacaugcauacacacacaaaacagauguggcuggcuccaggacaaauuuuaauuuaaacaauggacuuugggauuccuaaaggaaagcagcaaggaaggaagagucauucugccuguucucuuuuucccagcugguaaaugcacugaaaacaguauccacauuugaaguccgggugguugauuacaaguacagguaagcugggacccaggcagguccucucaucccuaaacugaaccacucacugguggggagugggcauacugcccuuuguagaccaaguggugacacucagucauuaaacaagacagggaugacagaggccucaaguucaggggagcuggugagcuuucugaggucuccuuguucugguacaaucuaauuguucuggagaaauaaugaauccagauuuuuguuugaaauuucugaauuuuuaaaaguuugcuacuaguauuaaauuuuaacgugcguaaacacauacauacauauccucauauauaaguauauauauauauguacauauauauauauauauauauauauauauauacacacacauauauguauauauaucuccauggaaaaauauauauacauacacacacacauauauacacauauauauauauguauggcuuaauuuacccuauagguaauggguuucagcucuguauuuaauaauaaaauuuggauuuaaaaaagaaaaaacuuacaagguauuuacauuucuuuuuaaauucugguggaaccaaaaggcuuggaaagagagcgugcugccaggcagugguggugcacaccuucaauuccagcacucgggaggcacauaucuggggguucaagcucagucuggccuacagagcgaguuccaggacagccuggguaacacaguuaagaccugucucugaaaagaaaacaauacaagaaagaaagaauaugccucucacggauggguaguccuguugguuugaggacagucacacugcaguggcucuguguagcaguagaugcaccauguagaaaauguuucucacuauaaggaggagcagaggggccagagagauggucaaagguuaagagcacguguugcucuugcagagcacccaggcuugguucccagcauccacaugguggugaagcagcugucuguuacacuuccaaaggcucccaugcccuuuccugaccucuggggggcaccaaacacacguaugguacacagacacacaugcaggccaaacauguacaucaaauaaaaugaauaaaucuaauucuaaaauuucaaaaaggaagcucccgcaaaauaacacaaagaaaaagugaaguuuucucuaucccucauccaccugugauccaauuuaugacuguugauaguuguuuccuauauuuuacauacauacgcacauacacaugcauacacauacacauacacacaugcaugcaugcacacacauguaugcaugcauacacauauauacacacacaugcaugcaugcacauacauguaugcaugcacacacauacacauacaugcacacaugcaugcacgcacacacaugcacgcaugcacgaacugcagaggggucccugccacagauacacuuccugcauuuacauaagcuugggccugcuaccacucacucaucaguucccaguuccuaaugggacgaauccacaaguaggccacugggcuucauggcugggauccugguaugguggacagugugucucuugugcuaagguuggagaaaugugaagcuguaggacagucacugcaugguagggucugcuguuauacuccaccggcuucaccuuacacaggcagccgugcucugacaaugcaaaguucucuguuuuacaagguacacugcuguggaggcuucuuccacuggcacaggaggaagucagcuuggaauauauccuacuaucuugcuagcuuugcccugcaguauuaucugccuguauuugaauggcaccuuuuauuuggauuauaucuauuuuuguaauuguguugauaucauguguuuucuuauuauacauucccuugaaaaacagaaauaauaguuugugcuucgagagcuuguuacauuaucaaggaagggguuauuaaauacuauagugccuucaaguuuucauggcagugcagauguggagugugacaaguguauaaauacugucucugucgaucauggacuaacucccuucaucccaccuuucuuguguuguccucguauugcagagaacucggguuuuuagaucagcucaggaucacgcacaacacggacauauuuauuggcaugcauggagcuggccuuacccacuuacuuuuccuuccggacugggcugcuguguucgagcugugaguauggguggcagcuuuccauggagagaugaggagccaggaucugagcuaagagguucagccugggcauuagaaagccuaauauauacuacugucaagcgacaccauggugguaucuggaaagaaaagcaaccuagagcuaaaaggucugaggucugccagucaguccccuuaggaagcagaggcucccuccauccucacagccucaaugcauuaugggauucugugguuucccagcucagaguucaccacugccucucaagggugagcaccgcccucccugcagucaguguaauuccugugcugaaggagagcaggguggugcuggcagggauagccaaggcccuaucuaucuccaaggauugcuuacccagcaugccugaggcagagauggugaagaggggugacuccguaaggagacuagccaaggaagcauugguacagacuuccaauauuuggcaaaacauuuucaagcugcuugugagguagaagguaauugugaauucugucauaauucauugguccuagagaggggagcauggaaaaaagggaaaagggggugggguguggaugagauauggcagcccagcagaccuggggugggcuaucugcuugcuuccuuaagcaacugcuuaaccuguaagguaauguacuaccuccuuggauacagagagguaacauauucuuuccauguauguaaagauaauaucuuacaagacagucuccaguucacaggcaguaggaccuaucgaauaaggugcccacuccucagucuuacucugacucuuuaaaaaucaaggcaagguauugaggguaugaauuuaaacucauuuuuuugcgcuguacucaaacccagggccuuaugcaugcuagcccagcaugaccacagugcacccugagaauguguguaaaauucuuucucuccuguuuguuauuuacaaaaccuuuaguaagaccacauuugggaaguggauguuuuccgccauagaacauuacgcacuagggaaccuccuggucaaaggccucacaucaugugugacacccuuguguccuuagguacaacugugaagaugagcgcugcuacuuagaccuggccaggcucagaggcauccacuacaucaccuggcggaagcccagcaaaguauuuccucaggauaagguaacauucaccaaaugguuuggaguccaguuauuaaaaugcaagccaucacugagccucuguucgucucuugaauacuaauauuuuuuauuugcaaguuagagaaaaaucucaauguuguuaaaacagcuuacaucaguuuacauacagcagccaucagcaaacaguagcucuaaugguacagaucuggccuacgaauuguuuuuguaaauaaaguuuuauuggguaccgccacauuugccugcauauugucugggcuugauuaugcaucuccuuggcagggcaucuaugacugagagcagaugguuggcagagcugaaacuaucauugggagcucugugggaaaagcuugccagcccauguuguacggcauaaguugaaacaguugcguuagccaaaggaaaaugauuuuacgucuauagaaagacacacccuucggugacuccgggauuuuguucugguuuguuucugcagggucaccauccaacucugggagaacacccgaaguuuaccaacuacucuuuugauguagaagaauucauguaccuuguccuucaggcugcagagcauguacugcagcacccacaguggccauuuaagaagaaacaugaugagcuauagaaguguugagguuguuuccaagaguguugacacccucucacagccauagacucacaaucagaggagcagaacagccugucauauccuacuguaagaggaaacaugacguuuuacuucugaauauagcucaggcugaccuugaacuagugauccucuugccugagccaacugagugcucaccuuacaggugugccccaccaugccugucuacagaguuacuuuuuguauaugaaagcacaccuccaggagaugcuaagucuuccauguguuuauugugucuuugcuauuuaucaaagguauuuuugcacugaaaaagguuacuuuuauaguucaaaggugggcagaugcccauugguguggcagagcucuccuguggggaugcaaaguugucaacaucgguggcuucagacuugauauauguguuuguuaacuguaaugugaucuugauuccagagugucauggcuucaucuauuuggauaaacucaucuauuuggauaaacucagaacuguuguuauuugccauuguauguucauaaauaugguuguagggucugggcacauggcuuaguguagaaugcuggccuugcauguaugggccucuggguuuaaucccuagcaacaccacacacacacacacacacacacacacacacacacacacacgucuaagucugugauucucaggaccaaacuauaggacuacguuauagaccaguaauuagucaacuccagauuccgugcaucaagagccugacaaagaucaugcuguuguauuuauuaauuuuguuucuauaucucauuucaaucauguucuccccaaauguaauggcaguguugauaagagccugucagaacauucuguaguaccaucuccacugacgcuucagccgugaagacccuucaugcugacuuggcaugaagucuuaguuuccaucaggccaguguuugugagcacacacggcuguguguaucuaccucuggcagaauggaaguaacccuagucucuguaaaacacugccaaguagccacaugaagagaagacacuuucccuguuuauuuguuuuuugauuuuuaaaauaaggccauuaaaaacacgguagaccugugaauuauccaaucaaaacaaaagccccaagaaaguggcacugagcaaacaggaugcccagcagcaggcuuccccuggacugccuuuguuucuuacugcuaagcacauagcucaacagucagaaaccauggguuuguucuauuguacagugugaugcuugugucuuauuaacaucugcggcaucucauuuagaagcuacuuuuaauuuuuuuacaaugcacuuagcaaaucgcagccaaggacuucauuuuuuaaauuuuagagaagcgaccuacaaaauaaaauauuggugacuaacagcuccucggagguuugcucucuuuuccuuucaggaauuguuaaaagaguuguagacuuuauuuauuaaaauaccuuucaaggaaauaguggcccucuauaggcaggacuucccuuugggucaaaaaaauucuuuggaaaacauuguaacaugaggaauuguuaaaugacagguuugcugcuguuccgggugcaggauauuagguaggcaggggaagaaggggcugucccacaggaaggggagggaguggaaggaucauguugccccggacaucgaggacaaacaucugagacugugucuggaaaaccuuccuuuuaccucauuucaagcugcacagggaccuauguguucacagacuaccgaggauuccagaaacugaggacacuuucauacugaaaccguauuugaauauuuugcaauuagaauauacuuuauauaaagacagucauuuaaaauuuuaauuaaugggauuaacuuuuuuaucagacuuuuggugggagcagaagaucugcagauuguuguaaaaucuaaaauguagauauggcccuuuuuuauuaagucuguaaggagaugcauuucacuguacauuuuggguguagcuuuggaauaaaguuuucuauauuucauuuacauaucugaacaucuucaggauuuucuguguuugaaugucacauuccugcuuuaaaaauaaucugguggcuugcgcauaauuaaaaaaaauuagcuca

SEQ ID NO: 3252 - RNA, 6880 nt, Mus musculus
uuuuuuuuuuuuuuuuuuuuuuuuuuuuuuuuuggugccuugaacagcacagagauuucuuacuuuauccacaggaaaggagacugguguuuucguauuauuguggauauauaauuaauuguaucuaauuuguauguguuuguacauauugagagauuuacagaguaauguuaacacugaaauuuugaaaucuuucacacugaaaucuucaacauauuucuuaaaaauguuuuaaacauuugaguaaaaagguuauuaagccuguaacuacuaaauuauaaacuaaggauucccuuuaaaagcagaagucacacugacauguuuaaaauguaaagaguaauuuaaacuuaaaaaauguucuguuuugaaaauuuauuccauguaucuuccacaaugaagugugaacaaaucuagaugcuuuuuguuacuuauucaaagaaagcuauaaauauuuaauauuaacuaggcauaauuggguagugggaaauguugcuuguaguaaauugugauagauacuaucaguagcagguaauuuugaaguauuuuacuacacuguuauaugaaucuaacaaaauaaaaucauuaaaaaauuuacucuuaaaauuagucaauuuacucuuuaaaauuacuuguuuaguuucauauaauuauauuucugaacauuagaaaugaauguuuuaaaauaaucuccauagcaaaacagaaaaguaauagaaguacauuuaaauuggggauuuuauaauuuuauguaguugaaccguuuuuccuugaaccuucaauaaacaaaaaaauugcaaugaguaguaguguagaauaacuuuagaauauaguuuuccccucuuccaaaugucacuuuguuuaaaaauuagucagguuguguuuuagaccuguaaaauauuuugauagauucuauuacuuaaaauuguuuaauugcuuuuaucacaguccuucuuuauucuuuugcuucuuuuguucuuuugcuuuuugugguucuggcuaagguaaaaaauaauccaaaaauauauggaaauuacagaaagaguaauaaauguuagaguguaugcugcugaggggagccugcuggaaucucacuguuugacuccauguguccaggacguuugcacgcccugugagccccugagccgccucaccucagcuguugugucuacuguaauaguguggaugagcuugugauccgguaaucccuuuguucuuuaauggccccaagugacaaagccaaauguuagccaggagugcuuccuuaauggcaagaugaacauccacauuggcugucuugcuggaaauugauagcuucuacuguuucaggcauccacucugggucucaaaacugucuuccccacgagaagguaggaguucaaguaaaaaccguaaauuuuaguuacauuuuaaacucuacuucagaucacagcugugaguagccaucuugcagaauggagaaauuuuagggguaauucaagugaccuuguuuuuaucuuguguucuuguguuucuguugugggaacucagauuuguagcacgaauaaauguucuuuuggugaaaguaacagucauaaaauuaaguuuuuguauuuuagugguaaaaagcagccucauaacuuuuugcuagcuuuaaaauguuuuaauauucaggggcaagaugauaagucugacagcaauaaauacauaguguuaaaagagacaggaaaccugaauuucaaaauuguuggcaagcauuuagaacugguaguuugggaaauguaaaauacuuuuuaaacaaauaauuugggaauguggcagagaaaagauuuugaaauuaaaauuuccuguauucuagauuuuauaauaucaacauuaaauauuuuucuugguucuuaauaacauuaauaaaagcagcccacuuaaaaaucuuaaaauguuuucaacuuacuuauguauaaaaugacaugcaaccauuuauaucugcuucaucuguaagugaauagcugauguucacacugcuuauguuggcuagaauauacuuagaccuuucaguacauuucaaguugauaaggggcacugaauaaauuucuuguaaauaauccaguaaguggcagaagacuuauuaagcauugguugcucuuuaauuuucuuuguuauguaucauugaaaauuaucuacccauaugcuaguagaauauucuaaugcauaaaauaguuugcaguuagaugcuuccauucuugggggagaaaacaaaauucaaaaaacaaaacaaaaaaaaaaaccaaaaaauaaaaaaccccucagauacuuggaauuaagaggcccagguguuggaggugagcacguggagacugcugcugcugcugggccucucuugagaacacucuauagcauucagcaugugggauguaccaaauacacgacauugcacuucaaaauaugcuaaguguggaugauuacugacuuagaaaaauuuuugguuuuuguaguuaaguaaauguaaggaauauuuaggaaguauguuucccaucaguuauuucauuaauugaaaguuuaauuugaaugcuuauuuaaaagcacaugauuuuggccuagagagcacuugcugaucuuccagagggccugaguucaauucccagcauccaugugguggcucacaaccaucuguaucuccagucccaggggauccagcacccucuucugguguccucagacaccaggcacacaguggugcacaggccuagaagcagacaaaacacccauacacauaaaguaaauaaauguucuagaugcacacaauuuguaguuauugaaaacaaagcccccaaauuaaggagaaaugggugcaaaaugucuuauuuuacuacuguuuaguauuauagacauguauguuccagggaucauuucucauucucauuacaaaaaagcugguccaaguuuucuuauccuuggccaguuuuaaacuaaaaaaaacaaaacaaaacaaaacaaaacaaaaaccaaaaaaccccacaaaaaacagcuacauauuuuguaaagggcuaagaguaugauuuaaacuaaaagauugauauuuuaauuccaaaugaaagguacuguaaauaagcaugggucugauuuaaauaaagauuucaaagucugcuuacauauuucauuuuaccauaagucacagaagugcgccuuuguacacagaccuguguggugggauaugcaagagagauuguugagacuugcaggaaaauugagaagugcagaauauguguaugacuuccugaguguuucuucccucacaaugccagcuauuucauccuagcuacuucacuuuggcuugucauacaaugcuaggauugucacuaacaguucaguugcugagcacagccuagguuguuuuuuaauucuccccaucuuugaaggucuucuaaggagacacaaaguauguuuugaaguuguuugaguaguuccuuugugcucacaugcaucaacuggaaaacauuuagguccauuucagcuuucaaggauugcugcauauuuuuuaaauuuuguuuuauaauguaacugucugcaucauucaagaucccuuuuccucuuauaccagcaguccuucuguuuaguaaacauuuuaaauauuacuucaucugugaaguguguguaaguguauauguagaugugguguguuguuugggagguauguguugugucuauguguguuuuauuguguguccauguuugguguguauauuugugccuguguguguagauguguaccccucagguaagugauagcaucauuuuccaccuaguaaugugcaguguacaaagacaccauuaguuacuuucuguacgggcacaguucuacauuugguugguucucuguagcaagcccauucagucaucucuguaguccaugcacuaacucuuugaacugaggaaaaagucaguuauaauguuguuauuucagagguuuguuucagagacugaaagcuaacagagcuaacucauucacucaauuuucuguuggugggauuugagucuauaucaguaucaauuuaugccagguggcuugccuuuaaucccagcaggcagaucuuugaguuugagaccuucuuggucuacagagugaguuccaggacagucaggcuacacagagaaguccugucuuaaaagaucauuuugaagagucagaauuuaaauuuuuuauaaugauauauuuugaggaaauuggaaauagcuauuacaguaauacagaacucagucucauuuuaaaauuccauuucuugcuuccuaugagucucaauaacuccuuaauauauguuaguaccugaaagagccccauguagauagcaugccagugugauuaguuuauuuuugccauuagguuaaucuguguuuagcaaacauuucaccuacuucauguacuugguuuuaacuguauaucauugcaccucaagcuccuuuuaaaguugauucaaaauagccauaauuacauguuuugcuguaaugggaagcugcauuuccugaaaaacaacgaaaccgguagaguaccaacuaagcugaaacaaacagucuccuaaaguugugcuguggucacgucacacaagcgcccugguuccaucgccuuugccaggcuuacuagugugguuaguggcugaguuaagagcacugguacucuuucagaggacugaguucaaguccuaguacacacauagcagcuaauaacuguaacuccgguuccagagaucugaugcccucuucuggccgugugugcauacacgcacaaaauaccuauacauaaaaauuuuaaaaugcauuuuaaaaacuacuguaauguucuuuuguucuuuaauguguguuuggcacauguaaaugacaugcuaacacaauacauacugaacaggauauauauuaaacaaauuauauacauauuaaacacauacacauauaaaacacagcuggucuggaacuugcgacauagaucaggcuggccucaaacuuacagagauccauuugccuuugccuuccaagugcuagcuaggauuaaagaaaggccuucccuaaagugcccagcccauguguauguuguauguuacuggggauugaaccuggggucgugcacauguuaggauagcacucaucuccguggucacuaaguugucugggugucuugaacuuccuuuuauuuuuuauuuuuuuuaaauuuuuuccaugacucagccuguggaguagcuggaacagcaggccuguaccaccaguucugguuucaguucucauaguagcuucuuaaaauuuauaagacauguaagccuugugaacugaaugcaucugagcauguuuauuuugacaccauuaauauaagcuggguccuuuuuuucauuuauuaguauuguauaggaaggugugaguauccaggaggucagagaacgaggucagggaguggguucuccccuuucgugguaggauccuaggauucaacgugggucgucaggcuugcucccacaagcgcuuugaaaacucuaagccaccugucagcccuugaacccuuuaaucauaauuuaauggcugucucccccaugcuccagaaggcaugcuggaacugcaaggugucaagaauggaagagaaugggagauaugcauacacguaaucaucaccuaaacaagcaguuagaaaucaucaugaaauagcaaaaacguaaaaauuaaacaagaguagccauuggacuuggacacuucauggacagguacaauucccuggaaucuacaguauuuucacuacccaccagagagugucccacuacauccagucucauuugaaaaucagggcagcaacuucugcucagaaugggaaagcaauaaaauuacaacccugagugauauguaaacagucccguagucugccugccuacucucuggugcuggagaccugccaagcgccuggaggagcagccagggacuugcaccccggugucccacgucccggaggggauguaggcggguguccccaguggaucaggcugugggucacaggguguccguaaccuuggcugauggguguccaagagugccuuccagacucuggucgcuggguguggucaaggcauuccgguccgcccuugagccccgggccaaggugucgcggcagcucccgggcgcccccuggcccggcuugggcgccggagguuuccgguucgcggcugccggcggugacgucucguuacucccaagcugccgccacugccgccgccgccgcucccuagucaagcugcaggugggccccgcgccuuccccgccuguuccuggccggcgccugcacccccgugggcccgcagccugacucugggacucugaucccagcccgcggccuucagcugguuaccaggaguugaucgguggcuguaggcuagggagaugcccagccaggccugcccuguugccucgauccccaugcuggggcggaguggcuucuccaggcacaccugggagccgagcgucuccuaagacagcugcuuccccaagcacccggggcaggguuggcugcugccgggcgcgaggggcugacuccgcuacacaggggagggguugacguuccgcagacaaccggaggaucgccacagcaggauugccacuucggcgccucaggcagccgagcucugucugagcucugucugcuugccuaccuugggacuugauagucuuugagucccagaugcacuucaucuguccgcugcuggcucuguugcccagcaaugcccuaagccauucaugugguaguccuaguaaccccagcucucaugguuuacggcguucagauuuuuaccuuuuuuuccucuucucuuuuuagguccgugaaaauccaaucaagccacacacgaguggagcgcgauugaccguuuugugcaaaaagacg

SEQ ID NO: 3253 - RNA, 23861 nt, Mus musculus
guucuaauucuauaaaagaauuuauuggaagucugcauuuauauauuaaguguuuacauuuaguuugaugggaauacaaacuucagaaguuaacugagccuuugucuuagaaguucaucuauuugaguuuuauacauauuuuuuacaucuucaagauccaagcgaaguuccucugcuucuucugcuuuuucuccauacaucugcagaauaguguuguaucuuugauccaaauccugaaaaauaugugaucauacaaacauaaguuauaaguuauaagucacuagaaaaauuaucacaaguugaacaaaaauauaaacucaucucuuuaaaaaguuauacucauagccagucuaucuagggauacagagcaaaacagaggaacugcuuugaaaaccuagacaggggacugaggagauggcucagugaggaagggcacuugcugagcaagcaugaggacccugcuucuaagccucaacacugacauaagaagccauguagcguacgccuuuagucccagcacuugugaggcagaggcaggcggauuucugaguuugaggccaaccuggucuacagagugagucccagaacagccagggcuauacagagaaacccuggcucgaaaaacaaaaaacaaaaaacaaaaaaaaaaaaaaaagaagaagaagaagccuuguggccuguaaccucagcacugggaggaggccccuggaacugcaagccagucagccagccuacccacagaacagcaagcucugggcucagugagacucugucugaugggaauaacaggguagagagauggagcagggcagccacuuauucuuccugccuccuagcaugcaucacagcacacauguacauaacacacauacaacacacacacacacacacacacacacacacacacucucucucucucucaaacccuauuucuccacuaaauguacaacucucuccaacuaagauuuagucggucuccuucccauuaauucaaguauccuugaugagauuuuugccuucgugauuaacuugguuuaaguacugcuuggcaauaccccacaggacaagucugcccuaacauucagcuuugucauagugaugugaugaaacaaacaucaagucaaauauuaagaaggcagaccuaaaucuuguucuuuucuuugauuagaacugaacauuuuuaucuaaacaguuuagauagacaggaacacaggcaauggauucaucucuaacauucuuuucuuuuuuuuuuaaagauuuauuuauuauauuuaaguacacuguaguugucuucagacacaccagaagagggcgucagaucucguuacggaugguugugagccaccaugugguugcugggauuugaacucgggacauucagaagagcagucuuugcucuuaaccacugagccaucuugccagcccccaucucuaacauucuuuacucaacuacugacucauucauuuucaacaaaauuaccaagucauccauacacauuuuauguaaacuaaaaccagagaaaggaauaauuacuggauuaaaauaucuuagacuuaucccuaagugaagaauacuuacucgcagcugaacucgaagcuuggguaucucuuucacuuucuccucaaguucaucauucugauuuguuaauuuaacuagcucuucggacauuauggaucgaguuuuuucuagguuacuaauuuccagcugagaaacauaaucauaaaaugguuucaauaaaaacauaccuuguuuaaugcucuuauuaauauaaaaauagucaaugugucauuucuugaagacaaacauaugucaauauacaauccuaaagcagugggaaaaagggggccccaacuuucuuuaggaguuuauuaauuagaggguucacuaagcaagcaagaagaaaauucaaugauuucuugcaaaaaugcagccagauuuuucucuuaacaacacacauuugcauuacucuaaguuacuagaaaaggucauaggcauguugccccucuuaaccguggguuuuaucgcuaaaagcuuucacuacucgcugagaaucuaagcagcacucgcaagcacagcaagcugggcaauuuacaucaauccauauuaaaauuauuucaaugagaauggcaagagcuuuucauuuucaguguauaaaguuuaucaucguaaacuaaaagcggcuuuacuaauccucacgcuguaagcaauacagcucccgcccgccucucugggcuguuuccucugugugcaggucucucucaaguuaguccuugcagugggcaaguuagagaaacucuccuguggcauuuacgggaagaaugaagcaagcacgacuucagugcuuccuuuuaucuuguugagaagagaugcugggaagaaagggccacuccugcucuuagauacacuaaguccucucuggggaaggccagggcucaggcucccaacauguccuaggacagagcagauaaaucuaccucauucuggcagucagccaguuaggagaaucagucaucugacucuagcuuuuacuauuaguaagugggauauaugucaccaauucauguuauuuuccauugggcucaaaguucagaugaaaugaaggcgacuacuuauugggacccauuauuucauggguuucuauagcauacuuaauuuuuuuuuuuaguacuuuauuuuuauucuuuuggagauuuuuuuaaaauuuaauuuuauuuguaauucauuuuuuacacuccguauuccauuccccaccccauagcauacuuaauuuuuuaaaauaccuguaaaugacuaauuucuccuucccucagcuuuagcugagacugcagauuuucaauaaugcucgauccagcucccauccuuacagcuucauaaagguugcuuccacuggcugauguagacaucggcccaaaugaauggucaugagacucauccuauucauuaaagagcacacacagacaguuaacacacauuauguucuauuaucaaguucaaacaaagauccuguucauucuugcuuugaaaugucuuaugacuguucucaaaaggagaaaaucauguguauuucgucacuucaauuagcacuacauuccccaacaaggucacggugucagccgaucuggcaacugcauguuuccuuuagcauuacucaagguaagaacuaaacgcauguaagaaccacacguaagccauuaccugagacaggaaggacgcuugcagcccugcagcaucgacuccacuuauagagcuggaacgugacauggugggagugcuacaaacagaaaacagcuugugguccuuaggggagaaaaaacucuguaagacugagaagcaaaaauaaagcaagcaagaaaauuuucuagaauuaaugaaaacaaaggcucacaaccaucuguaauggaaucugauacccuccuucuggugugucugaaacagcgacgguguacucacacacauaaaauaaauaaauuuaaaaaaaauuuaggagcugagcuggcaagauggucagcagguaaggaugcuugcugucaagccucaccuaagcucaaucaauccuaugaccacaugguaaagaagaaagaagcaacucuagccucuagcauguugucuucugaccuacacacacacacacacacaauaaaaacauuuuaaauuaaaauuuaaucccugggggcuggaaagaucgcucagcagauaagagcacugacuguucuuccagagguccugaguucaauucccaguaaccacaucgugguucacaacaucuguaauggagucugacuaucuucugauauacauaaaaccagacucauauacauaaaauaaucuuaaaaaggcaaaaaaaauuuuuuuuuaacuuuaaagccugccuuuccccaauuauauuauaacacaauuagccaguuuauuauuuuuuuaaauggaaucagagugcuuugguugaaaagccuacagaagcuaacuacaucauguuauagaacauauuaucaauuacucuuaaaguugcuaaaauuucugacuuauuccuuuuauuuuaauguauuaaaaccaaaaaacagccagucaguggugguacaugccuuuaaucccagcacuugguaggcagaggcagaggggcagagaaagagagagagagagagagagaggcagagagagagaggcagaggcaggcaaaucucucugaguuugaggccagccuggucuacagaaugaguucuaggacagcuaggacuacaaagaaagaaucuaacuuaaaaaacaaggaaacauguuuuguaaaaauuaccucugggagcuaaggagguggcugagugcauaaaguauggagaccagaguucagaugcaagaacccauagaaaagccaggcaaauguggugggucccugcaaucccaguacccaggagguagagacaggcucccugagacaagcuagcucauuagacuaguucuaggcucagcaagagacuugccucaauaaaacaaaguagugaauaagugaagacagacacaccugcacauaugcaaacacacauacacauauuuucacacaccacacugauacacaugcaaaaaaaaucaacaacaacaaaaaaaaaacccucacuacauuuacuaaucagaaauauacaacaagccaauuaauucugaaguuaccuuugggccaucugcuauauuaguuucaguaagacaucacagccaggcaguggugguacaugccuuuaaucccagcacuugguaguaagaggcagagguauuuuuaaaaguguaaacguuucuauaauucacgaccaaucacagaucaauuugaaugcacuccagugacuucaaaccuguucucauggaguacuggccaugcuaccacucaguucaguaauuuuagaaggagaaaaacucaagacaucaggacaaccaagccacagagcaauccacaguuacccacaacagcuuagcuacacacaaaccaacacaauucaguaccuuuucuuuuagugcuucuugagugaaaaugguuuucuuccuuucuuguucaacuuucauucuuuccauuucuaacugacugcucaaaagugucuaaaggagagaguacaguaaggucauuugagauacuagccccggcaggaagcucagagugucaaguacaagcugcuccuucagcccugaggacaagguuccgccucacccagcuuagcuccacagcaguuugcugcugcugcccuccccauccaucucuaacgcaagccugggggagcgagcacuaacaaauaccuucucuuuccuugacucuucaagcguucuuacauauucaucuuuuagguuuucuaauucaacuugguaccuagaaaaaccagagggaauugagcaaaaaaggcgacaggaaagucuacuaaaaccucuccacuugucaaaccccagaugcaugcauagucaguagucauuuugucaccagcucagcauugaagacuuucuagcugacuguuccagaucacugagacucaaaaguucuacucuacccccauuuuuuaaaccagugcuuggagauuuaaaaugagacauuuacacaguaauuuaaauacuagcauuccaaguucaaauguggcaaaaaagagagggggagggggagaaagaaagaaacaaagagagagagaggaaagaaaaagcaggggucaaggguaaaagcauagccguugacuuuauguaauuucagagagaugauuuuacaggccaugguuuuaggagaauccaaauucuuacuuagaacacacuggaagacugcauagccaccauucucuccucccucccucaccuccccaacccuugcuucuguugguggccucuuaaaaaaaaaaauaaauaaaaaauaaaaaccucacugauaggacagauacuuuaccuggaaaaacacagcuuauguagaacaucgcacgcagccuuacaagaccugcaguggcucccucccuagcuugacgcaugucagaaaugacccuaacuuuaaauacucaagguguucaguucuccaugcaaugaaaggaagacccaacaaaauacuuuccaaaagugcuuuagaauguuaagaaccacagagaaucacauaaauauacucaccgacuauuuucauccucuaguuuucuuaguuuauuuuucucugacucuagcugggccugaagucuacuguuuuccugucguaauaacguauucugugacuccacugaagacaucuggauuuuguuggccaggaguucuucuguagcugcacguucucuuucaacugcugcagccaacaaggucugugauucaccugauuauagaggaagaaaaaucauaugcauacaccagggaaagaucagacaccagguugguucugaccucaaauuucuagugacucaaguuuccagacuuagacaagaagccagcauugcucaaugcacaaguuagcauucucuccucaguggauugacuugaaaauacuguuacucaguagcaggguaguaaaucaauaagaagcacuggagcaaccaaauauccauggacaaaguagacuaguaaaagacaaauagaaugaaagaaagauagagccauaaaauagaguccuucuucugcagcaggugcagaggaggaaaagacaccaggcuaaagacagagcuucauuacuuguuuacuuguauagcaggcaugaagccaugguuucauccccagcacugcauaaaccaggcuuggugguauacaucuauaaucccaugacuuggcaaaagaagcaggaggauuaggaguucacggucauccuuggcuaccuagaggguuugagaucaguuugaggucaguuugacuauaugagguccugucuuauuuauuuagcuauuuguaauauagaaaagacaggguacaaacuggaaaaaaaauaaaugcaagagacauguauagauuuagugcuuaaaguacaacucuccgaagugaaacuguagacaguuuaguuuaaaaaugagcaaaagcuaugaacaggcaguucacccuacagcguggacagagcugucaacaggcaguucacccuacagaguggacaaagcugucaacaggaaguuuacccuacagcguggacagagcugucaacaggcaguucacccugcagaauggaccaguggaaaacaagcacaugaaccaaugcucagcaucagcucucauuagggaaaagaaaauuaagaugaugagauauaagaauuuaugaauuguaaauugaaacaaaacaaaacaaaaacagagaacggaaaaugcuaccaagguuuuaaacaaacuggauuauucccacagcuauaagcacuaugagaacaguucagcaauuuuucugaaaacuaaacacgaacguccauaugguccagcaacugcacuccugaacagacauuuacagcaccuuuaccuaaaucuggaagcagaccagccauccucccccaaguaaauggggaaauaaacuacagaacagacaucccagacuaacacucaacagucaaaggacuacacuacugaaauguuuauaacuuuuuaaauuuuuauuuuauuuguuuguguaggcucgaaguauaugaauagaguaauuacucuauucaguucauuucccucagccaauuucaaugucccaaaguuuaauuaacagaacagggaagcugcccugaacugaacucaacacuuuggagugauaaguucuauaugcauuucaaaaaaauaacacugagaaaacaggaucugaguugggcgucccagcacucagguaaaaggcaaauacaggaguauaugccuguaaccccacagcgaggcaggcaaagacaggaggaugcggguggcuugcuagcccgccaaucuacccaaaucaguuaguugcaggcucaaugagacccugucucaaaaaauaagguagagaaguaauugaggaagauaccagauaucaaccucuggccuccacacauaugcauauacauaugggcauauaaauuuucacacauacuuguacacacaaacacaucacccccacaccaauacaacaaaugaaauggcaggcaguaaaguacaugacacacuguguaagaaaaaaugcuuuaagagucccaacugagguguccauaaaaaagggggaagacauaucuauauguuagacacaaaugucaccacaggacugggugaauuuuagugccagaccacuauucuaccucuacagacaagacagaaaguuuccugcaucaaauguaaacuacuaaaggcguucguuaccaagccuaucagaaagacucuucuccagugucucccacgaggacgucugggaccccagaguugcuuguaaguuuucuaucugucgcagcaacggucuggcuguugaugaaacacuuugacucagcucuugguuucgauucucugcuucuuggagucucugaaucaaaaaauucuuacuuuauuaccacugacagagaaaaaacaaaacaaaacaaaacgcuaaaaacaccagcaaaccuaaacuugaguucaauuuuuccaagaaaaaaguuagcuaucuuacuucuaaaaagaaaagaaaaacacuauugaauaugcagcaagccuauugauaaagacuuccuuuaaaacaaaaccaaacgucuuccuaguucuuuucagaggacugcuuguacuugguucacuaagcuacuaacauguguccacugguaguaaggcuuucgauccaggaauacuagccuccugauuggucacauuacuucaaguggucacauuacuuugaccuugugcuugggaaagcaugaccauaccugcugaaguucacugaucucauggcguaaguaauccucuuuucuggcagcugcuugcuccgcccgcugcagcgcuagccugaggucccccaccugcaggauaaacaacacucugucggagcauuagcuguaacuuccugcugacauccguguggacuuuuuauguaugacacuucaugcuaaacggugagcacgcauccugauccuuaagcaaugccaaggcuauaaacauauucaccaccuaacugaaagcauccuguuaucaaagaaaaguaugcaaauauguauagcccugccauacaauaagagagaggagagaucagaacuagacuaaugaauaaacaaacaaauaaaaccuagguacuaaacuagggguguugggauacuggugaggucaguaugagcauuucgaucuccaggccagccuaggcuguccagauagcugugcuacauaguaggcccuaucuaaauaauaaaacaaaacuaaacucuuucugagugugaugcugugugccuguaggcacagcuacuugggaguaugaaacaagaguugaagguugcuuauacaacacuguuucaguacaagaacaaggagcaaggugcugcucacacacagcuacacaaugaguaacuaccauaacuuuuuuuaauacgguggcaucauauuuaacuaaucagaaaaggguguuggcaucuaucuggccacugcaguacaguagauuuagucuuuggagcacauggagaugcauuagcaagccuggcagcaacaaggugaaggcagagcucugaacuguagcaguccugugauuuguuuucaaaugcugauacacaagcauuaaacauuacaaucaaggcauaaaauauuuauucaucauaaauggaaagguuaucaugucuacgguuaucaauuauuaaaaaaaaaacuagagggagauaauauuaaccaaguaacauacaaaauuagcaauccuuauauaccauggugguuucaagaaugacaaucccaggcuggagagauggcucgguggugguuaagaaagagcacugguugcccuuccagagguccugaguucaauucccagcaaccacaugguggcuaacaacuaucuauaaugggaucugauguccucuucugucaugcaggcagacaugcaaauagagcacuuauauauuauacacguaaguaaauaaaucuuaaaaaauaaaaagaauugaauuaaaagugacaaucccauauccuauuccuuacucucaauuuuucuuuauuauuguaauauauuuuuaauuugaaagaauuuuuaaauauuaaaaaauaggguauucauguguguguguguguguguguguguguguaucaugcauguguaugacauguguguacaggugcccaaggaggucagaagagggcacuggaucaccuggaacugaguuaugggcaguuauuaagcagccaugugagaucugggaaccaaaccuggguuugcaagagcaguaagugccccuaacugcugagucaucuuucuagcccauucauuuaaaguaguaauauucuguauacaugucuuuaucucuuuuuuuaagauuuauuuauuuauuucacguauguaaguacacugucgcuaucuucagacacaccagaagagggcaucagauccccauuacagaugguugugagacaccauauaguuccugggacuugaacucaggaccucuggaagaggagucagugcucuuaaccacugagccaucucuccagcccaguaguaauauucuguauauacguauuuccuuauauaagguagccccuugaaaaugacaggguggaagaaacauauggauauguggaccacgacauaauuuccaacauaaaauauugaaagcaauccaaacuuaucaaaaauauaccugaaaauuacauagcaaagagguauaaaacuaaaacucuaaguuuuaccacuauauaacuagcagaauauccuagagacggcucaaccauuaaagguuaugugcaaaauauaagaauaguccaguaggaacagagcaaguuguaaaacagcgcuccuuccuggaagaaaagugacggaaacgccaguguggcugagugaaucucucagcaggcagacaucuguagcccugcauuuaugacaccaacacugaaaaggugaggccaacacugagaacguggugaugcauggaccagaaggcgcaacagggagggcacacagaagaagccaagcuuucaucgguuaagucagucauccaccaaauaugugaaacaaaaccaaacauuaauugaggcugcugagaauaguuuugcguguuuucagcaggguuggaaaacuaggugucuguauacauaaggccuacuaugcaauaaagcuguaguucaguagggcaacacuucucuaguacacaaaaggcccuggguuagacccucugcagugaagaaaccaaacagaacaaaguguaaugaauacuuacagcagcauuauuguuagcuaaaugauauaucauaaauguucaauauauauuauauuuauauaaauuauauauauaucgauauaucuacauaucuauauguauauuggggggauagauauagauauauauuggggggggagacaggguuucucuguguagcucuggcuauccuggaacucuuuauguagaccaggcuggucucaaacucaaauacucaucuuccugacucaaaauugugagauuaaaggcaugcaccaccacugucugacaauauuugacauuuuguaacuacaguaugccaaacuuuuuuucuuccuucauuagguucaugaacugccagaaauguuacaaguauguucaagagucaaugauacaacacagucucuugaaacuauguuuuaauuaaaugcauauauauuacucuagccacaggauaccuagcuucauaaagcuuucuuuccucuagcagugagugcucagcuccaucacugagcuacaucucacaacaccauauacucauaaacguguaugaaacucagagaaagccaagcaguaacagcacggugugugcaucacacuaaagacacuuuaaaacgcacacaaaugagucuguauaacccaguauucuaaaaaugccagugacauagucacagaaaauuccuagauguaccucauagaagaagagauucacauuuguugacuuugcagaaauugccuaccugaagcacuaaugccucuugcugcugacgggcuucuuccugggccuucuccagugccccagaaaguucuucuuuagccuucaucucacgccucagagcagcuuccuguaccucacuguccuuagcagcauuggcuuugugaagaucgguaaguucucuuuaaaaaguagauugauacuuuuuauuuauuaauaaaacacaaauguaaacacauagcuaaacuaaugcaauuucuauguaccauagaaaucucaaaauaacagcaagcacaucuguacaauaauucuagucguuauaaggaucuuauaguuggacucgcuuuuucuaauuacagacacacucauagaaaaaucuguaaauguugcuaguaccuagacaacagaaaaaaagacaagcuggagagaugcucaguauuuaagagcaacaaucuucuccauccuucucaggcaugugguacacagacaugcaugcagguaaaauaccaaugcacauaaaaauagaaagaaagaaagaaagaaagaaagaaagaaagaaagaaagaaagaaagaaagaaagaaagaaagaaagaaagaaagaaagagagagagaaagggaaaaagagagaaggggagaaagggagauggggagaggggaagagggggagaggggggagggggaugggggagaaagaagagagaagagaagagaagagaagagaagagaagagaagagaagagaagagaggagaagagaagagaagagaggagaagaaaggaggggaagaggaagaggaaagaaaacagacuucuuuaaccucccacugugauaacagauuguaagcccaccacaccguucauaccuguacgcacuaucuagggcagccugaguacuucggcucuucucuucaaguucauccaugucuaccugaagucggccaagaucuuucuccuggcguucuaccacagaauuuaguuuuuuaauauuuucucuauguuguuucucaaccuccucuuugccaucaaggaccuauguuaucaaaacagguaagaacaccuuucaauaaauggugcaugguacauaacgaauucugggaaaucucuaacacugacuauagcuugaauagaaaauguggcccacuggcacaagugucugaacacagcucugcucaugguaaguucuggaaagcuguucaaaccuuggcuggaggaaaugggaggacaggccuucaggguuugcccagcccuacuucucuacuuccuggauggcaccaaguaacaaacacuugccacacacuugccccaccacaagccucugucauaucuuucccacugugauggaaucguucaugucaaguguuugaucacggugacaugagacaacauuagcuagucauuuaucaauaaacuaagcccuuuucuugccugacaucccauuagaucauucugaaugcugcacacaccauggccaauuagaggaaguaagagcaacgcauguucagagaacacugacugcuggucaccugucuuaagugcuguaacuccucuuccagcuccuuagcuuuucuguucagcuuugcaauuacauuuucauugucuuuaucuuuagcucuuaauuucuuaaugauauuggaauuaugcagcugcugcuuugaaaguuuuucuccugaugguuguaaaaaaacaaacaacaacaacaacaaaauagugagugucuaagaaccugcauagaaagcuuuaucuaaccaguagcaaaaaugacuuuuuaauaccauaaagacucuaaacuccaguguuaaaacucaauugaacaggaauuaucaauaaauauuaaaauuauuacgugacuggauucuagguaacaagauacuaacagucuucauuugaucuuuagccucaaacucgggcuccuccuccuaccacagccuuccaaaugcuaggauuauuaguguuuacacaacaucuagcucauagcuauaacuuaggauucccuauguaccuauauuuccugcuuauaaaaauagguucagaaccaaaaaaaaaaaaaaaaugguuccuaaaggacaggaaaguauaucauaucuaguaauauaccgaguaauauccaauauacucacugucuaaaggaauucuuauguaaguaaaaaaaaaaaaaaaaguuggguaaaaguuagcuucaaauuaagugauugcuuccaauuguccucaaauucuauagcugcucugaaacauauuuacauucaaugaccuaagaaauguucaccccacauuuguaauaugaacauuuaaaaaauaauagaucuaacauuaacaaucacuaaaauaacugcaauauugccaugcaaugaacuuuauacagcugucaguaauaauauacaaaauauuucauacuacagugacagauaagaaggcugcacaugaaauaugcaauuuuaacuaugcuugaagaugcaaagauacacugaagaaaaacuagaccuccaagauuuaaaaagaaaaaaaaaaaaaagccaaaauacaaauauauuaaaagucaucaacuguuggaaccucauggcgcucagaccgggaacucggcccgucagaccuacaucacagccuucgaaugucuuuguuuacugacgggcucuuauggcauguuacaaacuuguaaagggcagcacaaauuucugcccaguuuuuggaaacuuuaaacauaaaaaaucuucccagagcaaaaaacugcauagcauauuuuucuuucaagacaucucaccccauucuuccacaagccgugaaagccauagucugugguguaagucuacccuccuggcuuucguuccccucuccuccccuuugcuuccuguuccuccuguuucaucccacuuucccucuucuuuuccuucuuucauuuuccuguuguuuauuguuguuguguuacucagguuuaucuucacccccuugucucggcagauccuccggcuucagugucgccaggaacuacagccgugugccaccauacccagcucaguauuugucauuaggaagcauguucuaccuacuacauaggaaguagucuuccuuuuucuuagacuauuauuaauaaucaacaaaauaccuaccuucuuccauuaaaccuugaaucuguucaucuuuuuccuucaacaggucugcaguuugacuacuauuuaaucuaguggcaaguucuuccuuuaugguuuucauuuccuaauuuaaaaaagcugugguuaucauaaagaauuauuuccauccuagguauauuuuuuuccagccuucccauguuugaagacgccaccuacccacaaucucaucccaauauuaaaagcuaucaguuuagucaacccaccugcauaguuaacuaauacaagaaaacagcugugaauagcacauaagucuauacucaucauuucuauaagcaaguuuuaauauaaaaaugagugaaaauaacuuccuauacuguuguccuucaguauuucuacacauguaaucuauagguuaagcuuugcauuuagaucaacacagcaauacaagacaggaagagauuuguugguuaagugucucaaguuauugccagugucuaaaaugagcuagcuaauuaaagcagccaagcaugagacuucauguaagagucacacagaaaaacaguaaauuuccaccaaucaaguauaucauuauuaugguuauacacuuuuaaguaccaauaacaauggcaaccaaauuacuauuagucaaaaaguagaaaagggguccugugaaauggcuuggcaguuaaaaagcacuugucaccaagcugaugaccuguauuggauguacaggauccacaugguggaaagagaaaaccauucacugcaaacuccccaggcacacucacacauguacacacauguccacagaugcccacacagagacauuaaaauguaagagauuacuaauaauaaagugagaaagcagccuaauuucaaaaguuaaaugcaaagagcaaguuauuaacaaaagcuaggacucacaugauaauuuacaaccguagcuuuaacaccucaagaauguaagugcuccugauugagagcacagcaauaacggcuucugaagagguauggcuuugcucccaaagagcacauggcagucccugcaacuaagcaggggaggaugacugcagugacauggaggggcugagaaggcugcuaggcaucuaacugcagaguacaauaguguccauaacagaauuagccucccaaaugccaauaggaucaaagaugaggaauguuagcacaagucaguauuacauacgccaaaaaggagucauuagccacuacaaacuacacuuuucaucuagacuuaaagaaguguacauguuugaagugguaggaaaauccaggggauuaaugaguacuuugaaaauguacauaguaccacuuagguuuaaguguugcuuauuuugauggaauuaucauuuuugguuaccuuaauggucucugcaaggauucauauauaaauuacauaaauaccuguuuuagagaaaaugucuguaugcaugugcacauuugaguauacaaugguagaggacccggcagccuucagggaacuucucugauuaaugcuccacauuguuauuuuucugagacacggucugaacacggaccucaucaguuuggugaggcuggcagaguaaagagcuuuagaagcauccgccaucucugagccccucccccagcacugggguuacugacacugccauuacgccuggcguuaacaugggcucuggagauccaaacucuaguccuugggcuugcccagugggcgcuucaaagccugcggagccaacucuccagucucuacauuucuuuaaaggaucaaaaucuaccaacguuaauguaccaaaaaugacaauuuaccuguuaauaugcuacauacauuuuuaauguuuacuuguuucuaauaccaaaaucugaguucacucacggaacucaacagcguuuaauuucaauuaccuucuuagcagcaucucucuccuugcaggcuaguugaacuuucuuuucugcuucugcaauucucuggguaaauucaucuuucagggaagaaaugcuacuacuuucuucuuuuacucugaacauuucacuagauucaaaauauaugagagugaagacacuguuuaacagucuagaugacagcauuuuuccaguauauaccauauuacaauaugggugaagucuaguaaccuuuacucugcuuugaugguaagacaugguccuacacuagagcacaaauguccucucuaaacucacccuucuaccucugguucucugcugggauuuuaugauggcaugugugucaucaugccuggcccaacaguuaauucaucaaagaaaaaucauuugcaaaauuaaaguauuuguuaguguuagucaggauugaacccagagcugugcaugguaggaaaacgcuagaccacaaacauguauccucagucuaccaaacuaaauuuaagaaaccucaaauauuagaugugcagaucuaagacaaaaauaaauguuucaauucuaaaucuuuccugucacacuuccucaaucgucucaaaguaaaccaauccuguguuaaauauaggauuucaauuuucacuaaacacauguuuuaaaucucuaauacuaagagaauaagaagauauacauguguauauguaauauacacauuugaauguauuuuuauaaaacauugauugaaaaugucaaagauaacaugguaaagauaauuugagaagaaaacuuuaaauauguuuauaauugaaacacuauauaauuuucagugacuauaaacaaguucaauugcaaaacauuuuguaaagacuuauuuauugaguuuuauacacaugcauauacauauacuacauacgagccuggaacccuuggaguuaugugggugcuggcaaccaaacacagguccucugcauaagcagcaaguguucuuaaccacuaagccaccucuccagguccaaauugugaaacgcuuccauuuuaaagcauccaaguacaacggccuguacacacguagugacaucacucgugugcucugcauacuuacuccuucagguuaucauacgcuuccuccagaagugccuuuucuuuacuaagggacaauaacugagucucccucuuuucuagcuucucauucagaaauucaacugucugaaaagagagaacaaccacgagucaaucauuugugacgcagguaaaaagccguaagcgucagcugcucacaacucaaccaccacugcugaggacagaggcgacaccgacaaacucuaaccaaugguuuggagaggacgcaccagagcagccauguaccugguaggauugcacacugaugaaggaguugggagaacgacuaggcagaaucuaccugagaacauagaagauuccacuucugcgucuaaccuuacaggaagcacauggugacuaaacaggugauaugcauaagaacaucuaaagcgggguauuccuaacagaaaaaaucuaggauaauauauuuguacagccacuaaagaaggaagauaaauuaaaaaaaaaaaaggagccaauccaaacuucuggccauguuucacaucuuaauuucguuguaccuagauauccugcuguauucuuauuauccuuuagcccaaauguaauuauuuuuuaacuauucuccacuauacuuaaaaauaaaauuaaaacaacaacaaaaaaccccuuaagcauguaauuugaauuuucuaggauauaucaguauaaaacuaacagaaguaauucucugaguaucucaugucuaagucuugcuaaagcagugauaaacuucucuguaaaggcagagagggugcuuuuccagcuucaaaaaagucuugucuugggcuggugagauggcucggugcggaagagcacugacugcucuuccgaagguccugaguucaaaucccagcaaccacccguaaugagaucuggcaccuuccucuggugggucugaagacagcuacaguguacuuauuuauaauaauaaauaaaucuuugggccagagcgagcagagguccuaaauucaauucccaacaaccagaugaaggcucacaaccaucuguacagcuacagaguguacucacauccauaaaauaaauaaaucuuuaaaaaaaaaaaaaggucuugucuugagucagaacagacuaaaaaucacuuaccuuccuaaggagucugaaaacaugaacaguaacuagugaugccuuugggggauucaaaauaccagcauguacucuauggcugcugcugcugcucauucaaaacuacagcauggcauuuuguucuugaacaguaugaaacccagggcacggaaccugcuacuuucaaaaauguuaacuaaggcaaaaugagcauucacaggacaucucuccacauguuauauauacaucucuccacauguuauauauacacaucucuccacauguuauauacacaucucuccacauguuauauauacacaucucuccacauguuauauauacacaucucuccacauguuauauauacacaucucuccacauguuauauauacacaucuccccacauguuauauauacacaucuccccacauguuauauauacacaucucuccacauguuauauauacacaucucuccacauguuauaugcaucucuccacauguuauauacaucucuccacguuauauacauuucuccacuuuuauuuauuuauauauauauauauauauauauauauauauauacguauauauacacacacacacacauuucuccacauuauauauacauuucagaagccuauuagagauguuagcuccuauucaaugucuaagacucaggagaaagcagcgcuguggucuaacauuaagaauggacaccauucucucuuguauguauuagggagaagucacuggucauucccagguuuuacuuuugcucccuggccauuucauuuucucauucauauaagauagcuauuaaaaacagauagcaaaguaacguaaggaaaaggcacgccaaagcacuguaagaaguauaccuguuaugucaaugaaacaucaacauuagacuaguaaacacaggaaagcaucuacaguauucauauaaaaccaaaacgauaaaaucuaaaauuucccauaaauaggauacauaugcaaaacacuuugauauaaaagugguaacauucagauugauauuccaugucuaucuucaggagaacacauugugacuuaaacaguccuuugcaaacugucagaaagaugaacagagcaucaaagaauguuaaagugauaaggacgcagcaauacagauggaaaauggaaacacuaagcuuuuauauaauaucuacuuaagucuaccauaguugcuuugcaagaacuucaaguaauuuaacauaauuacucauuuuaaaguccguaacugcuacaauuaaaugaucaaacaucuacuuuuucaaaucaccacacauccacgaaaacaucuguaacucugaaacauaccccaaugcccucuucuacucuguaguuaccuugcaaacaucuucuuucucuggcggugcuuuuggcugguuuucaacagcuucacacugcucaguggccgguccagaggcagagugcccgccacuuccugcugugggagaagccaauauaucuggcuggucacaguucacuggaguagcacuucggccacuuuccucuaauucugcuuccucagacggcgcaacuaaugucucguuuccuuccucuucuucagcauucucuucaguagauucuacuacuuuagucuuugggguugaaggacucacuauuauggguacuaaagcauagccuuugccuggcaguucgucgucugaguugauuucacuuacgcuccggcuaucuagagacugcacgcuaaaugagucuauucuuucaaaagcauccgaugagcagcaacucucauugagcuucuggaagucaucuaagcggcuauacucgggacaagcagacgcagagaggagcugaaaugacgucugcaugaggugaagacucgacuuugcauccgaagucucuugccucgaacuggccgagcucucacugauuacacucucgugaucuaaaacuucaaugucacuagugguggaggugcccgacgagaaggagcuaacaggaggagaagguguguugcucugucugucuucguguuuuuguucuuuagguuccaaagccauauccuucguuucugccgugagagacugaguggaugugguagauacaucuucuguuguguuuacauuaacuacguuuucagacgccuucaaucucacagugggcaccuucaccucagacucuucaccugccguuucuucaugcuugucuucagguacaggugagggagugcccacggcugaagucucuccagaaacacacacggagucucucacuucagcugucucagaaacucuggacuggccaggagaugacgauucuuguaagcugcuuuucacuucuuccucuggccgcugggauuuagauggagguuuugauaccacugggcucuucugaaugguaugggcauccgacggagagagaaaggcacugaagaaauuuucagauucaucuacuacaguccuucgaacuggcuuuguaauugcuugagaggcuguugggggacucugagguucgcugcuuguugaguucaauccccagguugaagugucccauccuccacucacagggggacuuauuccuuugacaaaauaaauuaguucauuaaguaaagaauguuagcauucguauuuaaaucaucaucagucaucaagugggagcaaagggaauuuaugaacugcacccuguaacucggaaaaguuagacucuuuccuuacagcaucacuuuauuaguuuccagguuaacuuugggcguuaaagaauaaaaccagugugggccaaccuaugagagucucaggaacaaguacaagaccagacuugguuuugccaggccaaagcaaguaugcuagccccucggaauacaugcuuaaaguagugaucaaggcuguacagccagugugaaaucccaggcacauggcucaucucacaaagacaguucaaaucuucacuaacaggcacaugcagucacagcacuauccagccacacgcucauuuuauucuuguaacauuauaaacuaaacagacagcaaugcucaaaacuuaaccugagauaauagagacagucuuuuucaaaaaucauaauuaaacugaugagaacagugaguucuagugaaugaauucacuuuuauguacuuaaugaccagucugcaaguuccccucucuuaaaccccaaauuauuuuuuccacauuuuuuaagauagcaaaauuaccaaaacucugcaauuagaagcuuauggaaaggguacacagacuuccugaggaagaaaaaaaaaaaaaaaacaacucaagaagcccuuuaauaaaaucugccucuuaacgugauuccacagcuaugaggaaugaagaguguuggggaaacugaacugggaacagaguuuuacauuuauuuguucagugugugaaaccagaaaacaaagcuuaaggcaagauuaggucuucgagguagcuaauuagcauccucacggauaccaggguuuaacuuugccucuugaaaaaugugguacaaaauuauaguaaccacacauccacuuaaacuauuccuauucuucagacccauguuguuuuguaaucuaaaacacaacagaugaucaaugaaaauagcauucaagaaagcauauuccauuucagacaaccugcccucuaaaauaaauuauacagcacuauccaugucucagauuucgcccggggcgggggauaaugaguaucuuuuuauuugaaacaucugaucuuaaguuuaguaacuccagcucugggguccaaccacaaaaaggcgagcuucccaauagcaaggugccacagagaaugaaauaagaucacgauauaucuacagucauacauaaacuacguuaucaaugauucaacuuaggucccgaguuuucaacaauguacaucuaaaaccagaaaccacaguuaacuuucauccaaagguuugccccagugucuguugcuacacacgaaaagugcuccagacucccuuagacguaaagacacaagcaaccgaauaauccuggaaagaguaauuucaguucaucugaaagaucuggugcugcaaaaagggcuacaguugggaacucuuggagcacaaauucucuugggacucugccccguacagacugugccucaccuggagaaaguuaugcauucugaguuucgguuagcuccucuguagaacacggggucuaccaucccugacucggguuguuuugagacggugaacuuuuuguaaacaaagucuuuuguguuccuuaaacgcuucccgcggggcuccgggacuggggauuuacaaggcucggaccuagggcgccaaggcggaagacgccuagcaauuggggaucuggggcugugcuccugacucuguagucaggggccuggggccaggaccagagcucgagcugacaccugaggucagcaggacccgcaccggggccgaggcgugcgggacugggguccgacagcaggcaggcaggcaggcgcgacaccccgggacccgcuuacccggcucgccguacgggauggccucggcccaggcgcucggcuccuccuccuggauguccaggacccugucgauggacuucugggccugggacagggccugcuuggcgaagcuggacaacugcgaggcauugaaccagcucauggccccuccucagcgccggcuccggccggcuccggcggccucagcggcggccccggccccaccgccucccgcggccgcgcggcgcugcgagccuuccgcaca

SEQ ID NO: 3254 - RNA, 23011 nt, Mus musculus
uagcaauaccggacuucagugacacugaggccggcuuccauuccauuccacuuauauugacagcugaacagcugcuuuuuuuuuuuuuuuuuuuuuuuuuuuuuuuuuuuuuuucucccuucagggcaaagaacacacacaagcgauguguuuaaaaagagaugguuuguauuuaaacugccagagagaacugacaccaccuuuaguuuagguaggggauuuccgcuaguuacuuuuuguccuaacauuggauaaagcccacugcucugagucacuaaccacuuccagccaaucacagacagaccaacacacccgcccgcagccaauuuucugagcccugccgugcuuuaaccgcagaaccaauccgaaggacccgcugucaucuuucauccagcugguugucgcugccgccgccuccagauuccgaaggcgaagcucgcgaagcagaggaacauggacgugaaccucgccccgcuccgugccugggacgauuucuucccgggcucugaucguuucgcccggccggacuucagggacauuuccaaauggaacaaccguguagugagcaaucugcucuauuaccagaccaacuaccuggugguggcugccaugaugauuucgguuguuggguaaguggggucuucugccuggagcaccuguccagggucaggacguagggaccacgaggacaagaucgcgaaaugcaagacuagguccacacggagcgccugccucagggaagggucucgggaaguggcccacccaguggaaacuuguucucagggcgaggccacagcucucugagguccccuuucuuucucuuuuugcucuagaggcuugagcagggacccugggagggaagaggugaggaaaacgcugagaacuugggacaaugagaacuacccccucccacguccccgugcugaagauauucgccugucagauguuuguagcacaguggguguuuuaaaaauaagaaaaaauguggugguguuguaaccuuguccuggggcugccuagcaaagccuggagugacaggguguggacccagggcuguguuuaaguggccucuccggcuaaugucugucuauacuguacauagaacugagcuuccgcucaggcggaugcgagucuccugguggcgcaucuuccccugugaggugacucuggaaacgaggcccccugacauuuucuuuuccccuagaaguugccggacacggucgcuuuagcuuugcuccuuagccuggggucuuaaacaucucugaaggccuuuucgaugcugguuaagaaguuuccugugcuaaguaagguuauacgugaacauucuggcgcacauacacguacacauuuccgcaccuguuuccugagaagcuguuuuuccuuguagguuacccuuuaaaaaugcuucuuccaccuuuuaacaaaauaaaugguuauauucgccauuuuauuaucucuuauacgaauuuaaauagaagguuuuacaaaacacccucuugcccuaaaagaaguccuuuucuaagguuucucuuuccgaacaaacccaaagagaaagagaagcugcuagggagaaaaacaaaaaacaaucccaaaaaggagagagaagagaugcacacucggggcucuuaggaaggggugcgugauaaggcgcugucuuaaguuggccugagguuagcuggcuuauuuacuuagcuaccucugggcaccagaucccacgccaagcucugagcgcaccaagaugaaucagacuugaauucuggcccagggacacauggcauuugcugagccucaaaaggagcaaacucacagcacggaggagacuggcaagcuuccucauuuccaggcgugguucggaguggucaccgguucucaaaugugggcuccaugugagaucuuagcuguguguggcugaaggaacugccaacucuggggauggcguagugugcagaggacacaggcucuagcggacucugacuaaacgggcagcugagcaaccauuagucaggggaagaaagccagaggcaguuguuccugaaccugcccccaaaacucugcuucuucccagaggacagacuucacaaagucgcuucuuuaaaauaaaauaacuagcugggcacugcuggugcacgccuucgaucucagcauuugggaggcagaggcagucgaaucucugugaguucaaggccagcuuggucuccagagcaaguaugaguauaguuggggauacacagagaaacccuaucuugaaaauccaacaaaacaaaaccaaagaacucuaauaauggguuuacaucucuuguaaacuuucauauucuuuucuuccucuuuggugguuaccuaguuaugggguggauuaucuucucuuaaauagaaagguuugacacagaccaaucaaauauacaaggaaaaaauaaauaaaaucccccuccccucacacucaaagcauuauauguccagacuccagcacagcccuggucaccuuguggccuucauagaacccauuuuucacagucagcucuuaacuaaauauagcucucucauuaugaucuuaggccacugaaccuggcagucuggagucuucaccuuucucauuucuaugucacauagaacuauuaauuguuagcuacgucuuugaagauaaagagaaaaguaccuguuguuauauaucugcaaagagcaggcaaggcauaguagcuuaugcuuauaaacccagcacuccagaggccgaggcaggaggauugcaugaguuccagaccaaccagaaacauaaaaauuucuuuauaccccagaauaauuugagccuguaaccuuaauuuguuucuuuuucuauacaucucuaagcacuuucuagcuuuccccacaaauucuucuuuucuuucuuuauaacuaauuauaauaaacuuuuauagagggcucugugugcuaaguacuuugcuaaguacugugugcugaguauuuuacugcauugugccaugcaguuccaccacuaaacuaugacuaucuucauuauugaaccugacacucagagaaguugaaugacauacuuacagccacagacccaggcuugucccuuuaacuacuguggcaucuuccugagagucaggagguuuagaauuauagugccugaaagguggaagaaauccaauaccuuugggaucagagaagcguagcugauucuggaacauuccccauucuaaacagaacucuccucuuuggaugcugcagaggaugggugggucugggcacuucugggaacugcuuaucuggauccucugcugguggguaauagucucucaugaggaaauggucagugaguccaucccuguggccaggcagccccuuggggacacuggauggcucuuaagguccucuauuguuuuggauuggcuuggcugaggauagacagggcugguuuguuuuguuuuuuuguuuuuuuucagaucucagcaugguggagggguguucaggaguacaugauguagcuccagaagcaguaggaaacacuagacagagauggagauuagaagggguuaaaauagagguagaugugcauuuuggauccugaccaggaagggcaugggggcuagaaguuaagucuucaagcaaggcauggcagugcauguuuauuaucccagcaauacagaggucaaggcaagaggguagagaguuuaauggcagccugaguuucauagugaguuuugugcuguguaucaagacuucaucucaaaaagaagaggaaguuuggucuuuguccuaaaaaccguggcuuuauucaguacuugacuuccauguacacugugcaucucagauucugugaacuccuucucuuccucccccuucucuucuuccuccuccuccucuucuuccuccuucuccuuuuucuccuccuacuucucacuccccuccucuuuuuccucuucuucuuuucuucuucuacuuccucuuccuccucucuuuccccacccuccuccucucacacucuacuucuccucccaccaucucugguuuuguuuuguuuuguuuuguuuuguuuuguuuuguuuuaaagacagggucucacucuuggcuggcuuggaacucaagguucuccagcuaccgucuccuaagggcuaugauuacaggugugcaucccuuagccuccuagccccucuugcagacaguuuuuauuuucaucugucucuuuaaguaguaugaauuauuaguuaugagccagauuaaguguguuggacucccagaugccaggcacgagcugugugagcacacugccucaucuucacagcagcacccaccucacaggccugccugaagacuagccagcaucccauagguagugcuuuuacaagagccuccucauuucugcugcauaaaauguuacuuaucucuuaucacuguuaguguugccaacaagacaacucagaaacacagcugcuuuagaccagugaccucuacccccagaauccagccugggucuguuuucccacuucugcaagacucagcuucggucucaccucauggcaaacacacuguccccaugucucuccuugccaguguuaguuggaccccacaucuguacuugucgcuuuccuguuaccccaaagucuuuuguguauaccuauauacaagaaaagaaagaugucuaagaugagagaccagaaacuaucuuccuauccaugacaagagccauccaugcauuaagauauuauauuuacaucacacaugucaacagaaguuaucuuaaucauuguucuauugcugugaggaggcaccaugaccacagcaacucuuauaaaagaaaguuuuguauuuaauuggggcuugcuuauagcuucagagauuuaguccuuuaucauuguggcagggaguacguuggcacacugcgcuggaucaguagcugagagguacauccugauccacaggccaaugagggguggggcagagacagagguugagccuggcaggggcuuuugacaccucaaugcccacccccagugacacuuccccaacuaagucccaccuccuaauccuucuaauccuuucaaagguguccgcucccuaacugaacaucacaauacaugagacuaggggaaccucugacauucaaaccaccaccucaggcuuugcuguuguuuuuguuucuauuuuguucuguuuucccaaaguaaaaagaacacaggcagcgauuaauuacacuugaaguacuaaguacuaaguacuaagccugcucuccacucuagcugugggugaggaugucugugggcuugauggaaugccuacagauaugaacuggaaaaaucuauucaaggagcaauagcgguucacacuugggaguugaucagaaaugaagacucccuggcucauggcugaccucuuggcuuuauauuuuagcaagggucuuggaggauucguccuuacauuaaaauuuggucuacucugacucaagagaaacacugacagugaacuaauagcauaauuaaauggcacagugacauacggcauugucgcuuuugcagauucugauuguguuguuuuguugcuaggucaggaaucgguugccuuucccccuucugacucuccaagcgacuguuauauguaucccccaagucuaaaugagagcuaggaauccugcugaguacccacacuuuuggaaacaugaagguuugaggucaugcagccaauuggaacccaaacugcuuaugguagccgacgugauugcuagcaggugaaauaacuuuucaaucaaaccacaugacaaauuugcuaaaguuccugcuuaaucagauuaaacuaugugacaaugacaucauuuuacuguuaugcuaacuuaucuuacuccuuccugauaugaaagcucauguuuuguauuuucugguguggccucagagucacuaaccacccacuguauuugcaacuuguaaaugcuucuccuugccuacaaggcacaggcacacauuuugcccuccccccuaacacagaguccuguugcugcugggugaaugagcccagguuuucuuggcaggaaucacucuguguccugaucauuuggccccuaaaaguguuaaaaaaaaaagggugggaucaacagcugcuacuuuaugcuucuggcuugccaagacgguaagacauuucuagaaggcuaguaauuauagaugugaaaaaaaaaaaagaaguauuacgguaauucucuucgaaagaaguaugguucuguguaugcccaaggcauauggcugucaguaucugguauugagaaugcuuacagugugcuuuuaaaugcuacaaggagaaagagcugguugccaguuggugagggaagaaagagcuaagaaaguccugggugcccugcauggggauauauuuaaacauuugugggaagaaaagacucgacaucuguguccuccccugcuagccucuaaauagcccuugagguuguucccuuguagcuacuguccuuugcccuggcuuugaucagguaaaccagaucaucuuagggguuuguuguuuguugguugguuuuuauauacuaaaagguagacuguaagacaaacgauucuuggaauuuuuuucguagaccgucuauugccauucauagaugguaagugaacccuccacaagcccagaccuguuucacccagugcccguccacugacccuguuuguaaguuuaugcugguagcuuuguuccgcuuacagauuugucauuuuuuuuaacucuuuauauucuaccaguguaaugaaugauaagaaugauggaaacuacuaacaauuauuuucaugguuguuugcaaaucgaauaaauggccgucuguuuaugcuuuaagauuagugagugccagugguuucucaguggauucuugcuuggcucgcuuccuucauucacucaaugggagugggaagcaccaccagccuuucagaugcuguugggaggagguggaaaagagugcauugugauuccuuuaucgagauuaagguccagagggguaguaagaccaugcugaaaaagguccgaaguaauuuuauacacaccaaccaagccuacaaaaugcauaacuauagccagaugguggugauacacgccuuuaauuccagcacucaggagacaaaggcaggcagaucucugaguucaaggccaggcuuguguacagggcaggacagccagggguacacggagaaacaaacaaaggaaggaaggaaggaaggaaggaaggaaggaaggaagaaggaaaggaaagaaaaaauagacaacuacauaguuacaggucuuaauuacacuuagaaaagucuccaguguuagaaauaggggaaacacuguuauauggacagguaagaggguuauuacauuuuuauaauauaauauaauauaauauuucaaucgcaauugacaguacuuuucaguugaacaaauauuaaacagggugcuuagcuggaguccugaggauaaacaccccaccugcccaauccucccaguuuucaucuccaucugccccauccugcuucuuuaaauagacuucauucagggaagacacgguguagguggaugucuuccucugguggaucuggaggguuuuuugguuuuuuuguuuuuuuuuuuuuuuuugguuuguuuuguuuuuuguuuguuuuuuuuuacugcagaucuuuaagagaucugucaacauucagauauuuaaucuaaagaucuuuaaucugagcugaggauguggcucagagggagaacaagcuuugcauacacaaggcccuguguucuaucccuuguaggcaaaauaaaauauccuuggugucauauaugucucuuguucuuccuggcuucucucugucaccaucucuuuuuuguuaaaagaauuaguuucccacccugccucagucaacuaauuggcauuucuguuuccuuucacuaggaaaagauuuacaauguuucuagguaaaaugaaauaaauguauauagucuggauuguucucucucucucuuccccucccucccucccucucucucucccuccccccucccuuccucccuuccuccuuucuuccguucuuccuucuuucccugcauguauaucugugugagggugccagaccccuugaacuggaguuacagacagucaugagcugacacaugggugcugagaacuaaaccuggaucccccugagagaacaguuagugcuugcuaucucuccacuggccuccccucuuagaaguuggaguugugaaucaauuuagggcuacagaacucuggacaauguugggauucuaucauuuuauacuauguuauauuauaugauuuuuccucuggaccugugaauuuuauccuuuagcauucaucuuuagaagacuuacccucgacguagcaucuguucagggaaugcuuuugcaguguccacugagcaauaauaccugcaguuuggcucccauucaacagcuguuuacuguaaauaggauuucaggggcuugccaugauauaacacauggcucagccuucccuucccuucacaggcaggcagaaaggccauuuaauauagaaaauggccuuuuucauugcuacuuuuguuguccagauuccagcccaccaaugugauuguauagguugaagguuagugugaaauaaauaagacacucccuuucuuucuuucuuucuuucuuucuuucuuucuuucuuucuuucuuccuuccuuccuuccuuccuuccuuccuuccuuucuuuuuucuuuuuucuuuuuucuuuuuucuuuuuucuuuuuuuuuuuuuaguuuuucaagacaggguuucuuuguguaacagccuggcuauccugggacucacucuguagcaucaggcuggccuggaagucacaaagauucuccugccucugccagacacucuauggaagggaacuuaguaucaccaaucucauucgcauguauccaauccaacuucccucccuugccaugcaacaguuauucucagguuuuccuucacagacaguacacuacuaaaagcauucagaaggaccaguuugucaauaagcaagugucuucuaucacuuccaacaggucccuggcuguggcaaggagcgagagccuaggcagugaggagcauuugagcguuauucuuccauucuccccaacauuguaggugaugaaggaggcgccccauuauagaaaguuuaaaaggacuugcugcagucuaaguagaguucugacccuguggggaggacuaguuaugguuacuaacucagguccuacugauugcuuaucagagauaaacuuaccagugcuggguguggagaagugaagugcuugcugugggaacaugaggaucugaguuuggacuccuagcauccucauaaaaaagagcagccuggggaugcugagaccggaugaucccuggggcucgcuggcuggccagucuagccaaauugguggucagugagauaucucauuucaaagaacaggauagagagagcaauggaggaagacacuugaugucaaccuuugaccuccauguacgcauacaugugcacacaaauaugcauacacauaaauaauaaauacacuaauaaauaagcagguagcuuaguaaaugucagacagaacaaaagcaguuagcaaaguaugccuugcuagaaauauguugagacgucagcuguauagacuuuuggagguggggagagcgcuuaguuggguggugcaaagcauacaggauaccgugaauucugugagccuugcuaaugcaaccagguagagaaaccccaagguuauguugcuuggacccucuguaacaagagagacaugcuccuuucccaccuaaacuuuccuuuguccuuugaagucuccuuuacccuggugauccuuaggcccaagaggugauggucccacguacugaagacuaauuugugucuaaagcuccuaguuauacuuuacagucagauagaggucuuccgagcuggcuggauugcacagugguaguggcacuugcagagaauccuaguagccuaaguuugauaucugugugggacgagaaaacuuacuccugaacguuguccucugaccucuacaucaccacuguggugaguauacacacuaaguaaauaaauguaauuuugaaagaugaugaaggaagaggaggaggagaaggaggaggaagaggaggaggaggagguggagaaggagaaagagaagaagaaggaagaaggaagaaagaagaagcagaagaagcagaagaagcagaagaagcagaagaagcagaagaagcagaagaagaagaagcagaagaagaagaagaagaagaagaagaagaagaagaagaagaagaagaagaagaagaaagaagaaagaagaaagaagaaagaagaaagaagaaagaagaaagaagaaauaaagaaauaguccuugucaggacagaagccauguugggaaagcaaaacagccacugaacccuuagagugacugugagaaacagaaaggacccucaaaggacaggucagcagcacacugaccucccuccguuguuccugauguuucagccugugcuggucacgcagcaugcaaaggcaccuuccagaaagcccacugccuugcuuccucacccaguccccucacuguguaggagugacccucccccuccccucccccucccccaccguccccacccgcccccgccaccccccccccagugguaccuuucuuuacuugucccuuugacaaacucugugaagaaacaaaggcuggaacuauuucccuguccuauuuaguauacaauggaaauaaucguggcuugucuauguuaagucucaugcuucuuaauggagggccacagaaauaugcugaacuuagugaaaugguaugaaaauguaaaagucucuuacuccccccaccccccgucauugacacauuuaucaaaugcacugcgcuaagugcuagggccaaaaaugggaccuuucuguuccuuauggagcauccuauguaggaggagcuagagauguguucaguacucacccacauagcugugaagcugaagccggcacugugguuagggcugcgggaaagaggcauaugguaucagagaggcugagaaaaggcugcugaaaugagccugaaagaggguuggagugaaucaggcagagaaaacagcuccugcacagacaggccagugggagcccgggaaagcagcguaaacucuagaaacccccugaagccuggcauaagugcagaaucaagacauggcaucaggaagcuggcaggaacggcugcugcgugucaaguaccaaaagggccccuuaguagauguaauguaagccaaacaccgagguuggugaguagagagagcaggcaccucacucugcagccaagcuuccuguccgagggacccaccucagguacaacaguguauauagcguagucugggcaggccuuguagaauguacagagugcuguuuuuauaaaggccacgagaagcaagcaagugccuggguguguucuuaauuggugugagccccugccuggguaaagaccacaggaaaaccucaucuucucagagaagcgcccugugaguaaacaggccuucugcuccccauccaugugagucaggcuccucuggaaccacacaucugaaacagcugcuggguuagaagucagcgugagacuguuucugcuucggaaacacuucugggccuuaggaguucugcuagaugugacagaauuuaucaaaaguucuugcgcugcuccgaaccgucugcuuucuuuaacuguacugacagcccugcaguugguggccuugggcacgguugcugacuuccuuggcuccuagcccuagaacucaguaauugggugggauuuuccucucuugcgaguggauaugaaucuguagauguggccagcugcaucaugaggacaguacaucauugggguguauuucaccacagagccaccuucauucagaucucucucucucucucucucucucucucucucucucccucccucucucucccaucuuucccuucccccuccacaugcacacacugggggcaacugcucucucuaucccucagcggccccucagccucugccucuuucuacucagagagaaauaagaaauaaucuaggggaauuuccaugguggaggaacagagcaguuuggaaugaagggguuaaaucccugucugcauugaggugcuuacccacacagaauggguggacugugaagcccagcccuaccgugucuccucccccacaucucccccaugacuaugcuuucuugcuuuuuugaaccucaguuuugucucguacugcacagugggauuguuuucgcucaccguuuaagauggcuucagaaacucacgguggcauucugaauguuuuuacaaucaagaacaaccccaccucaggaaaagguuuauuauccaacagaaugggguaauuuauacaaauauguucaucucaaguugaaaacauauuucauauuuuuagucugcauaauuagguuuguguuccacaaagaacagaaucucaaauguccugccuagucuccaucuucuaucgucuucuucuaaguacuuucccuuucccuuuuccuccccauuucuuauuauucauggauaaccaguaaguaagcccacacccgcagggccccgugaaagaugagugucuuguuuacggaaaccacuauuccaaaaguguguuuuaucuugaugggugugacuaaccacccaaccauuggcaucucagaccauaacugcuucccagauucuugcccucauuggaaaaugcacuuagucuuguguuuggugugugugugugucuguguguuauuguguuacaaguguaaguggcuaccagaucaucucuguggugcucauuuggaugacuuucagaaggaagcugcucguacucugaauguggaagaaacuaauuucuccucccaguaacuuuguucuuccccccacccccacccccagcuugaagcuugaugcuuucuaauuauaguuuguggcuggccacauugcaagcuaaaaccaguucuauaggagcccuugcuucuuuucccuugagccugagcuacaggaacaggugaacagcaaauguggaauugcuugagucagcucuggauuuuccauuguucuucaucgagggcuuuauuuagacacucgguucagaucucugcuuuacuuguccaaaguaaaaaauagaagaaaaaauacuuuaugugacuuuuauuauacaccuuacaaauuauucuuuuaaugagaauuccagaacgacugugguacuuugcugcagacucacuagcucuuguuuggaguucaguuugucagagucuucuucagcuccagacuuccauccucagcugucucucuccccaccaugcaccaugcuuuugagacaaagccucucacugagaccugggcuugccaaacagacgaggcuagcuagucacugagucccagggauccgccuagcucuaccuccccugugcugggauuacaagagcacacuuucccacuggcuguucucggggugcugaggaccaagcuuauucccucaggcuuguguagcaagcaccuuccucccuggcccuccauucuaguucuuucuguuaauuuugaucuuugcuuuucuuuacagcccagaaacacuuggguggguccuagguuacaaggauggcugugugagaggauaucuuuauuauuuuuaagugucagguauuuuuaauuauccaaguagcauauggugauugaacaauauaaaaauaaaugcuaggcuugguggcccaugccuguaaacccagcacuuggaaggcugaggcagaaggauugccaugaauuuaaggacagaugggcugcagugggagaccuuuucacaaaaguacacauacaaaagaaggaaggaaugaaaaggagacucucucugucucucucugucucugucucucucucucucucucucgguguguguguguguguguguacuaggaaugacaauuuuuuaaucuguggaaggucccuggccucugacacaaggcugucuaagauuuguucagaaggauauacuuuuugcacugucugauucugccuuucucagauuaagucuuggagcauggcgcaugugcucuuaaucccaccucuuggaaaguaaaggcaggagggucaagagcuuaagucaucggugagauccagcuagccugugcuacaugagccuccgucuccgacaacaaacaaaaaucaaagcugggauuguaucaggagacaagguaugacccagaugaaaauacacaguaaaauaauaaugacacagagaggcuuggaaccaggagggaguaagggcaagcaggcagaauaaccugugaucuggguguugagagccuggaggaggucagaugguccaaacuggcacacagagugcagacagacagcaggaagccaagguugagguaaagauggaaaagccucaagguggcguaugaacucaaaccccaguaaugcaaucugagagauacgaagagagcgcuaagccucggcugcgagcugagaagcaguugaucuuauacgucuauauuuucuucuuuauguaguuaucuuauuguuauuagaaaauaacaugccaauuauaagccagaucagguggugcagaccuguaaucccagcugccagggaagcugagguaggaagacagaguucaaggguagcuugggcaaguugcugaggugcugagacacacaccccuaacccagaaaaauaaaaccaacaaaacaaaacaaaacaaacaagauaaaccaaaaccaccaguuugaggacacagcuucaugauagaaccuuuaccuacgcaugcacaaagcccugggcucagucccacuagcacacucaaccacaaagccaugaagcacaugucaacugggcacgguggcccacaucuguguuccaggacuugggagguagaagcaggagaaucaggagauaagguuguccuuaucugugcauuaagucugagacuauggugggauacaugagacccuaccacaggagggagggagggagggagggagggagggagggagagagagagagagagagagagagagagaaagaagaaagggagguagaaaggaaauguaaaugauagacauuucugcuuuaagguuaugucacaagcauaauaugcuaaauauaauagagggaauguauuauuauuuuuucacccacucaauauauugucaauaucuucucuuuuguuuuuuuguuuuuuguuucuugagacaggguuucucuguguagcccuggcuguccugaaacucacuuuguagaccaggcuggccucaaacucagaaauccaccugccucugccucccaagugcugggauuaaaggugugugccaccaccgcccagcuauuaucaauaucuugugcuacuaaauuauaagucacaucuaguagugccugucuguauacuuaagcuuuuuaaucauauauacauauaugcacauauauuacuauaguaccugggauauauauauauaucccaguccaguaaagcauuguucacauagguuauuccuaacaguguuucacacacacaccaccaguguggauauaucucagucuuggcaagauuguuuauuaccuuugucuucucaagcuugcagggucucaguguugucuaggauuuugagugaaauaggcaacugugauuguccuggcggggauggcacuggugggaauggauguucugaagacaaaaggaggaaggcacacaguucauuagcuacacugugguacaucaacagagggcaaggcaguagagagagcccaucugcacacagccacucugagaggggcugcuuucaugcuggaaggggagugaauuuccaugccggcaggcaggcaggcaggcaguggcucucaaugucacaguguccuggaguaauugcaguuggagcuugucaugguuagaggcuguaauggucuugcccugagucagaaguagcucagcaugaugauuauccuaagcuggcaccuguauuuucuagcuggggcuuguguuuccccuuuucugagaagauaagaguccuuagacuccugagacuggcucagaacagcaguuggucccagaacagcauuccuaaguguuagaggcuguaguguguuuaaacuacaguacacuacucuuuccauugucuaauucucugcaugcucacgcucccccagcccuuuucugcuuuaaagacaggcucucacuaugcaguccuggcuggcuuggaacucaggcuguagaccaggcuguccacagagacacacuguugcucacagagauacacuugucuccacuucccgaaugccgagacuaaagaucugcacccacacauccagagauucuuugcuuuuguuaaguggagagcuuuagcuucuucuaagcaguuuuacauucauuccaaccaccuggcagcaaggauaagagacuuucacucccuacucaaauagcugauguuucaguaggaucagagcuaaaauguaaaggaauuuucauuuggaaaagguggugcacauauguaacuauaguaccugggaggcugaggcuggaggaugguggguuucaaggccaaccuggguguuuuaguugcuuuucuauagugaugauaaaacaccacgauaaaggcaacuguugugcucuuuuagcuaguuauuggguuuuuaugucuaccacucuuccaacccuuguuccacccugacuccuuccgacuucaaacacuagguaggagagaaagaaaguuagaggggaaagggggcauagaccucaacaggcuacuucuugcugacuaggagaauuggguuccuuguggcaaguccgaucugucaucagacuauaucuagcaguacaacaaaccaguaauagcaaaugcaacagcagaugcagcagcagcaacagcaggaugaacaggugggagcagagggggcagcggggaggaacagcagggaggagcagcagccaugagcagcagccacaccaggcccucuuggagcucucccauuuauaccuucuccagaguccccagaauuagacuaucuacaacuggcaaagaucacaccccugcuagugcacaaggcaaaucauaaucaccugcugggaagcagccucucaucccacacccggcauuaaacacaaacauauucauauagcugaauguuuaaagaaaccaaaauucucacuuaaggaagucuauaaaugaaacuuuaaaaugggcuugccauuucagaagguuaggaguccauggcagcaaagcaaaagggcacggcagcaggaacagcugcgagcccauauuugguuuggcaagcagaaagcgggugcccuaagaauggcuggaguccuuugaaaucucagagcccaccgccuacugacacaccuccuccaacaaggccauaccuccaaauccuucccaaauuaguucugacaagcaggaaccaaguauucaaacauaccaaccugugggagucauucucauucaaaccgcaauauugggcuauguagugagaaucugucuccauaaaaaggaggggaagccagacagugguggcgcacgccuuuagucccaacacuugggaggcagaggcaggcggauuucugaguuugaggccagccuggucuacaaagugaguuccaggacagccagggauacauagagaaacccugucucgaaacgccacccccccccccccaaaaaaaggaggggaagacuacagugcuggguccuugucauguacaaaacauuugugguaaauuucuucuuccuaguguuuccugcauuauccaaagucagugacaguuguccuccgaugaagaccuuugucucauggcccagugaauuuagaggcuauauauuuggauuucugaguugacaaccuauguugaagaugguuggggccgcuggaaaguucaaucaaggggcuguuguguguaugugucagaaagcauaaaccaauguuucuguggggcauaaggauuagaucacuuacugcgaucagcagcuugcuuugggcuuucaugucaaggaagcgauggcggguagggaugacugggcuccauggaagcgaugguggguagggaugagugggcuccauggagagccucuguucagccucagggagaagguauuccagcugcuggguuacaaaauggaaggugggcucagagugauugaauucucuuguuccaauagaagcaggaguuaccccauguuuuguuuugugguuuuucuauaggauucaaagaaauacuccaauaagcacuguguaguccaaacagaaauaugacuguagacaggaucuuguucauaaaggccauuguaugaucccccuacccuauacauauccaucguggauagaugaauuaauucauucauuauuucuacuaaacaugaaacacuuagugcuaaaaauaaauaaaaaaaagaacaaagcaacuggugugcaguagugcuuaggauguaugaaaguuaaacacaaugcaacuauaagaacaugggcuagccgggcaugguggcacaagccuuuaaucccagcacucgggaggcagaggcaggcggauuucugaguucgaggccagccuggucuacaaagugaguuccaggacagccaaggcuacacagagaaacccugucucgaaaaaacaaacaaacaaacaaacaaacaaacaaaacaaaaacaaaaaaaagaacaugggcucuucaaauuguggggcucucguaagauauccuggcaagucgggugggcgccagacugcugugguggucuuaguuccacuguuuccucuguuguuguuauugauuaccccuucuucccuccucuuccucuuuucacauuuuucauauuuuucacauuuuguuuuguuguaggggguuguuguuaagauagagucuugcuauguggcuaaagcuagcuuugaacucaugauccuccugccucagccucccaagugcuaggaguguguggcccgccaugcccaguuguaagugucaccguuucuaacuacuaaggcuguuucucuauuuagaaucaaccaguucuucuaccucauagguugugggcuuuaaaguuccgguguugaugaaguacuucguggguucucagugguuuucaccccuccucuucccuucucugcccaugcuccaccugccguugagccagucauucuccgcuuucccaccccagguuucugagccccuucaacaugauccucggaggagucauuguggugcugguguucaugggguucgugugggcagcgcacaauaaagacauccuccgccggaugaagaagcaguacccaacggccuucgugaugguggucaugcuagccagcuacuuccucauauccauguucgggggugucauggucuuuguguucggcaucacucuuccuuugcuguguaaguaagccugcuuuccuugucucccuucauuaaaauaaauguagaugaaguuggccagugagcacugcauagccccucgguauaucuaacagugucagcaucuucuaagacagcacaugaaagccuggcaguugcuuauuuccauagauaugugugggcacuugcagugugccauguggcucuucuuacacagagauaccacucaacaaaacaaaugcaaaucccagucacguggcaagaacugguacaaccugcaugguaucuucauggcagcucacagccauccacaacucuaguugcaggggaucugauaccuucuucuuaucucugcaggcagcaggcauucgugagguaugcaugcauguuuacauacacacauacauacauacauacauacagguaaaacucucauacucauagaaagguaaguguaaaugaaaaaaaaauagguggaccacgauauaaacacuaaauacuaugauucugguaaacuagauauuuucuaaacaccuuauuuucuaagaccucaaacaguaugaaguaaaacaaagaucuaauuccaggucucagcagcagagaucuggcugaaauguuaguguccuuucugacgagagaaugucccuuuacauuugaaaauguuucgucuaggcauguguuaaaaaguaaauaaaaucauuugcuuaucugagaucuugucagauugagcccaaaauauuuacaaaugaaucccacacuuuauuauguacagucuaucaaccaguaaguucaagcuuugggaaaguuucccgagauuuuccuugcuguacuaugaguuagugccggaaugaucccauuuaaauauacugccuguuaacuacagucccuucucugccugagagccugagccaggccagaggaaugaaagacaccgcagagucgauuuguuucucuugccagauuuacagaaaccagagcaucaucggucgcccuaaguaggcuguguucacccaucucugagacaaggaaacuaagaucaguuacucccaaacucugauacacgaggaacaucuguucaagaaccguuugaaaacauguaucucuaagccauauccugauucugugggucaacagugguaccccaagugccugacgcuuagaaaauggcccguaucuuuaaaggucagcguaggcuacggacgucuagucuuucucuggauuguacauaguguaggauggaaauuugcuuauaguaggcucuuuuguuuauguauguauuauguaguacauguacgugugcauaugcauacaugcgauucccaugugcguaagggugagcaugcaggcccagaguuuacaucaguuguccuccaccaguguucuccacuuuauugauuuaggcaguagucacuuggcuacucugucuggcuuguccugaggaucuccugugucuuccuuauaagugcugggguugcaggcuggcugccaugccuaccuggcuuuuagguugauccuggagacuccagcacucacacauuaugcacugagucauuuucuugcccuuuauuuuuaauuuuucaaaauugcaucuauuuaucaucuacccaccuauccauccaucuauccauccguccuucauccagccagacauaaucuugcccaagaaacuguggagguaagaggacaacuccuucuagcaugugauuccugggaaucgaacucaggucaacaggcuuggaggcagcacuuuacccacagagccaucucaucaacuccccagcccuauuuaaauaggcucuuugggugcuguguauguacauggaacaaauaacuguuauagaucacauagagugucuuaaaauacagauucucuaucccauucccuuaagguuccgagacaagagguccacaaagaaggaccagggaaccuauuucauaguaaacaaggccaggucauucccagugacgccuuuagaaaacauguuucuuuggaggcaccuuaaaggugggguuuuccuagauucuggcauuuaaggaacaaaguacagauaaaccaagaaugcaaaaaaaaaaaaaaaaaaaaaaaaguccguccugggaaaccguggguaaguggauucauagucagacuggagucacaucagugagcaauuguguugaaugucguguuguuuaaggaacauuugcaagguagagauuucagugggugggauaaaagaauguggcugccagaucaacggucuuccaaaugagcacuguguuuucuuccacacacacaacagucaguguguggcuugggaagcagcuuuauauaaaggcuauguaaccaucugaggauaagcgaagcaagcagaccugacagcuaaaagacacaguuuacuguaugugugggggguugaaguggggauuauugggcuggugagauggcucagugcuuaagagcacagaggacccaagguugguucuccacauccauguuagguggcucagcaccaccuagaacgccaccuccaggagccaccuccagggggaccugaugccauuggccgcugcaggcaucagcgcucacgugcauaaacccacagacauagacauacccacccacgauucaaaaacaguagaaauuguauuuauuugacauuauuugaugcugucacuucuuucagugauguucauccacgcaucccugagacuucgcaaccucaagaacaagcuggaaaauaaaauggagggaaucggccugaagaaaacuccgaugggcauuauccuggaugccuuggaacagcaggaagauaacaucaacaaauuugcugacuacaucagcaaagcgagggaguaagcacagcccgcccagugacggggccccgcagcaggaauccgguugcacuuucccccuuguucagacccauuuucagucugugguuuuuaaacagaaggugcacgucuuaccacccaccucuccaaggcaucaugcaugcacaggcccacugcuaagaucuccgauaugacccauagaaggccucagaaacugcaaaaauacagacccacucucccguugugucugaaguguccggugugcuuuugaaaaagaguguggauuagacggccacagugccaucuuaucguagggaagaagucccuguagagccuggaggcaauguggaggacaugaagaucaguuaaagucgaggauguugugugucagccuguuucuaaugcugucugacauccccuccaaaauccccuaagacucugaugugucggguauguuaguuuagcgguauuauuuuuguuguuuuaaaaccagaggcuaucacuugggcaccuguuugaugugcaguggaaacugggucagccaguuguuuauauuuuguuuacgaauaugaagguagcuguuuaggacaauguuuuguuaaauuuuguaaaauuuuuaaaaggguuaguaauaugcuuucaccagcagguguuucuugcaaacuaaaugucaaccuccugggguaggggugggggguggggggaugguuacaacucuguaacuucuguuauucuuguuaagaauaaauacaauagaaccaaacuugaguucugucuauauggcacauuuuucguuacuacaacaauaaaaggguguccaagauaaugaua

SEQ ID NO: 3255 - RNA, 530 nt, Mus musculus
agaaaguuucaagauggaaucuggagugaagaaggaagacguagcguggugccucuguagacauucuaagagcuuccaauuucccuucagauauuuuuaauaugaaauauauuuuacugacagugccaaauucuuucaucaggaaaccuuucucaggaggguuuuuuuuuuuuaaaguguuuaaaugucaaaugugaauuggugaugggugauggagagauccaagagcagugauugucagauguaugaauggauggccuuggugagauucgucaagugcgcgguucccaugcauguuggguaaugcaaaucuuuggaaacacugaugaugcuauccagucuuguagcuuuauuacuuaaggggguagggaaaauaaguucccauucuuucaacucccuuaagugugugacucuuuuccuagaauagaaaugcaaaugugcaugaaaagauaauuguaccauaguguucaccgauacaaucauagcauugucuguuuuucucuucauauuuauguggggggggggugcgg

SEQ ID NO: 3256 - RNA, 2648 nt, Mus musculus
auaaauugggucucuccagcagccauagaggauaugaguguguguuuaaguucagagagauuuauugugguaaguuuacuaacaaggugagggaggcugagaaaacccaugcucucuugcuugagacucaagcaaccuggaccuguacuucaauguaagucucugcauuccagaacugaggaagcuaaugauauugacaccaacucuguagguaagagaugaguugagaugguccagcucaaacaguaaaguggggagaaagugaagaauuccucuuuccuuggugauuuguguguguguguguguguguguguguguguauguccaucugucucugccucucaguauuagaacaguguguaccaucggggcaggcuuuguuugguugguuugguuugguuuuuaaauaguuuaacaugguugaacucagguucugggagcaaucacauuuguaaacaagcccuccuugcaucccucacuggcuguuuuguguucuucaucugaucugaugagguccagcacacaggaggcaccgugcaucacagaguucgucagcuuauuuacacuaguguccucuaccaguguccacuagaaaaaauguucucaaacaucucuagaaacaguguuuaacuugagugcagcaugauacaucaagucaacaugaaauuaagcaucauacugucccacuuaaaauuuggcaagugcuuccucugaggucaggugcuaagucuuggccuuaguuucaaggaccacuaggaaaucucuuacaacaauuuggaguuagggccacucaggccaugaagacuuuugcuuaugacuauugcucuaaauauccuccugugaauccuuccucuccacacucaggcuuuccagaguucucuuaucuuacuugaucuagacagccuuucuccaucuacauagcaacugauaccucuuaucugggaacaacuauaugaugcuggccccaaacaugauuuucaaccuguuuuucauauguauucaugaacucuuugaugaguauaugccuaauuuuaaauguucuuuaaucuuggauuucaugaugucacccaacacaguaaaaguagauucuugcguucaugaguucucacauaaugcuugacugauaaaauguucaauaagugaaugaauaaauguucuaaccuaaguaucacaaacuuaugaagucucucuaguaagaggccuucaaacacuauugagcuuaggcauauaaugaaguuacaugucaguggacuguauuuauguucuucagucaagaugacaugcaguuuacuguaucaggaggggaaaaacccugugacaagacuuuguuucagcacauuacgauaaucccagcuaaucaagguacaucaucaauuucaaagucguucccacaagcuaaaagcuccaaauggaaaaaucuccuccauuacuaaacgaaaaagcacaaaucacaaccucgcucaguauucuugucacucagcagucauuuuggagggagaaaaauaaagaacccauucaagucgagacuuucuauguuuuccccaccuccuguaugcugcaacugcuuugugagaaauuacgugggggaggggggaagcaaaaaaagcaguuugcaaauagcuuucaaauccagagugcucuccugaggauaggauccuaauaggauagagaugaggcuaaguugcuggaugcugcugcccauuacucuuuuguucccacuccaggaaaacaugcacagaucuccuaaggaggcuucugggcacguguuuuugcuuacugccuaaugugguucuaauaacacaaacauuccagcgaagcaaugacgacacagcgagagcuacagauauuagaggcccacgcaauggaagcguuugggggaaagaacagcgaaugcgucucugacauuuucuuguuacugucuugguaugacuccuccuggccugcauuaacagaagaagaaacacagaccgagcaaaagugaacgagagggauuugaggacagcauuccucggaauaccccaaaguauccuugcuucggaggcgguucugccuuucuaaaugcauguguguggaucaauuacagguuuuuuggaguucuuuuuucacuguuugauucauugugcauucucagacauggaccaaguaugugcuccuuggguaagaaaaagaacccuaaacuuauuacgguacaucuuacacuuuaaauuaaauuuaaauucagaagaauuauuacugaaggagguuguguguuggcucauccagacaucaauucuaaugucaauggagugucuuagacucugaguauuaggugaagauggaccauauuuaaaccuugagccaacagcuuccauguucccuggaucaccuacaggcauauggcuuaggugggagaguccaggcuuggaguguucucauggugcuuagcacacgcuucuugccauagccucuuuauuugaaacaugggaaggugcuggcccuaaaaggccuuacuucaccaucuauauaacauuuuugcccauaguuggaguuucccuugaggugaucauccauauggaagagaguucaguguagagcaucccacaaugggaugacaucuacaucaaacuugacagcauggcagaguagaguccaaacuucuaguugcuuca

SEQ ID NO: 3257 - RNA, 682 nt, Mus musculus
cgccgagcgaugggcaucucucaggacaacuggcauaagcgccgcaagacccggguuaagcaaaaacccuaccacaagaagcgaaaguaugagcugggacggcccgcugccaacacgaagauuggcccucgccgcauacucacagucugaguucgaggaggcaauaagaaguaccgugcccugagauuggauguggggaacuuuuccuggggcucugaguguuguacucgcaaaacaaggaucauugauguugucuacaaugcauccaacaacgagcuuguccgcaccaagacccuggugcuuauugacagcacgccauaccgacagugguacaagucccacuaugcacugccccugggccgcaagaagggggccaagcugacuucugaggcggaagagcuuuuaaacaaaaaaugaucaaagaaaauucaaaagaaaucugacgaaaggaaaaagaaugccaaaaucagcagccuccuggaagagcaguuccagcagggcgagcuucucgccuguauugccucacgaccaggccaguguggcagagcagacggcuaugugcucgaaggcaaggagcuggaguucuaucugcggaagaucaaagcccggaaaggcaaaugagccucaugcauaguguaauaaaggugucugcuguucuauuaaaaaaaaaaaaaaaaagaau

SEQ ID NO: 3258 - RNA, 838 nt, Mus musculus
uucugaaauucuuuuuuuuuggauuuaaaugcacuuuauuuuuagacaacccacaugacauguuuuuuuuccuuaaaaaaacaaugccaccacuccaaauaaaucacggucaaaauaaaagcucaagaugacaucagucccauuuguccuaaguccugguguuguauggaugguaagcagcagccaauuauggugacaggugauagauccaauuuguuaacauuucuccaucucuaagccauccuuaaagaaaaucaugaauggagucacaccaucuucacgguaguccaggagagcaaccauaccaucuggauucauguuuucaccaauaaaaaacugguaguuauugaaauuagcaaggaugugcuuaaucugcucugcagcuccagucauaaaaggcuuuacucuuucugguuucugcucuucaaguuugccuuugagugauuucauguagucuuugauguacuuuuuguaagccucuuuugugaagcugguuucuuguaagugaugguucaugacaaugucaacaccggugacuacugugcuuucgguaccuucgcccuccggaccuucagcggaagcauuuccaccgaugagcgagucaucgauggcacccucuguucuacugaccaucuugcccuccaccuccaggcacagcccguccgcgaucucccggaucuuguagaugucggagaacagcucgucauggcugaugaggucccgguagaugaucauggugauggcuggggacggcggcgcuagccugacagcgcggaagcgagcucggugcagccggagcggcacgcggggggaggggggagugggcggaaaagcguga

SEQ ID NO: 3259 - RNA, 4936 nt, Mus musculus
aaggggaugaaguccuucugcaugaagacacaacaguuaguccucguggagccaagaucccaagccaggacuacagaaauuaagucugcuaacucuugaccuauacucaagccacaaagcagcgcuugccagagggugaagagcuaagaaggaaccugccccccagucaagagacucuugucauuauuucuucuaugacagaacagccccagugaaugaagagcuaagaggaaacagggcuggucacagaagccagcugccugucccugacucauacugggaccucccugacccucaggcucuucuucaucacugaacuagggucacggagagaggacugauguuuguauucuaugaccugauuuccuaugacugccagaaucaggaccuggacucaaucuaugagucuaggucuucccggcauacaggcaugauaccagcaauuuacaauuacauuucuagaaguuuccagaugugucuagaaaacagcgagauggggucuggauacuuuugccaugcaaucccguuuuccuggcuuaccaaucagggcccagaguucuaacucucaccaccaccuccuucuagagaugaauaaggagucuagcucuaacugcuucagagaggucaagugauugcccugggucacagagcugggaggcagccaagcccagaucaaacucuuggcaaucccucucccuuucacaagccucagaugacagacaaggaacaaaagguucugugauuuuaaguaccacaaggucaagagugugaguaccauagauuggauugaguuccuccacgagguucaugcccaggucuuagcucccaguaccccagcacaagaccuuaucagaacaagcaucuuuggagaggggaucaaaucaauauaagguccguaggcuggacacauauucaguaugacacuggcuguccuuauaaaaaggguacagagagggaaagagaagugaacacagacgaacacccccacccuuugucccagccaaggucccacugaaaucaucagacccucucacaaccucaagagaccaguuguucagcugaaacauuacuuccagccucuaaacugagaggcagcauagggccaaagaggcgacagugagguauaguaguuccgucuagaagccugaugauagaaacacagguagccaggugugaugacacacgccuugaaucuaaucccagaacucuggaagcagaggcagguggagcucugugaguuugaggccagccuggucuacauaguaaguucaggauagccagaacuacauaaugagaaccuguuucaaacaaaacaaacaaacaacaacaacaaaaacacagauggcaagggagacucuaauccuucuugguuauguuccccuccccccacucccccccccccccggcauucuggugcauucugggaaggcuucuuggagaaaggccauccugggguuagaaagcaccagcugaaagauggugguggggggugugcaccacagaaaggcauaguugaggcuaggggacccgcucacaggugacuggacccgcucacaggggccaaggccuggccugaagcuggggcugaacagaagcagagaagacuugaggguggccucuucauguagcaccaggccuuuggaugucauccugggggcaguggggagucugcugcuuucugcucugagcccugucaccucagcaggagaucucuaagaacauuucacacaguggccaggcccuccucuucaggagcuggaagagcggaaaugguggguuugugcucagcaggagagcaacugucuuuuuacaaagcccccuccggccugugaaugaagggccucggcugugacucccacccggccgcccuuagaaagugccuuggcugccaggcgccaagaauguuucaaauaaagacaggcccacagggcugcaagcuggggccaggaggcagcacgguggcuccucccaugugccucauuccuaauagcagccuguguccccugccucuggcccagcugggaggcucagguguggcuucccuuccgucccugguuuauauagcaagguguuuucccucguggcucgugaggccagaagcuagaaagaaagaguuauggcuggcaggggagaugggggacaagacugcacaaccaagagccuuuccacuacuaccucugccaucuccucagaagaaagccagucucucaaagucugguuguguugagguaaagucacacuccauagagcccaagcuuugaacucguugugcccuucacccuugagugcuggaacucauaccacagacagagccaccauuccugccugaagccuuugcuacuuuccuucugcauucaaagucuguagccacaccacacuuguuugaagagucacuguccagucccgcacacaaagccaccccaaccauagcgcuccucucgagcaucuccccugguagucagucagcuacacaaaccagucccaagccaacaaggacucuucacacaccaggagaccugugggggaggagcugagggggaaacccuccuccucuccacuccacugucucucccuucccacuccgcucuccugcgccaaggccuguccggcucuuccuugggagcuuaaaccacgagacucugcaaguggaggcuguggugggcagagcccaaacaggaagccuggaagccuagguggccggcaagacaggaagaggcuuggcuugugagagucuacagugcgccauguggggauggacgggacagaagcaggugugacugacagaccacugcucagaagagaagagguccaugguacaagauggagguuugggaaccagaaaaggaagguggagggugugugcauuuguguguuucagggagugggucucucucucucucucuguguguguuugugugugugugugcgcgcgaguguggauucagacagcugauucagaaaagaacgauccaggaagccucugguugcugggugagguaugcccuugcggauagccagguaguuaggguuccugcgggagucugagacagccuaccucagauacugggaaaucuagaugaggcugggccucuagaggacaggggcagauuccagaaaugagccaggccugaagauaagcagggcuccccuaggagaagacugcuccacaguaucccugaggagacggggccccaggcccugaucucacacaccuggcucagaacagagccccugggcgacuuaaaagaugggugguguccucugaggcagcucuccugaggaagagcucuccugaagaggcuggaguucaucccaccuuggacgugugcagacuagacagcucgagacccuguaucuccaggucagccggcuggcaguccuguggaauagccuggcccuuacagaccuggauuuaggccagcacacugauaagaggaggaagauaggaaggaaccccaaugauaggaagccagggacagagggagagacaggcugcaggagggagagaggugagggcccauaggcccacggugggggaagaggggggagaagaggaagagcggagcggccuguggugacugggaagggaccgggagggggaggggcggggcaggaaggacugagaaguaggugagaggucagggacagagggaaguagguagggggcaggugagggaaggaaucugcuaaggaccuuggccugugcacagaguagggccuguggucuaaggcagagguucccaccaggcugccgcugacagcccguggguggcccugcagccugaaguacagagauugguucugucguggggugugugacgggaggggggaugggggagugggggggggagggggaagaagaagauaaacacccaaagccccaucauucacucacuucugacagggcugcacccuucuuucuggaaugccauuuccaggggacacagaccugccacugaacugcacuaggccagauguggaccuuggagaagcaguuguugugaggagaguucaggcaaacagaagugaggcuccaguuucacaucccaccacagaggggaaggaaggaggagagggguccccucucccagcagaggggggcagcggugggaggcuggggggugugguaucucccaccucuggcuauuuggaauuucaucucuaagggaaaaagaaauauugagugugaagucagagcagagccuccccagacagccaugaagggagagaggggaccaggcagaaagcaagccaccgugaggcagcccgugcacgggcuccguacuggggcaagaggcaccugggcaugcugaacuauacaccacucuaggaccacgagccagucaguucugggcuggccaucaccacuucaacucccagagcuguggagagagagaggaggugcugacuccgagaagaugaaaggagagugucugaggcaguguguggccugggagaucaaacaaggaagguuaaaggaagggccuuuuggacagagccgccagugaacccagguguuauaaauucaccucaggucagcugucauggauucugggagcuccugccauaggcucugcuggugggcucuucaccucagccgccccuuccacccaugccccgcugggcauggggcugguagcugucggcuuauucagguugaagaggaagcauggagcuacaggucuggacuuaaugcgcccuggguuccuccuacacaggaagaagacacagugaggcucucugcccuaguccuggagaaggaaggcagcccccaccucagagaguuggacagcuguuccccagggcuuagcaguucuggcucgcacuugcccuucugacuggauguuagccagggucuggagaacuagaacuagaacucaggaguaccggccuuaagcacaggaagggagugagcggggcuccucccagccuuccc

SEQ ID NO: 3260 - RNA, 99362 nt, Mus musculus
cacucacuuccgccuccguccggaagcgcugugguacggcgugggucugucgcgcgggggaacugaucgugugccuagcggggcuguguuggcuucaggcgcgcgcagcgaugcuuacuccugcguucgagcugacccaggacugcgacuuccucaccgucgccauccgcgugccccacgcgcgcgccucugaguucgacguguacuucgaggggguggacuucaaguucuacgccaagccguacuuucugaggcgaguucccgccgccugcgugccgcuuucauucgggagcccacgcucgcgauuuacuccgcgcucgcggacacaaacacucucgcgggucucuucgcugccgccucggcggcgacuucuuccaggcucgcagucugccugccgcacaaucaccuccuguggcauccguggaucccgccaccgagcacggggccacccgcgcggugucaguccggucacccucguucucgaucuuuccugacuugugcuuuucuuucacugcacgcccgagccucccccuauccguggugaccucacggcgugggccgguccuuugacucccgcccgcaugucaucugcuuccuguaguucccaggucuccuguuagcaucagauuagccaauucuuuuaugccuggcugcccggagaugcgagcaguacuuagcauuuaccauucauucauaucagguuuuucuccauguugaaccaaaauaguaguggcagcucacacucgccaccuucagugugguaggcaggcagcuucuuagaugcgcacaugucguuuuaagucauuuuaauucugauagccggacuuugaguuaagcagaacuaguacccccuuguaccguggacggugugagagucuuucuaaacuugcucaucaguugcccucugcuuucaacggagucaagcuacagucaagggguuucuucacugcucgagugggagccacauuagaucuuuauuagcauaccaacuugaaaauacaguaggucacucccuaccuaugagagauacuuccaggacuccucaauggauaucugaaaucauggcuaguaaugaauccuguauauacuauuuucucuuuaccuauaaaccuaagaugaaguuuaacuuauagauuaaguuuaaagugaaguagaacagacauaaauacguuugcaauuguuuuuugugaguuguucucccccccccccccauuuuauugguaguuaaaguauucgaauggaaagaugggccauuugauuuuuuauuuucuuaguugaagagugaaucuagauuauuuagcuugcaaaaugugaagcacugaaaguugccuuucgaaugguggauagauuuugauggcuaaaacuaugcuacgauugaugauggccuuucuuguguuaaaucugcagauuaacucugccuggaaggauuguggaaaauggaucugagcaggggaccuaugaugcagauaaagguaugguuugggguuuuagauagauugguguguguguguguguguguguguguguguguauguauguaugugcacgcgcaugccaccuguguugcuaacguuccuucccuagaaggggcauucuccuaaggucccauugaaaaacuaaaugugauuccaucaaaguucacugggagaaccauugaguuuauuaaguuauagaguaguggguaagggguuuagggcaggaaucuugguaaucuugaaguagccacaguagacgaucugcauggcuuccucagggcugcauagauugaacucccucccuucagccuagauucuagcucuucccccacgaccacaugcaguuggggcagaauuggaucauacaauucugguugggggugaugguggcugcccucucauucugugagggaccguaaauagucagcaggcucgucugugaugaccauuugugagcugaagaugguggcaguuuggcuccaaugaugguacuguacaacugcaucuguagguauagauguggugaggggagguguauauguguagguucauaugugugcacacgugcaauuggaagccaaaggaccaccucugaugucauccugaggaauguguuagagauaagguuucuugcuuguugcuuaucaguuaggcuagacuggcugggcaggaagcccugggaauauucugucucugucuccccagcuggaggauuacacacaugcaccacugcaucuuauguuuucauuuggguucuagaaaugaaacucggguccuccugcuuguauggcaagugcuuuacugacugagccauaggcccagucuuggcugggauuuaguggauuccuuauacucaaaugguaguagucucuaaagauaccauggggggcuuucagagaugucuagcaauugcuguaugcuguauaacuuuuuuuaaucuuuagugccuauuaucuauggauuuuugacagguagcaguuuucucagucuuuuaaaguauuuugcaauaaucuuuaaauuugacucaaaaguccuaguuuaauuuucugggguuguuucuauauuuagcacauguuuaagguaaacaucaacucgaaaugauuggcuuuauaauggauggaugguuuauaagcuuuugaaugaaaacuuucuuaaacaguuuucaaauuuagauuuuuaauaacagguagaugagaaauuaugcauggaaaaauauaagaguaauuggauuuucuauucaugauugacaagcccccaucuuaagccagccacaaaccccaggaauuuuacacuuacugcagcuccugucuuuucuuuuggacugaguuuggaauaaggguagcugugggggccggcaaauuagcucaauggguaaaggcguuugucuagcaaaccugguaaccugaauuuaguucccagaacccauguaaaggcaaaggagaaaacugacugggcagagcugugcucagacugccacacaugaauuauagcacagccugucacguccccccuaccccaugcaugcagaguaguauuuuuuuuuuuaauuuaaaaaaaguagcucguguauauucuuauguaauuuauucagugacuauugagagcugggguaaggggcuggggagaaugagacuaaagaaaagugauuaaauucccacucguaaugaugugauaaugaagucuaagggagccgcuauccuagcuguggauaagacaguggcauuauuaaacuuuauggcugcagagauagcccggcuguucagagcauauacugcuuuuacagaggaucagaguuuuugguuuucaguacacagaggcuuacaguugcucuaaguccugcuccagggacucugacacccucuuguggcuuccgcaggcccuuguacucaugcacacauaauuuauaaaauaaaccccagaaagcaaaacaaaacuguaaaguacuuggaguugagguguugacuaucugggaugucgggacgggucguauuugauauauuguauugcgugucagugugauggaagagggaaauuuuuaacacaguggacuggaagugggcauacacacuuguaauccuggugcucgggaccccaagauaggagcauacauaguuucauguggguuugggcuagccagggcuccauugcaaagcugucucaaaaaaaaguaaaaaugucucuagaguuagugaagaaauuauuaagcuauaauugcuuugauguaguuuuaaagccguuacuacuguguggauuagguauccugacuuccccgucguucagaaauacauauuugucaguaacucuuggucagcgcagucaccuccucagccccugacuuguuaaagcucuuugagcuuggauauuuugacuagguuaagaugguauuaggugauagcaaagcuuucugugguuugguuacaguaauuucugaucaaagagacaaguuuggaaaaaccucuuuuaagaguuuuucuugauuuguaguuacuauaauaagggcaaaguuuuagaaucccuuaagaaauuauguuguuuuuuuuuuaauaaucuaguuaaaauguuucauugguguguauucauugcagaugguguuaggauuccugaaaacauuuuuuuucaaguauaucauauauucaccacuccaaacuguuuccuuucucucuuccccuuuuccucuccuacucaugcccuuuccccuaguuuccguagcuuucaagucucauacaugagggugugugugugugugugugugugugugugugacuuuucucugcauccuugccagcacugcuguuguguuuucucuguaagaggcauucugacugagcugagauggaucucaguguaguuugccucuccuugcugguuaaggaugcugaccauuuuuuuuuuuuuuguguuuauuugccauuugguugaguugguuguuuugucuaguguguguguguguguguguguguguguguaggugguuugucccuaguuuguguuuguguguaugcaccuacuguagacaagaggauugacuuucuggguucuugcuucauuacgaucuaccuaagagacgaggccuuucacugaacuuggugcuaggaucuuguugcuucagcuuggccagcaaaccucagggguucugucuucauuuccucagcacugggguuauagguauuggauguuggucucagcuuauuguauauguagaauauagagauugaagggguucugccuccauuuccucagcacuaggguuacagguauugauguugugcucauauuguauauguagaauauagagauugaagggguucuaucuccauuuccucagcacugggguuacagguauugauguugugcucauauuguauauguagaauauagagauuugaagggguucugucuccauuuccucagcacuaggguuauagguauuggacguugugcucauauuguauauguagaauauagagauugaaacuuagauccuuaugguuaugugagaaacgcuaccaacugagccauuuuuccagucuggccugaguauuuuguguuuugagcucuuuacauguggauauuaauucucuucagauauguaguuuguuggcuauucuguccaauucaagcugcaggauggccuuucuugugaugggcaaaagccccacucuagaaaccucauagacuauucaggcugcugacccuccaugugcaggagcaaccagccuuccugucucaggagcuccaagagccaggccuugccccacucagacuucccuaauggcuguuaauggccgucccagccccugauggcaggagaguagccagauuuuauccuacggaaaaaaaaauuccacuaauaccugaguuugccccaagauagggccacaucaucccuccaaucccaggccauccuggaaagcucugccacccccauccccauccccaccucggccuccccugccucaagaaacccuauauaaaucccaucuucugcugaguucuuugcugccacccuccugggguuuuccucccaguaaaucucuugugugauuuugugguauuccuuggcucccgacuaccaagacaccuuucccuuacgagcugcaacccuuguauuggagaacccuuuccuucccuggagcagagcuggaacacuuacauaguuaacagagguuuuccucagaauuacauauuaccuguacuuauauuuccuuauauguacuuaugaagucuaaauauucuaaugccuaacuauacaacaauuucuuuuaaaggaauuuuuaccauucgauugcccaaggaaacuccuggccaacauuuugaggggcugaacauguuaacugcucuucuggccccgagaaaauccaggucugccaagccacuuguggaagaaauagguauguuuccuguugucgggaggaaaugaggacaaagaagaauucucaugacaauuuguguuucuagggaagagacuuggggauagaaaaccagaggaaaaaguuucaagugaagaaaauaaaaagggaaaguccaaguguccugagaaaauagcucaucugguagcacagcuaaaagccggggccaggaggaguagagcagucacgcucuacuccuauuucucuaucauuaaagcauucugccuugccagaaguguauaguugaaaagcuacauaauaugaauacuugcucggucacgagcuguaguguucacuuauugccuguacccugggauuaaagauuccucugaucccaucacgcucuucccagguuccauaccugaucuucccuagauccccaguacccguccccuuugccugaccagagugcguguuccuuuuugucuggcuucuuacguucaauguucuuaugagguguauguguguuaaaacacaaguccaucuaccuucagcacuuccaguugaucuauaccuccuacuguggugaacauucgggcugguuccacuuuuuggccauugugaccugcagggcugugacuauucuugucugggccuucggugcacaaauacaggcauuuucccuguagcaacuucuuccucucauuggaccuagagaucucaggacuuugagcacuaaacuaauguauaacacauuuaggugcuuccgggguugcugaggaaggagcugacgacgaggaugaagaguuugacugggaaaucgagcagacucccuaugaagaggucucagaaaguacucugcaaucacagugucacuauggauuuggaaaccugcgggccggugugguucagcgguuacagguaugcuguccuggaagacugugccacgcagucuucaacuucauuucugcuuacccggggcacuuuuaaaggaagauuguggaaggagacacaguuagagccuguagcaagcuacuuguauguaaggaucaugcaguuguccauuuccuuucaugaccagcuugaugcuuuccuuagggaaaguucccucuaggauggagcugacuuuccugacuaugaauagaccucucuccuggugcuccuggacauccuuaaggaaggaggaugcuucggagggauggaggccacacacgaggguaucauacagcuucugucgcacauguacagacagacucuuccagugagcaugagccugugagccuuuucacacuugggggcaugcauauauguguguauacauacacacacacacauacacacacacacacacacacacacacacaucucagaaucucucugaacuagucccccugcuucauccuuuccugggauuauagguuugugccuccucuagguguguuuugauaaaauguuuaguucuuagugcgcaguagguacugcauucuguuuauucuugguggaggucacauguaaacucauuuggauacuugaggguuugcagaguuuugggucuuagauuuucccugagcagugcucaguuaggaggguggaucugagucucucaagaaaaagucagaaguugacauucuguucauauuucugcuuccacuuauguuugggauacugccauggucacuggccacauguaaguaguucucucgguaaaguagugcaaaugucacgagauacuggacacaugagaaaauucugaaacaccugcccuugaaacaccaaaguuacuuugaagauucuuacaagagaauaaaaucggcuuuuacucagcagcaaauaagucaaaggaauauguccgaaaaagcucggacacuuuucugcagaauguggucugucuguguuucugucugccacuccugucccuuguuuuucugcugaugggucagguguuuagaacagucagcuuuguggcaucugugacagaaacugcagugaguuucacuacuuauguggucaagagccaguuuguggucauuuuauuuguggcugacccgcccagagcugugaauggaggccaguaaguaugauauggcuaaguucagaaucuccauucagguuaaagguaucccagacacuggucacauccaguccagaugcaugugaccaccuugaaggguuucuccuggcuuagaggaugcuggaggaccauaguucaggugggagagaccaagucccuuuuaggucagaaguuuuuguauuuauugaaaaucauuuauaaguaauuuagguugcuuuuuguuaugaaauacucuuuuguuuuuugauacagggucuuacuuauuccaggccauccuggaacucacuacauagcugagucuggccuugaauuccugguucuccugccugcccuucucaagucccagaagcacagauauauaacacuacaccuagcuuuuauugucaaaagugguaagcuauauauacucuugagauaacauggugucucaggacauggaugcagguaguacuuugugucuuucugaauugugcgacuaaagcaucagguauuuaaauauuugucacucccuuagaaaaugaacuaucaaucacucuaguuaggaucucuguauaucccucugugauuacaucuccucuuuccccaucagagaugcuuagucuguuuacuuagcuuaacugucuaaaauugcuaaacucuuuuucaaacuucaauagaacgaauauuacuuuccuuaaaaaaaauucucauucccuuaauuuagaaagaaaaggccacccaagcgaguggacuccagggcuuuauagaguagugugcugcuggcagcagaagcuugucacugcacaaaacacugcgagcccagggcucugagaaugcccaguuuccaaacauguuuaauuuggcaccaaaaaccugaucugaaacaacaccgguuuuguucuggucauuccccuccccuucccuuuuugagacgaguuuuuacucuauagcucuggcuggccuggaacucagaauguaaaucaggauagccuugaacguuugguaauccuccugucucaguaucugcaguggugaaaugacaggagugagucaccacaccuagcuacuggcucucccaguauguuuuaaacuacuuacuuuuaaaauuuauugugauuguguuuauguauguguauaugacucagggaagugagugcugguguguuuguguuacagcgugucuguggcggucagaaguuaacuuucuggauucauucuccuuaccccguggguuccagggucauacucagguugacagcugcugcuguguuaaaauacuguaaccaaaagcaacuuagggaaagcagaguuuauuugacuuaugguucuagagggagggucuuugauugugggaaagucguggcaugguggcaugaacaggaggcaggguaaucacauguuuauccacacacaggagagcaaagagagggaacuggaagugggaagagguuuuuccuuucugcacacucucaaaguuuccucucacaagacucuacagauccauaacuuauccaaacagcacuacuuggcuguugaccaaguauucauauguaugagccuauggggggacauuugccauucaaaccaccauacauggcaagugcuuuuaccaacugagccaucucuccagcccucuguauauuuugaaagcgauuuuaaacuacauacuuaguguaugugucugaauuauugcugaagugcuuggauagagcaugcugccccagccuucuaacacacacuguaaauaaaacaguguguucucgaauaccuuugcaguccagagagagcccaaaggcucaagccaccaagucugggaauugauauggaacuguucugaguacugugugagucagcccaaaaguacugguuaauacugguucccugggcaucuuuacuguugcauguguauuuuuaccagggaacaaagccaguaaacagcuuuaaagaagugggauuuucuuaugaauuaaauuugagggauuagucagacuuuuagaaguccuaguaaggucgugugucuucucagacucuuacauaauugcuauuacugcagugcucuguguuuacagcugcucagguugugacagccacaucaaguggcuaaaaaaaaaaugacucuguaacauuaacagugguaauuagugaagacagcuauagauguuccuaaaagaacaauugucuuauaauaucauuaaaaaauggcuuuucuaguaauguguugucucacaauuuuaguuucucuaaccuuugggucaagacacagccaaaacauuuguucacuaguaguaugccaggauccucuccccacucuccugaaaugaaaauaguuuuguuuucucugaugacaaaggcaauguacucaaaaaaaaaaaaaaaaaaguaguacaaaggaaaaaaaaacaguauuucccacaccgagauaaugucuucggugaauaauuuaacuauuuauaaaggcauaauccugucuccuccuaaacagauuuguuugcaaacuucuccauuuuaucugauaauaaaaauauuuuugcugaagcaaagucucguucacuaacccccacccucugcuuuccauguauguacacacacacacauccgcuuucuuuccuuuuugugaaaucucugccagccaccagggugccuuuggaaaacugcccuaacugcgcagagucagggcugcacaacaagcuguuggcaccaguggcugccagcagucacaauccuggagucucugggcgccaccccagccagcuccagggacagccucaguugcaggaugccaggccuucuggcccuugcuuuccuuuggcuguuucaaggacccugagaucuuuguuuccaggagacgcacuggccagaugugcacacaguucauucucuuucuggaugggguccuguuugaucugugauguaaaugaacgcaagaguggcuuaaauccuccacgaccuuuuccuggcaguguucaucuucagauugcucaggcaacuagugccacagcuauucugaaacacagaaagggcaauguuuuucuuccugcgcagcuucuuucucuuccuuccccaugguugauugaugccucagauuuuucuucuucuguggugcugaggauugaauccaggaccgcgcgcaugcuaaggaagugcuccaccaccagccaugucuuucuuuagauuccagucugacugcauuagcuucccauuguucuuauuacaguaccguguagaagaaaugguguggggaaagauucugcuucauguuuucuguacaucgugauagggaaggcuugccagagcagcucauucauggggaugagagcgugcagcgcaggcugcucacaucacaggaccaggcaggaagcuguguaagacagggaguagggagcgguagguaagaaacccuuaaggaccugcucccaggagccugcuucuuucuaccagcuaagcccaucuucugaggcuuugcccaaaugugcugcuccauggggaacacauaagugugcagagcucaugaaggcccuuugcuuuuuacuuugcuguaguuucucacuaggguccaguuugagccgggcugugguaggcacagaacaaugccgguggaguuugcccagcugggaauagcuagguggugugugagaccuaucuguugcauugcugugguggcuucgagacaugagacuagaggggaguauaagcaaggcugaagagaguuacuuuuguauauucuaguucacucccaugagauuggguauuuuaucugugugcucaaaacuggaucuguauuccaguaagcagacugguccacagccucugugcacuaugcacacagcaaugauuuccuccugacugccaggcucacuguccuaguuaggguuacuauugcugugaccaugaccaaaaagcaaguuggugaggaaaugguucuuuuggcuuacacuucuacagcuuagucugucauugaaggaaguccagacaggaacucaagcagggcaggaaccuggaggcagaagccgaugagaggccauggaggggugcuguuuacuggcuuguuguucauaucuucucagccuacuuucuuauagaacucaggaccacacagccuacggauaguaccacccacaaaagggcugucucucacccucaucaaccacuaauuaugaaagugccuuaccggcuugccuacagcccaguuuuguggaggcacuuucucaguuaagguuuccuccucuaugaugacuauaguuuaaccagcacacacacugagugcagugaaagagaagguagaccagacccccacccugugaagcauucuaugggaaggcaggcaaucaugucgacaacagauaagcuaauggcaguaguaacaggaagaggacagggugguaugugaggcuggggacuguuuaggucagggugcccagaggugaccccuaggauaaugugaggcacaugggaugauagugagaaggacaccguaaaugcagagggucagaguggagucugagaugaguguuccauaaaugggaagaaauguaguagguggccuuagaccagagggaaaggcuggcaucaguuugaaaggccagcuuggcuugaugaugcagagcugggaguguggguucagagagcccauucacccucugaaauacaguuuucugucaguacucacuaaucauagcccauucacgaccuuaagucuguccuggugugauaguuaauuguucuguuacuuccccccaccccaccccaccccacucacacuuuaguugcuguuggcagguaaggagacugaaauggaagggggauuguguucccaguaagaagucaguaacggaacagccauggaacagagaggaaaagaaaucugacguuaguggguauauuuagcccuggauuguaucauuuaauacuuauaacagccugugccaccaaaugcugcccauccucaagaaaauguuaaagaugugguuacccauccuguggagauuuuacaucacauggggagaaguacuuugcaacugugauuaaagcuaaugucgacaugccuuuuauauguggguccccuuccaccauggagggaggagaaaaggccuggugaccagagaugcugggguagggguggcaucguccuguggauuuacaguccaaggaaaggacauggccccaugguaguguucucccaaggcagccguggacucgcucugcugcuucuccuccgugccauggcccaugugugcucucaccuguggcuggaguugggaugucagugaggaaacggagggagggagggaggauggaccgaugcugcaccguggaggagaugcucugcuggauccgacuccggauggcaagccugcccauggaaacccugcugcgugcuugucaggcucuuugcaucaugaaugagcuguuucaauuuguuaugaaccgcauaaacucaagggcugcccugagacuccuaacuacuauuuauaauaggauuccuguaggaaaaugcauucuaggugcucagaaauuaaauugcauaggaacuuuggaauguaaauuuuauuuuuguggacaggcauuggucuggauguugccucaaauguuuguauuugaaagaauuaagauauucugguugguauaguggcuuccaaaaaggucacuggaucccuucguuguauucgaauguacuuugguuaagccccacaugcuuagugguaacaaagaguuuauuuugacuuuaaagcuacauacuucuuuauuuugugugaaugugugugccuauaugcaugccaugguguacgggcagaggucagaaagcaguuuuggggugucaggucccuccuuccaccauguggguccuggggguugaacucagucagguuacucaccaggccacuucucuggcccaagaacuuuuuuaaauuuggaaacuuugguuacauagggaggcugugcucgucugacuccccacagcuuacugcaguuuaagagaucuugcauucuggccaccagcuuuacugugcugugacauacgaggaagagaagugaagggauugcuuaagguccuaggacgaacuccagaggcagcucugcgcugucacucuugccuuucccacgcaucuggcucaguucacugcuguccguugcguuuacauuuccucagguuacugguugacuucuucccgcucagauccguauguuucugccaggacuguucauaccugcagaggaaauagguggaguggacacagacgagagccacaguuuugggggaugguguggauucucugaggucucuuuaguucacaauuccuauuggucuguucuguagaauucugcuugggaaacaugcuucauguucauauguguacauacaucuugguuaaggcaguaagggugauucuuaggauuagauuuuuaaaguuucagaugggaaguccuagacaucagaauuacucauaaaaauucuuuaaaauuuuuuauuggguuaauaaaauuaugaugaaauuuaaugauaaaugaaaaaaugauaaguaaaaaguaaugaaaaauuuaaaauguacaaauggaagucaggggacagcuucauggaguuggucuuuuucgucuaucucuauguggcuuccaggaauugaacucaggucugcauggccagcacauuuacacaguaggcuguacaggauugcauuugcaugaucuguugugauccugagaccagcugagcuagcgaggaggaagaaaggcaagggucucuauaucugcagagaugccugaugaacccagugucucuguaucugcagagaugccugaugaacccagugucucuguaucugcagagaugccugaugaacccagugucucuguaucugcagagaugccugaugaacccagugucucuguaucugcagagaugccugaugaacccagugucucuguaucugcagagaugccugaugaacccagugucucuguaucugcagagaugccugaugaacccagugucucuguaucugcagagaugccugaugaacccagugucucuguaucugcagagaugccugaugaacccagugucucuguaucugcagagaugccugaugaacccagugucucuguaucugcagagaugcccgaugaacccagugucucuguaucugcagagaugccugaugaacccagugucucuguaucugcagagaugccugaugaacccagucucucugcaucugcucagagccuccugucuuuaggagcuuucagaucucuagcacugaacagggaaaugaauuaagaauuaaauauuccugcauguuugugaggguuuauucaauucugcuuuacgugucaaaaguuuuaaauaaguaaguguauguguaugcaugcagcauguguguagagccaugaugacaacuucuguaauuguuucucuccuccuacuguauggguuccagagauacuggugaucaggcuugguggcaagcacccaugauccuuuguguuaaacguuaauauccuuaauagaugcuggucagcuugucuuauggguuaaaugagguaauuuaucuggaaguuccuaacagaguacagaauaguggauucagacauuugugggguugguuuguuugauuguuggguuuuuguacuuugcuacuaggucucacuguguagcucuggcuggcuuggaacuugcugugugcgccagacuggccuugaauucagagagaucuuccuaccucugccaccuaagugcugggagccaagguuccaccacaccugucuuaaauguuuguuaggucagaguuuaacuauuauaagugucucauucauacuuuagugaucagacaggucuuccagccuucauguuccuccucccuccccuauauuugauuuuuaaaaacuaaaaguuugagauagaguccauucuuguucugguguuuuuaggaugagcugagugagguuaucgauauuaaggauccagauuucacuccugugacugaacggaggcagaagcgccuggcugcugaguuggccaaauuugaucccgaucauuaucugugaguaugaacuuuugugacaguuaaauaaguuaguuacuuuacacuucuuuaauuuuuuucagaaucuuugagcguuuguguguguguguuuauguaguuaugugugcauguggaggccaaaccucgacaaugagugacuucugcaaucacucuuugccuuauuuccugaauccagagcucacccauuuagccagggugagcuaaauggccauccuuggccagugagcucuaagaauccaucuaucucugucuucccuacuuugucaugccuggcuuuuuauuuagaugcugggaaucuaacucagguccuuguauuugcauggcaagcauucuucccagugagucaucuucccagccucucaauguacuagacauauuuuuagauuguggaauuagugaagacacuaauccuaguugauuuaaccuacucuguaauggcuguacaugugugaccuuuguaaacuugcuacuuaauuuauacuagcaaccgagaacucauuuuuuuuuuuuuuuuuuuuuuuuugguuuuucgagacaggguuucucuuuauagcccuggcuguccuggaacucacuuuguagaccaggcuggccucgaacucagaaauccgccugccucugccucccgagugcugggauuaaaggcgugcgccaccacgcccggcucgagaacucauuuuuauuuuaacuuuuuauggauucuuugugaauuuuacaucauguaucccaguccuacucaucucccaauaucccuucauaccuaccuucugcccuugcaaccuccuucccaaaagcaaaaaaaaaaaaaaaaaaaaaaaaaaaaucugauuguggaagcugcagugugucacagugugucccgucacagugugucccacagugcucccuuuuguccacacuucuuuacuugcaaauguucauugcaacgagucauuggucugguucgaggccucugucuucugcuacaccaucaauccuggauccuggaucaauccugggacuucucucagauauccucuuguugcccugugucauggaggccguacaguuuuggaucuguaggaccagcccuucauguacuucagcaguucauagaugggguagauguuggggugggcuaacucaaguuccuggaucugggccugggugauagcucaguuggucaguuacccacagcaccaggaugagcuuucuggcacugcucugucuagcucacccaaugcugcagcuagcaaggggcagagccagcucucccacucccaugccugugccagcaggaccaucucugcugcgauguccgggugaggugcagggucugcucuccugagugcugcagcagguaaggggcugggccagcgcucccacucaugcccucagccuggcucacucucuguaaccccuggaaccagcuguacugggcuccccagguaaggugcaggggccacuugcaauggagaacucuuaauaaacucuuuggcacaaccugugggucaugacuuuuggggucacauaucagauauucuacauaucagauauuauauuacaauucacaagaguagcaaaauuacagcuaugaaguaacaacaaaauaauuuuaugccuagggaucaccacaacaugaggaacuguauuaaggggucgcagcaugagggagcuugagaaccaaugcuuuaaugguuuccuuaccaugcuuaaagcaucaaacuuacaagaauauuuguuuauacuucuuucaaguagaauuuuugucaugguuauuuguguguauaacugaauaugucuugcuuuccauaagaauccagaucuaugugugcuguauuucuugcuagucuaggcucucacuggaacguuuaucugccaccaguugcagugaccagauaguuguccucagugcuaggguaucaguagaaccuaaucagaguugugcuguauuucccaccuguauccgcugugcccuuugcugcaaucagaacuguauuuggguaaggaacuuaauaaaacagagaugugcugucucuuacuggccagauaacagcacguuuuugcauuuuuuuacuggaccucugaauaccugauucuuugauuguguguagagaaugaguguaguucauaugucgaugugacacucuuuuguuauuuuucccuaggugauuacaaauuguuacccauauaccauagucaccauucuccaguauuuuguaugguguuuucagcuucucaugucuccucauaggcuuauuucacaaggacgaaaagaggugaagggacuugcccaaggucacaccacuguuaaguggauggguaggauuugaaaagaggcuuccuuugccacccuguguuuccuuuucacguacacugguacacugcguauacugcucugcuuggcucuaacugccauugcuccugugauuaacauucucucuccugugacccagugggauacuaauuggaauagcagaagugaagcuugugaugugcaaauggaaugagugauguguggugaugaacggcugagcauccuaagggaagccagggaagagugggcugugcuauccuguggaggacaucugagagacucugcuccauuuagacugccauuucuaauuacuuuuaucucuucaauggugguuuuaaagguccacugaagaguaauuugaagaaacccauuuagaaucaugcugaauauuuaaaguagaaauuuccauugucagcaaauuucucagccagucugaaaacagaaugaguuuucgaaggcugaaauuuuaagugggagguagcuuaauuagaagagcugucuagaagacgacguuugugacccaagaagacucagguauugaaauuuauaguuggcagcaugaccgucuaagcagccuguuuccucugccucgugugcuuuuguauccaggagcuuauucucuuuaaauaacuugaagcugcauuaauuaacuuauggguguuacaacaggcauggagaucagaggacaacaugcaggauucaaaucucccgcuguguggguucccgggauggaguucagguucucaggcuuggcaagugucucuguccacugagccuuucggugggcccagaagcucaccuccuuaauaguuugaauagaauguuuuuaccauuucuuaaggagugguucucagaggagugauggcgucagguuucgaaagggcuucaagaaaacaaaugugauuuuagccuacacaggacagaguugagccagcugccuauaaagagggauuuaugcauuucaaaguaacaucuaucugcuuugggguuaugacuguuuugaaaucuguuguaaaauagagaucuaaugugguuugauuguuacauuagcauggccugcagccaguggagugccaugugcagugaucuguaaaccucguuguuucugauuauucucuuugacaccauuuguuccuuuuagacaugauuuuagaaauuuucaauuuuauuuauuaguguguaugaauaaaagugagugugccaugccaucagaugacauuuucaggauuuggaccuccuuccagcauagauuccaggugucaaacucaggucagcaggcuugaguggcaaguuucuacugugagcccuuugcagacuuggauguuauuguuacacuaaggucugcagacagcgucuugaaguauuccguaguagucuuucaccuuuauauauggccaaauauuuguauuucuuuuccuggagauauuggggguuuuuuuuuucuuccuacauuuguuuuuuauucuucagggacauuuuuaucauaaccaaucuaugaaaucuugcuuauuucuuuggugagaacaggagaaggauuuaaucgacauuuuaaacaucugugagaucaugaaaaaacaaaaaugagucaagccuuuuuuggaauacuauuuuaagcugugguagauuuucauuauuaggaguuuguugaagaggcugacacauugaucuguuugcuugcuuuuuuggucuuguuuuguuuuuuggauguauugcguagauugcagcuagcauuuggaaggcuggaagggguggcuuucuauucggcacucugagcauaggaagaagcauuggauaaaacaucagacuuguucuuuuguuuguguguguucuggugcaacaagcauuuguuugaaagucuccuacucaccauccugcagaguccaagaauagcacuugaaugugacagaugucuacacucaugucacuuucauuccagucggggaggucagcauaucugguggagggccauugucuuagccuggguuucauugcuaugaagagacaccaugaccaaggcaacucuuaaaaggguaaacauuuaauugaggcugguuuguaguuuuagagguuuaauccauaucaucauggcaggaagcauggcagcaugcaugaaggagcagaguucuacaucaugaucugaaggcagccaggagacugucuucagcaaacagccaggaggaggcuuucuuccaugcuggguagagcuugagcauaggaaccccacgccacaguggucuucuaacaaggcuacaccuccuccaauaaggccacaccuccuaacaguaccacuucucaugggccaaacaaauuuaaaccaccacagcuaugaaggagcaaguucgaguuuuugagagggccuggcauccuauagaugucuguuaauuuucaugacuguuacuuggguuagaacauagugaugcacaccuuuaauuccagcacuugggagguagaugcagguggaucucugugaguuuaaguccagccuggccuacauagugaguucuaggacagcuaaggcuauauagagagauccugucucccccuagccacccccccccaacaaaacaaacagaaagcaagcaagcugaggugugucuuugucaucuuugucucacacaaucaauccuaaagcugugcuacgucucucuuugauuuccucuacuucacauuucuggcccucuucucacauggcuuccuauagccuucugaccaccucacagccuucugugggcuucagcagaucugucagcugugaggccagcagcaugaugcucucaugugaaaccugccuccacccaugcuuggugcuccacagacagugcuccucagcuucagacagcagccucugucuccugagcgugacggcaaauguucucugugauguggaaccugcuacuucugucaguucaauuugccucuccuugccugugccuucuccagaggcaacagcugacgcuugcauucucccccccccccaacccccccuucucaugugcuucuaacacauacuggccuuuugcuagcuuguuccucccugcaucauuccaugauaccucaccuucgagcugugcucagacaucacuuccagagaccuucauccuuuggcugggugaugaucuccuccucaguggcuccccgcugugcccaccccccucaaaccacauuguauucuaaccuuccauauuuguguccuugguucugauuaaauaguggagcccucguggcagguuuaaucuuuuccuuuuucuuuguugcuauguguauguggaggacauucaaugaauucagugacguuuaaaaaugugaaaauaacugauuauggaaagcaguaggucaugaaucauauucauguaacucuuaauuuauagacagaguaaagagcaagccauuagugggccugaugguguuagccuacaguccaagguaugcuggaggcuagugaggacuauuaggagcaaguuuaagguuuagagaacaucacaaauucaaggccugccugagcuauggugugaguucaaagccagccuaggcaacuuagugagacugucccaaaaauaaaaauaaaaauaaaaagacccaacaugcuugaaacaugagguccaaucuccagugcaauacagacuggaaaacagagucacccauuccacuugagauucuugggguggugucugagaauguuuacucagaauaaguguaucauuguggaccauaggauggguuuauacaugccaugccaugcacguggaagucaggacagcucaugggagggagucaguucuucuacccuaugggugcugcaacuaaacucaggcuuaggggcaggcaugcauauccucugagccaucugaccagcccucauacugguuuuuuuguuuuuguugguuuuuaaaucuuggccaagauauaucaccuuuccaggcucaggcggugaugcuggaaggaguggaaggcaucauggaugcaaacucuccauccaguagacuccggcguacuuuccccaagaauacucaucuucaacuugaaaggcaagaccacaugauuucugagcgugucuucgaaaaaagagcuaaaaguguauuuuaaauguccuuuuauuuuucuaguuaaaauuaagagaguacagaaaaccucuaaagaaugggguuuuuugguaucuacaaagguuguuuucaucuuuuucaacaaauuaaaaccaaggaacuguuacgauuagcauagcucaauaaaguagcauuuuaguagaaaguauucacacuggauagaguguuucggugugugagugcgugucucggucucuguggaaaugcagaauccugaaugacaugcucaucuguuugcuuucuuuuuucuucugcugagucugaaagucauuucauuuaucuuaacauugguccaaccugagcuacucacaagccuggcgucaguucaggagggcuguggucaguguaggauaagagcucagggcaggacagcucucccagugcuuucuguguacagggucaggggugacuaaggcccuuuuguuaggugguuaccguuugcuuuacgggaguaaagucagcaccacacucaguuuucucucagaguguguauugaauugguguagucuccagauuagagagaaagccaaugcagucugauuuaacaagcccguuccuuuuugagcagagcugacuucuuugaagacgaggcaguugagcagauuuugaaguacaguccuugguggaaugaugcacaugcagaaaugguggccucuuugggaaagaaccaagagcaaggggacucugcugcauuagguaagaaacucaacauuagcaucguuugugauuuuaaaacucaucauugugccacgccacuguccuucguguuuuguggcauaugauuuuaauuguccuucauugugaaaaugggguuuuugagagcuauuucugccucuugucuuugccuuucuuugcugguagauuugaauuguaagguacuguagaauuccauaauaaaucacucagauuauuuuuguuggaaaauccuuaugaacuaguaaauggaucuaucaguaggguccuuuaaguuuuaauugaguauccgugagagagacccagacucauucccguucuagugaaagaauuggauguggccuccucaguugauucacagguuaagggaugaggaagccagaauagcugucuuccuucauguuuccagaacaugguaaagcaguuggagacugcucaggugaggauuuuacaggccacaggagguggcugugaacacaagcauuacccagugugguagauuuuggcuguacugcuuugugcacuuggcagguugcaagggugcacccgcccaggagcuaucuuagauccgcaaauggaaaacauccacacauaccaguuaauuuuuaaaugccuugauuaauucaaaguuugagcacucauaaacguuccccugcuaccccaggcccaauuggggaaguggccaguggcucacaugacugguuggcuuucucuccugcugcuacuguauccccuucuucccccaguccuccuuccugugucacccuaagugucccgccccgugcccaaccauuggucauggcaucuuuagugauagaucaaaaaaccaauugggcacaaggaccuucagcacucuggacgugcagauucaaagcauuagcaccaauccccaacaaccgagaguucuuucuuggguguuuaucuucucaugaugggcucugaucaauacaagcugguuguucuaagucuguauaguagaguaguaaugguuucaguuagaucagagcaggaggccuacauugucugauaggcugauuuggcuuuucuuuauauacuaaaauugaauuucagcauuugaugaaaggaauacauagguaagaacauauauucuaaagauuuuaaguugaauauaaaccuccccuccccaaguuccucccccuagaagcagucacugcuaaauuuuuaaguuuauuuaaaauuaacuuagguuugugaugaccaucaaacccaggguuuuauguaugcggaacacacguuuuacccuccagcgguauucccagcgugcgguguuuuuaaagcacacauaccacauguaaaagguucuguggcuguguucuugccaucuuugcuguggauuguauuggagguuggaaaucucccacaugagcauacacagaucacucaacuugucuugcuugaaaaccacuggcugcuguccuuugcaauauuucucucaugcuuggggaacauuuggacucuccugcuggcagucauuugggguuugguuuacuccucucacugauaguacaggagcccuuuucacacucagucugacugagguagcuauggugucuuaugcaccaauuccuaaaaauugucuucaagcuguccuguccagucaccugcugcccaccccaccccuuggcaugugguauugugauuauuauauaauauguauuaaguaguauuuuauuaaguauuuuuguggcuaagcuuuguuagacuuaagguaauuuccaccagaguggaaaauugccgcuguaacuuuagaaacuagacucuugauucugaguauggaugugugugccauuguuucuagcgugcucugggguagcauuugaucugugcuuacgaagccuuugacugcuucccagcugacagacuugcagauggaacagggcugacucccucuacuuagguagagucuucagugggucucaagaaguuugcucccaaggucagccacuuucuccaguuucuagaguguguuggugagguaagcugguggcuguguaguugggcuuucucuccaccagagugagcuaguugcccugaaaucagaaggcagccuucccucugacuucaguucuagcuugcucuccuuuaaucaauggcacuguguuccgaagucaguucuccaugucagcagagcacugaguuagagcuucuguaaucuuagcagacugagccagugcucuguccuuuuaacugcugcuuccaggcccuuuaucugaccuguggccugaagccaggcuggugguucaggcagucagucugcucagccauuauggugauucacucuaaaagucaccuuuaaaccagcaagggugugugacgugagguggagagcuugagcuggguugggcagaaaggaucuccugcauuucgccagcugucagguuaagcaugggcaaggcaucgcugugggagucuugcauuuaacgucucuacucugugcuggccgcguggcuguagcuguagaacucuucccugccugccucagagcugccagcaggauugaaugaggccaugugugggaaagcucacugcacugugagguuagagacgauugucggagagugaacugaaggcaggaagccaggaguaggacgacugcucugucagcuugccgcuuuguacauuuuacagagcuuucauggccuuguuaaugagauuuuucuucauuuuauucuuauucagauauugagucacccagaauuggagaaaugaacugaaguguguugagcgaggauaaaguacaggagaaaacgacauaaaacaagaacuaguuuuauaguucuauuuacuaaguuacacugugcugugugucucuugccuccuccacacgugucugccccucucugcuaccuaccuuccuguucuguuuuacacagugagacguugccauuuggauaggacagugcagaugauagaggugcacuguggcguuguccuacaguguacugugguaaccugcuuuguaugaguucuagcuaugcuacaguugguaaacuuugccgcugucuuugcuuggguaaugauagugguccuauuuauuagacuucagagucacagcagggaaacguauuaacauuuccagcuuuauaaagaucccgauuuuccuccccaaaggcuuaugaauggcagcguuaaaugccgugcucccucggagcucugguuucacgaggauggacucaccacauuucccaaguugucucucagugguuaacaucagcccaagcgucuuggcacauaauugcuuguuaugacaccacauaacauuuacaguccaugaacuuccuugcagggccauccugcuuggcaccagugagcccuggaguguuuguggagauagcuggcagugucagcuuugagaguggcggcgcggcagagcugcccguuuagcuugacuacagcagugucucgaucuguuuccaggacacguacggcguaauagacagauacguggcacucagaggggccagauuauggaugccugaauugcugauccagacaagacagcggccuuugggagggggauuuaaaguggaagagaagguuuaaaaguaacaaaagucaggagauauuugggagggaggguaagcaucucagcagcauguuccugucuuuaugaggcuccuuugcagaucucaacacagcggcgagguugcuaauguugggagguggcccugggcacguacuuuaauguucaugcuccagggucuccuccagcccuucugagcuuugagcuggcuuuuguuucacuaaagaucauuuuuaggaguauaauucucuaaaauguugcgaacucugcagcuaagucacacaaaugcuugacaaauguugcuugagguggugaccacccagguguuguuagcaccgugccuguagguauuuccugugcugcugcuggguuagaccugauugugugcaggcugucccaagcucuucuuugggaugugauucacagcccugauaaauugggguuuagugaucugagacuuuugauuucuggaacaacauccucauuuauuuugucuucugauucuuuugguuggaucaaauauaaaauggaaccuagaaaugcccagaaaaaguugguauuuuaagaaaagcaucuauaaauucaagaguacagucagguagccuuuagucauugaaagugauauauaauguguggauauccuuccauauggaauguaccuuuggagcuuugagguuaacuauuuucaguuugccagacaauuaugggucuaguuacuuaagaacugagaugugaacauguagaagagucgauguguuuaaaaacaguuuggggcaugcuuacccugugauucaggagugcuguggaaguggagaucuuuauuagucagccaggguauaaaggcuuuucucuagugagauaauaucacugugaacaccugguacuuuccuauuagcuaaauuaaugacugucuggaaaacugugcuuaugggaauccugucucaaaucuucuugcuaaauacaaggucuuaaauacuuugucggguuuauuuucuuuguguauugaauuuguuucuucauguagcuucuuuaaggccaaucauucaacaugagcugaguauuucuuuuuaaauaaaggcaucuuuagaugaguucuuuauugaagcaaauaacacucaauuaucugucuuauuuuauuuuuuaaacaaugcucugaagagcauuuuuaacauucucugaagaaugcuuuaccuaauacauaccuauguuucauuuuuaaaaauacacauuccuuagccaugauagccagcaaauuaaacgagucauugaaaucaugugucauuguggaagccgugcuuguauaagugcacuuauuccuuuuugcagagauuugcuaacaugguugaaacaguaauuaucuaaauauauuucaaaaccugcuucuuuuacacuaagugcauuuuaaugaguaaacagaauacuguuucuacuaauuucaguguauuuaggauucuuccuccuagaggauaggcugggaaauuuuuaaacaauucaaagugucacguuaaacuugagcucauacaagagggcacaagugaguuuggaaaacugcguaugaaaagggcugugggagucagccuucugucacucugacaagaugucugagguaaucaaccagaaugagaaguuuguuucaguucuugacuuuauuccauguuggugacucagaaaaucauucaucuauagccaggauaugaaagagauaggaagggguuggauccucccucuggaagagcuggauucuuacuauccucaaggcugcccccagugaucucuauccucccauuaggcuccaccuuaaagauuccacuaugucacagacccaccauagguuggauaacagccuuuauuuaccucaugggcauauguggaacacuuauucaaacuaaugcaagggcuuauguaauuuuauauguuuauagucucuucugaauuuugucaaauuuugguaaauaggagggcagucucguugagcugagacacagacuguguagcugucugucuaucaggagaaugguuugggaauauuaaaaggcagccugauaacuuuugguaucuggacaagguagcaaagaaccauaugucuuuucacaacucuucuaguaagaggccuccuugacuuagagcugagcacaucucacucugcuaguggcuggguuuccuuucuuuacuugcagcuggaugugacugugugcuugagcacuggcucuugggaugugaugguggccagugauaaguguauuuucugcaucccuguuuuagagaggagaugcuugcuauccuccuccuacuuuguguuuucucuucauuuagaagauagagcagcucucuuggauguauguagaaagaaguuauaugccagggaagcccaaggcuuauggauaagcuuccaucccuuaucuaggguacuggaacgaggggaacuuauguucuacuaucaggggaucuucauuuuagcaguuuaaccugcacuuacuugugcauuguaagucauucugacauuuuuauaugaagcacuagaaguggaaacaguccccugcuagugggauauaaauuuaaaagugacugauaagagaugggaaaaauuacuaauuuguaagaugagagaucaauugcacuuuuauuuagagguagccaaacuuggcagugucauccaugucacuggcuuugguugcguaaaggaagaguggaagagccagggaaucguggacucuucuucugugguuuuagagaacccuugagaccaggcaacauguggcaggauuguuccagcaaggcucugagaggacauugugugaagcugugaaauugaagccuguguugucuuagagaccugaggauguuaagagaugccagccugggauaucugccaugaagagcuucauucugggcuguggcaagcuguggugguuugauugagaauggccagcauaggcucuuguguuugaauacuugguccacaguagguacagcuguuugauuagaaguguggucuugugcaggagguuaugucacaaggaaugggcuuugggucucaaaagauugacaccauucucagcucucugccaccugcuuacagaugaaguugugagcucucagcuguuccugcugccaugccuuugcuuugccaucuuuauccucugaaucuguaagcucaauuaaauguuuucuuuuauaaguugucuggaucaugguauuucaucacagcaauagaaaaguaagacacagccuaggagagagauauacguuucaggucgcaaagcuggagcgacagagccaucuaagcccuuugacacuagucauagagcuauaagauuuggagauuguccuguuggguuucagccuugcauuggucugguauuccucacuauggccaugucccucccuuuugggaugguaaaauauguucugugccaguauguuggaaggaugacauuugcuuuuugauguuacagggguuauaauuaagagacuacuugagucucagaagagcccuuggacuuuggaccuuugaacuugguugagacugugaaagacucugagggcuuuugaaguugaacuaaacguauuuuguacuuagagaggccaugagugcaugcuggugauuugaaugagaaauaucuccuguaggcccagguggauagacaccugguuccuaguugguggaguuguuugcggagauuuaggaggcauggccuugcugaaggacuaccuagagguaggcuuuuagaguuuucuaaacucacccucauaguugucucucuuugcuuagugcuugugguugaaauaugagucuuggcuuccuguucuguugcugugcuugccccacuugcugacuccaccuuugacucuuccucucuagaaccauaagccaaauaaaugcuuccuucucuaaguuacuuuugaucaugguguuuuaugauagcaacaaacaaggaacuaauacagucauguuuugcauauaauagcuagaaagugaaaugcuugaguuuuaacacacuuucuaaccauaacacucuuucugguuaugcuauagauggaguauguuacuuuguauaguauugaguacuaaugauguuagugugagauugacuagaaaagcauguuacaugaucuuucuguaacuauaaagugacaugguuggacggggcugaagagagcucgguaggucaagugcuugguguguaaauggaagguacugauuuggauccucagcacccacauacaauacagaguugagugugauaacccaccugcaagccuacaacagagacaggguaucucacaguaagcuggcuagcagcuagcuagacaagcgagaauuagugagcucuaggcucaccaagaaauauauaagcauggaggaaaauaccugaugucaaccucacaccuacacacaugcacacacacacacaagcauguguuuccauaaacuauaaaauacacaaaugcacacacaugcgcacgcgcgcgcgcgcgcgcacacacacacacacacacacacacacacacacccugcuccuugcuggcugaagcauugaauaagcuaccuggagcaaugcuaaagagcuugcccuugugguguggugccagagaguuagcaggcagaccaacucaguugccucccaggcccagauccagggcuuugaauuggcccacccuaacaucuaccccguuuaugaucugcuggagugcaugaaggggcugguccugcaaauccaaagcuucaugaucuccaugacacagggcagcagcaauauauccaagagugccuuugaggauccaggauugauguaacagaagccagaggucuugaaccagaccaaugaugcacuguaaugaaaauuugcaaguaaaggugugugggcaaaaggguauagugugggaaacucugugacgcuacagguuccaagacaagauuuguuuuacucuacuuuuccuuucuuuuuuuuggggggggggaguuuguaacggugggggaugggauuaugaauggaauugggguacaugauaugaaauucacaaagaaucaauaaaaaguuagggaagagagaugugugguagauugccuaaacuguaggcaucaaaggaaacuuagaaacugaagucucauacuuacuugucuucauguaaacaaagcauuuuguuguaucauuaacauuuaagcauuucaguguguuguuuuggaauauguagucaauauuugguagaguggcugauauauaaaaagaaauauuuuuucucuuuuaucaugaagcauuuaaugauggcagugggggaaaauacuguauuugcaacaguugacuaaaagcaaaaauacuuugaaguaauuuuaguaacaaaaucagcaaaucugucugacaagagucggugguucaguagaguggggauucgcuguucaucuagaauaaagacaagucuugagacaugaaaugcuggcuuccagauagguuuaugguuacuaguuuuuaaauguguauucguguuuugccuccaugugugccacauuugugacuggugucuacagaggucagaagagagcaucagauccucuggaaugggucuuacagaugguuuugaaucaucgugucgguaccgggacucaaaccugggucuccuggaagagugcuuuuagccagugagccaucucucuagccccaagugaaacaaucuuaaagagacuucauuuaugacucagggguuggaaagacauuagccaaggauguaaacccagaaucuguuuguuugggguuuuuguuuguuuguuuauuuaaaggguuguuugggauuguauugaaaacaguuucugagacaacauguauuccaaagucacagauuuggaauuugguuaccauuuacauuuaauuuauuuaauuuauuccuuguguguguagugugugugguuuguguauuccauggcucauguguggaggucagagaauaacuuugugaaguugguuuucuucuucccccuuuauugaguucucaggaucaaacucgguuagccaugauuggcaagugcuuucaccugcuuagcuaucuacugguccaaagauuauauuuauaauucacaaaaagguuuucaaaacuugacaagccaaacuacucaagagggaaaauuggaaagaacacaguccagugggcaauuugcagagcaaauccuguugaccaacacaacuagggaauaacacucuacacuuagccgaguggcacugaccgaagugccuggugugcgucacaguuuuaagaguuucuugcuguagaacagcuuuuccccacacuguguucucacaguccauccauuacagggcagguaacuccgauggguucucagcucagggccuugggagacuaggagcucagaugugcccagccuguggccggugggggugagaacuaugaaugcagcccaacacaaaacccuaaauuuaaauaaaacaugaugagcccuuuuagugaucuuuuuuguagcuauauaguuugguuccuuggaugugaugaucaucaugacacaacagcaucauuuugcaauguuaaaagguuggacaugcuuaccagccaaauaugcccaucucucuuaaaaacuaggugucauuugcuacaguuuuucuccaggcucauaccauuauugacagaauucacuucucaggagcuguaaaaccguggccccacuuucuugccugcucuuaaaucuucagauuguagaggucucagaaguacccgccacacagccuuuccacgggccaccucaccaaagggcuauaccaguuaggacacccuggaaugugagccuggcagugauuguccugucaucuuugccauacugugcuggacagaaucaccugacaggaucuaucccacauaggaaguggugucccucuuuggugucaucuuggaaaucuuaccaugcucacuuaaauccauuaaacugggacggaaugggaaaaucauugcuaacuuuauucccaggcaggacgggaaguauguguagguaggugugcugguaauuuaugucagcuugacacaagcuagagucauuugggaaguggguagcucaguuaacacaaaggccccaucagauugaccggcauccaugucagguggcgcauaauugucuuuauuggcaccuccagccuccugcacucaugugcaaauggccacauacacauagaagcacauguguaugcucauguacgcauacuuuaaaauaauaaggauaaaccuuaggaaaaagauuaagugagaaacugcuauugaaauguccuaaguguaucaguguuaugauaggagggaaaggucuggaagguuuaaacagaugcauggcucuuaauaaagcuggagacaccuccuuuaagaaagugccuuauaugcaguguuaaggauaaauagcucugauuuugcuuucuacauccagaauuccaauuuuggcaaaucuucugcacugguaguuuuaugaacuugaauggcacauuuaauuuucagaacuguguuuucuucuagugucuuuuucagaagaggaaaaauaucagcuacgaaaauuugugaauaagucuuaccugcuagacaagacggcucaccgucaaguguacuaugguuugguugacauccugcuggccuauugcuaugaaguacgugucacugaaggagagcacagcguaaguccaugugugccagugucccuacugcuuuagcuaaagguagcccgaguuccccuguugagcccagagccuguugugauagcugacuuaggaucuguccugcagagguacccauggcggucacaguaugguaauggggagucauccuagagcuuaaugcuaaccuguggucuugccucuucucucugggcaguggaucuacuagacagauagagcagagcagggaagugugugaaauaaagccaaggguggaaaacagccaguuacaacacucacuggguuuccucaaagcauucauucaccacaugcagagaaagccuuugcagaaagaaucuaagcauacagaaggugcacucagaaagacuuggaauugcuacucuuuccaaaacugggaucuuucuuugguuguuguuauuuaaaagguucaccuuagguugagacaagaggauugagaggucaaagcuaggcugagcugugaguggagagccugcuugcaccuguuuucaucuucauuuguuugcuaaagaagccacguguuguguguguguguguguguguguguguguguguguguguaaagucuguggguucaacuggcagugccucaguccauucuccagucuuucagucaguaaagagaggaaugcugggaaaacaccagccugagggccacuguugaugauggccuaagcuccguuuuagccuugucuaugcuuucuguuuucuuuuugacuauacaaaaaaaauuagauuuuugugggauauuacauaauuccaguaguuaguaauaaccacagucacaagauuauuuaucugccuagcuuuuccccugcauguaugugugugugugugugugugccuguuuacuuuguauugcagcaccuacucugugauuuuauccacuuaauucacacaacaucuuagugcaauagaguuagagaugccaauuuuuuuuuguugucuugauucugugaaauuuuaaagugacuauugcagucuacauaugaucuaaaagaauaaucuuggagcuauuuagaguguuuuauauauauauauauauauauauauauauauguauguauguauguauauacacacacacacacuuuguuuccaaguugguuuugaaauacauucuaagugaauaaaauauguacuuggacaaaaaaagggcucuucauuucauaguauugaaucuuuuuaaaaagauuuaaaauuuuauauauaugaggugucuuaggguuuuacugcugugaacagacaccaugaccaagucaagucuuauagaaaacaacauuuaauuggggcuggcuuacagguucagagguucaguccauuaucaucaaggugggagcauggcagcauccaggcugucauggcgcaggcagagcugaggagaguucuaccucuucauccaaaggcugcuaguggaagacugacuuccaggcaacuggggugagagucuuaagcccacacccacagugacacaccuauuccaaccaggucacaccuauuccaacaaggccacaccuccaaauggugccacucccugguccaagaauguacaaaccaucacaugagguuuuuuuuuuucuuuuucuuuuuuauuagauauuuucuuuauuuacaucucaaauguuauuauucucuuucccgguuccccccuccucuuccuggaaacccacuaucccaucucccuccccccacacaaaucuucugcacuccacucacccacccacuccuaccuccgcgcccucaauuccuccucugcacugggacagcuaucaaguuuucauaggaccaaggacgucuccuccuauugaugccuaacaaggccauccucugcuacauaggcagcuggagccauguauacucuaugguugauagcuuagucccugggagcuuugggggucuuguugguugauauuguugcucuuccuaugggguugcaaaccccuucaacuccuucaguccuuucucuaacuccuauuggagacuuugagcucaguccaaugguuggcugcuagcaucugccucuauauuuguaaggcucuggcagggccucuuaggagacagcuauaucaggcuccugucagcaugcacuucuuggcauccacaauagugucuggguuugguaacuaacuguauauggaauggcuccccagguggcauagucucuggauggccuuuccuucagucucuacucuacacuuuauuuccauauuugcuucugugaguauuuuguucuccuucuaagaaggaccaaagcacgcacacuuugaucuuccuucuuguugagcuucauguggucugugaauuguaucuugaguauuuggagcuuuugggcuaauauccacuuaucaaugagugcauaccauuuguguucuuuugcaauuggguuaccucacucaggaugauauuuucuaguucuauccauuugccuaagaauuucauggauaauagcugaguaguacuccauuguguaaauuaccacauuuucaguauccaguccucuguugagggacaucuugguucuuuccagcuucuggcuauuauaaauagggcugcuaugaacauaguggagcauguguccuuguuauauguuggagcaucuuuuggguauaugcccaggagugguauagcuggguccucagguaauacuauguccaaauuuuuugaggaacugucagacugauuuccagagugguuguaccagcuugcaaucccaccaacaauggagggguguuccucuuucuccacauccuugccagcaucuccugucaccugaguuuuugaucuuagucauucugacuagugugagguggaaucucaggauuguuuugauuuacauuucccugaugauuaaggauguugaacauuucuucaggugcuucucagccauccaagauuccucuguugagaauucucuguuuugcucugucccccauuuuuuaauaggguuauuugguucucuggagucuaauuucuugaguucuuuguauauauuggauauuagcccucuaucagauguaggauugguaaagaucuuuucccaaucuguuuguggccuuuuuguccuguugacaaugcccuuugccuuacagaagauuugcaauuuuaugagaucccauuuguugauucuugaucuuagagcauaagccauugguguucuguucaggaacuuuuccccugagcccaugugcucaagacuuuuccccacuuucucucuuauuagauucaguguaucugguuuuauguggaggucuuugauccacuuggacuugagcuuuguacagggagauagaaugggucaauucgcauucuucuacaugauacccaccaguugugccagcaccauuuguuaaaaauguucuucuuuccacuggaugguuuuagcucccuugucaaagaucaagugaccauagguguguggguucauuucugggucuucaauucuauuccauugaucuuccugucugucucuguaccaauaccaugcaguuuuguuuuuguuuuuuauuguuuuguuuuguuuuuaucacuauugcucuguaguacagcuugaagucagggaugcugauuccccuagaaguucuuuuauuguugagaauaguuuucacuauccugggguuuuugcucuuuuuaacucuauaaagaauugauuuggaauuuuaauagggauugcauugaaucuauagauugcuuuugacaagauagccauuuuucuauauuaauccuguuaauccaucagcaugggagaucuuuccaucuucugagaucuucuucaauuucuuucuucagaaacuugaagaucuugucauacagauauuucacugguuugguuagagucccaccaagguauggaauauuguuuguggcuauugugaaggguaucauuucccuaauuucuuucucagccuguuuauccuuugaguagaggaaggcuacugauuuguuugaguuaauuuuauauccagccacuuugcugaaguuguucaucagcuuuaggagucucuggugguauaugagauuuugucuguguauguauguguaucauguuugugccuggagaggccagaagagggcaucaaauccccuggaacugcagguauggaugguugugagcuaccauacgggagcugggaacccagguccuguacaagagcaacuaguauucuucucucccgcuccacaugcuaaaucuugaugagugaaaguguuauacuugguaaaauguacugauuauuucuuacgagcaugaaaucuugcaacuuuucaaaccccuggacuacuguuacccucaaaugcagucucugaaaggcaguuucucagcgagguuuuucagguaccagggcagcagcucagcagcucagcagcuagugacuuagcagagaaagaaacagcaggcauuuggcuucaguuuuguuugaaugauccugcuuauuuguuuguauauucuguuucucucaucaaugaagugcuuaauuucauacaauucccagcaaagugaggaaaggcauuuguuagucucugcaucaguacgguuauuuauauauucauaaauacaucauuuuccugucagucaauauaacucuuguacuaguuucaguggauauauuugcuuuguuuccaaaugacuucugaaugugacacuccuuucuccaaaacaaagguugaaucugcguggaccaucagaaagcugaguccaacacucugcugguuugagguaugacuucuacuugaaguaguucagaaaguuauuuuucuguucuucuuucuuuuaaguacguuuuuuuguuguuuaaauguuuuucuuacuauuuuuaaauugggaacuuuuuuauacuuuuuaaaaaauacacuugcuggggauagcgaaaucagguaagcauuuuaagaauuuaugaauuguggaggagcacugagaauucugggauguuuggggaaacguggguggagcugcagcuguguuaaugagcugaggcucagaguucaaaguggaaaacagaccuagaugguaauacugguuuauagcuguuauuuauuuuguuccucaguuaagucauucaauaaagugaguauugcugaauuuacaguugaaaaaacuuagaucaugcaccuuaaauaaauugucuugcauucuaucauuuuaugguuagagcuauuaacuuuuuuuuuuuuuuuggaaaaaacaacaaaauuuagugucauuauuaucauuauuuugcagggcucuuaucaugucauguaugugaacaauuuuguggaaucgguucuugccuuucaccuuuauaggugucagggauuaaacucagguuuacaucauuagugcaaguaccuuaauccauggagccaugccacugcuccugcugaccaucugcaguggagugauaauugguuuuguaucuauuuuccuaaagaauaguaucuuaaguuucugaguucggaacagauuguucacuaucaaaguuguaccgucaguucagaugaugcauauuuuaaguuguaaaguagugagugcgaaauucauuacuuccuucugugaggagguaagguucgguccagcacugagacagguaccauaggagagucuuauucucccaagauuaagaguggaccagcagccuugucagcaccucagcucagagcugcuuauaaagccaggaagccuguccucacccucccucaucagauccaagucugaguccauaggcacgccuguccccuuacgacucuaagugauccuucuacacuuguggguuuucagucaccuuugugauuuguugaugcagugugaagaauucugaagugugaugaagugaggcguacgagaaccuggcuugugucggugaucuagguuuacacgguuuaaccaaaccgccacuguucuuucucauugugugcuuuuguuguguaauguacuuuauggagaugacuuacugaggugacuuuucacagaccuggacagacguucaugaaauccugguguccuuuggaaggagaguuuugugcuauccacuuuaucgucauuucaagcuggugcugaaagccuaccgagacacuauaaagauacugcaacuagguaagguaggcuugcagaucugggcauuagaaguuguaaauuuuuaguaagugaagaugcaaucacgaguuuugcucuuuucuauauguaaauaaugaaagugaucaggucccccaccccucaggauauaaagggcacgcugaccuuuucuaagaaagggaggauaaagggagaagugugcagcauccagagcccuucacacugaacauuccauugcucauuauguuuuuuuggaacccuauaacuuucuaggcacugaggucauguggauccaauaaugaggauagaaaauucucuucuccagugaggguuacagcuuugucagagauaacuaaacugacaguuccaguacagagccccagauauuccgccugagaaguacagugauuguuaggaggggacuuguuuccaagacuugggaaagcaaggacguuccaaggaacggcaucacuacucucaagacucuugacugccgcuaaguuuagcaugaaaagucaauacuuucugacuauaagaguauggaaaauuccaggcuucaaaacaaauuccaaauugccccuaacaucuuuaaaauagaguaauucccaagguagcauccauuuguguggauuaguucuggcauauucaucuaaaagucacuuucgguacuuccuggccuuuguuuuuugucccacccaugugugugguggagggucucuuuccuuugcccuuauaaagguuuauugaagagcaaguuuucauucuuuagcaaaagaagggauguccauuuccuauuuccuuaagaaguccaggacuggacggcucuuccgaaggucauaaguucaaaucgcagcaacaacaugguggcucacaaccaucuguaaugagaaacaaaaaaccugugggcuggagugagcgaguggggccuggagggagaggggggccagaguuaucgggagaagggaagggggaaagggggagaaaaaaaaagagagagaaguccaucucucauauccuuaagaagaaaagcucacccccuuauacauaagggaaauucaucccccaaguccaggugacuucacuggauuguuagggacagucacuucuccaguguuuugucccaagggacaccuggcuuuuugucuucagugugaccuguauucuugcugugcaggauauguacuugaaguagaucauaauugugaaaaugaaucauaguuaacugaaagaugccuuuucauucaccugauagguugagacuagcaguauuuuacuuugaaggauuguuguuuaagauaaaugaauaccauugacagaucuaucucguuuaacugugggaaacaagcugccuuuuuuuuuuuuuuugauauguuuuuuuuuuucuugcuuuccauccaagguauuucucagaucucuaaaauuaccuugaaaaaucaaucuacucuaaaugaaugauugucgagcuggaacugcacaucacaauuacuugcucuuuguagucuugcaggauuuuguaagcauuguuuauagauuuaagcucggagacucuaauguuguggcuuccagcaaagcugucgcaagcuuucccauguguguucccacguacauccacucucacuuucacuccuaugaacuaugucuuguuacuuuuuauucugggaaguaaucuggcauucuggauuuuuauuugaaaaguaaucaguucugugauugcauaacccaaaauaaauuugauugccuugacuuagagucuaaucaauuauucaaacaguuuuaguagguuagagcugaaauuaagacuuaacuuuucgucguuaucgcucacaagaaauagucuuaucagcuguauuuuguuagcagcaggaaacuugaaauaacacagcagagccucuguugaaaaugaauaugauccaacuaagccacggugcuggguccugugacugguguagguuguacuucguguggaagcacagcacuggauuguccugaacuugugcuauuggaugugaggaugacaagcucugaaugaagguugugaccuguguuugcacagguggauggcacagaaaggccauuauuaucacugaggaaucucaucgguuuggauacuccauaaaauaaguagaaauagcaccaacuuggcauauggagcuuccaacaaugaguuuguaucugcuuagaguucagaacacagcccgagcagucacacuuguguaguaaaggucagagagugcuugcacaguaggaaguaaugaaugccucuuccccagagacacugaucucaaguggauguuuccagaaccaacuggggaugcucaggggccacagaggugacuucaugauaacuggcuaagugggauuuuucaaagacccaugaauuugcuuuaucugacuucacaacagccuuuacaagggugcuuuacuggcccugaguaucuuuggguuucuuggauccuucccuccuuccaucuagagaaggcugcuuaucuuguugcacauuaacccaaacuugcucagggugggaaaccugaccucgcucugauaagugugauuuaaguguuuaacaaagaaccuagcccuuuguuguucuccccuuuuugguccuuuucggagaacaaaacucccccacuuguauucucuguuacugacuccucagcaaaaucucugccucuuccucguugguuucuuuuuaaagagcgcauagaaccucccuggagccauccuucagcuguugucagucagcuggaaaugagaaacauugaaagaggacaguuuccagugugccucaguuuuagucuacuggaagccacacaucgucgcauccgacacucgauggagcacacguuguacacuuuacugagcaugugggguccugucuuuaucuucuagacccuaagguucuuuucacuucugcuagaaggcugagcaugaugggccgggagggcacaacugguuucaccacugagcucauucugugcccccaccaccuugaacagaaggcauacgugccuccauagggucucugacacuucagaaucuauauauacaugguuuuccccaaguucuaguugcaaggggagucuuaauuucaguacgugaaaauuuugcuuugcauguguaaagaggaagccuugguggucugguuuguucuguuccguguugcggagcuggcagugagugggacagcuguugcaggaagggacugcagguggccuccaugccugcugacuuguccguggguuccggagaccuagacgccaguccuaaugcuugugcagcaagugccucauccacugagcaucuccucagcucuagaaaaugcuuucaaaggucaguuguaggauauccccaaauuagaauacuaccagaggaauuccuuuagacugacuaaugcuagcaugccuccuuagaccuuguaauuuucauuguuuaaauauauucuguacaaauguucuccagucuguucagcaaguguguguggagugccuaucgugucagacuccugacaacgcaguggcuuagauaggggcuuaaggauucuauuacguguuucaaaggauguuuagagauuuucuuggugaggauugaaccuggagccugaagcauucuaggaaagugugcugugcuacuccaaagguuuuugguuuaguuuuugaauuguguguauaaugaaaaucugagaagauaaaaaauguaaaaccagggacgcugaggcguguuaccuccuacggggggggggggggaguuccugcuauauuugacccccaugucuuagcuccugccauuuucccagcacuuaucaaauuaacgaguuuaucuauuaauugauuuuuuuucaacagacauuuuaaaugaguaccuacuuaaaagcucuucugugcaaagaacccaguaaacauuaaaagcaguagaaggaggaauuaguaucuuugcagcuguugcugauccccguagcggcuugcuucuagcucuggucagcaccauaguguuuuugacauaguggcugauggugagucccuaggcuguaucucuuucacuucuuuguagacaaaguuccagagacagcggaaaaguuucauacucugagcucaggagagaaaggauuuuauuagaagaguucuuuuugucauagaguuguuccaggacucaugugccaggguuagugacuauacucuuauggugcugguggcaaguucaccugagggaagaaguuuuaggguaagaacuucauccugaaguguaugaucccgguauguugucauggcaaaugcuggacaggcacaaauccuuuccaguguuguaugugcacugcugagacugcgugguugggucgcuaucacgcagucuuuacaaaggugagaugaggcauaagcaucagggaagccggcagggagaucccuauugggccggcaagugaggacaugguaacgcuuuuaacuuacgugcaucuuagccacuaggccauuccuucugcagcucauuguauauuggcacccgucugcgcacaauuuccaaggaucuuugugcucucccugugguucuuugguguccuuauggguuugguuguuuuguuguuguuguauuuguuuguuuguuuguuuuuauuuuugucaguuugacauguuuaaagaguuuugugggaagaggaaacuccauugagaaaacaugucucucagauugccugugagcaagucuguggggcguuuugguugauugauguggaagagucccgcccacuguggguccugucuuuccugugcaggugggccucagcuguaaaaaaguagugauagcacacaccuuuaaucccagcacuugggaggcagaggcagauagaucccugagugucaggacagccuggcccauauagcgaguuccaggacagucaggguuacacagagaaacccugucucggguugggguacgguucggagcaaacacaaacaaacaaaaagaacgcacauucaaagagccaugaggagcaagccaggaagcagcuuuucuucuucuugaucuuugcuucaguuccugccuccaaguuccugccuugaguuucuacccugacuuccccgcuuggcagacuacaagcuuuuaaaggaaauaaucccucuagcucccauauugcuuuuggucauggugacuuuucacaguagaaaccauaacuaagacauuuggguuacauauuuuccuuauucuucuucaaggcuagcuguauugcagagcuaagcuuacgauuuugaauaaaaacuaaaguaagagggggcauaagccuuagugucugugucacuaagaacggagacaaguacuguguacuagcaggcacacagcacuuaagcagguacccuccuugaaagaaacauucacuucaacaaagggagaaggaugauucacuugaggucagacaaguccucggggcgacuaacuaauacauccaguucuagauacaacucacuuaagcccuaauuaaaaucuuacaggagcaagcuuuggagcaggagucaacuccuaaaucgggguaccaagccaagaauguuggaaaauguagggauggugagugagccagccugagcuacuguagggauggugagugagccagccugagcuacucucuaccuucuccccccucgagcacagaggcuugaacucuuaccuguuccuuagagagccaguguguucugugucuucagugguucugucuuucugugcaugguaguuaaccucagagcacuugaggauuccuaccugugcccaucuagaagguuguugaugcacaacuguaagguaagaagaccauccacuaauuucacagaaucccagccucucuaauaacuccugggacucucuaagcaugguuagcuguuaaaaauguauagaucguucucaugguaauuuguuaaccuauaauuauaaguaagguuuucuuguucacuuaaaauacaauauagggggcagcauuucccacaugguugguuuacauguuacaaauugccuuuuaguuacugugaauaauuaauaguucaagguuaucuugguaccaacaaaucacuuaaaaugugcuguuccuugaaauuugaguuauauaguagugcuuacugguaaugauguucaaaucaaguuaucauuaaauccuuucagagcauuaaccaucuuuguuauauuuccugcacauuugguuuugcuagguuuugcuaguuucuuagcugaguaauauaaaaaccagaaguuaguuauauuuuugaaugugugauuuuuuuuaaaaaacuuuauaauuaguucucuuuaaauaucuaacaucaguuuuaagccuuuuuuugaaaaugggaguaacuuucauucuguauuuuguaagaagauaaaggcagaaaauuguauuuauuuaaaaugaaguugguagagagaggggaaagcuuuaauuuaagguuuuauugcauguuaauauuggaacuuagaugaaaugaauugagucauuuuaugugcccccccccaugaacaugcaagaauucuauuugugugacuguuucuuuaaauaagaagcugauuucuaaauacuagcaagugacacgcaugcauguguucaguagacaugaaucaacucuguuuugugugcagggcauuaaaacagaaucaaugaagaauauaagauucuguacagcuugggcuuagccuaugaaguguuuauugcgugacaggaaugaaggaacaaaagauaagaccugaaauauaagcauuuguaagauaaagaggccuggcgaugggugauaaaugacucaguuggucaaagugcuuacccuacaaguuuaaagacucaaauuugaaucucuagugcccacauaaaugccaggugugcaugguggccugcauuuaaucccagcuccugagaaguagagauaggauacccagagcaaacuagcuagccuagcugaaugaagugcucuggggucaaguaaaagaccuugccucaguguauaaggcagagagcagucaaggacaacaccucgguccucugcaugcacacacauguguaccauacauacauacauacacacacaaauguguaguuauaagacaaaagguauguauaagauaaaaaugagaugauuucuuaagaaaauaucuuaacuguaccuaacaaacugaaucuauccuguuugguccuugaguuaaguaaaaauguuuucauauuuuuuuacuucguuuacuuauauguaggagggcuauuaagauagaguaucauauaauccaggcugaccuucaacucuucaugagggugagacuggccuaggacuguugaccauccugcuuuagcuuccuuccugccagugccaggauuuuaggcaugugucauuaugcuggaacuuuuuuuacauuuuuaagugguuaaaaauagcauaagaagguaguaccuugggucuggcaugguggcacauacccuuacucuugguaccuaggagaacaugcaggaagacugcaaguuccugcacaugggcagacuauguccccaaagaaagucagaaacaguguucuaugacaugaaaaugauauucacuucaugguuuagugcccauaaauaaagucuuaucagaacacagacaugccuagucacuuacauauuuucuguggcugcuuuuauaguucaauggcauggucaaucaguugcagcagagauacagccuauaaagcuaaaaugucaaguuucuagcucuucacagaauagauuuaccacccuugccucaaguuuaucgugaaggaugggaggcagcccucuugugugagccgaggccaugggcugccucccauccccaacagcagugugcugacacacauuccuuuccuugcagucccucccugaaggacaagcuggaacucaucuguuugcuucccaguagcauaagaacccccacacuaagaaaagcaagcugagaugcaguagagcaagcaguaaacaaauaaggcagcaugugugaaaacacugaugaggccugggugagcugggaagaucuguggcccugcugccauugcugucacuguggucuguguagucuugccccucugcagggcuuuaaaggaaguagaaaguuagaacaccaacuguugacauuuuaaacagucaccucucacacaacggcaagagaugcagaugugacaggccacuugaaguagcuaacucuuuccuccugcacacuuguguuucuucucucuggcuucauacaguugcuuccccaauuuaaagcugaaacaguuccuaaagaugugucagaacuuuuguuauuaaguaguaucugauacuaucaauucaaacagccaaguuuuagcugaacauagaaauacguggcauauuuuuagaaugaaauuguugaaucaaauugugcugaaauauuuuugaaguuuuuaguauauuuuaaguauagguuucgauagcagguauuucaagagcucuguaucuucagcuucuuguccauuuuuaaauucacuauguaaauuggaauuuuuaaagaauucuaccuggaauuugaaugucuuauuccuaacuguuuaaaugagugagaauugguuaugcagccaucaaguaauucugaugacauccggcugugugcuuagagacguuacuauccgauguuuccacagacucugauuaaggguuguaagaacugaaguuuugugcuggugcagagaggaaacggugcagcugaguuccagggcauagauguaauaggagaagaaguuuggaacaaguuguauguuguuggaugaccuuccccaggaagacagcaaaccaaacaaacaguucuacccaagucuaguuuagugcacccgugagcuuauugaaguuacuuagaggaucacuggggaggggcuucuuauaagagcagggugacuaaagacaguagagucaccaagagacccagcccagagugaguagcguucuuggagcucuuugcauaacuuucaggcagcuuaccugguccuagagucacuucuuuuccucagucauugcugcucuguagucuugugggcucccaucuucuauccaagaugaauuacaucuacauaguccacucuuuccuucaguuucuacuuuuuuuuuuuuuuucugccugcucuucuguguucccugaaggaggugacauggaugaucugguuauuuucuuccuuuuauagcugaguacugggccacuaaugacuguuacagucacuuauucuugggaaauucaucaaugauaaggcuuuacagaucgccacccacugcaaaaggaaaguuccccuuuauacuugagacuacacuaaugguuuaugggugugaacacaaauguuuuagaaagcagucuacugggcacaagacaccuuguuaguaaaacaauagcaguugcuuccccacuggagucuagccauaggucuuugcugugauuuacgugccagacaugacuucccuccuaugaagagggccuuaacuucagucagcaagccaucgauggcaccuguaacagucacaccacuguuucaguggacucuuuuuguuuguuuguuuguuuguuuuuguuuuuuccuuuuuuuaaauuagguauuuucuucauuuacauuuccaauccuaucccaaaagucccccaugcccuuccccccacuccaccccccacucccacuucuuggcccuggcguuccccuguacuuaggcauauaaaguuugcaagaccaaugggccucucuuuccagugauggccgacuaggccaucuuuugauacauaugcagcuagagucaagagcuccgggguacugguuaguucauaauguuguuccaucuauaggguugcaguucccuuuagcuccuuggguacuuucucuagcuccuccauugggggcccugugauccauccaauagcugacugugagcauccacuucuguguuugcuaggccccggaauagucucacaagagacagcuauaucaggguccuuucagcaaaaucuugcuaguguaugcaauggugucagcguuuagaggcugauuaugggauggauccccggauauggucgucucuagaugguccauccuuucgucccagcuccaaacuuugucucuguaacuccuuccaguggacucguuuuaauggaaagauaggcaguguccuuaaccaaacaggacugcugguggcaguucugccccugcagccugcuuaacauccuguagcauugugaaagcuagcaagcaagcaaggagagagcuuccagcucauuccagccugacuucuacacauccuccugccaaaguaugugguuucucuuagcagcaguauaugguuucucuugccaucuaauuuuggcaugcaaccaacaguaguagccuuuaugguuugcagggccucaggaaccuccuuggcuaacuuguagaguaguaacuaucccuagcacugggauugucacccacuguuauggcuccuaggagugccuuuuucuaccgcugugccaugcuuuuguuuaaacucucuaauucguuuuuauuguuauuccagaugcuguucacaucuguaaggcacacaagggauaacauagcaauauauagugaagcuuuuuuuuuuuaagggagauaguuaagccuuuuaacagaagaugguaagaaucuuugaaggccuaacuuguccccuccaaacaaguacucguaguaaaagaaaucuuuguaaggucuaguauaguacaaaaugaccucaucaugugcaucaauugcuucaucaaagaaccauguugaaggcucagucagcuaagugcuugccaugcuggcauagggaccugaguucagaucucuugcaucauggaaaaucugaacguggcagugcacaguguagacucauugcuagggagauggaaccaggauuccugggacgugcuggcuaguuaaucuagaugaugagugaacucucauuucuauagguugagaagugauugaggaugacauccaacauugaccucugaacucugcacucacaaauguaugaguucuagcaggucucuuguauguguacacacaagaucaguguugaguacaguggcuuauagaggauacuaccccaucuggucuucccuagucgguaguuguucuucaugagauaucuggguugacugaucuugggguacuguugcaacugcugcuguggcugugagucuguccaccccaguggucucuguggagccagcuuguacugcucagccuagcucaaggccaggagggaccagggcuuugcuacagccugugguuggcacuagagucgacauguguucugacaggcucugucuaccacuguggcacuuuccuguucaucagucuaccagccugugaacaaaggcugcaugaacacauugcauguucuggaugugaacugcccaccccaagagaagcugcaucuuugcaccugcggugcugcgucuuuuaugucuucccugaacugugcugaggcuuuaaaggcgucagaaguuaacuggcacagccucugccuucugaucgucuuaggaacucucucgacaaaucuagcagccugcauagacuccuuugucuacuuugacuuuuccgccccucuuaauugcuuuugcccuuuacauaccugguuuacagucugggucaucccagucugccagggcuucuccugugucaggauugugucccaccuugggguucagcaacaccacuagaaugaaguccuucugagucacucccccuuucccucuuuccucucucacuucacuuuuauuuuuugauuuauuuugauauguguaucuauaaguagaaacgugcauaugagugcaggugcucauagaggccaaggcuucagaucccugaggcaggaguuagaggugaaugugagugcccuaguguggcugcugggacccuagcuugggacuucugaagagcauugugugcucuuauccacugagccaucucuccagccuuucagcuucuuuucuuucuuuuuaaaaaaaaaaauuauuuauuuuuuaaauuuauuucaaggggauaccuuuaccugguuuuccccccucccagaaacccccuaucccaucucccucccccugcuucuaugaggguguuccuccauccacccacccacuccugccucccugcccucgauucaccuacauuggggcaucuauugagccuucauagaaccaaggaccucuccucccacugauuccugacaaggccauccucugcuacauauguagcuggaaccaugcguauuccuugguugguggcuuagucccugggagcucuggggggucugguugguuuauauuguuguucuuccuaugggguugcaaaacccuuaagcuccuucaguccuuucucuaacuccuccauuggggacccuucacucagagcaguaauuggcuacaagcauccgacucuauaucuguaaggcucuggcagggcuucucaggagacagcuauaucaggcuccuuucagcaagcauuucuuaguauccacaguaguguauggguuuggugacuguaucuggaaugaauccucaggugggacagucucuggauggccuuuccuucagucucugcucagucuacauauuuguuccuaugaauauuuuguuccccuuucaagaaggaucgaagcaacuauacuuuggucuuccuucuuguugagcuucauguggucugugaauuuuaucuuggguauuuggagcuuuuaaacuaauauccacuuaucagugaauguacaccauguguguucuuuugugauuggguuaccucacucaggauauuuucuaguucuauccauuugccuaagaauuucaugaauucaucguuuuuaauagcugagcaguacuccauuguauaaauguaccacauuuucuguaucaauuccuuugucgagggacauaaauaaggcugcuaagaacauaguggggcauguguccuuguuagauguuggagaaucuuuuggguauaugcccaggagugguauagcuggguccucacauaauacuauguccaguuuucugaggaacugccagacugauuuccagaguggugguaccagcuugcaaucccaccaacaauggaggaguguuccucuuucuccacauccucaacagcaucugcugucaccugaguuuuuuaucuuagccauugugacuggugugagggggaaucucagggugguuuugauuugcauuucccugaugacuaaaguuguugaacauuucuuuaggugcuucucaguccgaguuuccucaguugagaauucucuguuuagcucuguuccccauuuauuaauaggguuauuugguucucuggagucuaauuucuugaguucuuuguauauauuggauauuagcccucuaucagauguaggauugguaaagaucuuuucccaaucuguugguugccuuuuugucuguugacaaugcccuuugccuuacagaagauuugcaauuuuaugagaucccauuuguugauucuugaucuuagagcauaagccauugguguucuguucaggaacuuuuccccugugcccaugugcucgagacuuuucuccacuuccucuucuauuagauucaguuuaucuguuuauguggagguccuugacccacuuggacuugagcuuuguacaaggagauaagaauggaucaauucgaauucuuuacauguuggcugccaguugaaccagcaccauuuguuaaaaaucuucuuuuuuccacuggaugguuuuagcuccuuugucaaagaucaagugaccauagguguauggauucauuucugggucuucaauucuauuccauugaucuaccugucugucacugcaguuuuuaaacacaguggcucuguaguauacaguuugaggucagggaugcugauucccccagaagcucuuucauuguugagaauaguguuugcuauccuggguuuuuuguuauuccaaaugaauuugagaauuauucuuucuaacucaaugaagaauugaguuggaauuuugauggggauugcauugaaucuguagauagcuuuagacaagauggccauuuuuacuauauuaauccugcccauccacgagcaugggagaucuuuccauuuucugaggucuucuucgauaucuuucuucagagacuugaaguucuugucauacagaucuuucacugguuugguuagagugguacuuuauauuguuuguggcuauugugaaggguguuguuuuccuaauuucuuucuccucuuacacggaacuuccucuuacugccugccuuuuauugucuuaaugaaauucaaggagaccuuagcuagugauagccaaggcuuugugguggugcccaugccagucuauggguccugcuauuguuugcauuuucucugucuuggggagagaugagugauuauauuccuuagugucuugguuauuuuucuauugcuaugauaaaacaccagaccaaagcaacuuauuuaaaaaaaaauuauuuugggggucacaguuccagaguauuacagucuguuaaccauuauacugggaaauauguggcaagcaggcucggaacaggagcaauacuugaaagcuuacacccugacccacaaacaggaagcagagugcuaacugaguugguaugacauagaagccuccacccuuaccaaugacauaccacgucccacaaggccacacuuccuaauucuucccgaauaguucuaccaauuggggaccaaguauuaaacuauaugagccugugggggcauucucauucaaacuagcgcauucaaguuucucugccucuauggcacuguggcaggacauaaacagccacuucuccuguacucaccuucaguucuguuggcccuguuugcgugucaggugcauuguaugcuccuuccuggggagacaugggcaacuucuauucacccuagauagggcacugaccacagaccaaaggaacagcucgcuccaugucucacuuaguaaaccagugagcuucuugcgucuacuuacaggcauauagacggagguucacucucaggaauauggugacucaacaugcaggcagcuugacugguccucucucccuagcaacugcguauugccuuuuauaaccauagagguuuuuggauguuguaacucgggagcuuucugacgccuucaggccuucuuuccuccuggaggggguggucccugacuagguggguuucguauuugcuuguuuuuguuguuuugaggguaauccuccugugcuggaauuacaggugggaggcccgugcuuauauauaauaauacaguaagcuugaaauaaguccucagagguguuaccacuuauacauguuaaccaagcagucugugcaagggcguaaauguuagcguccgucuacuccagagugcagccuuuauugaacaggaacauacaguuuucuggacauuguuccaaucuagagaaugaaagaugaaaacucacccuuuccagccuacgaguucaccacuuaguaauaaaugcagacauuguguuuaugacauaguggcugagagucagauuuauuucuucucaaauccuagccaaaucauucauuucuugugaaacaaaaaaggaaguaccuaacuuguaggguuaaugaugggauguugguguuggcucuaauugacguaauagagagacgugcugggcaucauaagggcaccugaaguggagcugaaggagagcuaggacuccguuccuagagagaggaaugccugaacuguacuuggaugauaaauuagacacuugauugagccucgugcauuuccggcaguaacugagugugcucuugcucccugcuaauucuguuuguggauguauggacgugaugugucacuggcuguaauggcaaaggcuaggccuuuaacuggccuuacucugccuaacagugaaucauugucuucagucugagcugcugcuuacucugcagaaaugaagaccuugggugcguaagacuuacccagugagaagcauucuguugucagggacuugacuuuauucuacaucuuaacagggcuugguagugaagcaaauugccacauuuugguucucuuaauuuugauugauuugacagaguguuucuaucuucucuuuuuggcucaaaugaacuaugaaaauuaauguuaaaauaguugcuaagaugucucuuuugauaauaucgucuuaucaaacacuaagaaauuuaccuaggugucugcuaaauuauguugaagaugauaauuacuguugguuuuuguucugauguauuuuauaaauaauaaugggaccuuucugucaguacuuuaaagacuuuuuucuuucuuuuuuuggcuucuuaucuucuguagcuuaaaacauuaaaaggggggcauagucaggaagggcccuugcuaagcaaguauggaccuguguuuaaugcccagcacacauguacaacgcugggguuuagcugcaaaagagaccgugucucaagagaagagacuagaguaucagagcagucuacuuaaugcucugccccggcccucugcucacuggccagcaguagcuacucaccgagcuccagucccaagagaaaugcuguuuccaagaccaggaaagauggcuccuggaggacaacugagcuugaccucugaccuucauguacauagagaagagccagaugccuagaaagcaacgcugaaaagaaaauugagguuuucuuggguguagguagcagcuuacauuauuuuucccuuuuuuuuuuuuuuuuuuuuuuuuuuggcauuuagccagcaaaagcaucuccuacucugaucccugcauggauaggaacaauuucuuaagugccucagccuuaagcuggucugucugucagugagagauuauugcccaaccuggccgcuaacaggaaggaaagcaagccagagagcgugucaaacugugucugugugccaucauuagacagucauuccugaaggaaaacauucaugagucuugucauuuauaguccugggacacugguuuccagugccuucacgggugaguaggaggcccuagauucagggccucuggugacuaggguuaguuuauccagccaaucaguuuuagggagucucugacguugggcccuuugacauccuggggacagaugcuagcuccuuccugcagugagaauaguuaccgugguuaccguucagaguaccuuuguuuuuuauacucuggaguaggcaguaaacugcuugaaaaguggucacuuuccugccuugucuuugagccaaaguaauuguccuagcuuuaggccugagcagcuuuuuuaugcucaugggauguaugaccacagaacuggaggcagggacugugaguccccauaagcuucuggucaccaaccaugugacagccuggaagaaagcuagucuuuuccuuuguggauagcugcggaauaaguagcugaguacuuauucuggacagagagaacacuuggcacaaaagagauguugaaaaccgcagcuaccuacccuagcugugauguggugcucaccacggggaagcuggcugcuagcuugagagauuaaacauggcgucggaugacaauggaggguggaagaggggugagcuuaaugugcuucuuuuagauuuccuggguaucuuuuaccaugcuaugacauagaauuccaugaaaaucguuuugguaaggcuuguggaagcacagccuuuaaagagagcuuaugaguccccuuugcccaagcuguccuguaugugaaaggcaugcuuguugaaaaccucaucugaauauucuuucucaguugcuuaaagacaugaaucacauguuugaacauucuccugucaguauuuaagggcugccugguagaucaugcccaccagguuuuauugaucauauaacauguuucugguggacacauggaaaaagagguggugugaggggugaauaacugcuccuccacguagaccaguacugcgcgcacagugggcucgcacuauugaguuagugacugggccaguacucuuccgaccacccuaaauccugcauuuucugcuaaucugguuauauuaagaagguaugaggccuugggagggagcccuuggggcugucacacuguagagaaguaaaguccaagugaagaggguuuuuuuucuggcaaagaccugugauugcuacuuggaacucuuuguagucagucagccaguuaccuagggugcugguuacuuuuuugucaauuugauacaugcuggagucaucuagaaagauggaagggcaauucagaaauugccucuaucagauuggccuauagguaagucugugggugcguuuucuugauuagugauggauggaggaagucccagcccacgguggguagugccacuucuggacaggugguccuggguuauauaagaaagugggcugaacaagccaguaagucagcaguguugcuuuauggcucuguaugcaagcugagagcugcaagauggcaaguuuaucugguuaagucaagggcaggacucugauuguaugcaauggccaggguaacuguaucaagugauugggguggacacuagaugcagcugauuccugcuugauuucucuauuuuggugaauauuugggacucuucagccacggagagagggcaggaauaagaggcauugccaaggagaaagaguagagguuugggguuggggguguugaaaggaguugcugggugagcaucaugcugugcguagauuucagacuugaaaagggggaccugcuagugugcacaugucucguagguauuggggaucaccucugaaacagcacaaguuuucucuuugaaaacaugcuuuccagccaggcagcugcgcaggccuguaaucccagccacucagcagggaggcaaguggauccuaagugcaaagacagccuggguaacuuuguaggacuguuucagaaauaaagaguaaggggcuagaucauuaguuuuaaauguucuuaaacuacuagaacucugagcuguuuuaaauguaucaccucucaagaucuuaauuucuuaacuaagaaagaagauauuuuucuucuuaaggcugacugaauguuuucaaauuuuccuucagguaagagugcaguuuuaaagugucuccuggauguucacaaagucuuucaggaaaaugacccagcauauauucugaaugaucucuacaucucagacuacuguguauggauucagaaggccaaguaaguugugugucccuggguaauuuuacaugcucgcagcagugagaccccacuuacccggagaaagucaguguaaguaagagaaacccaaagcugcucgacacuuuagaaauggcuggaugcuacacagggacauuaguacugggaacucaucugagcuacauagaaagacugucucagagagggagagagagaacacucacucacacacacacacacacacacacacacacacacacacacacacacacacggauucaggaaagggagaaacaggagggcaagguucauuaagauaggcagcuugauaaauugcuuggggaggugaguguagguagauaaaauguggguauugcuagagcagacagaaugugugacagagacaacuagagggaggagcaagucauccuguggacaguuuagagcaguggcucucagucuguaggucacacccaagaccaucggaaagcacagguauuuacauuacaguucaaacuaccaaaauugccauuauuaaggagcaaugaaaauaauuuuauaguugggggucacguguauuacaggugcacagcauuaggaaggcugagaaacacugguuuagaagguucauggcaaguaaggcaugguggcugggcccaugugcuauggacuugccgcauggcuuccucacgucuuauccagugaggagaaaguggggcgaggcuggaggacuccugguggccugaguccaaaagcucuacagcucccaggcgguuguucucuuaaccaugacagaugcucauagaaggguaugugggccuccuggauccaaacccuaauggugugcacagaauugcuaucucuaaacugauaggacaucucaagacuggguaccuagcccugcaccuauggcagggcugagugugcaugcauguguacugacucuugauuggaaugaucccucagugguauagagcucuugauuggaaugaucccucagugguauagagcaccauggcacaguggugugucagugcuaccuagacgggaaagaagcacuaggcuucugucacugcaguaauugccuuuuaauaccucuguggaugaccugugaucuggaauuauuucuucuuucuguucaugaggaagcaaugacaugagaguguagugugaaagccaccccgcggccuguugucuggagggugcucggguugcugccgacaacaccucacucuguggcauguggaggccacgucuguggugaaaagcugaauccuuaacccuucaggucuuaaggcaggccacaugacuucauauuccccccccccccccccccccccccgcugacugagcuuaucagaucccgugcugcccucuccugguguugcucuguuacuauuauuauuucauaauacaauucagucgcaguagucacauguaggugauuugucucucaagagcagagcuuguauaaacuuguaaugaguguggagguuggugccaggaucccauuuuugugagugcuucucuccacauugugacauuccuuauuaaauacagagaaaacuacauugcauuccacagacagcucuaagugugcauguugcuguggagucaccagauguacuuacucuuuaagggucuuuuuuuuuuuuaacacuuguuuuaagucauaggaaacagcagaauucauagguucucaggaauuaauuauucuggugguaaugauuuuuuuauuuguuuuugguuuuguuucuaaaaggauaguguagucaacaguaggaaagaagagagagcuugcagagacucaacaauuuuguaaacuacuuugcuucuucuacuucaccaauuggaguguaccuuuucuuucccuaaauggacuauguuguuucacugugauaaaauuguugauagccuagcuauuuuuccucuuccuuuggaauaacacuuuucuuaaugcaucugguuuuuauuaaacuuucuaauuucagccuugguuuuguuaaguacagcuuagaugaucuuucuuguauuuuaccuaugaaccaucucacuucugaauuaacccccgggcagccucuuaacuauuuuugucuucaucuuuugcugucuuauuuuauauaguuaaaccaccacauuuuuauauuacacaauaguuuauauuuucuuuagucuauacuugauaguuuugauuguaauaauaaaaagcuguguaacauuuucuuggaagaacuagacaaguaugaaauucugacuugacccaaaacggcauuccaguuuuccagccagacauuuacuuuggcaaaagcuuauugaaaugcugucauucuuauacugaaucaaaggagcuauggcaacaaugugagguuuaccccaggaggguguuuugcuuuucuaugcuaucugcuuuuugugaacacuuggauucuuaauacaaaauuaugaguuggcgaauuaauuuuucuggggaaaacaaaaaagcaucccuuguuuccgucaguguucguggcacugggauuuccagcguggugucugcugcagcauacauuuccugaguggcagcagugggaggauuguugguuuuucuugcagugaugauaacgauaggucuauaacagugcccugcccugugggaucagauaguuucccagauaugccauguguaacaacuaguugucuucacucgugcacuguagaagugaagucaaagaaaaagugcucccucuaggaacuuuuccaggaagaaggggauuuagugaagcauuuguucuguuaguaggugcucccuuagcgcuugguugagaggucacuacauacaucguaugccuuugccauaguggauaagcuaagcccucacaucuucuaaaaacuucaagagcccugugaaagaacauuaaucugggucuaucacuguuucuugugugcacagcaaauuuuaguugaauugaaugggcccuguuaguuaaaggagacauuuuucguugcuaaaauauguagcucuggggcugauaagauggcucagcaguuaagagcauugguuguucuuucagaggacugguauccaauucccaacaucccccaagguggaucacaacuaucuauaacuucagauccagugcccucuucuggccuucacagguauugcacacauguaguacacugacauacauucagaccaaacacccauacacagaaaauaaacaaaaaaaguuuuaaaagcugugaagugggacuccggagauugcucaguagggaaagacacuugucgaacccagcagacaacuuugaguuugaucacugggaccauaguagaagagaccaacuccuagaacuugucuucugaccuccacacaugcaccauggcauuuguguaaaugcaugcacacacacacacaguaaagaaaaugcaauuuuuuaaaagcugcauccaucaguuauagcuuaucuuuguugagauuuucaguucuguucagugcuggcuugcucccugccucugagucuuucaugguggcccaccguuauuaguucuugcaguucugucauccgagaacuuggcaguuuccacccuuugcguagcgcaggaugguaagagugaagcagugcucuccggcucaguucucacugcccugugaccugggagagcucucccucgcugccuucaaugcaguuauuaguauucaauacuuccuccugcuguuucuuauuuguuuuauuuauuuuuuauuuuuugagacaggguuucuccgcauugcccuggcugucccggaacucacucuguaaaccagucuggccuggaacucagagaucugccugccucuaccuucugagggcucccuguucauucuuguacaugucuguuuguaacuuaauaguuuucaggaagucucuucccuuuacaauguaguuuguaguuucuauuaagucuuuuucuuuuuuuaaauaagacacuccucacuguaaaaggaggugcguguguguccaaggaagaggauugacaauaacugacuggguugauuuuguuuggguuuuacuaguuugaaacaggauuucuucagcuucccucgugcagggauugcaagcaugcuuuacccagcuggcuuaaaauguacuguguggcuuuaauccacaguacauuuugaaaugacuaagggacaaauaaugaauuauuuuuguucuucugcauauaaaauuuuugguauuuuuaaaucuaaauaaaauccagacuauccucaguauaaacauaugaauguguaacuaauuggguaguauucucucucuagugugguacaauuuuguugguuuuucuuuuuuccuuuuuugcaguacuggggaaucauaccuuugucccugcaugugugaggcaaacccgcugccuuucagcuaacacucuaacucaacuaguauagcauuuugcuuucaagguaauuaguugugcagaaaaagaauuuuaaaauguguccugggaaugcuggacuuacuuauauugagcugauaguuaacuaauacuauugguauauuuaaauucccacucuauuuuagcauacuuuuuccucagaagcagucuuaggaucccaaagauacugaagccagagucugugaagcaaacaguuuuguuugaguucagaaaccucuaccugagcuuuggcaauugcaagugaacugaagucauuucugugcuaucucacaguuguggaggcccaaggccucgcugaccugcccugcucugcugccuccaggccugugugcuuagcugaaugaggugugccccgcuugcuguggagcaagcagaggcuugcuuuuuccuggcauaucuucagcaggagggugugggguuggcucauauggagggacagcauugguacuggauaguuuauggaauauuguaggcuucaaccuuguugaacucuaagaugcuaagacagccgugggaaugcgcuggugaacaaagaagguauguugucuagcgguacugagaaguuacagggccuugagaacugaguagcugcagcauguuuaacccuuucugugaggcagcauuaauccccacaguaauggacugguucuacauaaagcagguuauuauaaaugggaucggcucccucaucucuucccucuccucugccaggcccauuuuguucugauaguccaucauucacagguuagugcacgguucucacuggaagaagauaagaaguugagcuagagagcuaaaagauaagacugucgugcugugcuuuuagacuuguugaacugggagccaaaauaaaccucaaauuacucagucugagguaugcuguaaucgcagcagaaaauggguuaagccacaaaagacccugacuuaagaucuuaaggacugaugacaguuaaucaaacggcuggggauguagugcagugguagagcuccugucuccuguguguucaauucuuuuuuuuuuuuuuuuuuuuuuuuuuucaauucagucaauuguaaugaaccaaagcuuuacagaaaaauuaaaaugucacaagaaaaaauuaaaugaguacugaauaauuugcaguuuguagcuacaaaaacugcuaaaaugcaaagaucuuuuuuaauauugccuaugaugaaauaaaauuugaaauauaguaacugagauaccucuuugugcaaagaaauuaaacugagcauguacggugucacaacaagugcucuguaaguuccaaacauaggcauauagaauagaauuucaaugaaagucuuugauagucucacaguauuucuuauuuuguuuuaauugcagucuuauguacuagcccaggcuggccaggaacuuguaaucgccugccucugccauuaccaugccuagcuuaauaacucccaauuuugcuaccaugauauggcuaccauagcauauaucaauguaacagaaauagcacagucucuuaagacacauuccauauuuuauuuacauuuugagacuaacuuucaucucaaaaucacauauccauacaccuauuuccuuuuuguugacuucacuuaaaacaucuaagcauguuuuacuaaacaaagacuguaaacaaauuauuaugucuguuacauguaacaaacgggaacagcuuuuaacagaaauucaaaaccccaacaccuuuuauuauaaauacagguaucaaaacaauccugaaccuauguuuguacuaauaguagucagcacccacaccgcuucaagaauuaacacaauuguugacuagucauuguaucugcuacuuuaaacaauuccaacugcagcucuaaauaugauaaagcaugccauuucuguucuuccuucuugagacuuuacuuuccagaaaaacaaauguuuccauggccacaugacacucuuuugucaugcuuuugucuugaaagccugaacuccauuuugaguacuucagguucauguuuaaaugacagugcuuuaauagaaagaaaaauugugcugcacgucucuuguuaccugaaaacauaauagguguacauauauuaaauauauucuuacaacuguccaggucauguuuaccagcugcaauucuuuuacuuauuguguggguauugugcauggugauauuuaaucaagacauuaacaugaguagaagguugcugauuuaagacaaguuugagauccacuaaaguuaguuguuguacgucuguccuucuggaggcuguggaagcuucauauuuucuuuggacaucauaagacgucuuagcucuugaaguaugacuuuaaugcuauaggaauuuugccauuuugcuaauacugguaugcuccgugcauccaccauuccacuggaauuauugaucccauucauauuaauuuuuguuacaaaucuaacugauggaggagcuucuggguauuuagauccacauucuacuuucaggcuauauauucuguuuucauaguuuguccuugguggcccaauaaucaugccuguccaccuuguaagugucaugucuucaucaucuucaaggccccagcuaacaguaccaucaccuacuccuuuuuguccuucuucaaguucuuccaacaagcgaaaauuacgaggaacuuuaacuccuguggagaccgccaucuucuccugcuaccagacgcaccaccgcacgcagggccguguguucaauucuuagcaugaaaaaggggaguuaaaaauaauggcaugggcauaugauacuagcacuugaggaauugaggcagaagauuggagagcuugaggcuagccugggcuaaguggugagacccuaugucagaaaaccagauggugugaggaaaagagcaagguaucagacauaggaaagagugcguggucuaccuaagaucucacaaaguaguggacagaacccaggaugggcauacgaaggagagagaugaggcuggaggcuccauggaaaccgugaccccuucaucccagaaguugagcagcaaaaaaccugaagcuaaguggucccuguaugagcaauaccauccgaucucauuguaggaauuuaggggugcggggacgggaggggggcguaaagcugaaagacuucccugagggcugaggaauggugacuggagcuugggugauugcagcaagagggaggcaagcagugcucagagucagaagguaggcaggucagguaacuacaugggcaggcucaagagaaggggagagggaggcaagagaaagccagguucugaccauugaaggugccuuugacaagauuuaauaauacuggagagguuagguugggagaaacaaagagagcagucuuggaaaugcugccucagccuuuaaggaacacgcaggaaaacaugccaagaacauuuggaucacagcugggcaagaugucuccagaggcacuuagacagagaaggggugugaauuaaacagcaacgugaaaaugcugucugguugccugggacugugguacuuaugugacuauaauaacgaucauuccugccugagaaaagaaccgugcagggagacagagcaugcuacccacaucgccuacguguagcugugguuagcaggagggcaagaguggacugaagcugcuuaugcuugggucacucuauccuuguaguccuccuucacugcugacugagccccguccuccgucuuaguuaugggguggcucuagcggauccugaaguugcuaguucucuugguuucagucacaugauggaggagaaacucacuugggcuuuggcaguggcaaccaguuuguuacuagauggcagauuguccucuggagcccaggugcuagaacauggcugggccuaggggacucaggccucgcagagugagacaguggccugcucuggccgugcacccggaggcugcugcuucacagaagcucucagaggagccaguagccauccacagcccugaguuuucauggccuuccugucgguggggaugguguagauccauugcuuuguaauucuaggagacgaagaagggguuggccccacugcucauucucucuucuguccaauaaccucggucacggcagugugaagaggugagguacucgugagauggguuaugcuacccagaguguaccagaaacaugcaccaccucaugcagagagagcuguagcuggggagugacaggcucucccuacagccaaggacuucuggcuaaauuaaggccucuacuuuggaggcagaggcaggcgggcuucugugagguagaggcuagcuuagucuacauagcaagcuccagacggcuagauuacacagagagaccucaugucaaaaaacuaaaaaggaaaaugaaguaagggggagaaugauugaagaauacacagacccacccuuaccucaguccuucauacauccacauacaaaagccuugcaaguguacaugugcaugcacacacacgcacacacacacacacacgauuauuugaaguaggguaaaauuacaaaugaagcaagaccaacaaaagcccucuccugggaggccugcucguuucuguagggaaacuaagaaggaauggaucugggggagaaggggagggauggggagugggaagaguagggggaggggaaacugcagcugggauguauuguaugagagaacuuuaaaaaaacaaaacaaaucaacuuucucacgaacccuuaacauucugauauguaauuuuucugaauacacagucuggaagcacugucucuucucaaagugugcggcaguucugaauccuaggaacaucugcaauccuaugauuuacuggcacuuugcuuagaagggaagaagagcagcuauccccagugcucacugcugaacuacugcugauacaguaaaggcccuugaguagcucccuucucugugacagcacacuggauggacacagggaguggauauuggcauuguagucaucuuuccuuauggagcuaaguccuacuuccguccaggaugaguuuguggguuuaauuaaaaauaaacaguaaaacuaaagagcaacuugacuugcgcaaauagccaucuuacccggaaugauuucaauucaagguuuaacaugcuugaguuaaucgugauuguauuuugaaauuucuacacauuugucauuagaagacaauguaacacucaacauuuaaccauucaucagagaagugacuucccacaccaaguaaaccacccagagugucugccuaucacuuuguaggccuuaauuuagccagaagucauuagcccuguaggcagauugggaggggggggacccuugucuuaaaaaacaaaccaggcuggggcucugucugccugucuccauauacuccaccgagugaguccccagugcugagguugcagauacggcccugcugcgccugaccuuuuccacucuguuggccauuugaacucagguccucaugcaugugccgcaggcauuuuccaccugagucaucucagcucucagcugaugcuuuauuuuaguguaguuuagacuuacaaaagacuugcaaaggucguccagaguuccuuauuaaguggugugguggugucaguaaugagucagcauuggcacauccuauugacugaagguuugguuuuuuucaguuuuaaccuaaugucuaccuuuuuuuguuguuuagccugaaauagagcccgagucaguuccuuaggcauuugauuauccaggagcuuaaaugccuuugaaagguacugaaauacuguagggacucuacuucuccgaggucucagaucucagccuuggagaggagugguugaggauuuucagaaaccucagaguauaacgcucaggucaucuguguguacaccuguguaggcaucagaaugcggauacaguaauagacuagagcacugugaagauaacuuaggcgagacugugugccucccuguguucuuagcaugguagagauuaggagggaaaguguugaugggaaccucaucaaaagagaacagcuuucagugguguacagcaugugggugccuucccugugucaggagcacugcguucccagcccauccuguaccucugaccggguucccauugccucugauccccgugcuccuccuguguggcucuggccuccuccucaggucuuggagcugugauuuagcggaggggcaauuggugguuccuuccaccuccuuguccuugcauuuuuaugucuuaaaacuccaggucaggugaguguggguggugauggaucaagugaguuuuguaaaucccauucugaaccucucggagaguuuccucugucccugaaugucgugauaucuuacucaagaggagacuuacguugauuaauguggcaugugugcgguuaucaugcucagagugcgcucuguuuaaggagagcuuugucaagagcagucucugaauggaguuaccaaaaaaagcuuuuuaaaaaacugacaacuucaaguacaauuuccuuuucuucugccuauuaugauugaaauccaauccuuguuauaacauaauuaucuuaacugaagccagcagggaguugcugucuuauuguaaggggugugaaguccccuaaauaaauagaggauuaaugacauucacagaguguugugaaggggaugagacugaaugcggucgucugacuugucccauuuccugcucugacuaugucuugaauagauagaaacuggaaaaaugagaacaagagcucccuagcaugucgcuggucacuggccacuggccucuggucacuggccacaagguaugggaaaaggaccuuuccgggucagcuaccagauuuuaaggccuuuaugugaugcuuauuuuauauaauucuaucauucguggguuuuuuuuuuuuuuuuacuguuuccaauuuaaagacuuauuuucagagguaauuuuuauuucaaggauacaaauaauagcaggccauuuaaguaauuugaccauuuuguguuuugaaacugcgucucacuguguagccuaggcuagucuugaauuuacguuuguuuuagacucucagagcugagauuacaggugugcaccagcauacccagucaacaaacuauguuaauguauugagcucucuccucuuucugccucucucucccuuccucccucuccuuucuuuuccuugcaguucuggggauuaagccagagccuuacauaugcugucaaauacucuaccccuggauggcaugcccagccccaaaucaacacauuuuugguucauauuuagauauuuucaauuaauauuggcuguugaguuuugucuguuuugcaacgaacuuaugcaaaauacuuaauaaauuuaauaucuuaauaaacuuaguaaauuuguuucuuuaugaaauugaucauauucuauuuuauguuuguuuugccuucuguuucuagaaaauuuucaguguucuaaauugauucauguaucuauuuucuuuguuuuccacuauucugacuuccucgaugaggugugcuuaccacagcgggcucaugagaacagcugugugagguaaacgaaacuuacacuagaccuucuccuaccugaguguauuaggaaugauuaaucuuggcugacauuguguaugugggugaaaguuuguucaguaggugguguaccauucaguuuugggucuagcagccuuuaucaaaaaaaaaaaagccacugcuuucuggaacaguucuccacaucucuaaggagaaucauagucauuauuccauguuucucagagccugaaauauggcuagggcuaaaggugccuuuccuagaaaauuaagaguugggguuagggaguuuuuggcacuuuguuucaauuaagucacaggcauggaagcugagaugcuccagccagacccuucccagcagaugugcagaggcucccagcuguuacucauuugugggcaggaugaauuucuaggugucuuagaguuuuaccucugugaacagacaccaagaccauggcaacucuuacaaggacagcauuuaauuggggcuggcuuacagguucagagguucagucuauuaucaucaaggcaggaacauagcagcauccaggcaggcaugguacaggaggagcugagaguucuacaucuucaucugaaggcugcuaguagaauacugacuucaaggaagcuaggacaagggucuuaaggccacacuucccaacagugccacuuccugggccaagcauauacaaaccaucacacuaggguaccacagcuuggcuuuacuuaacuuugcuuugggagucuuguuuguuuguuuguuugucccauuuuguuuauucuuauaaggagggggagguacccguggaggugagaggacagcuagugggcuaaguccugucugggaucaaacuuguguugucagaccugggcucacucccugcucugggaauucuuaugaguucauucaggaaguaaagagcaagaaccaaguggcauuuugagaaaaacagaauagaauuggaaauagaugcucauauuuuaugccaguguguucauuuaaaacauuaaagagcaaaagcugagccuagggagagagcucagcugggagaagaccugcugugccagcaccaggaccugaguuugacaccagaacucauguaaaaaagccaugcauguggugucugucuguaacccugaggcugccgggucagccagucuacccaacaggcaaugugaugauuugagugaaauguccccuauaagucucugguauuugaauacuugguccccaguugguagcuauuugggaagaguuaggaaguguggccuuuuuggaggugugucucuagggggugggcuuauggcuucaaaggacuccucccuucccagugugcucuuugguuccuguuuguggcuuggggauaugagcucuaaguggcuucuccagcuccgugccugccuaccugaugccaugcuccuggucaugaugguaaggggcuucugccucucuagaacuguaagcccuccccaaacccuucuuucuguaaguugccuuggccgugguauuuuuaucgaagcaauagaaaaguaacuaagacaggcaagccgcagguuaagugagagauucugucuccaaaaacucauaaaaacagguagaaaacauaccuaggaagacaacuggcauuggccuucuggccuucaugcauguacacauauauacacacacagaauaaggaaauuguuaaaugagcaauagauagcauucuaaggggaaagggcaaugucauuugaaauggacaaucuuaugugaggugagacauggguuuaaccucagagcguaugaucccauaaaguuugauuuugugauuucauuguucaugggccuagugaacucugcaccgugagcguuuccuaggggaugaaaguuucacucagugugguacuccaacauaaagcaaagucccugacucuuguuaauagugcucaguaugugcuccauggauugaaaguucuaaaccagugaaaucuacucagguaaauguaccacacacacccaccccagaaaagaguagcauuguagugggugccuaggugugcgaaagugagagugggguguguaggucacauuuccugcucuuuccagcaguaucaggucugaguguggugcugaggcugccaagcugcuucccaguggagucagacucaguaauuaaccaccuccaguccugcaggcgugugcuguuacccuguacagagacagaagucauuugcagaggaaaaggauguucccccacuucaaguccagaaugugcccuacaucuuuauccucuccaaauuaugugccucaagagaagacagugguuugcguguaacugaaaggcauuauguauaaccauuguuuuuaauccugugaaugacaaugucuucgaucgauucacccaguuuaugugaaauauuuaaccugugaacguuucuguucuuagagguccauuuguuuaaaugaauucagaucuuaauugaacccaaaggguacugagcaccugcuacugcaggcauacuucaugcuggauagagugugagaguccccgucugugcacuggaacaccugcuggcgaggauaguuaguugaaguugcugugcaggaagcaaugauacuauacugucacaaaaagucauaacuggaaaauacauggaaaagcagcauacauaaagagaauagucacagaacaaaaucucacaaggaagcaugguaaugauaauaaaaagugucuaguuuguacacucaugggaaacuuuucuauuucauaggaagauuuugguaugcuuuauguaucaucuccugucccccggaugccaugccuuuauauuuucuuaaauaagcauuuuaaaaacuuaaauggaugugccaacauugcagaguagcacagguguguaggcagaaagugaagugguuuguaccuaaguccaaauggacaaaugaaagaaagagaaggcucuucuuccccaaaggacguacaguggguacagccagcucgcucgcuccucggggcuucuuuggguuuucauagcuacaaauggaacauuuaagccacugguccuuaacagugcaaaugcaaaguuucucucacuguuuugaugcaccaguguugugauuuuaaacaaaauuaaauagcagaaaggaggccacaccacuugacauguuuaauugugcauuugugccuauguuaccagguguagaaugucccuuguaaugucuguagugaugccuacccagcguccuguacuggaugagguaucucugucacagcuacacacacaugcacaccacacaugcacagcacacacuauacgauacuauaguaaaucuaauuauguaguauacuuuaccugacacagagacauagggaaaggggugccucuucuagucuugauccuuccaacuccaucuugguagguccggggcgcauaccauuucuuucucucuuuccagaacccaaagacauuuucugagugaggagugcagcaacuucucacguguaguuuauggacccuugcaccacuccaaggaagcgugccaaccaauuuagacuuuguuuuuguccaugguauaccguaaugcuucaggaagauggcauuuaguucuuacuggaaggcauugacuucccuuucaauaugacguguaaaauccguugucagcaaauguccugcuacuugucuuaauagccauggcaguuagaaaggacuucaauuaugccaugaaagcuaaagugaugugagguaaacgcuggcagaagcucucugcugcacucauggaacccagugucccagagcacagguuucaaggcagccuucugaauguucgaucugcguguccccuguuggagauaauuugcugcagucaugauuccuauguagcuuccgucagcucugcuugguagaccuagcuucuucuuaggcuccugccagaaaggcuggccuugcuucaggugcuucaaagagugucuuuuagaagccacccagagcaucccuguugugugcacaugucagucuaacacguucccacgagguuccugcuagugcucuugagcauggcucaguucuaccaaauacagauguuauuucacauuguuuagucuuguuauguuaaggagugauaguugugcuucugaaguugcuguugcauuuggugugagcauguguucaucuaccuauucauucagcaaagagcuaagaauugcuacaugggcaagguucuuuguuaaggaccugagccugugguagaaaacaaaaugcagccacuuggcuccuggggcuuacagcgucauccggagaggacuuguuggagucacaugcacagaaagagaaaccguggaaaguacugaaaaaaauuacauauaaauaaagauagaaagauaaaaagauagaaagauacguagauagguagauagauagagacuuagucuguggaagggcauagggggaaaaggaaaugucucaggaaagcacuccuuagaggaaaugugugauuuaaauauucaugagacagggguaguagacuucuggagacuacaguggauccaugugcaaagauccugugacagaagagauuucuauagguguucagaacgcugaaagauguucaugguggcaaaaacaaaacaaaagaaccaggaggaaaggagcaugugaggagaggcucgggaugaagcucuaggcgagcugagcuaacuguacagcaccuuccaguauaaaggaguuuaugguggcuaaagggcuucguaaugggaagugcuuuuuaagcagguggagugggggugcuacucuagacauccucagggaugagugccaccucuguagggaaggaagacugaggaacuaaaauggauucugggaagagcagaagacagugccuggguuugugguuucugcagcuaaccaguaaugacauuucucucauuuggggcuaaggccugggauauuggcuuuuauuagaggaauucugcugacuaugggacuuagccucuuucagaauucauaauccuaggaaguugcuacuuuucccuuuugucucuguuauugcuuccuucccuauuuaaaauagcuauuaaggcuagcauaguggcucaggggguaaaggugcuuucugccaaaccugaggauuugaguucaauuccugggacuggcguggcccagaagagagaacugacucucaaaaguuguccucugaccucaugcacagcaccccacugaagcaaauaaauaaauguaauuuaaaaauaaauaaaaugacauuaaacagaaccauuuauuuagaguuuggcuuuuauguacuuuuuugugugaguauaguugcuuucuuaaaaugcagugaugcacuguguacaugaaguuaaagaacaauuucaaacucagaauaggugucuguccccagucaugagagacagaacauuaccaguuucucagaggcugaggccagccccucaucuaauuacagggcccccagccccauuguucauucuuuucauuuuuuuuuuguggguuuaccauuuauguuuuagucccaaguuugcuguguaguugugcuuguuuuaagucuuguaugcuuaaaaucaugcacccuucuguuagcucgcucuuccccuuaauauugauguuagaugaugcccauagagugcggucccuucuuuguuuuccugcgugcauucugccguugucugagugcugaaaguucucacaguuucuggggcuguuggggcuguuggaaaagcugcccugauuaucaccgcaugcuucuggugaacacaugcauugcuuagcgaugcugggugaagaacuuagagccuuaugugagcaccccacuacugacuacauccccagcauacagugucugggaagccuucuccuuaggaacggaagugcuggagucuggggaguaauuguuggguagacuucccuggguaaaucaaauuguuaugcaaccugguuguggcaacuuagaccuuauucuaacagcgcagaauuccccugguucuaauuucaugcuaauacuuacauuaaacuuaaggucuuauagucugacaaaugagaucaggcacuuucaagauugucuggcuauagauaagacuugauggucuaaaggcaugugacacuacuucuuuuucuuucuuucuuuuucguucucucucucuuccuuucucucuguuuguuuuuguuuguauuaucuugguuauugauaaagcaaagcaccuuuauguguauucuuuagccauugguguuccuuguccugugaaauacccaugucucacaauucccaauuuucccaaaaagguucuuuuauuuuugacuugaaggauuccuccggucugcugguugcuagcccuuuguuaguuaaacaugcuguguguuccucccagcuuguaguaucuuucaaucuugcugagucuuuauaaacggaagauucuuauuucaguguaugaaauacauuugucaguaugcuccuuuuggcucugcuuuuuguuucuuguuuuagaaguucuuuguggugaaugaaugucuuuaugacacucucuugcggcaucuaacuuuuuauuguuuugugauuagcauuauggguccuuuguccaucuggaguugauuuuuauauguuaugaaauagggaucccauuucauuguuuucccauauggauuaccuuaacccagcuuccuuuauuaaacagucuagccuuuccuuguccucugucauaaaucacguuuccauguauggauggcugugugucuggguugucuguucaguuccaaggaucugcuugucuaucacgcgccgauagcaugcuuuccuaauuacuguggcuuugugucagagucagcuugucagaguuccguggaaaaacacugcgauaggauugcuuugggucuauuaaucaguugagggaagcaaaccuuuuaaagucuuuuuuaauaacauuauaugucuuuacguuuuccuuauugucuuucaauaaaacuuuuuuuuucuauaaaaggcauaugcauuauuuuagauuuauuguuucauuuugggcuugcuguuacaaauaggauccuuuuuaaacaguuacuuugaagcugucuauuuggaguguguggagacucgucccagcccugugcuaagugugcuucaagugugcacuugugcuuugguugucugguagacgaugggacgaaagcacagucggaugcuuucuuucccauacucucugcccuucuuuucuuuucuuaugcuuucauagauggccuuuaucagcuggagcgggcuccuguuauucuuaguaugcagaguuuugauucuaagugguuguucaaucuuacugcauauuuuuccucauuuuucagugauuuuaaaauuuucuccuuuaauccgcucauguaaucaguggccaugugcaaaucuccuaacaaaaauuaggccuugcaugccugucuuauccaugguuuaucaugucacugugauauggacuaaccugcuauagguauuuucuuucacagucucagcacugucauuaagguuagcccagccugauuuaaaaaggaaaaaaaaaaaaaaaaauaaggguauugauuuuucuaguuugaggaauagugaauauuaacuauugcuugaaucuuaaauagaauuuucuuuguggagaaguuuaacucuuaaauuuuugugugacgcagaccauuccgguucuuuauuucucuaggagucauuuauuuagauuacucuuuuaggauagcauaacacacuaggugccaucgugguguagccaugcacaggugccaugcuuugcgcccguucauucccauccugcuacccuccucccuuguauucccucccuccagcuggucccugcuuccuguaguuagcuccucugcuguuacaugacuucauuaccccaucucucauuaccuuuaagaucgcuuccuauccucuucugcuccccuuucuaauuucaugacaaacacaugugugcauaaaauacguaagucugaccauuuuacuuaaugugacuuccaguuguauccauccaguuccuguaaauaucgguuuuguuuaugggugcauaaaauuccacuugccuguguuaccacguuuucuuuauccauuccucugccuauagacgucuaaauuggauacauuucuuagugugaguaauacagcaguaaacauggaugugcacguaucuguggugcacugacuuagaguucuucaggcauaugccugaaagauguuuaggucggaggacgguucuaguuucagguuuuuuugaggaaacuguacuaauuuccauaguggcugcaaaaauuagcauuccuacuaagagugaauaagagguccccucuuccucagauccucuccaguguuuguuaucuuauguuuucuugauuuuagugauucugguuggaaugaaguagaaccucaaacaguuuaauuugcuuuucccuacuggccacgccuauugagcauccuuucuaguauucacugacuguguuccuuccuuuugggggaugauuuauucacuucacuugcccauuuagugauuggaugauuuggguuuuuaauuuuuuauuuuuugcuguucaaauucuguaguucuuuauauaucaugaauauuacucuucugucugguguauaaaaugacaaacauuuucucccauccuguaggcuauuucuuaacuccagugauuguucccauuguuaaacagaagcaucuuaauuucaauucaguucaguucaguucaguucaguucaguucaguucaguucaauucaauucaauugucaauucuugagguauuuuuccuaugcuguuuaaguccuauucucaauaaaagaaugggggaccuaugauaaaccccccaaaaaacuucacauagauuacacacaugcauacaaaugaaauaaagaacucagaagucaacaguuauagcccuugaacuuuugacaacgguaucaaacacaugcaccccaccuccuccucaagggacggaccuccucacaucaauuaccaaucaagaaaagaacccuacagaccuauugccuauagguggucucgauggacacauuuccucaaaugagcuuccucuuuccaaauguuucuaagucugugucaaguuggcaaagaccaacuggcacacguuccuagcacuguguuuguuuguuuugguagccuauggugucuaagaggggcauuguuccccccccccauuuuaaaauuauuccauuuaaacucaucuuacauauguauaauuauauauucuagagagcuucuauaguuguagguuucuaaguggcuuuuucacaggucuuuugugguuuguuuguuuguuuguuuuuaaacuguugugaaagagauuuccacccccacuccccaauuuauuuuuugcugaguucacuguugauauauagaaaagcuguugauuucuguaucaguuuguauccugcuacuuugcuaaauguguucauaaggucuaaaaacuuucuggugaaguuuauagguuccuuuaauuauauguucauguaucuucagacagauaaauuaaccccuuccuucccuguuuugugugcccauuguuuccuucucuugacuuccugcagucgcuaagacucuaaacacuaguucugaguaugagugggaagugugggcacuguaguucauucagacugcagaggagaugcacuugguuuuucuccacguagccugacaugggcuauggguauauuguauuagccuuuaucuuauucagccaaguuccaucuauuucuaguuuguucagggauuuuagaucaugaaaggauguugaauuuuauugaagaccuuuugugaauaauugagauguucguguaguuuuuuuucuuccuuaaaucuguuuaugugcugaauuguguauauugagccaacuuugcauccugaaaugaugcccgucaugaugugugaucuuuuuaauguguucuugaauucaguuugcacugauuuuauucagaauguuagcaucuguguucaucggggaacucugucuauuguugucuacuuuuucccuugucuaguuuuggugucaguguaaucccggcuuuaugaaucacuauuaauccugucuuugccuuucuauuuucuggaacaguuuaagaaacuugguguugcucuuuuuuaaagguucaguaaacaucacuggugaauccaucugagccuggauuuauguuguuggagguuuuuuauuucugcuucagucuuguugaauguuauggaucuguuuguuuguaucuucuuaauuuuaguaggucauauauaccuaggaaauuacccauuuauucuaaaugucacagauuuugaacuauaauuuuucaaaauacucccuaaugauuuucuguauuuuauuagaaucuguaaaaaauaacacuucuuucaucuugaauuuaucaaguuuuucuuucuuuggguuuauuuggcuagagguuauuguuuuauuuuuguuuuguuuuguuuuccaaagaacuaacucuuugauuccguauaucuauuuacuccguuuuguucauuccuggccuaugcuguuguuucuugccaucggcugcuuugggguuuauugaucauguuuucugugacuuugaggugaggugacucuucagacuacuugagaucuuucuggucuguuuugucuuauuuaaacauaagcuuuuauaacuagaaaguuuccucuuuaaaauguccugccuggccaggccagaugacacacacuuuaaucccagcacuugggaagcaguggcaggagggucgaugaguucaaggucuacagagggaguuccaggacauucggguccagaucuacacagagaaacccugucucuaaaaacuguguguguguguguguguguguguguguguguguguguguuccuugcucgugcacucuggaaggucugcuuucauuuuccuuugauucuagaauguuuugacccacugagcaugcaggacuguguuguucaguguucaccuauuugugugguuuuugaagauuuucuugcuauuugguuuguaguuuuguugcacugucaucugauaagaugggguuguccugauucuuuuguguuccuacagacuugauucagggccuagaauguaguccaugguuagaaagguuaacugcugagaagaauggagauuccacuuccuuugguuggaauguuuuguagauaucugucaagccccuuugaccuauguuacaguugaacucugagguuacuucagcccgucuuuuccugaaauguacuguucccuuuggucuugugauugcgaccaucuuucuucccacucuguauauaguauuccuaugguuuuugcagugcuggcuugguggucaugaacugccuugaguugugcuugccuugaagugcccuuauuugucuuuucauuuaaaacacuagcuuugccggauacagcacucuuggcuagcaguuauuuacuuucagcuuuugaaauauaucauuccaugcuguccuggcuucaagacuugcugaccagagaucugcuauuccugucuuuguuggugaguuggcguuuuccccuuagcgcuuugaauauuguuuuugcuuuguauucuuuguaaacuggcuauaguguggaaggggucuucucuggccacacaugugugggguucauagugcuucuuguucagaugucuguuuuuagauguguggaacuuugugcuucaauuauugaacagggccucugccuuuaguguuuaucuggguuccuccuucccauggagucuuuaguuucaacuuugauuacgucucagagcgccuggauaugguggugcacuuugcucugagcacugcugaaaugcagcgugucuucgccugcccuccaucccugaucuucuuucccugcuugguucagucuauugguuucccacugugcaucuuauuugguucguuuuucugaauuuauuucuaacacguucuuucuguuucuuugcuuaauuuucuuacccugucgcugcugcucuuaccuaaauugcugcuguucuccugcugacuuuaccucugcguuacuggcuuuccucuuugggcccuggaugaauucaucuguugucuguauucucuuuggccuuuggaaucuucauuggccuuugucuggugucugagaugucaguacguggagggccgcugccuuucagggucacacugucuugcuuucccuguccuugcguugcugugcugcaugugccuugcgcgucuccugguuucagucucuucugcacuuguagaggggaucuuguugagcagccugcucuccaagggucaguccccagcaccacucaacauaggagaaacaaacugcuguaucagccgcagcaacaucacaccaugcaagauagaugugcucagguaaguuauaacccagcgaguacaucaccacugaccacagaacugaaaaugaccacaucuacuguagaaugugcuuugaaauaaaggauuacuuaaguguggaaaugguaagugacugagauauagaaaguaugccaggaaggcugagugugguggcucacaccuuuaaucccagcacuggggagacagaugcaggaggaucucuaugaauuugaggccugccuggucuacauagcaagugccaggccuaccagggcuaaguagugagaucuugucuuuaggaaagagacuaggaagggaagaaaaagaggggaugcaaaauuaaguaggucaaaggagaaaggaggggugugaagacgaaugauuuagaaaggaagaaacaagagcaagaaauggaggacggagggcauacccaaagaauagucauagugaggaaguucgggaucaaaauuagguaacuauaagaaaggggauaaauaguuaacacaccauuagaggaaguaauuuuguaaagcugauaagguaaagauacuacuaaauauaaagaagggagaguguaaggaggaagccagcagaaaggaaaaguacuucccuaaauggaaaacgguucaauggguauaugaaaggggaugacacacagggucucuuuuagaauacaguauagcaaaaacccuccugaacauuagaaaugaaagaaauccgaguaggggaguuucuuucugaucccucaaaacuuggagccugcugggugagugcacagaguagguggggucagcugauccuggggguccccauccuuccugugguuuagcuguugcccggugucugcuguccaccacugcugucuucacacugcgguuucccuuacgugcugguuugaauaagaaugguccuuccaugcucaggaguuugaacagucgaccacuugguauggguagauaagggaggugucaccuugcuggaggaagguugccaccaggaugagcuuugagauuuuaaagccaugcuccauucccgguucaaucucuuugcuuucugcuuauauuuggaaacgugagccccucagcucccaacuuacagcuccaccuuuccugccugcugcccugcuggcccccccucccccgaccuucugggaucauaagccaaaaauaaacuuuuuuuuuuagaaguuggcuuugucggaguguauaaaacaacaauaaaaauagcaauagaaaaguguacuggggucucuuucaugcuuagcuuugccuucuguagucuaggaagauguucuuauccuccagggcuccccagggcauccaucgccccugaugcuuuagcugaggggugucucccaaaccgaguguggugaacacaugagaagcaaccauaggauugagaucaguagaggucagaggucaguaggagcaguggagaacugacaccauggguaugguguuuggaacuuuggaguucuugggcucuguugcagugaaguacagugucuuaaaugagaucucccacuggcccucaggcucagaccagcaggcagaauuaucauucuuuaugaugucucagcuugaaucuucugcugccugcagcuuuggguguguuuuccacaucugcuuucccgggacagacugaggcuccccacccugugaauguucccugcucuaggcagcugcucccaggguugcccugggcuugcauuucugccuugcccauccacuccugcgccuguccaucgucauuuuaccuccuccuucacggucugacuguugucuguuugguuguuuuuuuccuguuucucuccuugggacaagauuaguuucuucucguuuguaacuucuugacucgcccucacagaggcggcuucugcucuuccaucuuaccugaaagucccaucauagucuuggauucaguuucaauagauucgaauucucuagagauuugucuguuuccuaggauuuuuaaguuuucugacauagaguuauuuuacccuuuguaggccucuuuuccacuugucugaaauugucuggguuuacagccagggugcuuguacuuguucuuguauugcucugccuguuuguaagaugcacuuugagaaggagggguauuugucucauguguuggugcuuuuuaguugauccugucuacuucaguugucuuuuauaugauggcuuuaucucugucauucugggauuuauucugcuuuauuuuccuucuuggccucuaguauuaacacuugcuaaccaauuaucaguuacauaaagccuugcuuuauuugagacuguauguuuccuuccaccuuucugcuuuauaguuaccuuauagacuaaaaucacuggauuuucacuauuacucaguucuaaauauuugcugguuuuauucauacaaugugugggguuucuccuuuccaaacauacugacuuuuaaaacacuguguuugcuauuaacuuuguucaguucuguuucugucaaagaauugugcuacucuuuggaacuugguuaagauugguguuauauagcauauagucggcuuuugugaaauuucagcuuuauucaaaacaacguguguuuucugcuuguuauguucugcuaugcucuauguaccuuaacacacaaaugcacuagccugucagcuggaugaguugcuuuccuuuaucuucacugauugggcuguugcaucugucgguuaggaacuggaaaaggugugcggaaauguccuacuguguuggcaggcaggcuugucuguuuuccuuaggcuugucagccuuuacuuuauggagagauguguugcuggugauaauaguuuauaauugcuacaucucucugaugagcucaauguucacuguguugugauguuucuaucacuaacaguagcuuuugucucacugucuugucugcugauaguguggcuggcucagcucuauuucuucuuguuuuugaagcagaguccugcuauguagcccaagcuggcuuugaacuugugauguuccugccuuagccucccuggugcugggauuauaagcguguguaccuugucccacuccaggucuuuuaauuacuauuuggcugaucuagauucuuuuauucuuaauggauuuacuucuuguaaacauuuuucaguaaacuuuagacaaccgauuuguacuaaauucaaauauucuuacaaaaccuugccuuuuguguauaugaaaauuacacuucgagcauaugauguaaagcugcaauccauuaauaacuugggacucuuuagaugcucuggucuuugguccucauuaagcagguuauggugauuggcucaucucagucauguguuccugucuuugauucccagcuccauauugaaucaaucaccaaguccuuucuguucuuccuauccucucuuucauguaaaucccuccuuuaaggccccacaccuuuccucuaauccaagucuguauuucuugcuuccugccaucgugucauagguggguccugcuguaaaaugugacucuggaaauccaccaguaaucauuuauagagcucuucugcaugccagguguaaggucagucauuggaagacugaagacuuagacgagaguuucuuguuugaaggaguuagaauggacauucuauuuuacuuaagaugugaauggaguguugaaugaggaaagcugagauuggaacugggcuacuuucugccaagcuaaauucagucucuccagucaggucagaugugaguccgguuaacuuuacaaucacagccccccauuggagauugucucccagcagaguuccuggguuuaggcuggcccaacaggcagucucaccuuugugacuuccaacagcuccuggggggucaccacugcuggucuuauauuuucuuugccucucuaaaagccaaacaagacacaucucuuugcuguuuuccucauggauacuggggcacacgucauucugauuccuuuccaguuguuucauguaacagcaagccauccuugucaccaguuacugucuaucaccguuuuaccccacguaucuguagucuuagaguuucuggcuguguuucccuuuccuucucauccugaguuuauucgucaaaccaagaacccaagucacacugacagaagcauacuccucccucuuaagacuugugagcuccagucaggcccggggcagcucuugaugugagccaugguccacagagccagucugcuuucaguuugggaagacugaugucacagaguuacccccuugccacugugaauacuguagcaaaaccaugaacaucaugaguauaagcucugagccagcuugucaguccucagaccucugcuguucccauagacaagccacuuaaacucugcuccagccaucccuaaaauaggggagauaggcauacaguguaaguagucaauaaaugcuggugccaugcuggcuuaacagugggaucaguccaucauggugacaacuaacacuugucaagugcuuccugcaugccaggcacuggucuggugcuuucuauacauucuuucucgcauucucaugggcugcauaggcguuugggauauaucucauuuuaauauagcccuuggcugcaaguauagaaauuaaagcuuagagagaucaagcaacccaggccuguuugaugucagggccugaggucuuaacugccuggcuguggucagccagucccucuggcauauuccagagcacaaaaccccagacacacuuugcacucugaagcagugucuguacaaagcauguguuuuaguugaagagacaagccauucagagggcagaauuagagagcuugugggugaccccagcucauucagagacaggcacucagccugguccaugggcuuagugaaggagcgucucgaagagagaagugaagagaggugggguaugaccuagcacggcaaaggaaggagaggugggcuaggcagggccaucuccuaccuguagcacaucaugaaaguuaggacagucccacaagguguagaagccuuuuugaaguagccaugcugccguagcacgcagaaaauggcagggaauugggaaaagcuaaguaaauggaaaaguuguaagcuaauuaccuugggucacauuugguggcucucucuauguuuuuaaaaacuuuaaauugguuuuaacacuuaaacauuguaagauuuuaugugaaagucuagauuuauaacugcucuugaaucauggcguucuggcaguuacuggcccauccucacaugguagcaguuggcuggcaugggggccagcugucuuuauuaugugguacaaguguuuuccauucuguccagacuccaccugcccacaagacuccaucuguuuguuuucugugggccacaguuuguggccuuggccuggugggucagagcucugauacugggaacagcuucccgugauugggcaagccucuggcacuucugcauugucagggccuagcaaauccuggauagcugguccuguggcaccugguuggcagcaguggucacauuagaaugaaaugaguuuggaaaccacaccaggauucuagagggcuuaggggagccagaccaagguuguaccagccagccuggugguucauuuugagcuguguuguaaaggcacaguguggcuggccauuagccucagagaggcugugcaguuuagaaacaacucagaugcauguguuauaggaaaaacugcugcuugucauuguucagugccuaguucccuagccaaacaugaagaggcucuguugcuguuugauucuuugaaugcacacuaaacaaugggaacaaaaaaaaaaaugcacaagcaagguuuauaaugucugguugccucacacagcaggacagcaacaugaagaagaucacugugggggcgguggggagugggggacagcccugugugauuuagcaaaagccaguaaaaugcgguugccuuugaauggugcuaugaucuuucauucuggcugcugacgacagcuugccucugcauuuagccuguguucuuguuuuguuuauuuauuuauuucccuuucuucuacacuugguauuccuccaggcacuaucugaauguaccuugccauugggagcacuaggcaagaagaaaguccuauugccucucccugaggcucaggcuuaggaaaaucaaagccaagcagaggcagcucuucccugccugcagcagggucaguagcuuguguaauguuuugccugucagcuuaucacagcugauuucuugugguuuugagcaagggaguggaagagcagugugguucuuuugaagcagguagggccugcagcugugaucaaagcugagcucugugcucccugccaaccauucccuacuucuuuguaaacuacuccauguggggguagcuuucucagugaagugagauggcaccaagagaaaaacccaucuggacucucagacaaggcauaaaaagggagccacacuugggccccucccuucuccuuuggagcagcaaguauuuugacaccaucauuugagucaaccauaaccagcuuuagcguccaguuccuguagaaacauacacuacuaagcugccacuggguuuggcuauaagcaucucacuguggugguuuucaguuguauacuaugcaaaccuggcuuagugaaauaauacgucagccacucucucauucuuacuuguagcagucagugauuuuuauggguaccaauuucaguccgacagggacauguuggcuauucuccaguucuaauaaugcaagaguccuucaacuguaagucuugaagaauaagugaacacgagguuuggugagauguccagcuaacuagugggguuuuaucaucgauagucacgugaucacuauaacaaaguaugggauagcucccaaccucagaacuauuuuagauaguuuacauguucuguugacagggucuaggauauuuaagaggagcaccaguuuuuagaguuggcuuuugcugccccccacagaccucugacagugccacauaaguuaguuauggagugauacauuccagugcccuuaaauaguguuaucuacugucaaaaucuggaaccucacuacgcuugccuucauguaagguagagccaaccuuuagucaaauuuagggacuuacuguugaaacuauauccuggugauguguuauugcagaagauacaggccucagcaauuccgucaucuggcuguaagugacaucaguggcauacuccaguggugagcuccugagggauuguagacgguauacgaaugcugagaagggggagcuuaaagaccaaacccaggggcuggcaagguggugagguggguaagagcuucuggcauguccaugugcuguucuccuuggagccugggguagcugccgagaggacagcugaagagcucugucuccucuguagguggcaagacccauucuaccacauccauuuccagccuacaaagauagguggguuuuauuuuuguuuuuaacuugacgagauauuugguuuuacucauaaauuauuaacuuguuuucuacuuguaccagaaguuguuuucaaucagucagucuuccuccaugucccucccccucucucuccgacgcccaguguccuuuccugagcuuccucacuggcggccuagagaggcuuucuuacuaggacuugcugugaggacugaauagauaaugaggcauaucacuaugaacagagcccaccccaguguaggacccaggaaguagcaguccuguagccuaugcagaaaggaucuuuguuccuuaacauagcccuuuggugugguccaguccauguuagaccugcuugcugaucugaccaugucacuuaaacauuuuauuccucuuccucucuuacaucuacuguaccaaaugugugugugugugcugagcuaaugaaaacuuauucauuaucagagccuuaaagaaauaaaaauacagccagguggugguggcacaugccuuuaaucccaacacucgagaggcagaggugauggaucucuguaaguauaaggcuagugugaucuacagagccagcuccaggacaaccaaggcuacacagguaaacccuguuuugaaaagccaaaaccaaauaacgaaaggaaaggaaaggaaaggaaaggaaaggaaaggaaaggaaaggaaaggaaaggaaaggaaaggaaaggaaaggaaaggaaaggaaaggaaaggaaagagggaagggaagagggaagggaagagggaaagggaaaaagggaaagggaagggaagggaaggaaagggaagggaagggaaggaaaaagggaaggaaaggaaaaaggaaaggaaaggacagcagaugcuuguaaacuuguccugagagcacauacuaaagcauuuuuaaaaaggucaucacugugucacacugcuguauacuuaagacucuaugugugagauauauagagcugugguuaauuugaagaucuuccuauacuuuaucacauuccaaggagauagaaggucuuuucugccaguaccuuggagaagugguuccuaucauguccauagagaaagguuugacccuggcuuaaggcuucaguugguuuucugaagcucaugacauaaaucaaguugagaugucuucauaguacuaaaauguguguguauggggggggucucacccugacauggguggguggagaccaaagguagaguucagguagacuugcugaccaguaagucagcaagucuaccugaacuuugcgggguuacaggugcuuacacguccagauuuuuuuucuuuaauauuuauuuauuuauuuauuuauuuauuuauuuaucuaucuaucuauuuuuuguuauauguguugagaugagaagacagccuggcuuuuacaugaggucuggagcugugagcucaggucgucaggccugugcugcucgcacuuuugccugccgagccaacgcucuaagccuagauuaugauuucucuuuuuagauuuauuuauuauauauacaguguucuaugugcauguaugccugcaugccagaagagggcaucagaucuuauuacagauguuuuugagauaccaugugauugcugggaauugaauucaggaccucuggaagagcagccaaugcucuuaaccacugagccaucucuccagucuauauguauucuuuuuaacauggguacugggaagccaaauuuagguguuuaugcagcaagcacuuuacccacugagcuaucuccuuagccucucucgaauuuuuucccguauuucucacauauuaaauaauuucaguuauugccacaacucgcugauaagccauugaaagaguaagagggagcucccugcucauggggaaccuaggauuccugcccaguggcagcucuuaccaugggagucacaggcauucaagcgugcagcaaaggagcccucacaccagcucgguuauaagugguaggaugagguagaaccauucuguaggaccaaaucucagugggucugucuguuaacagacaucaggguguccucaggaaguccugcagccuucagguuucugucuguggaacguuaccaaagagaagcagugaugguuacccuaugaugauggcaauuaagcuuggacucugcaucuaucuacaagccacugggcuccuguacuuccagccaugccagaagcuaagggcagcaguggggccacgcuccccucagaaagaacugcccugucaacaccuucccuccccaucugcagccaccagacugugaaagaaccaguagccuauguaugggugcugacuagggcagcuccggagcggggaguucagagaacugcuaauccccagucuacgaggcucucacugucacgccacagacugccuucaaaucuaguuggaaacugaacuggaagcugacaugccuuaaacaacuuguacuugggacuggagagguggcucagcaguuaagagcacugaucugcucuuccagaggacccagguucaugucccagcaccuacacuggcacuuuacacaugucuguaacuccaguuccaggggaucugacaccuucacccagacagacauacagguaagacauagguauacuuaaaauaaaauaaauaaaaauaaauuauaaaacagcagccacuugugcuccgcaccccuucugggauaaagcagucgccccuucuccagagggcagacagcguuaguggugcugcugcaaacggcugccagugggcauuugugcuuuaugccgguccucagaagcaagguaggacuuugcuggcaacuucuaccuaaagccaguguaguaccuuuuagauuagucuauaaaacuagauuuagggcaggggccagugagguggcucaacagguaacuaacucuauuuagccccauaccuaacacccauuuucaaucccugaaaugagagaaccaacucccucaaguuguccucuaaacucuggucacacaccgaggcacugccaccaccacauacacuaaguaagucaauguaaguuuuuaaaaguaaagugacggcuggagagauggcucagcgguuaagagcacugacugcuuuuccagagguccugaguucaaauucccaacaaccacaugguggcucacaaccaucuguaauggaguccaaugccaucuucuggugugccugaagacagcuacaguguacucaucauauauauaaaauaaauaaauaaaaucuuaaaaaaaaagauugugugugugagugugugugugugugugugagugugugugugugugugugugugugugugugugugugugugugugaagggccaugaaguuuagaaauguuucuaaauuuccaguagaaaggaauucugaugcggcacgguuguugguguccuuuaacaaguaucauugcuuggcuucagauuggagcuaagacuuuguguggggcucaggagcagaauccuccccugcaggugagguguccuggcagaguuagccaacagacugucauccucugugaacugccucacacugcuuccuggccugcauuagcagguguggccgcuggucucagagcauccugcccggcaggccuggguuugagcagaggaaaugaaagcuagugguuuacuaugaaauuuacagaccugccguggcgggcuguggugaaaaguugauugaucaccugagacacagcucuguaaccacgccucugcuuucacuuaggccugagcccugcccccuaauacauuucaggcucuuucugugcuucggcaauuuguuaaagagagcuguggguccuuuugaacacucccugcucagucaccaaaugugaaguaauggggggggggggggccaguaucaguuuagcugugucagagcugugugcuuagaacuguugcuuugacacuuucacuauaggcaaguuuacuagaacucauccgucagcaaccuauaauuuaaaauaauccuccaaugggauguuacugaugcuacaacuguacaaagaaugugcaguuccauggcggaguuacauuuguaacaacuaagaaaauauaguuugggcucugacuaaauguaauacuaggaugauccaguugucaggucucuucaguacugauucuagcaaaugcauucuuagcaugugagauguuucccguuuacacauaaaagccauaacugcagccagggaugcauguauucacuaagaauaucagacaguggcacguguaggagucuagcuacuuaauguuguugacagagcuuuuuuuccuuucuuccuuccuuuuuuccuucuuuuuuuuucuuuucuuuuccuuuuuucuuuuuaaugugaacuagcuaguucugccuugaaugugacaaaaagagucagagaaucacccuuagaugguuugguuauggauagaaaugguuucgccguuauagagauggauucuagaacuuacacggaacagcagaucagaccgauaguaauuuuauucccaugcuugaaagaacaaaauggccacccagccacaacaugacucuucuccucaaauagcuuccccauuuuuccucuuauaugugugaaacaaucgaguaacgagucccauuuccauuccucaagcuuucuaucacuuuauauguccauacuauuuugaaacuuaaucauguuuuuauuauuauuuauuuacauuccagucauugacacccacuacucucucucucucucucucucucucucucucucucucucacacacacacacacacacacacacacaccuggucaaacagucaucuuguagaaaugaguucuucauugugucuagaggauggcacucuuggugacaggcgccuugcuuuccucagccaucucacaagcccuaacauuuuuaaguagcagguauugcauucuuaguuaggguuuauugcugugaacagauaccaugaccaaggcaacucuuacaaggacaacauuuauuuggggcuggcuuacagguucagagguucagcccauuaucaucaaggugggaacauggcagcauccaggcaggcauggugcaggcggagcugagaguucuauaucuucaucugaagccugcuagcagaauacugacuuccagacagcuaaggugagggucuuaaagcccacacccacagugacacaccuacuccaaggcuacaccuaauagugguacucucugggccaaacauauacaaaccaucacacauuacuaauagauuuaaaaauuaaacaguaggcaacaucaagucuccaucuguuguaggacauauuuaaaaaggaauccacuaucucuccggcuggaccacacgcucuugcacuccugucucccccaucaacucucuccagcuagccccugcagcaucugucucacuugccccaggagcugcuagaacuuccucagccauaaacccauguagucagggaucccacauucuaauaacaaaaugaaacauauguaacaauauguguuacauaucacaauacccaguaacccgguaaaaucaagacuguuaaugcuuaauuaaccaaccacauguauguaucaaugauaucacaaguuacaagaugccaauacaauaauuucaaagccaauugauagugauaaaagcuugucccaauuaaucuaaccuuaugauaccacaacuacuuguggcugguaaacggcauguggguucaugucuacagccaucuugccaucuuccuucuccuccuacccugagacgcucucugucucugcaacucuuagugcugccucccuuuucccuguccagucgaagaccuccucugcacucacguaauuggacagggaaacuccugugacauccaucaccuggucugucauuugcccaucuuucugguugguuauccuggcuuagguucugguuuccaaaacggccucuggauuagggucugaucugggauugagcauaguuuucucaacuuaacuuuaguacuuugagcugguuuugauggguuguggggcuucucuuagcuauaguuugacuacaucaagcuuucuucccugaguuccuguccugugaaugauaaaaaggcuuucugcagucuaaagucacaaagggaaugcacacuuccuccacagccucuguuucucacacuugcaucugugcgcugcuugggguuugccccgugucgugugacaugugugucagcuuugugguguuuuagacucuguuggcaucagucugauugaugagcuaaccuaauuuuucuucuuaauaucauuuucaagguccaagaaguuggcugcccuaaccgaagccuugaaagcagucucgcucaguaaggcccagcugggguuagaguugccagaacuggaagccgccgcacuccucguccaggaggaggaaggugcuggaagagcagcccagugcaaucccucgcaucaggcuccacacuccagucccgagcccagugacucggacagcaccucauccucuggcacagaggacucagcgucagagcaagaggagccugcugggacccagcccucccugcucacuucucugcaagccccacuuuuggaagaggacagugcccugaucaucagggagagugggcucugcagaaacauggccagccagggaugugaagucagucaaggacagccacuggccuccgcccgggcuccucucauagaggagcugggagaugcgcugaagaugcuucggguuuccacaccucacggugucagugcugggagccacgggaguguagaggaugcagaggagaggggucaggugcccugcgauugacucaaguggugcgcucauuacugggcacuaggucagcugugcucucauacagacgugggauuucugauuuugauuguguucuuuuucugugugaacauaggacauuguuuuucagugauauaacauuuauaccuuucaaauuuuuauuuugcaccuugaaaaauaaaguucugaaguauucuuuauaagguguaaauaauuagaaaugaagaccauaguucuacuagaaaaaucucuagaccagcgauucucagucuuccuaaugcugagacccuuuaacaguuccuuaugguauggugaccaccaacuguaaagucauucuuguugcuacuucauaacuguaauuuccuacuguuaugaaugauaauguaaauaucugauaugcaagcuaucuguuaugucagccugaaagugucaugaccccaaccaagguugagaaccguugcucuagacuguaacaggacagguagcacucacaugugaagugugcacugugaggaaauggugaaaugcucacugcugucagggccauacauuuccccaucgucuccagcugucccuggacccuuugacaucccuuucucugggccagaugccacccacccauguucccugaucuuacauugcuugcacuguacauaaacugaagcaugcagugugcucuucucagagagcucauuucacugcacauaauuaucaugagacugaugaggcugcuaguaugugccgagucuuuuguguugucuucucagagcggagacauuucuuggaauagcuuugucccuucagccacugauggacauuugaguugcugccgugguuuugccuguuaauaagacuguugugagcauucagauacaagccucugugugcacauaugcuuccuucucccuagguaagcaucagugugaugugucuugagugugggauaugauuagcauuuaccaggcggugcagcuauguucccucuuagcucggauggaucagucugcucuagcaguggguaagugggccgucccguucuuuccagugcugaaugcugcucgguguuuccauccucuuucacauuugcuugcuuaguuacugugugucugugugcauguguguguucaggagucaggucuugccuuuacccacguggcuuccagggauugaaugugggucaucagacuuggugucaagcccccuuacccacagagccaccuugccugcccuccugguguucacugcccccgcagguguagacuugaggccgcuucugaucucagguuucugggcuaggccucucuucauacuuccugauagcuugcagauccuucugagcuguccaaaucuuucggcguuuuuaaaggguauucuauuuucuuacuuucuagcuugagaguucuuuauaagguuuggauacaaguucucauuaugagucauguuuuccugcuuuuuugugugugccuuaucg

SEQ ID NO: 3261 - RNA, 1164 nt, Mus musculus
agauggcggucuccacaggaguuaaaguuccucguaauuuucgcuuguuggaagaacuugaagaaggacaaaaaggaguaggugaugguacuguuagcuggggccuugaagaugaugaagacaugacacuuacaagguggacaggcaugauuauugggccaccaaggacaaacuaugaaaacagaauauauagccugaaaguagaauguggaucuaaauacccagaagcuccuccaucaguuagauuuguaacaaaaauuaauaugaaugggaucaauaauuccaguggaaugguggaugcacggagcauaccaguauuagcaaaauggcaaaauuccuauagcauuaaagucauacuucaagagcuaagacgucuuaugauguccaaagaaaauaugaagcuuccacagccuccagaaggacagacguacaacaacuaacuuuaguggaucucaaacuugucuuaaaucagcaaccuucuacucauguuaaugucuugauuaaauaucaccaugcacaauacccacacaauaaguaaaagaauugcagcugguaaacaugaccuggacaguuguaagaauauauuuaauauauguacaccuauuauguuuucagguaacaagagacgugcagcacaauuuuucuuucuauuaaagcacugucauuuaaacaugaaccugaaguacucaaaauggaguucaggcuuucaagacaaaagcaugacaaaagagugucauguggccauggaaacauuuguuuuucuggaaaguaaagucucaagaaggaagaacagaaauggcaugcuuuaucauauuuagagcugcaguuggaauuguuuaaaguagcagauacaaugacuagucaacaauuguguuaauucuugaagcggugugggugcugacuacuauuaguacaaacauagguucaggauuguuuugauaccuguauuuauaauaaaagguguugggguuuugaauuucuguuaaaagcuguucccguuuguuacauguaacagacauaauaauuuguuuacagucuuuguuuaguaaaacaugcuuagauguuuuaagugaagucaacaaaaaggaaauagguguauggauaugugauuuugagaugaaaguuagucucaaaauguaaauaaaauauggaaugugucuuaag

SEQ ID NO: 3262 - RNA, 1164 nt, Mus musculus
cuuaagacacauuccauauuuuauuuacauuuugagacuaacuuucaucucaaaaucacauauccauacaccuauuuccuuuuuguugacuucacuuaaaacaucuaagcauguuuuacuaaacaaagacuguaaacaaauuauuaugucuguuacauguaacaaacgggaacagcuuuuaacagaaauucaaaaccccaacaccuuuuauuauaaauacagguaucaaaacaauccugaaccuauguuuguacuaauaguagucagcacccacaccgcuucaagaauuaacacaauuguugacuagucauuguaucugcuacuuuaaacaauuccaacugcagcucuaaauaugauaaagcaugccauuucuguucuuccuucuugagacuuuacuuuccagaaaaacaaauguuuccauggccacaugacacucuuuugucaugcuuuugucuugaaagccugaacuccauuuugaguacuucagguucauguuuaaaugacagugcuuuaauagaaagaaaaauugugcugcacgucucuuguuaccugaaaacauaauagguguacauauauuaaauauauucuuacaacuguccaggucauguuuaccagcugcaauucuuuuacuuauuguguggguauugugcauggugauauuuaaucaagacauuaacaugaguagaagguugcugauuuaagacaaguuugagauccacuaaaguuaguuguuguacgucuguccuucuggaggcuguggaagcuucauauuuucuuuggacaucauaagacgucuuagcucuugaaguaugacuuuaaugcuauaggaauuuugccauuuugcuaauacugguaugcuccgugcauccaccauuccacuggaauuauugaucccauucauauuaauuuuuguuacaaaucuaacugauggaggagcuucuggguauuuagauccacauucuacuuucaggcuauauauucuguuuucauaguuuguccuugguggcccaauaaucaugccuguccaccuuguaagugucaugucuucaucaucuucaaggccccagcuaacaguaccaucaccuacuccuuuuuguccuucuucaaguucuuccaacaagcgaaaauuacgaggaacuuuaacuccuguggagaccgccaucu

SEQ ID NO: 3263 - RNA, 3969 nt, Mus musculus
agccuagacaacuaggaggagcccauaucaucuccgugagguuaaaagaaggaaagucuucuuuugguuaauugcuuucauacagcaaaaggaacaaugccagucuaaguacaguuuuucuauaaaauacagguuuguguaagaaggauccuauuuuccagggaggaacacauuugaaaauaaacauccugaguucucuucauccuacacagacagcaaucuggaaauggaaaauuauauauauauauugugugaacccucuguaucagcagaugggacuccucaacacuacauaggaaccuugcgguggcaguuagugugugacacaguuauuguagucacaaauuaagguucagacacucucuccucuugccuaccaccugcugucauuagggaaaucaccuuguggugggcuacucucauuuuuacuguuguuuuauguccucaccagcagacgugacaucuuauuuuggucuuuccggcugcgggcacaugaggcgugggguaacuccccauagucuggguuuuagugauggagccagaauguacacacagagcaccgacuuccauuccagucuuucucuucaccgucuguucagugaacccacgagugcuguuuagacuccuccguggcuaccagaucuaaagaccuuccaucgagucuguggagaggcuuucaaauacaaaauucaacagugccuuuguuuuuaugaaaaacaggucuacucucaaucuguaacuguuugaugccaacugcauacacagcacuguugccaccgaagcucaaugguagaaucugaaaacauuguagaaggaucagucaugaucaugugacacuuuaaaaccuaaugugacacacacacacacuccacuccccauguggaauuuccaugcuguggccuacaauuuuagguucaguagagaauuuaagaaaaaaaaaaaaaaaagaucccuuccaacucuuuguaccuaaaagugauuaauuauuggguuuucucugccuuugguauuuccuggcaaacaccuuugaaaucucagagccacguguuuauucaauuaacuucuacacccugugaucugggauaagaaguuacaggccaccuuucagcucccuaggccacacugaaucuaccccugcaagagcugagacaggugcucuccucuccuccugcucugcccuuguuucuuuucccccuccucucccuucccucuugucuuaaucacugcuaagaugagaaucuuagcuggucaaagugguguacaauguucaugccagcauuugaaaagcagaggcaggcucuuacaggauugaggccuacagagugucuucaagacagccagggcugccuauugcugugaagagacaccuugaccgaggcaucuuucauacaagaaagcauuuaauugggggcuugcguacaguuuuaccagcuaauccuuugucaucauguugggaagcagacaggcauggugcugaagcuaagagcuuuacauucuuauuccucagguaagagaccuccaacaaggacacaccucccaugaacgggggacuaaggaugcaaauaaauaugagccuauuggggccauucugauucaaaccaggacaccuccucucugcugucuucucucucuucucauuuccuuuuuuuuuuuuuuaaaugucggucuguguagagugucagcacuuuggaacagcaagcaauggucgugcuuuugcaugcauuggaggugagauuucaguggcaggguuaguaggaaggcuggggucacuuccuacuguuuauuaaaucugagaaauugugacuuacgugaaaagucuaauacuuguauaugucccaucuacaauaucaauuugacugucuccucggcuucgacaauugggguuuagcacgauacccuuggcuucagcuucugugacauuuggaugucauguucagugcucuacugugaaccaucugugcuuucacuggcugcuucugaaacagacauacauaugcucccagaggccggcugguaucuaugagguguuuguaaguguccauaagcgaaagucaacaagcacagcaaaccauacauaaugaaaucucgauucagagugguagcucugggcaugguggcgaguaacuaucauccuagggagauggcuaugaguuagaggcuagccuggaugaccugguacuacucaggccuuucucaaaagcagcuggaggagagguuggagagacggcucagugguuaagagcucugacugcucugcuuuccagaggaccuggguuuaaucccuagcaccuacugauggcuuacggccaucuguaacuccaguucuagggggaaucugacacccgcuuggggcuucuuaggauaacaggcaugcguguaauucacagacauacaugcagacacaaugcccauacaugugauuuuuuaaaaguuaagccaggcgugguggcacacgccuuuaaucccagcacucgggagggagaggcagguagauuucugaguucuaggccagccuggucuacaaagugaguuccaggacagccagagcuacacagagaaacccugucucgaaaaacaaaacaaauaaaaaguuaaaaacacccaagcaggacccaucccuuuaaucccaguacaccguagacaggcaggugaucucuguaaguucacggccaguccagucuacagagugagugaguuccaggucagccggggcuacguagugagacccuuucucaaaaacaaaaccaagcacacaugcacaugguuaugucugagaaaauccaaacaacaaaccaaaaaccacaaaguuacugagugaucauaaaacaaugauucagucaguuaaagucauuauagccuggccugcagacaggacaccugccacaucaauguagaauuauaggaaguaauacuugguguuuacucauaaagaauggaugccauauguuugaugaaccaagauggguaucguuucaugaugagauucagaaauucauucucagugugaaagugucauugaacagagaggcaggcaacucuccuuacauucuugcuuccuacuauauuuucauacuucccauuucugccuuucccuuucuguuuaugauauagauuucuggguaguacaggaaccacggcuuucuuggaacacaugacaggccuugggaacccuuguguagguagaagagcguuuuugacuagaccuuagauccacucaucuaugauuagggcuguuacagacacuugaaaaggcuaacaccugcacacacuccuacacacaugccauauuccuuuuacuguaucugugaguugaagaaucaugcacaguuaaggucacugauuucacaacagccuugagggccuuuaccucugacaagacuucuugggcaaaagagaaagugcuuggcucuaguuuuuguuuuucacaggucaaaacuggaaauauucucuugaguccgcagcauaaacucugugugugucacucugugugugaacaugugggaaccaggcacagugcugauuucacuggguugacauguuugcaucgucguugaaaaaaaccaugucuacucuucagagcuccuaagaagucccugaacaugggauguuuucuguuuuguuugcucaaaaaguuggguguuuuuguuguuguaauuuuauuugcaaagcaauacauuuuuaaaagaacaauccaaagagaagaaauuauuacaguuaguaaaauggaagacaagaacuaagaugaccugaccaucucaucuuuuuaauuguuuuaucucuugcuuuucaccuuaaaaaaaaauuaaaagcuuuaaauauguguuauuugauaaugcuuuugaauuguguguuuuuccucauaagauuuuaagcccaaagguguaucuuauguauaauuaguaaagaguauuuaauacauagaauaguuauuuuuuaaaaaauuauuaaaaauuuuaccuugauuauaau

SEQ ID NO: 3264 - RNA, 36315 nt, Mus musculus
gggagcgugcgcgcgcugacgugccgggcgccauguuggagggcuggugguagcggcucggggagguucucgcucuguccgucucgcuccgucucucgcuuccccccgccccggcucccuucgggaccccccuccccggucgccggcguguggcggagugugugcgagggcgggggcgggcguccgggggggcgggggcgggcgccgcggcccccgggacggcggccgagggaggcgccggcggcgagggacugcgcggcgccauggacgucgagaggcugcaggaggcgcugaaaggugggggucgccgcgcugccggccgcgcgcucgggcggaggccgcccgcgccucccugcuguagcugucgccggcgcggggcuuuguguggguugcgggcguggggugggggggaggggagcgccuagcaccggcgcggccucgucgugcggcggcggcggcggccuccgggccuggggagguucgcacucaucagacgcuggggccgcggcuuggcaagcaacaggcucgagaacacugcuucccaaacuuggaaccgcggggucccggcguucugaaaacacccccacccccuaggacaugcgggagcauuuggaggauggcggcucgguuggguggcuuuaguggcuuggggcuggauucauucaggugcacgcugcggcggucgggguucgggucggaugccggggcucccugcgccacacuuggggaacacugaaggauagucugugagguggagugcccccuuuaggagaauuugcacugccggugaaaaaggguaacgaggagguaggaauucagggugcacguauguggguauuugagugagaggcugauuuucuuucuuaaauuaaaaaaaaaaauuucguuuugacacaguuuuucuguguugccuuggcuggucugaaacucaaagaaauccgccugcuucugccucccaagugcagagauuaaaggcuugucccacaggcgcccagcugagucugauuuucuuaauuguuuccaaauguagagaaaguuugaauguucuuggcaaggacguagugauaacccuuuuuuuuuucuuuuucuuaucuagauuuugagaagagagggaaaaaggaaguuuguccuguacuggaucaguuucucugucauguagcuaaaacuggagaaacaauguaaguagaaacauggguucguggucacaggccuaccugucauucagaguugcucaggaaugugggggagagaggauuucaaaacacucacggaauagaucuguccaaauucgagaccccuggggaugggugagauagcccaacagguuaagguguugacuagcaggccugagggcuugcguuugaucugggagugccacauaauagagcugauucccaaaaguuguccucggacucaaacacaaaucaauaagugaauguaaguuaaaaaauugagaugccuuaaagaucacaguagaggugagaaucuuucugcauguugcauaacaguuguuaagaauuuaucagaguuuuuuagauuucuauacuuuggcacaaagaaccuacuaguuuuaguuggaaagaacuuaggaaagaauguuccauuguguggcuuugauacuguuucagggauuuguugaggauuuuuuuuuuuuuuuuuuuuugugcuguugcuuacccagccuuuuguuuucuuacuaauucuuguaguuguuugaagucuaacuuguauuucuugccuugaggacuuaaggugauuaucugacacguuccagauggugagguugucacuguccugaccuaggcuagcuaacuuacauaugcccaacaucuuacuaggcucuuuuccaaaaguugcucucaacuuauacuguauuuuuuauccaaaggaagaaucuaguuuuauuauucuauagcuuguguggaaaaaguugcucucacaguuuggcucaguuacucuggaagauaacccaucuuuguacacugcucugaguaggguagggugaggagcaggaaagaggaaagguuauuuuggguucauguuggugaacugccugcuuaguuugaauaauauaaucacucagcaagugauuguacagcuucucugucauuagcacuguucagucagggccuggagccacaacuauuuauuuuagaccaggcuggauuugaacucugaucuguauugccccugccuucuuaauagguagccaaaccaggcuguuuuuauccuuuuagguguaaccuucaccuagcucaggugguuuggaacucaguagguaacccagacugacuucauacucagacgugccucagccaccaagugcugggguuacagaugugacugccaccccggcuucccucauuguugucaacaucuuguuauuauuauugauuacuggagggcacuggagcugggaccuagugucucaugugcaagacaagaaagagccauaacacugaacuacauucucagccccuuaaaaauuuucuuuuaagccuuuaaucccagcacucgaggccgaggcaggcaaaucucuugugaguucaagccagcuugguuuacagagugaguacugggacagccagggcugcacagaaaaacccugucuugaaaaaagaaauauuuugagaguuacccacacacuggcuuugaacuuaggguccugcuuuuucaucucuguagugcuggaacuacaugcaugccccaacaugcucagaucugucuuuauuaacaaguauucauuucuuacacgauucauuuaugguuguaguuuagcuuucuaauaacuagcugcauuuuagaaauaucugguguaguguauaauuuaguacuguaaagcagaaccuuuucaguggucuguuaaagugcaccuuuaaucccagcacucgggaggcagaggcaggcggauuucugaguucaaggccagccuggucuacagagugaguuccagaacagccagggcuauaccgagaaacccugucucaaaaacccaauaugacuaaugugacuauaauucauucacuuaauauuucuuugcaugucaguuuuaagaauggaauucuugcaggacaugauggugaacaacaccuuucaucccaguagaagauuaaaggcacagacagguagauuuuuaccaguucagguacagccuggucuacaaaauucuaugacagcuaaggcuacauacugagacucugucuuaggugggguuaagggaacccucucccagaguggagagguggcucagugguuaagagaucugacugcucuuucaaaggacccagguuugauaauuggcacccacuuuuaggcuaacaagucucuaacuccaguuccaggggaucuuuucuggucuccaagggcauagaacacacauaugguacacgcuuauacaugcaagcaaacacccaaaaugaaugcaagucacuaguuuacuuauagaaaagccuaaaaaugauuagguaccauuuuucaaacguagucccuaagugagucccuagagaaucauugcuguauugccuuucuuucucuugagcuguugacuagacugagcuauuucugugucaucaaaagaaaaacauuuuauuuucuggaaaaaaaauuuuuuuuuuugacaaaagauuaucuuagcuuugacuauucacaccuuuguucccagcacuuggaaggcagaggcaggcagaucucuugaguucaaggccagcuuggucuacagagugaguuucaggacagccagggcagugcagagaaacccugacugagguauaggugacggguaucuucccagucaggucuauacacauugccuuaacuguuugauuaguacagugccuauaguugaugugcucugaucuagaacuucagcucucugcucacuacauuguuuggcuaguauauauuuagauguuuguauuaaaaugagugguguuuuuauauucuuuauuacacuuaguggagcuugaacuauauuuuauuuuccaaacuaccuguagccugucucugcuuucuuuuucacuagucaggggugaaagaaaccugggucuugcauauguuagcccggugcucagccauugagucacaaugcagaaccagauagggauuacuuuguuuagcugguucuggagaugauauucaucacugggcaacauccccaguccaguacuaugaggcuuuuuuuuuuuuuucccacaacaaauucccugguucuggagaugaaugaguggcucaguaucucucacgauuacuacaugaaucuauuuuacaggagaaaagacagaaaugaugcuaguguuacuuccauaaaacaggaauguuaacauuuuuuuaaggcuuacauaauuuauuuuuuguuuuuucaagauggguucacuguguaguccugguugucuuagaaaacacucuguagaccaggcuggccucaaucucacauagaucccccugccucuguuugccgagugcugggauuaaaaugugugccuggguguuuucccugaauguaugucugcacugugugaaugcugugccugccaggaucagaagggaacgucuggaguuucaggggauuuucaggugccuauggguauuuggaaaugaauucagguacccuuaacugaugaaguaucucucuagccccaagaaaguuuuuauuuuuuaacaaaugcuccuacuucauagugcuuucccucuaccuguuuagaggcagguucauguguagccauaguggucucuuuauguggaguugguaucuggacaugaaugagcuuuguuuguuaaugccacauuuaggagcuuagugagcacaaauggccccuucagaucuucucuucacucacugguggaguggccaagaguguuucauuuguagcuguggcuuuuaagucaggcugccauggcucuggugauaccugcuggaccuuuugugugugugucuuuguagugaaacugauuagacuuuguguguaugagagagaagggguggggggaggcacgagccaacggagggaggaggggggcagggaaggagggaggauucuuaguucagagccuugaccucuaccacuguucuguuuccuuuugaacagguaggucccagaggugcacaauuuguugggcuuuuuauuuugcugucuagucugccugacaggguuuugagagacagacaaagcugacagugccauucuuuuuuauuucuuucucuucucuucucuucucuucucuucucuucucuucucuucucuucucuucucuucucuucuuucuuuuuucuuuuuaaagguaaacuuaaauccuugcuagaccaguguaguguggcaaaacuuuuccuggggaacaauauacucacccccauagggaucucacaacagaccaaacuacggauaccaccaaagucccccuuggugaaccagugaauuuucuugggguuacuuaggaacagaaugacucaaggacagcugcauuauuaccacgguccaccccagcaugggugacagcucacaaaaucggauaaaccugaagcacacugcacagccugcaggcagcacaacagcuuggagugucccuuuccuuucccuuuccuuucccuuuccuuucccuuuccuuucuccuuucuccuccuuucuccuuucuccuuucuccuuucuccuuucuccuuucuccuuucuccuuucuccuuucuccuuucuccuuucuccuuucuccuuucuccuuucuccuuucuccuuuccuuuccuuuccuuuccuuuccuuuccuuuccuuucuguugcucuaaaccacuucgcaucagcucuucugguucuuccagcuucuuccaggcagcuggucucuucuuugaagcucagcuucucuucccugagaggaacucauucucagcuuuauuguuuacucugucugggagugcccuagugaaucuggucagcuucagggacuucuugcuuuguuuaccucugcuuaaagagcuugccugcaggauggaauguuuuuugaucauggaggaagcuguuaccuagcagccaguuaaaauaaggcaaguaccucaaacaguauggaaauaauaugcaaaaauuagaccacuacuuggugcuaaauaaauaauagcugugauacaguuugcagugguggcuguguugggaauuggagguggucuagcaauuuccagguuaaccuggaacuuacuuuguaguguagguuggcuccagcuggcaguccugugugacucuccuuauguuuauauauuugauacuucaggaaggauauaaaguuagguaacuuagaaguaguuacuagucacuaggaagaucuacauuauuacagugugaggccuugauacauuuugagguggggaauauuuuaucuguaguacuuuuaacuuaguaaucauguaaugcuggagcauauugauuuuuuuuuuaagucuuaauuuuuuuuugguuuguuuuauuuuguuuuuuuuucgagacaggguuucucuguguagcccuggcuguccuggaacucacucuguagaccaggcuggccuugaacucagagauccgccugccucugccucccaagugcagggaucaaaggcgugcgccaccacgccuggcuacaucacacuuuuaaguguggaauucagaggacaccuuguaagaaucaguuauaauacuuuuaccauguggccccagaaucaaacucaggucaucagauuguguuccaucuuacuagucucaguuuuuguuuuguuucuuuuuuaugaaagaaacuauagaucaaaggcauaugccuggcucacaaggaacuucugcuuuggguuguuaacugucucucaccaaaccucaaggaagacagauuucaugaacauguuuuguauaagccaucaaauauuuccugugcauauccugccuuagucuuugugacuguuuucugugauaauauucuguuuaaaaugaggcuaggcuuacaaucauauguacagaugaaaaacaaugcaguuauccuugggcauggacauuaucagguccuaucagaacucauuccuugaugcacugcgugugcuguguucacuuguauaacaucucucuccagcagucuuacuuaaaccuaccaguagaauuaucauuauuugagguugucauuguuuaccuaaacugacuucauauaccuacacagcucuucuuccuucgugguacauagagcacguggccugauggcugagcccuguggauaggauaggugcuugggcaggaauuggaagguuguguguggugaugcuugcacacuauuuggcaguaaaauagguggcccacgugcucuuaacaucuuuacuuugucauuucuaguaacuucaaagccugaacacauuguguaaauacaguuuuugcagaggcauaaauuugauaggacauugauguuuagaccgauacaugcuauuuuaguuuguaauacauaaaccuaguuuuuuuccguauaugaagaaggcauacauuguggaagcauuugaaauuugagggacaugagagguuucacugauguugguguagguuuugcucuguugugucuguaaaaagaaggugcgguggcuuccuaucacccacugucacgcugucucuuaagcuugcaugguaagggaauuuguguuuacagauuucuuuaaaauuaugguuggauuuuagaggucuuuccacagugauuagcaguuauuucugagauuaccgcauuuccuuccuaccaguucugggcauggagacuggucuaacuuuuuacggguuuuacaaacaguauuucuugauaaaacaaucuugaauguggguacaauuuugaacauuuuucucuuuagagacaguaucuuguagcucaaacuggcuuugaacuuuguguauaagcaaggauggccuugaacuuccugauugaucuuccugcuuccaccuuuguaauguuaggauuagagguuugugcuacugugccuggacuacauuugaagguauuuucugaguccgugaguagguaccguugaugacuccaugauaguucacggugcuguugucuuggauuuugguauuuuuuggucuuuccuccuguuuguuugguagguucauaauuuccuuguugcuugacuuucuuguauuuucuguggucuguggucuuccugucucacucacucuaggauaggauugaaaucacuggcacagcccaagugcggcaacuuuaaaccauuguuaaugguucuggagagaugggucagugguuaagaucauuuaugcuugcagaggucucguguucgguuccuaguacccacaccccucaaaaaucauccguguaacuaguucccggggagcuuacaucuucugaccuccaugggcacugcauugugugcacaugguacauaaugcagacuaagcauucauaccgauaaaauaaaucuuuuuuaaaacuuaaaaaaaaauguaucuugacaauauuuuuaggguuuucuuuuuucucccugaggcaaggucucucuguagccuugacugucuugguacuuucucuguagacuacuagacuagacuuuaaacccauagagaucugccugccucugccuccugaguucugggauuaaaggcacuuguugggaguugauacuauuugcaaacauuggagauugcacuuaacaaacauaggugguggaggucaguuaguaagccuccuggugucugagucugcagcuggcaccauacaguuugcuguuacauagucagcuuuagcuagacuagcuuuagcuagagacauucucuagcaauaaaauguauguaggccagugagucacauguucuuaccaagaauuaugcaucauaguaacuauaugcauuacuguucuaagcuauagugcaaugaguucuugggaaacucauauggacuguacuguguuauaguacauuauuuugauggcauggcuguggcaccacacuaggcaauaggaauuuuuuauuuucauuguauucucuuauucuguugaugaccaaaccauaguuaugaaguauaugacugaauauuuuauauacagaauuuuuuaaaagauuuauuuauuauuauauauaaguacacuguagcugucuucagacacaccagaaaagggcaucagaucucauuauggaugguuacgagcuaccaugugguuguggaauuugaacucaggaccuuuggaagagcagucagugcucuuaaccacugagccaucucacagcccuauauacagaauuuuuagugguuguguuucuucauagaaacuuccaugauucacauguguuguaguuuguuuuuacucauggcucuguaacugaguuggcagagccugacuuguuccucagcaguccuugcaccuguuaggcuuaugaaaggcuggccuagaacuuguuacacuuuugcugcugucucuccauuguugugauuauaggccugcgaccaccacaccaagcugggaucaugcuuuuguaucauugguccuuuaaaaugaagacuuaacuauuuuagcuugagcugauguaacaacauagaggcugcauggauuaauaagcaggucuuuuuucccaguuucuuagacugugaaaucuaaaacugugagguccuguggugguggaacuuugucgucugccuugucaguauuuuauaacacuucagaaaaugucagcuucucaugugucuaggcucuaaccuaaucaugaaggucccgugcagauguccuuaacuagccaucuccucaagucauugcauugaaguuuaaaggcuucaaaucgcaaauauuguaagaucucauaauugaguugauacuugucacaaauuugugcagugacugagccucagauuuacugauuaaauaggagugugcguacguuguugaagaugacuuucuugcaaguguauauugaguugcagaaacauuuuagcugucccuuccacugucuuuaaaagaacugugagaaggggcuugaauuuguuaaguauaaucuguguggcuacuuagguacucaacagccuguacaugugaaaugcuuuguagcccuugauucuccuaccuccccacccccauccccaacucucaagcaacuggauguggaugugugccacugggccugacugaaaauguaguucuuuaagagaaauguuucacguaauuuuuaagagaaguguuucacauaguuuauuagaugagucuaggaccaguugggaccagaaugaagucaacauaugacuacugauuuugcuuugcauuucuacuuuaaagaaauggcauguaugccaauaauacaacauguauguagggaggugugugugucuguguuguauauggugugaguaugucggucagaacacaacuucagaugucaguuuucuccauccugaagcacugugaagaccagguagguugguaccuuaggggacuggggagauagauacucugagucaguaucaucuugucuguauuagccuagcauucuaaaaguauacacacaacagggaaaauguaaaauugaaauuagcuuuaaucggggcaguguugguacccgccuuuaauccuagcacuuggggaggcagaggcagguggauuucugaguucaaggucauccuggucuauagagugaguuccaggacagccaggguuacacagaaacccugucucgaaugcccccacaccccccaaaaaagaaauuaucuuuaacuccuguuugugaauauuuauuuuacauauacauauacauauauauguguauauauauguauacacacacacacacacacacacacacacacauauauauauuguuuguuuguuuuuguuuuuguuuuuucgagacaggguuucucuguauagccuggcuguccuggaacucacuuuguagaccaggcuggccucgaacucagaaaucugccugccuuugccucccaagugcugggauuaaaggcgugaaauauuucuuuuauaauuuggacauaguuauaacuuaacccaacaauggcuugucuuaguuaggguuuccauugcugugaagaaucaccaugaccauggcauggccacucuuauaaaagaaaacauuuuauuaggcuguuuguuguuuagggaucuucaaauaugugugcuguuucagguuaauaggguuuaugggaaaaaaucuuaauuugugacaaauugaagauuguacagagugcuaaauuaaagcucagauucucugaaugcuaaggugaaccuuuaaguuaggcaaucugcuagggugcauguuuaaguggcucauuugggaguguuuaaaaagaacuugaguuaauguacuagucccacaacaguuuuaguauuaaaaacuauaaaauuuuaaauugugaugggaagguuagaagagacccuccaccugccauuucugguugaaacagaagcauucuaaauguuauccuaaaagaguauauggguuuuagacaguaccauaauaaguuuaaagacuuuuuuuuuuuuugauugacuuaaauccaaaaggaaauaaaagaggaaaaagauacauuuuuuuuuuuuuuuuggaaggauguugaguuagcaacgaaucaggcuuuggguaggaggauaaggcaccugugggcgacaaagccauuguaguugguagagcuguuccuugggcugccauaggccgacugugcuucaacugguuucucuuucgguuuccuuucuguuccaccuuucagaggcagaauauaacugugccacaggcaugguaguacauaccuguaaggcauagagacuagggcauuucugugaguucaaggccagccugagcuauaaggugaguuauaagccaguuuuuuuucuuuauauguuuuaaagguauaaauagauuuuuuugacaggaagaugugaugggggaauggagucaguagugaauuagggauuucaucacagggagaagaaaauucuggcaggaacuauugaugggaaacaucaguuugguguuggacaguuuuagcaaaauggaagaaugaaguacgugguugaauggaugagucucagaaauaaggucuaauugacauaccuagguauaaaaacuaugcugggugaaaccauuaucuguucauaaagaagagguaggcucugcuccugaaugcugcagcuuugaacauuuaaaaaugaggaagaaugguaaccuuucugaacgcuccuuguagagcagggaaguugagguguuugaauuaaccacugaggccuguagagaugcucuuccagagguccugaguucaauuccuagcaaccacaugguggcucacauccaucuacaaugggcccugaugcccucuucuggugugucugaagacaucuacaguguacuuauauaaauacaaucuuaaaaaaaaaauaaccacuagauauagcaacauggagguugcugaugaucaugauggggacaaauuagauuuaaugauagagcuguaagcccgacugggagauucgcuauaggaauuuuacugcagaagacaaugaagaaaugaggugggaacuaggaaaggacaguaaaggaaaaaaaugaagaugggagaaauagguaggugggugauuugccagugaaguauucuguagguuugugauaagaggugcauaggugagcauagagauugcucaucaggagguaugcaagagaaagcuggguauuucuucccuaaugcuucaguuuuaaaaaagaagcaggaaguggggccaucaaauuggacaguaagggaguuaguuguuggugaaguacugaagagugaaaauaagggugagugcacuagaaauccugguggagucagacuugggaaugugaaguacauaaaugucucucccucaucaaguacuauaaaaggaaaucucacuagaguuggacaaagcuaagugauacauuuuuuguuuguuuguuuguuuguuuguuuuucgggacaggguuucucucuguauagcccuggcuguccuggaacucacuuuguagaccaggcuggcccugaacucagaaauccgucugccucugccccccccagugcuggcaugcaccaccacgccuggcuaagugauaacauuuuuuuuuugguuguuacuuucuauacugauuugucauuugacauauugucuuuaucuuuaaauaaagaaauauaaaugaguugggaaucauuacugagaauuuucuucuccuuaacaaaagggaaugcuuaaagugccucugaagguauuucuagggcagagacuccugaaguuaccuauuaugugauaguauguuaaagaguucaacaaaagucuguuuugcuggguggggguggcacacuaauugcagcacuuaggaggcugcaaucugaucucuuggaguucaaggucagccuggucuagagugaguuccauaaacagccaggacuacacagagaaacucugucuugaaaaacaaacuauaaaacagucucuaacugauccauuuuacuauuauuagugucaucccaaaaugucccccucauccccaaguuccuauauuucuuucaacuucauuacuuuuaaagauuuauguguaugaguuuuagccuacauguaugcauauauaccugcaccacgugcauaccuggugauccuagaggucaaaagagaccaucaaaucuccuggaauuggauuuacaaauggucgucaaccacagugugagugauguaaaccuaaucccaccccucugcaagagcagcaaaugucaguagucugacagcugacgaggggagcacauacgucuccuuagagcagcgguuuucaaccuuccaaaugcugcgauccuugacuagacuuccucaugugguaacacucaaacaugaaauuacucucauugcuacuucaugacuguaaucuugcuacuguuaugaauuguaauguaaauaucuuaggcaaucccuccgaaagguucauuugacaccccuucuaccaaguguuaugacccaccaguugagaaacacugcauuaaaguauauucauuccuguuagauuauucuucauucuuuaacacauuaaucuugaggugaaauaugccucugucugauaaaauauaaaaagaauuuaaguaggagccaugguugaccacuuuuagucagugucauauguacaagcugcucugcaucacuccuuggcuuuugugaccuuuggaagggcugguccaagcagcccauuauacaugcuugagacaggacugccuugcuaggguuauagguagggaccuccaugccuagcaaugaagaaccaguuuuaaaguuaaauugugugauggucauaauguguaguggugcucauguaggaaucagaggauaacuugcaggggcuuauaucuucugccuuguagguccagggauugaacucuggucaucaggcuuggcagcaagcuccuucaccuguuauauuaucuugcugaaccagaaagagccauucuugauuguuuauuccaaauugauugccuauagguuucaaauuccaugucauaggaaucuuuaucuuacaacugagaugacaauuuuuauaaugaaggugcucuuuaauaauuucauuuuucuaggcacugugacauccuuguucacuugauuuuauugagcaagggaauucuggacagugaacugacuaauucugcuuucaguguuuaaagacguauugguuucaccucacuaccauggauaguuugggcauaaaguuaaaaaaucaucaucucuuuggguuuugaaggugucuucuuccuguuacucuuacgacacugccuuuuauacgucucugguauguuuaaucaaugaaauauuguagugcuuuuuauaggguuucaagauuaugcaauuauauuaugcauugauguauguaugucuugucaacucuuaguguggcuacuuucacuuacccuuaaacucuuugaaugugaaaacuggucgucauccuuugccuucaagguuuuuuuguuuguuuguuuggguuuuuuuggggggaggggaguucgagacaagguuucucuguguagcccuggcuguucuggaacucacuuuguagaccaggcuggccuugaacucagaaauccaccugucucugccucccaaguguagagauuaaaggcgugcgccaccacguccggcuucaagguuuuguuauaggagcccuguugauaacaaauucuggauacucaaguuccuuaauguuuauuauguucaaccugcacauaccuuucaugugcugcuugucuuggugaccucugugcugugauaaaauaucuucauaaaagcaacuuaaaggggaagggauuuagugucauaguaaccccuugugaugcaagagcaccacaggaagacgaagguggauguuuuaaaggucacagugcuagagcauuuauuuuaaaugaaccauuuacacuuuagaauuugucuuuucaccuauauguuauuuuaugucucugagauuucauuuggcgguucuggguuuccuaguuugauuuuucgcuguaguccucagcagagggauuaaggauugcacugguuccuaacuggcggcaguucauuuagcagugucuagaggcauaguuguuacuucugagguguuccuggcacaaguguuuggccaugcugcagaaaacuaaaacucuuaaggcagcuugccaugacauagauuccaacauuacugaguaugagaaauucccuuuauuuacuuuuuuuucuucuuguacuggcuuuacuuaagucuuugaccuuuucgauuuuuuuuuuucuauacucaucuuuuuaagggccagccuauaguuaggacucuuuccugauggcuuugugccauaguucuaaaucacgugaucuuuuuguggcuucuaugcauuagcacuaaaaucucuguugucgaguuucuauuuaacaucuaaagucuuuugaaauaaauuaauuuugcuaauuguggaucuuccucuuugauuucuucaggaaauuuuauguugagauaugcuaaucuggaacuggguuccagugaucugugacaccacuuugggaccuuuuaacugcucucaaccuuguuguagguuguuaaaaugaagagggagggguggguuaucuuauguagccccugcugaccuugaauuccugaucuucugucuccauuucccaacuguugggguuauagucuuauuacaucaccaugcccaauuuaugcagggaucaagcccuggccaucuaccacauauccagcccuagauuuauaaacaaaacaaaagaaaacaaacccgaguuucugauuguacuguuagugcaauuugguuuucaucuggauugcuguuagguugucaucaguuccauucaucauugcuuucaauggcauuauuaguauaucgucagcacagcgaagauaccugacuucucauucaagccuuguucucuugaaucacuuacuuacagaaguauagaugaaggguauacacuacucuccuaguuuacagggcaacuaggcaauuguauguuuagcauuuuuauguaugucugucauagcgcauuauuauacuguuuuuuauaauugugaacuugcaugaaauuacugucugcacaagaaaauaggugauaccccuaacuuuugugucuccuaaaacuuagacuguauguucagguaucaccuucaauuuuuuuuuucuuacacuaaugguaaggugugaggauaaaaaggucugguacuauuccuagagagacaugaaugaaccccuacucaugcuuaauuaggaaacaaugucagaccaaaguaaaggauacuacuaccaaaguccagcuuggugagcacuggcucaguuuacauacucugguuguuagucugcugcugugaagagaccccaugcccguggcaacuccuauaaaggaaacaguuuagggcuugcuuauacuuuaggcagugguucucaaccuuucuagugcugugacccuuuaauacaguuuucucauguuauacugauucccaacaauaaaauuauuuuucuuucugcuucauaacuguaauuuugcuccuguuaggaguuguaauguaaacaucuguuucugauggucuuaggugacccgugugaaaggauguuuaguccccuagagggucucgacucacaaguugagaaacacugguuuagaaguugauccauuauuagcaugguggcagcaggcaggccgugcuggagaaggaacugaaaguuguaugucaucauccacaggcagcaaggaagagacggacccugggccuggugggagcuuuugaaacuccaaaguccauccccaucccguguugacuuaguucuuccaacaaggcugcaccuacuccagcaaggccacacuuguucccugucaaguagcaccacucccuaaugaccaaguauucaaauacacuaaccuucacacugagguacuuauaggaagaauggaugaaggguuacuuagaagagcagaaaugcagccgggcgugguggcgcacgccuuuaaucccagcacucgggaggcagagagguggauuucugaguucgaggccagccuggucuacaaagugaguuccaggacagccagggcaacacagagaaacccugucucgcgaaaaaccaaaaagaagaagaagagcagaaaugcucccaggcagcuuuaucaccaaaaguuuaucguggcugguaacccacggaacuggaaauaaggaauguaccaugcugcuuguaguuagcacagucagagggugugucuuccaggcaguauggccuuggagagagacagugcuagagagaugguuuagugauuaagagcucuuguuauucuuacagaggaccugaguugauuuccaacacuuagauacaacuuacaacugccugcaaaacuucaguuucaggaaaucugacacacucuuguagccuccuugggcaccagggacccaggagguucacaagcaaacauucacacaaaacacccauauauauuaaaaauauauucuuacugcuuaaaugagcuugggauaagcagguuguagugaguuggucaguguccgguacuugugaaacagcugaguuguuuacugucugggucucaaggggcaucccauaacaacuuccugagucuuacaacugccuucaaagauggaacauuuuauuuuggaggaaauuaccacacaacaaugauuagagaugaaaaaugcauaauuuccccaugcauaugugcauguuugugugcuuguguguauguguaucuaaggaugauguugcaauugauuuuuuuucucccuuauuuguugaauacagucagugucucuuguugaacccaaagcuugcugaugaaacuugucaggcuagagagcuggcuucagggacccugucuuuaccuucuaaguacuggaauuauaguaggcagcuaccauaccuaccugguaccugguucugggaauccaaacucuuguucuugugcuugagccccgggugccuuaaacacugagccaucuuccuagcuuaggcaguuguguacuuuauuuauuacugucugacaggcugggaccagcacccugaauaccucagaugacaagugacugaaagugucggggguggggugacagacaguaaaguuguuuuggcuuauuuuggguuguuuauauuguuugagugaaaaucucacuguauggcaccugauuggcuuggaacuuaaauuguagacaaaacugcccauaaacucagagaucccccugccucagucuaccaagugcugggauuacagguguaugccaccaaaccuggcauauucuguacuuuuagugguaacagacuuuccuaguccauauaagcauuauagcauggaaaugaugaacaccuuuauaauguccgucuguauuuauguguaguguaaguauguuuugugacuuuuuguuuucuaggauucaguggucccaauuuaaaggcuauuucauuuucaaacuggagaaagugauggaugauuucagaacuucagcuccugaaccaagagguccucccaauccuaauguugaauauauucccuuugaugaaaugaaggaaagaauacugaaaauugucacuggauuuaauggguaugcacauaauaauaguaguaauaauuaauuuuaacagaguuuuuucuuaaguuuuacuauaucugauugauaauugacuuaucuuuaguaauugucaaauauugguucauaaguauuuuaaauguuuacaaucuugaaaaaaacaaacuguucuuaugaguuuugaggguguucagacuuuaaauaugcaugauagcagugauauuccuuuaucaaaauauauuuuaauauuuccuuuguuuauuugguuuuacaucuugauauuuggugaaggcuuauuuauacuuaagaaguuuguuuauuuuagaguuuauguguccuccuuucuuccaauaacuaaacaccuuuuaaaccuuuuguaaaacauugaaaacaccaggaacacuaaaugagugugauacuuuaaaaacuaaaaacauugcuauacuuuauuggucgucguguuuauauuuucugaggggaagaugaugcguuugugaaguugaauugcuuuuggcacuagcaacuugaagcaguuguaacagugugaaauguggggaauugguuuauguuaauauaguuccuguuuacugggaggauuuauaugaagaaguuuuaauucuauguuuuuaugccagaaauagccugauucuuuugggggcugguguuuggaacagagaacagagucuuacuagguggcccuggcuggccuuggaaauucagagauccgguugccuauuuauuguuggugagauuuaaggugugccaccauucucagcugcuuauucccauuuuaaguuuagggauuugccuacaauaucagaaguuuaugcuuugauauugggucuauuaauaaaacugcuuuuuccaggacaugccaugcuugguugguguuuaguuucaucggauuaguuuucccaccuugacuggucauuaugaguuuaguuggaacuuuaaaaaaaaucacauaccaggaagaagccauauguuauguuuguuauauguugcauaagauuuauuuuagaacuggguguaugcagaauaaacagacuucuuuguaaaauauuuguguuuaugcaaauguguacacacacaaaaugcauagacauuccaaauauaugcgaguuaaaaugaauugcauugugaauauugagcuaauuuauaaauuaauaaaagcaaauauucuuaauuguauuaaaguuagacuagauaacagauaagcaggcuauuagauaaagcuaaaauauuuauaauuuuuuaaccuguuacaacauguauuuaugcugggcagugguggcacauaccuuuaaucccagcacuugggaggcagaggcaggcggauuucugaguucgaagccagagugaguuccaggacagccaggacuacacagagaaaccccgucucgaaaaaacaaacaaacaaaaaaaccaaaaaaacucaaaaggcaaacggugcauucaucuacuugagaugauuugagcagucauugagugcauaagcacacuuaagcauaauugcucuuacgguguuuuucaucuuugagccauaguauuuuaguucugguuuucagaaugacuguuuuugaauuauuuauucuaauuaggcaggaucuaaguuuuaacuagugauaugaauuucuauuuuauaccugccuuuuuggucuacaauuacauauuuacauugaaacaugauaaccuuuuguucuuaaguucugaauguagauuuugauagauuuaaaaaaaaaaacccauacccuuuugcuuuccauccaguuuauuuucuuucuuucuuuuuaaauaauguuguguuugugaugccuguguaguuuccuguggccaccacaggucugucagaaugucaucuucaauugcuuacuagcucuggaguucauugcuuggcuagugaucgagcuccagggauccacuugccucugcuuaccagcauuugggauacagauuugucuuacccaccaccuaagugugcuggcuacccaaauucagguccucagguugagggacagcaaauauuuuacccaccgagucauuccccaggcuuauucaucaggggauucuuauuucuaguauauguuaaucauguuuuaauagguugucuuugauaaaauugauauaucuuuaaauccucaaauaccagaaauacauacagaaauguauugaaaucaugguguaugcugguuguauauucauuuuucaaaagauaugauaccucagugaacaguaaguacauguauggcccaugugguggcucaucacacaugucaucccagcacugagaagucugggaugauuuaagacccgaaugcugggauuggagagauggcucagugguuaagagcacugacuacuguuccaaaggagucccaauucccagcaaccacaugguggcucacagccaucuguaauagggauccaaugcacucuucugguguaucugaagacagcaacagugcacccacauacaugaaauaaauaaaucuuuauuuaaaaaaaaaaagacugcugacuagccugugcuacauaauuaagaucuuguccuaaaaccauaaaggagagaggcuugagccauggcucagcuauuaagaaaguuuuuaaaaaaaaaaaaaaaaagggcuggagagauggcucagugguuaagagcacugacugcuuuucugaagguccugaguucaaaucccagcaaccacaugguggcucacaaccauccguaaugaugcccucuucuggagugucugaaguacagcuacaguauaaauaaaucuuagaaaguguacuuccagagggccguaguuggguucccagcacccauaucaggcuuuucaaaaaccaccugcagccaggcugugguaguccacgccucuaauccagcacgcgggagcaggcagaucucacaaguuggagaagacccuggccuguagaguuccagcacagacugcagagagagaaaacccgauuggaugcuugcuuuuggcuuacaucaacaugugcccuuguguguaugcacacguauacacaaacugucgcuuuuuaaaaccaaaaaggaaagaauauguaaacggcucagaauaugccuuuuuaucucuagagacaggguugguuuguuuguuuuguuuuaaagugauucgggagagcaguacugugaaccaugcuuguuuguaguauguuuuuacagaacaucuuuugcugauuuguuguucuagguaagaacauaucacaaacaagcacaaagcauagcagaaaccuuugugugugugcuccugaugccucagauugaaaucaagcccauugcaaguucuaggccagcgcuuuaccacugagcuaccucuuagcccuaucacaaaaugucuguguauaccucuguguaguaacugaaguuacuguaguuuuguguauucugugaaugcuuuucagaguuuuguguguaucuucugucuacauuuuucuuucuuucuuuucuuuuuuuuuuuuuuguuuuuuugagacagguuucucuguauagcccuggcuguccuggaacucagaaauccaccugccucugccucccgagugcugggauuaaaggugugcaccaccuugccccacuucugucuacauuugaggugccaguuuauacuuuuguaaaauaaaaugaaguuuuuuauuuaauugcuauuuuuuucuuuugugaguggguauuuuguuagcauguauguuuguguaccauaugcauggugcccuuggaagccagaauacugcaucagaucccuaggacuggaguuaggagugaccacgugggugcugguccucugcaaagcagccauuuaucuuaacugcugagccaccucuccagccuuguucuguuuguuuucauuguauugcugcugugucuuuaguuuuauuuaaaagcuguaaauuaaaugcuuuauagaaucuuaacacauaucuuuauuuucuaaacuauuuuuguaaauuuugaguaauuuuugcucuuugaauugcaaguuguuuacauccuugaucuuuuuuuuucuuuuauuuaaaguaguuguuuuuuuuuuuuuucauacaauacauucugauuauggcuucccaucucuauccauaccguuucccuuuggucucuccugagaaaacaaacaggcaucuaaggaauaaugaagaacaauaagauaaaaauaaauuggaauaggacaaagcaaacagaagauaaaacauaaggaacacauucucauacaggaaucucaugaaaacaaaaaacuguaaaucauaauuuuauauaugcguuaaggaccucuaaaauuaagaagaaggcccugacacaacauuacgaacaacuucccaagaugccauuggguucauuuuguguuucgcugcugggaagggggggccaauccuugcuuuguucacccagugaggcucuccuggagaaaacuaauuuucacuuguaagugccuaucaauugcaaauaauauuuugguuaggggucagaguuuuuguccaguucuucucucaguucuaggacguucucacaugcagacucuguaccugcuucuauagucucuguaaauguuuguaugugcaacuuucguucauucuguguuuaggaggucuuguuuccuugguguuuuccaucuccucuagcucuuagcacucuuucugucuccuccucuucagaguucucugaucccugagggaagggauucgauaaaaacauuccccuuuagggcuaaguguuccaaagucuaauuacuccgcauguugucugaccaagggacucuauuucuucuuacccguuggaggaggaagcuucucugaggauggcugaguguggcacuacugauuuaugaggauaguagacuaucauugggaguaguuugauugcuuuguucuuuuugcagaacaguaguguuugguuuccccuuagauaccuggacugucuuaagacagucucagguucuuggccaucuagacacugucagguauggguucuauggguuccauggcauggagugggccuuaaauccagucagguauugguugguuacuccauaggcuuuaugccacuaauguacaaguauaucuugagaguaggucgccauuaacauuguaaauguucaugcagguaaauguuuuagguaguaguaucagcuuccuuaguauaggaagaacaugcuucuucaaauaaggaaacguuacugacuugcgauucuaaacuguaugagagaauacaauuaggaaucuauucagcuuuuaagacaguggcauguauggagugagauugugagugaauguuugacaugacagggacacaugggagugguaaagccaguaaguauugacaguaugugcagaaagaauccgcaguagcuuuccucuucuggauauuuacggccugaagacagcucuucaaaagacgguuuuacugagguuaaauuaccuccuuauuccacuguacauacuaauaagcauacugagcuuccaggaugcuacagcucuucucugucugagagcacaggccaccuggucuuagcuuuucuaugucagugugucuuuauucauucccucacugcucccaguuagggcugugggacuuugcaaagauuuggcagcaucuuacuauugucuuacugugugucucuggcuggucuggaacucgaagagccaucugcuuuguuugcuucugagagcuuuuguuguuguuguugguuauuuuuguuuuuuguuuuuugagacaggguuucucuguauagcccuggcuguccaggaacucacuuuguagaccaggcuggccucaaacucagaaauccgccugccucugccucccaagugcugggaucaaaggugugcgccaccacugccccugagagcuuuuaaugugcccugccacacccagcuucuuucuguucaguuuuugauacuagguuucaugaauaguuugaagacuaaguagaaaagaaaagcauacuaaagcuacaugcuaugcauaaaagugaguggcucuuugggccuuuuuucccugaaaggauuuacauaaucacuacacuuacauaauuuccaccccuuccuuuccuccucugguccucacaaauuaaugaccucuuacaguguguguguguguguguguguguguguguguguguguguauaccugaguauagguuugugcaugcaggaauacuuuaaggucaaaauccagaacuuuugcaagagcaguaagugcucuuaaccacugggccuuguuccugugccguuugccuguggcucuucacaguacaaguucccccuucgugucagcacaucaauugauguugacaugcaagucuuguuuagacagcaggacuguugagacuugauggugcagcuucccuguuaaguuuagaagacacuguucagcagcagucaucuucguucucugacuccugcaaaucuucccaucuucugcaguguucccgagccugaagugcaaggguugcauuguagauguauccguuguggauuuuguauuuugaacauuugcggaucucuguaaugguaauagggcaggguaauagauaauaggucuaguuucugcuuuucacauguggacauccaguuuucccagcaccauuuguugaagaugcugucuuucuauuuauuguguauuuuuugcuaucuuugucaaguaugggaugacaguaacaugcacacaugugggucuucuguuuuguuucauugaucuacaugucuguuacugucaauuugauguuuucuaauauuaggcuggcugguuuuguucaucugcuuagcuuuguacucagguugucucuuugguguacuuggcguuguuuugugcugucaggcaaaugcugcugccucuuuuacguucuuugccagagcaauuuucagauugaaaguuaguugauuaaagauagagccuuggauuuucaacagaaaacauuuauuauaaacaacauuuucuuuaaacauuuucuaauuguacccugacauaaugcaagaaauaguguugguucuaagaauguaaauuuugaugggugugguuguguaugcauuuagucccagcaauagugaggcagaggcagaacucuuguucaaguacagccuggucuauaauguaaguccaggauagccagggcucuguuagaaaccuuguuuuaccccucccugccaaaagaauuugaguuuugcuaaguaugguggcacagugucuucacaguuguagcacuggauaugcagaaacagggcagaguucaaggucggccuggucuacaaaaaaacgagacuuugucuuuuaaaaaagcauaagauuuacauguaguuuauucaguaaaaaaacuaguaugauuuauaucagauguguguggugcagugaagaugaguguuuuuuuauaagaccuauuuauuuuauguaugugaguacacuguaccuguacagauaguuguucaugugguuguugggaauugaauuuuaggaccucugcucgcucaggacugcccuucuugcucugguucuccccccccaccccccguuccugcucguucuggcccaacgauuuauuuauuauuauacauaaguacacuguagcugucuucugacauacuagaagaggacgucagaucucauuauggaugguugcugggauuugaacucaggaccuuuggaagagcaguuagugcucuuacccgcuaaaccaucucuccagcccaauguauugguuuugaaauuagagaaauuggguucagguuauggcauugucacacacuaacuggcaucgcuuguaggauagacuauugugugaaaauaaaggcacuaugaacauugugcagcugaggcuuugcaauuccccucauaagcagcauaaguagguuuuaauggagauguauuuugcaugccauuuguacuuacaucacacuuagcuacaauuuugaugauugcuaauaauucugugaguccaaaaccuuuuuuaaaaauguguuuguuucuauauguuguuuugccagcauguaugucuauaaacugcaugcguaccugcuucccacagagaccagacaguguuauucaaucccuugggacuagaguugugagcugcuguauggauccugggaaucaaacucguuccucuggaagagcagccaaaguucuuaacugaugagcuauuuuucucauugccuccaaacucuuuguaaaaugauuguuguuccgagucuuauuucaagacuuucacucuuggauuugcugugauggcggaaaaacugcauucugucaaaaguguuugguauauuuaacucugcaaguucuuagaaaauaguaaaguuugacuaaauguaauagguuauauauaaaguuguaguaauggagcagagucuauuuaaaauccuuuugugucagaacuaauucaucauacucuaaccaguaacagaaucauaaccaucauaugauguucaguaaaauguuugggagcaaaagaaugcuugaggaaaccuucuguuuguaaauaaacuaacaauuguuauuuauguuaucucuuacaaaaaguucaaauugaguggucagaggguagaauauuguacuaaucuuuuuuuggaaugaguuuuaaaucauuguguuuucugcguuccuuuuuauugcucuaagugacuccuacaugcauucuucuguagcuuaacacauggcggcuugauaaagcugugaugcacauggugaccugaugaagccucacugugaaguucugcuccuaauuucucacacuaauggccucaaacuauaaaauuauuuugcaguaucccuuuuacuauucagcggcuaugugaauugcuaacggauccgagaagaaacuauacaggaacagacaaguuucucagaggaguagagaagguaggugucuaccaugggauaaguuuggagaaagcugcuuauuuacuuuuauuugauuuuuauucuuuauuaagcauuaaaaaaaacccaaaaacaaaccaccagagagacgugagaacugacagugcauuguaaacaucacugugggauuucaaaagucagaagcacacaacuuuggaaacuugaguggaaaaccauuuaagugauguauauugaguagaaagauccaguucagauuauggguggaagguaaccaaaaaaagaauauuuuggaggauggaaauaacuuaauauacaaagauaugguguaauuaaguuuaaaacuuaauucuacuguucauuauaauuuuuguuuguuucaaaaucaguccuuuuacucugggaacaggagucuaggaccauuaacuuugggauuuuucagcaguuagggcucaucagacucauguuuugcugagucuuuguuaucuauuagugaaauucugcagggcagcuucaggguuuaugagcacuucagcuuaaggguccggagacguuguguuuuggggauuuuauuuuuugauaggguaucacugccuucauuugccaaaucagugcuacgauauuuuauauucugagccaggaauuuaaacaaaauuuguuuccucugaaauuugggucauagggcugugagaugaucuuaaaagcacuuuccugcuguaauugccaaaggaaggggguuuggucucuuuuuggguuccaaagaaaagaaacaaaacuauuaacaauuuaaaaacgaaccaacauucucccuuacaauaugauggcgaguuuccagggaucauaaugccacuuacacaauuuaaauuauuggaauuguucuuccuguaagaaaagaaacaaucuugguauagugguacaagcuugggagucaggggcaagccaaucucugaauugacuguccugaucuacauagugaaucccaagcuagccagggcuuuaaaagaggggcagguuuggagaugaggccugaucuugagacuucuguggacuuuuacucaaggacaugcaugcauacaagauaaauaugauauaagccgggcaugguggcgcaugccuuuaaucccagcagaggcaggcggauuucugaguucgaggccagccuggucuacagagugaguuccaggacaggcaaggcuacacagagaaacccugucuugaaaaaaaacaaaacaacaaaaaaaagaauaugauauaaauaaauauaaagcaagccaguggcuguugcagucaaaccugaagucuugcuguuuuuaauuuuugcuuuauuggcauuuauuuauuuauuuauuuuugguuuuucgagacaggguuucucuguauagcccuggcuguccuggaacucccuuuguagaccaggcuggccuagaauucagaaaucugccugcuucugccuccugagugcugggauuaaaggcaugcgccaccacaccuggcuuggcuuuuauuuuuaaccaguuacuuuggguuggaauaagcuugccccgcaugcggcugauugugaaaaucucccacaaaggguaaacaguuuauguucugugauuuaacuucacucaucagcauaccgguuucucuuguuucagaaugugaugguuguuagcugcguuuguccauccucagaguaaguauagagaguuuguuuuuuuaaagauugauugauugauugauuuauucauucauuuauuuauuuauuuauuuauuuauuuauuuauuuauuuauuuauuuauuuauuuauuuauuuugugugagugcacuguagcugucuucagacacuccagaagagggcaucagauuuuguuacggaugguugugagccaccaugugguugcugggauuugaacuucggaagagcagucggcacucuuaaccacugagccaucucaccagcucccuguguuugcuuuugauauuacuauauucuaguuuuuaaauagugucacuuaaauaaucauaguuauuucauauguaacuaaacaugauagcaucuauucauugugaaaucuacuaccugguuccugagguggaauauugccaaaauacuguucacgugaaccaaagagauggguuaauuacuccaguucuggccguguagauguguuuguagggguggaauaagauacuucaugguauucuucaugauggacagcauugcuaauugucaagauaucuagauccaaaugaaggacuuagcuccaggcaucuguucagccgcggcaguguuagcauugagcucaaugcauaauucuuuguuguguguggaugucccuaggaauugcagaaggguaguacacccucagcccaaccucacccagcacauucagaggcuggggcaugagaagggcugggaagaaaacgcugcugcuugcauggauccacuaccuuauuaaaaacaaaaauuuuauuuuuagaacucuugacuuaugagauaaucuauugaugcuucuuguuagaagaaccaaaaaaauuaugcuacaaauuugauuuccuuuuuaauuaaauguuuugcuuuucugaugaauguaaaguuagcugaagaacauuuccagagauuugaaagcaagugucaauaguuuuguuuuuguuuuuaaaccaaucucaccauuggugcaugcaugugcuaauguguuugaauuugcuggcuauguuacaaaagacuuucuagauuuagauuuuucucuuuuuaauguauuuauuuugcuucuuauguaugugaguguuuuuaucugaauguauguaaguauguauacuuuguguaugccauggaguucagaaggggggcauuagcucuucuggagaagggguuaauggaugguugugagccaccauaugggugcugggaacagaacccaaguccucuggaagaggggcuugggcucuuccugcugagccaaucucuccagcccuauaccuagauucuuacacauuagccauucacaacccuccuuccuucuuuuucuuccuguaaggcuuuauuuuauuuugagacauggucugagucuguggcucuggcuggccuugaacuuguuaugugguccaggcuagccuugaacucacagagcuccacuugccucugccuuucaguauuaggauuaaagucuguauuaccaugcucaccugaaguguuuucuuuuacuacaggaagaacaauucuaauagcuuaaauagaaugaaugguguuauguuuccuggaaacucaccaaacuauacugacaggugagaauauggugguuuguuuuguuuuuuaaauuguccagaguguguuuucugguaguauuugaauuaaggcuugguauacuuuuuuucuuuuaaauauauauuuuauggggaagauacaagauaauauguuguauaucuuggacacaaggcuacuuuacauaggguaaggcacagauccaaaagccaaaauuacugcaaauauuugugauguugucuuuagaaggggugauuguguguguguuuaguuauuuuauuuuuuauuacauuuuuauauuauuucuaaaaguagaaaaugauguucauuuauuucauuauaggucuaauauaaacgggccuggaacaccuaggccacuuaaucgaccaaagcuuucuuugucagcccccuugacaacaaaugguuugccugagagcacagauagcaaagauucugagcugcagcuaagugaagagaaaggccacagguuuguguguuucguauuugaagagauagaaaugcauagaaauuuaagaacuguuaaagguuuuauagcacuauuuacuauucacaagguggaauggaccuucuauauuuaaugggcuccauuuguggguuugaaagagucagccaguaaaaggucagaagucauugagggagaaaguuugcaucuguccugguuaggaacuuugucccccgugccuaagaguguucauuugcauuacaucaccuagcacugauucccaaguaagggagaugauugccccggggcccuagaacuucccacgguccugagggacagaccaggccuuaaaggagauacggcuucuguauugcaucaguacagcugaagguaaaugcagaauucucauaagcgcauagagucggacaaauugguccuaaugaaacaguucagggugcuuuggaaauuguuuucuuagcccagauacuaacauuuaauuucacagucaguuuguuaaguuuuuaaaauuagaggugagaauguagauuaugaggaaaaugcuuuuauuaaugauacuuuaauaaccaucugcagugauucuucagccucugaaucagaaguuuccuuacugagcccuguuaaaaauaaacauccagaugaagaugcuguggagucugaggaacaugaggugaaaagacugaaguuugacaaagaaggugacgucagagagacagcuagccaaacggugucuggugaagucucuucaguuagagcagaggaaacggaaacagcagcucccccuccugacaaggacagagaaagucgaaccaggcagcacuguacagaagaggaggaggaggaggaggaagaagaggaagaggaggaggaaggugaguggggguggaguucaucacccuucuuccccacacagugcacacggggcucuucuacauguugccugcugcugaguuugaggagcuaugagccauagacacaggaaucaugaaacuuaccugggugugucuugaaaauaaauuuaacugcaacauuugcuuauuucuagaaucguuuaugacaccaagagaaauggucccagaaagaaaaaaucaagaaaaggaaucugaugacgccuuaacugugaaugaagagacuucagaggagagccaucagauggaaggcucuggugugucuccagcucagacagacuccacuucagaaaggagugacagugcaggggccucaaggaguggcucugacugccuggagacacaggagucaggagggcccccuuccaguaagacuggagagagugugucagugccgucguccauggagagugaggaagccgcagaagucacagaugacccaauggagcaagacuaacuacucagaaacacuuagaggcaguauuuuacauacaguucugguuuuacacuguauaagacuuuuaaguaauaaaguggaccuuuaguuuuacaagagaaacaggcuguaaaauaaagaaccuuaagaauaaacccugaagguuguauguggaagagcugugaguacggcuccucugggucccgcuuagugcugauuuucuuguuugguuugguuuuuuguuugcuuuuuuccugguguacucaaaucagugguuuguguauagauuuuuuuuuuuaauuuagaauuaaaguuuuuaaacuggaagauaauuauaauuuugaaaacuuuaaagaugaucucauuugguuuauacauacacaaggaagauuuuugucuugucucuagcaguuuccauauuuuggucauaguuuaaacauguuaacaugugaauuaauaggguuucaugugguuucagauuuuuauuguucgacuguacaauggaaccuuaagucauauauacauauauagauuauccugaggggggauguuauauuuuucuguuucuauaagagaugaauacaguggauacuuuuuuauugguaaugacugaguucacuucuuucagaagacaucuucucuucugaguaguugagacaaaaaucuggccccugugagacccugggaaucuuucagucuguugaaauaccagguuaaacacauuccaagagaucugugcaaacuaaauucuuuuguauacuucuaaggugccugagacaacaagacuucauuuauuuauggaaagugugcuuuaucuugggaguugugcucaagcauuagcuugcugucuguagaaugagugcuucggagccugacaugaaaccaucucaagagcccacaggucccauaacauucgguugcuuuucugaacacugucaacaucacaucugucuuucugaauaauccuauaugccgcauggcacuggugugaaacaucacuguacuggaagaauuaguagaggacuucaguaauguaccugagcuaaaaugaccgaggcguuaggggugcacagaaaccaccaugauuuguauaacauuuugaagugaauuaauauuuuugaacaugcuucuucaacagccaguguuauauuuuucagaucaacacaaagcacaaugguuacuacucuauaaacucaauauuuucaaauucacauauuuaaagucaugcaagcugcaacuucccugucagaauuacuggcugccaaauuuauaccuguuucuucagcuguacuuuuugauauuuagaauuuuuaaauuucuguaaaguagguuuuguagacuguaauguguucacugccuuugugaagcgguauauuguauaauuucguguguaacugaaugcuugggcuuucaauacaguauucauauaaagcaauaaauauuaauguuaugaaauauuggaguacauuuuuaucaaaauacaaaaucucuuuuuuaguuucagacaucugagguacagggauggaccuaauagcugauacaaacaguuucucacacuuuaucuauccuaagcuucgggugaucagagggaaaccacaagguuugcauuuugacugcuuagacguuacuauggcuaaaaagauauuuggcuccguuuguucauaaaguaauaugcuacugacugaugaccuucagguucacagcagcuggacaguagauuuaugaaucugucuaguaaaacugucgauuuacuguacccaaaggggugaaagucaaauguaacuucaaguuuuuuggcaaaaagauuaaaaugaagcaaaauuuaagugugacauucauuuguaauggccuguuagaguugagggauugacaguaagagcagauuuuaaacauuuuagguuuagaguuuuugagauuuuccuuaggauauuuaugagguuguugucaauaaaccuguucucuaagcuccugugaccuuugauagucuuuauuuauggugccauggaccauuuacaaacaagucaguuugcuguugguuaaaaguugaagauuucgcaucaugaauagaggucuguggcuuuauuuguaaacuugcaauugcuaucuuugcaaggggaaguguauuucuuuauuaaauaaaguacaauuaauaauggugaauguaccaaaaugacaucacucaauucuaugagaggucugcauuuuaaccuauaguuuaauagcuuuaauauuuauuagcuauuccuauguugaucauagaugaaaguuguugcuguuuauacagauacacguaggauacuggugaagggucucuagggcaguuguaauauucaucaccgugugaggccauguucagacuguggaugcauuggucccuuggaaguccauuuccacacgugguguuagaugcacuuacaggagacugcaggaaagugucaguucuaaugagcacugaguccuuugugagugacagaaugagacccaagagggagggucaagccgucccguggcugaaguagcuggcucuuugauguugaacagauuccuaaccggguucuccuuucccaagccuaacucagaucugggcagugcugauggugcugacagaauacacaugacaugguuuugccaccccucccuuuuaaaaagugaaaacauuuugaaaacucuauaaaguucuguacauguagaacagaagugaguagugaaaauauauuuugaggauuaguaaacuuaauccacuuaauugucacaacuccggucuuucccauauguagccagagcaauggaguuacaacucuggcuuucgaaagcuauuccagaaacccugccccagaaagucuuaaagcauugagauccuuguguuuuauuuuggcaguguagauaggcauguauuuaugcauuuguaaaaucaauuuuuuucaaauaauguauguaauguacuagcuuaaacgguacugggcagagccuagagcuacugcgaggauugaaugugaagccgguaucgcggguggaaauguaccugcagagcuacagcaaacuauuccggguaguguuucaggcugccuuugagcaggaguuucuuagaucuauugguuuugacaaacugaagaucaguucuugagauuuguguuaaucaugagaugaauggaugcaaaaaacaccuuguaauuucauguggaauuaugaaaauuagcuugaugggauauuggccuaacaaggaugaugguauguacuggcuagaauacauauauuucacauauaaaaaauaauccggacaccagaauucucuucuuucaauuuggagccuagaucgaucacuuugccaaauaaauguauuauuuucauaaugcaauaaaguguaaacuagaugaauguuu

SEQ ID NO: 3265 - RNA, 6856 nt, Mus musculus
cacauaucgauggaggaaugagacaccauggaaaacaaaugaaaaucuguucaauauuaagaaaauggcaagugugaaaaagaaguaaugcugggggggaagcaaugguaaguacucgaaggaaauguacaacugcugauucaaacaaggaacgcaggaaagaucuacugaacacuauuuugagugaauaaggcuugauaugucuguaguagcauugaaauaguaaugaacuuggaauuggaaacucuggguuccacucauagggagugaauacuguccccuucagauuuauaggcugaaguccugaccuuagcaaacaugauguaugaaacgaagccuaacgugagugcagagugacuaguacaaucugaauagggccaauauuggagaggaagaugcaggagaggggcguaagcagacaguggggaguaguugucuaugacacaaggagagaggcuccaagguacuagcuugugcauggugcaugugagccuucuggccccuggaaccacaaggaaggagaugucuuggcuguaacucaccuagcaugugcuguucaguaugucaaucugagaagagagagaacucugaacucagacacaugcaagccguauacucccaaguuuguagccucgugguccuuguuggguccacagaagcaguauggcugaccucauggagggcuggagcaucacuguuaaguuaugacaccugguugacacgaggugagaggcucuuguuccuucagacuuggccagcccugacaguuacugccugugucugacccuacucccaaaugucucucuuuaaaugcagcagcuuucuugaccucugcacuggaaauuuaaccucuuaauccuaaaugugucccaaaauagaacucaccaaccuguccucuguaaugucacggcaucugcacagccucucagaguucuaccaucugaucuccagcauucuaguuuccagacaaaaacaguacauucacuuucccccccuugucucaaaacugauucuagaaugccuagagacccugaagaccaugcuuucaaaaacaauacccugaacacaggcacaacuugccaccuccaucacuccuacaccaaucaaaugaacucugaccuggcuuuuucaguagaguccaauuaggucccacagaugaguucauuccuccucgugaccaguuuuaucagggaugacauuucugccugcauucagcuuccugagccaaaagccuccaacauagcacaacugaagcuuucuccucuucaguaccacauaucugucccuuucuucugccugccucugcauucuuauuaagcacaagggagggcuauuaauccccucaugcuaauggguauuuuuccuuuugucucauuuggguggccuucccucauuuccacaaagucauguuuaagauaucugauaaugacauagacuggcuuuauggaucacaauaaauaucccuuaacauuaucuuugcuauauaaagugcuuauuuugaagauuagaguuuuuuuuccagauucaaacagaaagaacauuaagaauagauaagcaggcaauuauuggauuaaaagaaaacuucuguguuucuauuaaccacuucuucauggugagccaucucaagcauuaccugaacuucccuaaaauuuggauaagggaccgaguguauuaaccauuucagcauuucauucuagugauuuuuuuucuguuuauaauaaugcccauucgguuacucuccagcccuuguucuuacuuccucagcagggauguagacacagucuaugaacaaugcuucaaacauuugacaugucugucccccggucacugcauuuauuuucucauuauuagaaaauuggcuuugguguaacuacuguugcuuaguucagauuuuccauaaagcauguuuuuggaugaugauuguacuuaacuuuaucuuuccaugcaaagcauccugcgagcuuauguguaagcguaagcucaaucgcauggcuuuggaguucacuaugcuaacaauaccccagaucaucuucaaguuuaugcugcacuuguuccaaccucugccuagugacacaugacugaaaaauguaucccccaaaaguacuuggcuugccuguuaggaucccaagagucaguagucagagacagacugcagcucaaccucuuguaaaaucguaaaauacucauuuguucauuggaaccuuuuugugaucucaaauacggaucaaugauuuaucuuucaagccuuuaaaaacaugcagcaucuugauuuggucuugaggggcaaggccuuagggcucacaguagcuguugacuuacuucugcauugcguucuccuucuaaauaagacgugcuauauuuaacacacuuuaauuaaugcugagccccagaugucacuguguacaaagcaguucaauauuaugaaacuguuuaauaaaacuugaucaaaugcauuuccacuacaaccgucauaugccuaggucuugcauauuucaagcuccccauguuagcaucucaagcugauugccugcuucccucauuuucaccugcauucucuuuccuuucucuuuaugacuuuaucuuuccuccugggcaauuggaaccuucaggcagaugcucaugcuagguaaauagauauguauuuguguacauuuucaauuuagcaagacgaggacgaagauugguuauuugcuacaagauaaaaauccaaucccauuuauagaaaauaguaaccucuuaucuucaagauacuuuauaauuuucaaagcacucacauauguauuacuucacugcagugcaauaauugagguuauaauucgggcuucugggagaggcaagucuggagaaugauccagaaugaucucuuucuaauagucugaaaaggaggauguuaacuuugcauucccgugccuugugaaaacaaagagauaguguauuauaugguugcuaugaaggaagugauauaauauagaaugcuucaacugcuggacaugguaggaaaugccuacuaccucaguauucugggagcuuagucaggaggaucucaaauucaagguuagccuguguuaaaucaacugaagcugucucaaacggcacaaauguaauaugaugcgauagagaucacuacagaaaacuacaaucaauuaaaaugcagcauuguccaaacagauagcauacaccagcugauaugaggcccccaacacacauacaguagaggacuuccggaucuguuuucauucagagaugaugcaccuaaccaagagacuggaggcccagggaguuuagaggucaggugggauaggaggugggaaggaggugugggauguggagcaauuggaggguggaugugggggcagggaauggaauauggaguguaaaaaugaauuaauuuuaaaaaugcaguaucguggcauaaagucugcacucuacacuuaugaaacacucccacauccaaggcucagguaacauugcagaagagggguuagaaagacuguaagagccagaggagugggcagcuuaacauaagaugugucuccuaguaauaucagaaacuaccucucuaaagucucaccaauaagcaugcuaaaguagauugggaaagcccacaaagccucagcuucacagaaagaacuauaggcacccgaggaaagcuuggaguaggagagaagguucucccagaaaagagcacagcaaauaguuguccagcccugaaaacauauauacaaccaacauuaugcggacugagaagguuauacucaagaauauguauguauauacauauaugcauguaauaacaauuaauaaaaggagaggccauaaauaugaaagagugaaggaagggauauauaagaggaaaggggagggaagagaaaaacgcuguaauuauuuucuaaucuugaaaguaaaaaacccauauaugacaccaccaauaacaaagucucaguuaaauauuugguucauacucaaguuuucagcuaauuucaauagaauuuguaaguagagguaugggauuaaacacuuagacguaggaggcauggauauuacaucuuuuuggaacacaugagcauucauccuccuacagauauaugaguuauguuauguuuuaguaccaacaucuugccucuuagaagaccaaccuuucuaaccauauaguuaguagaacaucgcugaaacauaaauguguagggucaggguguauguaauuugaaauuucacauaaucuucuacauuauccugccagaaggccuuccugugcuccaaccauggaccagaccaaggacucuugccugcaugagaacuacccagcgccuccucuuccccugcccucuccucucuucagccccagggcugaccaagucacccucaggacccccagucuguucucaguucuuccaugacauacagcagcaucuggaauguucgagacugagaacccguccacccccugcagacuggauccuuuggauucacacagccagacaccaaccccggggccauguggagagcgcagcaguccuuugcaauggccugcccagagcacuggaacucuggcaggacgugagcuuucucccacccccucuauccccccacacccgcugccccacaggagaccacuaagugaauauccauagacguauuuugccuuuuaguugaacaguagaaagauauucauaugacuggauuucucagauaugccuaccuggaucuugaaaauuacaaaauaaggaaaucagaaagucuuuauuuaucuuaaucuuguugguuuuuucuaggcuuauuauuacuugaugcuauacaaaacuugggucuguuauuuuaagaaugcuagaauugaccaagugagguucaugugugaaucuggggcuagaaauggucaaguuaguuuaaaagcacuuauugcagacuuuggcuugauuuccacacugacaacugucugcaauucuagauccagaguucugauucccucuucuagcuuccauaguugcuaggcaugcauauguuacauauacauacuugcaaguuaaacacucauaucaauaaaauacaauuagauaaaucuuuaauauaauuucguaagaucugagaaauggcucaguaguuaagcucuuucugaggaccuaguuuggauucccagaaccuacaugguugcuugcaaccaucuguaacuccagccccaggagaucugaugcucucuucuggucuaaaaagcguggcacaacauagcauauagauacacauugaagcaaacacuuacacauaaaaucuaacauaaaaagugaauaaaacuuuaagcaugaauuuguaauuccauucuuacaucuaacaggucaacugagguuugacucauacagaacagacucacgcuaguuauugguucccacuuaauucccugaaacccuuugccuacuugagucagccucaaauuguucucaucacaaaaaaagcauuaaacagagcaagccaagccauaacaguacauuccaagcuucuguucugccauaucugcuaauaugcuacucacuaacacgggucaauuagccaagucuaaagucaaagggucaaaagauuacuguaacuauggagucaguuugacaaguagcaaauagacccugagaaaugaucuaaucuacugcaaaaagaauaauugcaugagcucauuuuauuuaauucuaggagaaaaugguuuuucagcucucauagucucuuaaguauagcaaaaugcagaguagugauaaaauuuagcacaaguuuaugaacaugaugaauaugccauacagucauagcugguacccaggaaaugaguaguucucaaagagguggcaugggacugcagcuuagagaauucugucaguagaggauagcauacucuuuuagaauggcaugaaaaaggaaaauaauuuuaguucauagaguuggaagcuuguggaacaugaauuggauaaagugcacuacguaagagauugagauggucuuccguggcuaaccuagcucucccugguggguaggacuggagacuaggauaguuuuguguucauaaaucuguguccuuguagaugaccucucugugccugcuuuucuaaauggcuacaugacugcucagcuuugucucaucuucugcauugcacguacuggucucuuacaccccuaagacaguuucguucaaaguccaaaaaaauccauuaugagaaaauauaaagcaguuuuucaacuuuaggcccgaauuuggacuguccagcuagcuaggaagcauugucuccagauggauagcuaauaagagagauuucuauaaugagacgcagaccacuccauauuacaaaggaaaggaaaggugggcucauguuacaguguggaaggguuuaugggaauuuaugugcaaagauucucaaggucuaagaggaaaggcuaaggccuuguguauguuccucuuauaauaaaacauguaaacaaagggaguuuauagguaucugauaugugcaaaauggaguuuccauuuaaggcuuacaaaaaauggcucaaauaugauuucccuaaauucugucacugcuuuguugucaguuugguguuaguagcuauaucaaaccagucacaaagucuuuuuaauaacaguacugaguaaacagauuugugguucuauuccaagagaacauauuucuuuguuuucauuuuauuuucucacuuguauuuuagacgaggucaucagaucugucagccucggacacuucaugaauuacaaaaacuuacaggacucuacguaaauauccagugacuguuaauuguugugcuaucuuaaacuucaaaggaauggaagaagcagagaagccaugaaugggaguaaagucuagucaugauuuaaagg

SEQ ID NO: 3266 - RNA, 411 nt, Mus musculus
cauggccaaguucauccguaacuucacagagaaggcaccauugaugguggccgcugcugugacuuacucaaagccucgauuggccacauuuuggcacuacaucaagguuaagcugguucccccaaccccuggugaaaucccuacagcuauucaaagugugaaacaaaucauauaaaguguuaaaacugguagcuucaaacaccuuagaguuaagaaagcugugcugaaugguuugguggccacugagguguggaugugguuuuauaucagagagaucaugggcaaauguggcauuguuggcuaugauguuugaagaccaaucuuuaacuucugauuugaguucuuuuuugaauguucuuggaccauguguaaagagacugcuaucugaauaaaauacuagguguugaaaaa

SEQ ID NO: 3267 - RNA, 13357 nt, Mus musculus
augaaauauuuagguaagaucuuuauuacauuuuuaauauauuuccauauucccuucugugguuccacuuuccauauuuucuccagugccuaaaaaauaugcguuuaucucaguaaaggagauaaacacagggcaagcugucuuacagccuggaaacaucuguaauacagucuuuuuccccucaauuuuuguuuagacacauccuaucuuaaagcauaauaggaaugcuucaagcauuauacuucagcuaguucugcuacacgggaccaaaauugggugggucucugaacaugugcugaugcugugaagcuuaacacuuugaugaauucauuagaacuacagaucaagaaggucaggaaacugauauguagguaaaguaacuaaauguccaaagaugaaaacaugaccucacuaggcuuuguaaacacauauauuuaccuuugaaucaucaaagaacauuuuuaagcaacagaauaucugccaaccuccuguauacuugucuuacauuuuacacaaaguacuauauaauaucuaaaauucaaagguuaaaaagcauaacuuaugucccaaauaaguaaaaaacugggauuacuauuuuucuuuucauugucuuauucuccacauuauuucuuugucuguaguuuauccuuaugugguccaauggcagcauaugugaauccucauggauauguacaugagacacugacuguguauaaagcguccaaccugaaucugauaggccggccuucuacagugcacagcugguuucccggguaauacagcuguuuacuuuucuuguugacucuucauuuaguuuuagaugaacuuucuaggaagauacaaaacaaacaggacaggaauaguuugaucacuucaugaauggguuaaaagcagggacaugagauguagaaaccaguaaauccugcuuucucuagcuugcuuuaaccuugcucucccuuuuacuuuggaaguggcagaagaauuagggauuagugacuuauuaucuuauuauccuugaacaaaauccucuuauuuggcaucauucuugaggacuguaaagcuaacauuaauaugcagaauccucuaccugagaaaaaugguacccugagagcagaagugccuugccugucuuccagggguucaugcucuccugcaucaccuucacgugcaucuccaacagaaauggagaagaaagcugugagguuaaagcuggagccaacagcaacauauagacacgugcaguaauaaauuauccaguuauaacaggguggcuuuguaaauuugaggugucagagaaaucucacgagaagccuaguacaaaggcuaaaaauagguuuuaacuuauaucuuuccuucauuuuauagguaugcauggaccauugcccagugcaagaucugugcaagccauauuggauggaaauuuacagccacaaaaaaagacaugucaccucaaaaauuuuggggcuuaacucgcucugcucuguuacccacaauuccagagacugaagaugaaauaaguccagacaaaguaauacuuuguuuauaagugcaccuguaggagugacuuccugacagauauuuccucaagucagaucugcccagucaucacugccucugauauauguguauaguggguuacagcauuugccuaccaaguucaagagcauauuuagggaaugagaaagcaguauaaaacauaaggcuggguuccaaaauacuugcuuuuuaguagcuuggugccauggauuauccuguugagucuaugucaugacaggauaggaaaacacaguugaaauaaugggaauggccauggaacaggauaggggcaccacugcucuaaaugaugaagcucuaaaugaugaaugcuccagaaacuggguugguaagcacaagauagaggcaaggcaguguaauuuuaaaaggacuuugcuccuuucaauuuuccuuagcuugucugagauacugaccuguacauuuugaacauauuaaagaguaacuaaguauucugagcagaaauagcagcauuugguguaguugcacuuuugauuugaugagccugugaugugcuagaucccuuuaacuaauguauauguccauuuugcauuuuauuugcaaauauaagugaacaguauauauuucuaggauuauaccauuuaggaaacagguuuacauaaacauaaauauccaaaucuauucuauuuggcugaauuaugucaaaguaaucaaguagaauacugaaaaguguaaguacguaauaaaaugcaacucaagaauaggcugcuccuuaaugucauuuuuucaaaaguucuacuuguguuucauucaagcugcugugauggaguggggaauuaugccuuuacugcugcaguauaaucugaugauccauggacuguuuaccauuacuuucagauaggacuguuuaaaggaaucuuacacaauauagcagcuuugaugucacuccaucugugcagaugacaacagcagaaacuccauaguuuaaaauccagguauuuacugaccugggugaaguagauuuugacacgcccuuuuauagcacaucaccuuauuugacuucaagaaaauucaaaauccaaaagcugcuguuuacuuguacaguacacagauaucuaugagcagcuaugcaguaaguaacuauguaagcuaucagaaagcuaagccauauccaucuaacuuguaaaauaaacaauguguucacuaucuguggcaccugauauaaaggcaagagucucagcacaagcccuccuguuauuccugcaacuuucugaaaucagaacaauccuguuauaaauagaugcuacuauggacucauucaggaaaccacuaagaaaacauaguuucucuucaacaguuacuacauuuuaagaucaacagcacugcuccacaagcauugggaaauucaggagguagacuugagcuuaguuuuucuaccuacacucaugcugguuuuggggucucaguaacacaggaggggagaacaccagccuuaccaagacuuccccuguuucauacagggcucaucuuuaggucuucuuuauguaacuuaguaguucaucuuuuuccauccgguaaccacuuuucuuccacuguucacgcaacugcuguagcagggccccaauuuccuucccugaagaaauacccacuuuccugaugucauguccacucacagggaacggcgggacagaccacugcugcaucucuuugagaagaccaugcucuccuugguacuucagcagcucacaaacacgggcaguugcaucugguucccuagacuaaaugacacaguuuuaucacauacuaaacacucacaauuucauucuacuauuuaaauacuuacaucaaaucuacagugugaaaaaguuacuuuucucuaguuagugagaacuauuuucugcucagaccuaauacauacuuacgucuaucacaaagucuugguaugguuucaaugguucugaacuaucuguugcuuuaaucaagucuuuccuguuuuuaacuauaaauaaacccagguuuuucuccucuuuugaaauuuucaaucucaaguccaauuuugugacaucaucuuguacuuugaauaaagaagccaaaagagucauugguuuuggugaaaagccuucaacauuuuuacugacuuuguuaaauucuucuaaauuugcauuagcagguaaaccuguaaacaaaagagaaaagucauuuuuuucuuaacuacaaaacccucacucaccucuuaaacuaugcagauuuuuaagaauguguaguguucuuucuccacugcuuauuaucagcccauucgucacucccuuaacuccuagaagaaaucuaucauguuccuguuuccuguagcagcaugucuugugaagcucaggagcugugaucauaucagguaccagcauaugccuucucagucaugauccugucugcacacauucccuacucagcaauuguauguucuuguaaaacagucaaaguuacugucuaaaauauacuggcuauaguuauuaauuuccuuucuauauauuaaguguuuugugaaagagcuuauuauacauuaacuuauugcuucauccuccucucuaugaaguagcuuuuauuuugaacccuuugugauuauaaaccaacccaaccugcaaaaccaguaagcuucaucaaauucagguguucucucugaacuauucuuuaccaauaaauaaacuauuuccaucuuuaaucccaaaguuuaucucagaauuucauuucacuacuuuaaauuccuuagguauguauguaacacaggacauuuuacuuuaaugcuuuuuacacuagguauuuuguugcuagaaauucacacccuuauaaccuguucucaccuaugugaggagccacaccaagaucauagaucagguggaucaaaugguuuacauggucaccaguaagaauuuucuucaguucuacccaaauccucucuccugauauuccagccaaaccuuuggcauuuucugcaauugcuucuagagucucauggucauggucaccaggucugucgacaauucugccauaaaaccuguaagauauuugaugugugacccuuuuuguuuguuaaguuuauuacaagagaaaaaaacauccucaagaguuuuguuaccucuguauacguacaugccuggaucaauauuuuccauuuuuacuaggguugucccgucuacaucuagcugagguaucaaccaaccauagacaaugcuacacuuuuaaaucuugauguuuggucuguuauuaacagacugcauagacucaaguuuagaaaacuucgauuuauugauaaaauaugcuaugcuacacaguacucugaucucaucagugaacaauguuacuagauguacccuagcuagguagaggguuuuugauuuuuuuccuuaaagguuaaaauuuggauuuaaaaaaaaaaauuuacugguaagaaauuaucaagauacaaccuacaaaaugaauggcacaucugaugaggcauuagauuauagaagaaacucaaaugcacaugaaauuacaggauauuauuccaguaagaauagcacaagugagacagaagucauacagaaaccuacuugcaaagcuaaccugaaauaaacuaguacaggcccugugaaagcuggggcggcuccucugaagacagaaaagagaugcacccucgaguuuaucuauccaaaggcagucaggucugugucaggaugugauccuggcucuccuguguucacugugguucacuuuugaaaacaaacagccaagaaaugaaagugaacugaugauccacugacaaaaaauggagcacaccaaaaaugugguacagugaccucaaacucacuguguagccaaggcuggcauugaacucauggccuucaugccuuaggaucccucaguguuaggauuauaggcauauccaccaccauaucuugucauuuauaauaauaaaguuagagauaagaguuaaauaaucuggacacaaaaagccaaguaaugcauaauacacauguaaccaaacuaggguaagcugaggacuaggauauguuaguugacuuauccaugaggacuaagguacaaggacacagaugacauucucaucacugcugcaaaguagagggacuacagauaaccaaaaaguucacaaggggauugaaugcuuuuagccuaaacaugauagcuuugagggaagagauguguuuaccuucaauaccaauguaucaagacauuauauauacauguauaacuaguguuuaugcaucaguuaaaaaucuacaaaaauuaaaaccacuaauacccacacaacuaucacugcauuucacacuuagccaguuucuccaacuuuuaaguaucggaauacucugauuuguuguaccacuugcuagcacucucuuucugugucauuuuuuggugaggcaccgaauauguuccagaacaucgacucuagguccuugagguagagcacagcuuaagucauuucucuguaguaagaucaccgagcacaauaccuggccuguggcaagaauuuaaacuacacaaucaaugaaggaaaaagacauuaaugauguaaagcuuuuauauaaaacauacuacaaagaacgguuugauuauguauacuucugaauaaaagccacagaaugcuacucaacagcuacuugggugucucaaagggugacacgcaaaacuaaaauuuucuaguguugaaauuuauaaguucuuaccugaaauaccuuaaaauucgaagauaaucuuccugaauucucuguuuugcauguccaacaaaucgaaccuuuuuauuuuuuaaaucugcauaaccauugaaguaaucaaacaguguaccaucaaaaccuauucaucagaaaagagggaagaaaaaucauuagcaaggauuuagugggaagaaaaaacaucugaaaacuaccacaaacaguaaaguucaauaagaguaagaguuaaaaaugaaagccuagguuguaccaguauucauauauauuacuauuaaaugagagacagaaccuucaagaauaaacaaucaauuuaccacacuuguguacaguaggauggaugggaagacaccagauagaacagcagauagacauagaagauaaacagcaauagauaaucuucuaaacuuaagacuugauauuccuaaaauaacaggagagaacuaaagagcauuagauaaucuucuaaacauaagaaauacuauuacaaaaauaagcauagcaggagagacccugccucaagggaacagcuggaaaguaaugcagaauagucagcaccuucccuaaucugugcacacgccugcauacauucagaaacaagaaaaucuuuaaaacacuguaacagacacaguaguaaaacaucuacuccauccaugaacugcuggagcguaccaaaaggcugguucuacaaaaccaaggauacaagaucucauugacacagguaacaacaggauauccaagaugagucccagugagguuucaguauugaugguguagcacaagccggaggccauguaccagaccaaggaaucacuuuuguagugaagauuugcaagcaaagaaguacggacaaaaugcuauacugugagacacacuauagcuuccacaaagagguuuuucuccuuugucagggagguuacaagggcgcagggcugauacaaggggagaagaagaugaguaggacugggguacacgauguguacuuuaaaaaagauucaauaaaaaguuuucauuuuuuagaaaauauaaauaagcuuacuggcaaaaagaaaaaauggaaaaguuacaagcuugauuaaauuucuggggaaaauuaucucaguaccaaaauacuaacagcuaauuuuccuaauaugcaaaagcuguuuugaaauaaacagaccaagauggcaaaauacauauuaggcucagcauuuaagauacugagaaguguuucuaagaugaucugaacacacacucaaaauucaaaaacaaaaagcagaccauauuaaaaacagguuaaaaaaauuaaaauccagaaaucuuaaaaaauaacauuucagccuuaagucacaauacaaguuuuugaaaagcuugucagauuucccucagauuggguaaucugauaacaggcucuaacaaagcaggcacccuggguggacucugugagccuauuaaucccucccucccucccucccucccucccuccuuuccccucucuuauuaagcacugaguuacuuccuaaucuucacuacaguacuaaaauggaaacugacaaaaacacuccaguuuccagguagugauguuaauaucagccaacagacuccgauagguucaacguaaaugauggauaacaucuccauagcacaggcuuaaacacaggcuuaacacagaaggaggcucucaaacagaccaguccuaucuucucaaaagauuaccuagaaacauagaauuuauagugagaucucuucguucagcgucuuucugccagucaguugugaauucuaccucugcaugucuuccaucagugguaacaucaauucggaguguaguaacuucaaaauuuucuucaugaagcugaaauuaaacacaaguuuuuguuguuaccguuugaacuuuuagcauaaguauacauguguuugccacagccaaggccaacuugcccaaauuuguugucuccuuccgcuauuaggguucuggggacaaaauucaaguugucagguuugggagcaggugccuuucccuacugagccaugacacuggccccacaagcuucucacuaguuucuguauuuaccacacuauauuuuuucuaguuauuuuaauguacaucauaugucauuaauuuaacaaaggagauauauucuaggaaauuuguugcuaggcaauuucauuaacauuuauuuaaaacuuuuuacaauaaauuuugaaacuuaagguacaacuauaaaaauaguuuauguccuauuguaaaucauacucccucuuuuuaaaaggauuguuuuguuaaccaaacacaaauuaguuucauucaaugagggaaggauggaguuggucguucccaugauaagaguagugccuugaggaacaauccaaagaccugaauauaauauaguuccagaaugcaugcaaacuuugacccugaauuaaugaaaaacuauaguaucaauacccuagaaaggcaggcaagggaggauuauaugugcuugcuguggagagagagguagcaaggaaguuaucucacaggaaugaugagcaucuucauaccuacaaauuaccaacauaaucuaagagagaggacuuacuugguuuuaccguagaaaauguaaaagugagaaaaguaucaaacguauauaaguagcuccaaugaaagaggauggaagauuccagaggguaggcggcauggacauuucuauugagacuuuuuaaaacacgggacaaaaauguuacacuucaaauaaucacagaaugccauagccaguacggucgggucggcugcacucacccuggcagugauagucccauguuucucuccuuuguuguugaucaugcgaaugccagcugacuggaacaucuccuucaucugaguagggguggcagugguggcgaaauccacaucuugaggcuucaccccauucaguaaaucccucacugcuccuccugcuauucuuaauucaugauucucuuuggcaaauaauucugaggaaagaaggauuuguuuggucugguuuuuguuguuuuuuaagugcaauguaugauuaaagauuaaggaucauauaagaacaagguuuugucauauauuacagauaguagaggucagugaacugagcaaucuuguaugacagugaaagcaggcccucucuucggaaaugguucuucuacuguagaacugcaggagagaucuuugaaaacuucuuucuucuccggaagguaguucaaaguuccaagaugacuuagaaucaucacuauaaauaugauaaucaucaacagaaaagcaagcaauaaaacaauugugcuugcuucucucugguguuauguguguacuuuagaaucaaagucuucuauacccuuugggacaaauguagacacaguaugcuuacacaggaaaccuaugaaaaacauuauagcaaagaacccuuaaaaaauaaaacuguauacuguuugaaaccaaucugcacaugggcuauacacaguaugaccacuauccaaggaugccuuccacagcucaugaaggauuacucuggcuugccagucaguuuuaaucuggguucucaccaccuaacuacagaacuagcuucuauccaugcaaaagcuaagaaugccaucagauagcaacuugguccuauacaacagcugcccucauuucauuguaccuucaucaaauguacaaccaaguguguauuuuaaacucgcacugauuuaugacucuguucuguaaaacuacaaaacuucaugaaccugcuuccauguuugaagguggaauuugagguaaccuaaaucuguuucccuccgauauggauacccaaauggcuccccuuuagaagagagcuguggauuuuaaguugauaaccaaagauaaugucuacuuucugaaaacauuaugcagaucccauuuccuaaacucuuucuacacaaacuaauccaggucccaauauuguaaagaguccguuccaaugcccucuugugggucuguguagacagcauucuucuuuuacugcaagaagcagcuuggcauauccuuggggaucaugaauccagcuaagcccuucccuaauuacaacucaggauagauuccucaacgucgcuguuauaccauacucuuccaucuacucuaaucaagcuguuucccucuguagauuuucuaaaguggcuugacuaaacagucuugccuuagguaaacaugggcucuuaaagaggcuaaaacuuccuuccauaagcucucuacaauaaggguucaugcccccguaauucucaaucaagucucucaaccuaucccucagcuaaguaucuuuaaaauauaaaaauucuaucuccaauguucacaaaauuaauggaguucaugucccaaacaauugaaaagcuguccagacugggauccgccuccuuuagcaccuagagcaguccucuacacucugggcucauucugacccagaacucucgagugucuucuuuaccuacuugcuccagcaucuagccccugagcuccagucuccauagcuggguuacucuaaagccccagaguaaauacuaggcacauccuccucccagaguaucaccgugaugucuaagugaugucacugugaugucuaagugaugucacugugaugucuaaguucucuagcacaguaagcaauggcucccauaaccaacuuugucucaucucucucuaaucguugcuucacacuuuaccuacacugaacucucuccuugugguuuacuuccaacuuuguaugcuuugaguacuucacuccaggcagcuuaacaccuuguucaauccugcucauuggcuaguggucaaacuucuuguccaguaacaucaacgacuuacagaaaacagcaagacaggcuuuaaggguguggcuucugguaagaugaccauguucuacacuuaggaauauaugggcagcacaaauuggaguugaugcguuauuuaaaaacaaacaaaaaaaagaacuugggagaagaaaguaggaauuaguuugauucugaucaagcuguaugaaauuuucaagaaaugaaaauaucuuuaaaaauauucaaaaaccuauaauacugaacaucuuuaauauuguuucuaaagaagaggcaacagagaacaggaaaacuagggcugggagaagauaugagaaaauguaacagguucacuuagcccaaauuggagcuguuauaucugcaguguuuacucggcauuugaaaugugugaguuugauagacauguuauaugugcuagauauauucuacauauacuauuaauuucauucauuucauuuuaguuuucuaguggacagagaauuucuggaauuuuucacucugauuaaaucacaguguaaacagcaucauaaacuuacauugagcuuaaaauguucuccucgguaggcaccuaaaauaccaucaucucauuucaagaguagaaaaguagcccuggaaauaccauaaucuucaggcaauguuucucacaguuucuucaacauaauuuauggaguaaaaacaaagcaaagagagucagcagaaucccacuguuugauuuaaaaguacuucaagggucuaggaggugucugaguaaaagucuuugucaccaagacugacaaccugaguugcauuccuggaacacacacaguagagacuauugacuccuguaaguagccuucugagcucaacacagaacaagcacccuggucaucccaggaauaacaaggcaccucaagugcauguccgucucugaggugguuuacacaaccacacacuauacuccuggaagccaauuuuuuuaaauauaucagcagguuuuaaauugcaguucuauauuuagauuuacaggcuuuuuaggugcacacacagaaaaagagggaaaaaaaucuauuuccuucuguucucucagagagcaauacaacaaaggaaaacagagcuucguuguuaacaaaucagaugacaucagacucuauaauuuaaaacccagcuccuucaauuacagaaacagacaggcacuucacuucccaagcacguguucucuucuguucagaacacauaucuaaagcucuugggucucauuacauaauguaugguaaauggaauuucuuggaggacacagaaaaguugugcuucaugcugcagucaacuucccaccauucucaauauaccccaaguuggccugucuuucauuggcgcuacaaaaauaucccaacacugacagaaagaugucugccucguccuuuucugcaguuaacaacuccaaagcccagaggacaaucuuaacuucucaccugucaggcucuucaauccuucggugaaaagggacuggaauucuggggacugcaacuucauuguaaacagguaucgcuucagaaggcacaaucuacuccaacuacaccucaggaccugccugugccaaggauacaggacgcucugcaucuggagacaagucgccaaucacacaucuaaggcgcaaacacacagguaacgccaauuacacuucaaaaggagggccaacaaacgcuguccgaaaugaaagugauccuuucaggaacgcuaaaccacuucgguggcagcuacccaaguacucuugcuaugauuacuauaugggaagcaggagggauuuggagugccagaaaauaaaauauuagaucggcagcaacagcagguuuccaaaaaacacaucaguugcacgugcucaccacccuccuccccuacccagggucggccucaagguuacagcaugccaaguuggaacucugcgggguugccucagcaauucucgccgcaugcccgaccucuaagaggugggagcucuuaaagggccccaagaaaaguagcgcgccgcgaggacagcgacgcucaagccggucgcguaucugagauagcgacuuucuccccuaacucuggaaaacugcggggaaccggcccugagauacgaccgccgcccacggcucaaugaagagagaccgggcguugccuagaguagggagcagccuccaccucccgccaucucccaaggacgcguucagacgcacgcugcacagccaggucgccaaggugucuuagaaacguggcgcuccuacuccgaagacccgcuuacccgccugcugcccgggccgcacgcgcacuuccgggucgcggaccagugacgucagcacgcacgaagagccgca

SEQ ID NO: 3268 - RNA, 21846 nt, Mus musculus
cuuugggauuaaagauggaaauaguuuauuuauugguaaagaauaguucagagagaacaccugaauuugaugaagcuuacugguuuugcagguuggguugguuuauaaucacaaaggguucaaaauaaaagcuacuucauagagaggaggaugaagcaauaaguuaauguauaauaagcucuuucacaaaacacuuaauauauagaaaggaaauuaauaacuauagccaguauauuuuagacaguaacuuugacuguuuuacaagaacauacaauugcugaguagggaaugugugcagacaggaucaugacugagaaggcauaugcugguaccugauaugaucacagcuccugagcuucacaagacaugcugcuacaggaaacaggaacaugauagauuucuucuaggaguuaagggagugacgaaugggcugauaauaagcaguggagaaagaacacuacacauucuuaaaaaucugcauaguuuaagaggugagugaggguuuuguaguuaagaaaaaaaugacuuuucucuuuuguuuacagguuuaccugcuaaugcaaauuuagaagaauuuaacaaagucaguaaaaauguugaaggcuuuucaccaaaaccaaugacucuuuuggcuucuuuauucaaaguacaagaugaugucacaaaauuggacuugagauugaaaauuucaaaagaggagaaaaaccuggguuuauuuauaguuaaaaacaggaaagacuugauuaaagcaacagauaguucagaaccauugaaaccauaccaagacuuugugauagacguaaguauguauuaggucugagcagaaaauaguucucacuaacuagagaaaaguaacuuuuucacacuguagauuugauguaaguauuuaaauaguagaaugaaauugugaguguuuaguaugugauaaaacugugucauuuagucuagggaaccagaugcaacugcccguguuugugagcugcugaaguaccaaggagagcauggucuucucaaagagaugcagcaguggucugucccgccguucccugugaguggacaugacaucaggaaaguggguauuucuucagggaaggaaauuggggcccugcuacagcaguugcgugaacaguggaagaaaagugguuaccggauggaaaaagaugaacuacuaaguuacauaaagaagaccuaaagaugagcccuguaugaaacaggggaagucuugguaaggcugguguucuccccuccuguguuacugagaccccaaaaccagcaugaguguagguagaaaaacuaagcucaagucuaccuccugaauuucccaaugcuuguggagcagugcuguugaucuuaaaauguaguaacuguugaagagaaacuauguuuucuuagugguuuccugaaugaguccauaguagcaucuauuuauaacaggauuguucugauuucagaaaguugcaggaauaacaggagggcuugugcugagacucuugccuuuauaucaggugccacagauagugaacacauuguuuauuuuacaaguuagauggauauggcuuagcuuucugauagcuuacauaguuacuuacugcauagcugcucauagauaucuguguacuguacaaguaaacagcagcuuuuggauuuugaauuuucuugaagucaaauaaggugaugugcuauaaaagggcgugucaaaaucuacuucacccaggucaguaaauaccuggauuuuaaacuauggaguuucugcuguugucaucugcacagauggagugacaucaaagcugcuauauuguguaagauuccuuuaaacaguccuaucugaaaguaaugguaaacaguccauggaucaucagauuauacugcagcaguaaaggcauaauuccccacuccaucacagcagcuugaaugaaacacaaguagaacuuuugaaaaaaugacauuaaggagcagccuauucuugaguugcauuuuauuacguacuuacacuuuucaguauucuacuugauuacuuugacauaauucagccaaauagaauagauuuggauauuuauguuuauguaaaccuguuuccuaaaugguauaauccuagaaauauauacuguucacuuauauuugcaaauaaaaugcaaaauggacauauacauuaguuaaagggaucuagcacaucacaggcucaucaaaucaaaagugcaacuacaccaaaugcugcuauuucugcucagaauacuuaguuacucuuuaauauguucaaaauguacaggucaguaucucagacaagcuaaggaaaauugaaaggagcaaaguccuuuuaaaauuacacugccuugccucuaucuugugcuuaccaacccaguuucuggagcauucaucauuuagagcuucaucauuuagagcaguggugccccuauccuguuccauggccauucccauuauuucaacuguguuuuccuauccugucaugacauagacucaacaggauaauccauggcaccaagcuacuaaaaagcaaguauuuuggaacccagccuuauguuuuauacugcuuucucauucccuaaauaugcucuugaacuugguaggcaaaugcuguaacccacuauacacauauaucagaggcagugaugacugggcagaucugacuugaggaaauaucugucaggaagucacuccuacaggugcacuuauaaacaaaguauuacuuugucuggacuuauuucaucuucagucucuggaauuguggguaacagagcagagcgaguuaagccccaaaauuuuugaggugacaugucuuuuuuuguggcuguaaauuuccauccaauauggcuugcacagaucuugcacugggcaaugguccaugcauaccuauaaaaugaaggaaagauauaaguuaaaaccuauuuuuagccuuuguacuaggcuucucgugagauuucucugacaccucaaauuuacaaagccacccuguuauaacuggauaauuuauuacugcacgugucuauauguugcuguuggcuccagcuuuaaccucacagcuuucuucuccauuucuguuggagaugcacgugaaggugaugcaggagagcaugaaccccuggaagacaggcaaggcacuucugcucucaggguaccauuuuucucagguagaggauucugcauauuaauguuagcuuuacaguccucaagaaugaugccaaauaagaggauuuuguucaaggauaauaagauaauaagucacuaaucccuaauucuucugccacuuccaaaguaaaagggagagcaagguuaaagcaagcuagagaaagcaggauuuacugguuucuacaucucaugucccugcuuuuaacccauucaugaagugaucaaacuauuccuguccuguuuguuuuguaucuuccuagaaaguucaucuaaaacuaaaugaagagucaacaagaaaaguaaacagcuguauuacccgggaaaccagcugugcacuguagaaggccggccuaucagauucagguuggacgcuuuauacacagucagugucucauguacauauccaugaggauucacauaugcugccauuggaccacauaaggauaaacuacagacaaagaaauaauguggagaauaagacaaugaaaagaaaaauaguaaucccaguuuuuuacuuauuugggacauaaguuaugcuuuuuaaccuuugaauuuuagauauuauauaguacuuuguguaaaauguaagacaaguauacaggagguuggcagauauucuguugcuuaaaaauguucuuugaugauucaaagguaaauauauguguuuacaaagccuagugaggucauguuuucaucuuuggacauuuaguuacuuuaccuacauaucaguuuccugaccuucuugaucuguaguucuaaugaauucaucaaaguguuaagcuucacagcaucagcacauguucagagacccacccaauuuuggucccguguagcagaacuagcugaaguauaaugcuugaagcauuccuauuaugcuuuaagauaggaugugucuaaacaaaaauugaggggaaaaagacuguauuacagauguuuccaggcuguaagacagcuugcccuguguuuaucuccuuuacugagauaaacgcauauuuuuuaggcacuggagaaaauauggaaaguggaaccacagaagggaauauggaaauauauuaaaaauguaauaaagaucuuaccuaaauauuucauucuuugucguuauuucuguuucuugacauuguuuacagcaaagggaaguacacuacaaagguuaaauggagaaauaggcauguuacccagaugaugaauaaacaaaccuuucuauggcacuaaugucuugggcuguagaucauaccuaagcaggcaaauuuauauugacugcaaaaauaaauggcucaaauuuucacacugaauauaccuuauucaaaguuggacaagacuuuauuguugauacauuccuaauccuccaaauuugaaauggucuaaguuauaaagcaugucagauuacugcaaacuguggcagguaaacaaguacuuguagcaucugcuuguauuacuacacagucgagguagcuugugaucucgacucucuuaugugucuauguagccugacugacuaaaugaugacguggaggcuuuacucacuuuguucaugauguccaauucacagcgaagccguugaauagcacugccgauuuuaaggagcugaauucucaauacaucaucaauaggaagacaagcagcuacucuguaagaaaagucuuaaaagacagagagguuugcaggcuuuaaacuuaggagucauuaauauacacuucagucacuuuccuuuaagucaaacauauacuugaagugacuuauaaacaaauagagaugacauaucaaaguaagucauggagccagcuucacuuguaaaggcucuguagagaacaggaaguaucuacaugagaggcacgucugcaauucaacuuaaguuagaaaauuaacaguaaggauuccauuguagcuugcaauaguaauuccuuuuuaaaaaauguucaaacuaaaagaaauguaagugccuuuucagaauucaaagguugguuuaaacugaguaauauuuaaggcuuguuuucccuuuaccaacaugccagagauagauagcaaguacuugccauaccuauuggauuuucaggaagagaaucaucuuugagauuuucaucccauucacguagcuguuucuuaauucuauccauuaauguuuccugguuuaaaacaaaagccauaauguuuagcccuuaaaaacauacacugguacuaaaccugagaccacguacgaugucuguauuuuaaagaugaagcugguugaauuuaaaucccaggcuucuccccuuuagguuguuuauuccaaggaguacgauucuaaaugccuuuggaugcucuuguagguugcugcuugaacuggucccucuuguaacuuuucucaaguccuuuuuugacuuagugcaaaucgcaguguguuccuguaguaacauuugcuaucuacacuuuccacuagacaacugguuuuuauagaaagugcugucuggcuuuccuaggcauuagcacacuuucagacugcauuuaagccuuugugaugacucaaaggcugcugaaaggcaggggccaacuccauuucccuucagugguauguacaucauacaugcucaaauuuacuuguuuaauuuuucuaguuuuuuagauuucuuggcaggaguuuacuaagaaauacaucuguuuaaugcuuacuauguguuaacuauacccaucugucccagaccaguguaacuggcaucgggcucugaagguggucuauguguuuaccaucaagcuucuuuacccuaguauugguucuucguggguuuguaagcaggggcacuguacucauguaccugacgcgcguuaaugaugcagagauaagcaacaauauacuugcuuggaaaauauauucuuacuuucacaugacccuuuauaauuuuaguaaccaaagugugucaucauauuuugcuaaguuauaaguuauaggacuacaaaaauucaaauaaaaggcaacuucccaguaacaccugccuauuuuacuuuaauaaauuacaaguacugaaguaacauacaaauuucagucaaguuacuuacagcaucauauaaugaauacagccagcgaggccaugauguuagauuugcacagugaaacuuucucugaaacaaaaagugucacuuauuaaaacucaagggaaugauucuaauaauacaaauaguaauaucugaaaauuauuaguccuacaaaaacaauucuaauuuuaaaaagauaaucaccaacagauuauuaucucaaauguauucacaucucacggaaggugauuaucugcaauguuugacaauuacacuuuaaugcuuuugaaauacuuacuagaucuggaacagagauguaaauacuuucaauacuuuaaugacaaggagccacucugagaaaugcuguucacaaaguacacucaacacuaccugaguguugaaacuauacacccacacuacuccuagacuauaagcucacauggcaauauggacugaauaugguaggcaacuaaaacacaauacuauaaacuaagcuuuaucaaguauagaagaauaaaugcuaugcuaauaugggaccuuuaccauggauggauuauucugaauagaauuagaauagaauuaauaauucuauuaauuauucuggugucuaaauauugcuacagacuauauguaacacauauuaaauaaauuauuuucuucaguaaucuugcccaagaaaaauucaaguagagaguuuagaaguguauuucaagggaauaugacucuuguuugcaaauauuuuaggaauuaccacaugguagagagagauuuucugaagcagccauugguauucuuucaaguaucaauauagacacucgaaagaaaaaaaaauauagcuuggcauaaacuucuaucucauccuaccuaaaaaugaucugggugguuuccuacuccugcuuaucucaggagucuacccuuaugagccagagcaaaagacuuagguccucuccaggaaguuguucuuuucuucuaagaccauguaccuaaggacaagcauuaaugucauaguuguuacagauuuuuaaaaaaugugcuaccaauaauuaacacaugacuaaugaguaauuaccaugaaagccauuaauacuauggcaagaauuucaucuucuauuauaauaccagaugguuacugaagcaucuccauuuuaaagggaaguaaaggcaggcacaggaagucacagauuucauaaucaaguagcuaggauuuaaccaguauuuauucaauguguugaucauuuuuguguauuuggaauauuauguauauuauaaauaacauuaaaaaguaaaucacaccccaugaggcuuauacuuuugggaaagaagucuacuuccuaaaauuagaaauucuuuaaauuacaaaauaacaggaaaccaagaaaaaguuucucuugaggugguugguggacacauguuuaacuagguaguaaaacauacuuucauauuaagaugauuacuuagguagcaucaaggcauuacacaauguagugcaaaaguguaauuugacacaagauaaagagaagcccaauguauuuauuuacauaaucauaagcaaaagauaaauggcaucuuuaacauaguaacaggaaugcaugaacaaugccauccuuuugcauggccccaacauauaaacaagcuggugucucaauucccucugaagcaaaggacuucuaaaaaucuuuauucuguacaaagaaauguguugaauauguuuuuaacaguaaucacacaaaugggagaacuguuaguuuuuacacagcaaugcccugaacucaacacugguccgcuugacuuggcagcacagaguggcuucucuccugugucagugcuguugguaacacucaggaguucacagcuguuccucaggcuuuauguuguaaaggguuauccuuuaaggaaucuguaauacuagccagaaaguugagguauucaaggggauaaggacugccauucagggaaccacauuuacugaugacagcacacauaacggcccuuaaaaugaaacuaagaaaauuuaaaaguugugaaaagucuaucaaauucacaaugaaacugauaagauauggggaaaaaaguuaaaaguagucauucuacugacuuccuuuacaugggcacagagagauuuuugguuuggucucauauuacagugaucaaaguaaaugauaaaacuuauuuaaaugaacugaaauuaacaauuuuuugcuuuucucucauuuaucaaauuucuuuaguacugagagcugguuugaucuuuacuguucuaguguuuuauaacugguagcacaaauauauaugcauaauauugugugcaacgggaaaaaaaucaagucuuugugugucaauagcugaacacuuaggaaguuucacuaaaaaguagcagugagaaggccagagaccccauuuguauucaguguuuaccaagcugagaaagcuacagcaguacaguguauauagagaauaacaggagaauaaaaguuaaaaccuagcugauccaaggagagcacuuggaucacuuugaggcauaaacucuuggccaacuguuacggggccaauagccgucuggagacagcgaugcucauucuagaguacacauggacuccugguuuucuguuuguuuuuguuuuucaagacagaguuucucuguguagccuuuguagaccaggcuauccucgaacucagaaauccgccugccucugccucccacgugcugggauuaaaggugugcgccaccacugcacagcgggcucuuguuuacaagagaaaaauaggugcauacccuuucuuaggaaguuacuaguuacaauuuagaauauuaaggcagcacacuaaacuauacuuacauaaagucaaaaacucccuguaaaauagcacaccaaaaccaaaacuagccgaugacagccgagagugagaggaaacaagugugauuacaaugacaaaagucaugcugguaggaaaaagaaacagaaacuacauagacaaacacacgaggcccuuaaauaaaaugcuaaaaguaaacauucaaguuaaguucauaagccagacuuagcaggucaucaaaugugguugugagcugugaaaccaugggaacaaggaaugguaacaguaugaacaucuuuuguaaggggcuguuaaaguccacuccaagcccuuguugucagccaagucacugacaaugcugagcacauguaccugugcaaaaacaaucuggacauuuccugcaggcucaaggaggccuugcuguguuguuacaauguaacuacaggcuacagcuuuaaaaaaaugugucugucaaaggauaaggaaaaguucccugaaagacacuguuagcaaagagaaggauagugguuauccuuuuacauaauguauaagaaaaaugcauuucccuaucuuuauucacucaagaagacuaaauguuagccguugggagcauauuugagggcccugccuuuguaggucagugcucauuacuacccugcucuacaggaugcacacgggcaacccuguggaugaacauucaauacuccacuuacuuucuauuucagucaacucuugcaauuaacaggacaagucuuauauauggauaagcuuugggcaaagagguaaauacaaguuucucauccaacaccaccucuuccaaucaugauagugaguuuagaaagguaccauaauuuaacaguaaaacagaagaaaagaagaaaaaguaaaugccaauuucaaagcccagcuaucaggaaaucaauucucuuuguagaaugggucugaaguguuucucaauuaacuuggcuaauguuucccccuucucaacauccaccauguucaaguguguguaugucuuaucaggucucuacagcuacuugucacauugggacacagcacaaaacacuuaagggagcuucgacccuauuugaagugaucugggaguaguuuauacauguugaagguuaacuaacuauaucccaggaagaccaucgucuccaagacccuuuaucuuccuuauaagaggcuugacaacgaccuucaaaucaugcaagcggccucucaacuccgccaccuuacuuccugcucagcagcgggaaaggacgcauccuuugcacuuugcuccauggugggauguacaagugagugugaauaaaaccuuugaaggcugaacugaccccaggucugucuaaacccaagcaaugaaugccccauuuuucaaaguaauugaauacccgcuuacaagcacaguaugcagacuuagcaggaagugcugaccaagcagccccggagcacuccuguucacagccuauacuuuuuacacacaggauaggucgggucuaagagguacaacaaaguuuacaagucacuggguacaauauacauuuucuaaaaacaguuuuuauuuuuuauuuuuuugaccugaauaaggaaaccuuugaaacaauguaaaaaauucaaaagcugaaggauucuuuuucuuuuauucucuuguuccuuccucacccaugccuuauuuccuccuguugaggccuugugacaaugagcaaagggcuacugagggcaagucuaggaugaccacucaguaaugucagauaccuguccccagaugagcagcgaccaaucuuugcucuuggaaccagugagcaaucaaguuguaaaggaaaaaaaaaagucaguguucaauguaagcacguggaggaacuucagccauagacuaugaggaguuuaaccaguaaguaacacaaaugguaacguuccuaaguuaugaacuggaacugaaguucaaguucagaaucucaagguccuguaggccagacaggauuugcuacacagggccaaaaagucaguuauuaacuacagucccaucauacacuuagaacuuuucaaagaauuuuaaaaauagauuaauuaaggagucccauuaccaucccaguuugaauuauaaaucucaauuaaguccugcugaaaaaacauagagccacugaauggacaacuaaauaugggcauggcauguaggaagcaagcauugacaggaggaauuuucuacauauccacuucacuaggaaacaaguggcagacacaaaauuaagcauuaaauagcuuaauuuaaaaaagaaaaauaaaaccuccuugacagaguuaucauuugacacagucuaagaauuauuuucaaaagcauugugaacauaauucccugcuguuguauugauaaauaggaguagauacauuuaaaaucucuaugugcaguuuggaaaaggaaguacuuuguagauaaacugaaagcugccuucaacuuaaggcaauaacaaugucaaagcuucaaaauauauuacuuucauuauccuuucggcucguguuuaagaagucuaauuauacuucuuagaaacacuaacuaaagcaugccauacuauucaugaauggcuaacagaauggagaacaagaagaaaaauuaacuguauacccuaagaguuaugagaccaucaaacacaacuucucuagaaacuaaauacuaaaugugauugaacagugaaaagaaaaugagauucuugucacaaaaaugaaauauuaauucauaucagucuaggauaccaugcuacucacaucaaaauguaaaccaucccuacucuaacuuaacaaagaguaaggacuuugauguuuauaauggaaauaacacuuuugaacuguuacaaaguacuaaaaaaaccaaaacaacaacaacaaaaaaaccaauuuauucuaaacuuacaaaugagcacauuuuugaguuuuggggaaaucauaaauuucagaaacguguuuguaccuaaagcuguauguacaugagcaccuacagugaaaugaggcagaagagcuuucacuuugguccuaagaggugaaaucauuuagccaaagaaaugcauaaguaaugcccaagcaaacauaguugcguuuccuccgcugagaucaaauguagggucuugaacacgcuaggcaagaccucaaccacugagcuacacuccugcagcaaggaagcaauaccuuaaacucacaucaauuucugagugguaggaagcauggagaaaaauaacugacaaaaaucucuccucugaaaagucccaggacaacaauccuuucuacugccacugaaugcuagccccaacaacucugacccuucuucacugcagcccuuaacucaaagccaaauaugugaucagaguuccuauggaacucugguuccuauggaaacuaaaacccacaggccauuaauacaugcaugacaggcauaaaaucaaaacguuuuacaacuguguaacauuuuaccacuacuguaagcuacuuuucauaaauaauggccggcgaauuauuuuuaaauccaucuaugaucaagggagcuacagugucaacagaauaucauaagaguugugacuuuuuaaaagcaauuugucuucaguucuagaagacacauaagaaauuagcaucucaccuucugguauuucugccaccauuuacaugaauacuggucuucccaggagauggguuuugaaggaaauaccuggcacuuauugagugauucuaacugcacugcagacaugguugacggcaacacacacucuggcaaaaucugcacuuuagcuugcuggauucuaaaauaaagagaaucaaguauguuguucauuuuuaagauacacuaaguuaaacuauaaguuucucgacauagaauaauuuuaaauauuaagauuuucucaaguuccccuuauuaagcaaacugaccaaaugguaaugcauagauauauacaagaaauucucaacacaauuuuaauaaaucuuaauauaaaguaugagguaacuuaaauauguauuucagucucagaauuagaaucaagagauuauacauuucagauaaauaugcaggcacaaaugaagcaaaauuuauuguauaaacaucauagaggcuacagauuaucuugacacaucuaauuucuuggauaacuuuagauaauacaauuuucuauccccuaaacucuagacugugggccucacaaacucuuuguuauuauuauccagauagacugugggccucacaaacucuuuguuauuauuauccagagagcaaacacagagaaagaauggacaaaacccacacaaacucuggacaguuaagacuacagcguuacaagcguacuccccccgcccaacacacacacgguuccuaaaaaaaaauauaccaaagacacuguguaaccaacauccucuauguucgcagcaccagcuuucaaaacuggagaggaagugagucuucuuggucuuuauucaacaugucugugggugugugccuaugugugugcgugugugugucuguuuucccaaauguguuuaugcaguuacuuugugacuauaguaacaucguuuuauaacaaagguuauaaaagcaugugaaauugaggaaaaucugaaaacuuuaggacuuugcauucacaccgacuagggacuauuuuuauaaugcuugcaacaaggacacaaguguagaugguuaauauauaaagaaagugccggagcauaaccuacaucccaguggaucugcaaccccgucucuucaaaaccaaauguuacacuauuuuaauuuuuacuuaaaguguuuaugauauauaguucaaacucuuuuaacuacaaauuacuuaucucagauaugacagauaagaaaucuuguaauuccagcagaauaugaauuucucuuuuucuguauacuucuaaaaacaguuucugaagaguccugagucaaauacacccuucuauuucuuacuuuuaaaaaaguguguguguguguguguauguguguauauauguguguguguguauguauguauguauauauguguguauguauauauauguauauauuugaaaaacagacuuuucaaaggaaaggcuagaagguaacacugcuuuucauauaugaaguguaauuuagguuaaaaacaaaaacagaaauugaaucuuaaucuacagaucucauaggguuaaauuuucaauguccuacaaagaaauucugguauaauggucaaaagcuaguuugaagucagaauguggaacaagucagcuauuucuuauuuacuuguaugacucugggcaaguaagcucugauccuuaagcuuauucacuugccaaaagcagaggcuucaugguguggagcacuugacuauuuuaagugacagcggaccagcaaggaagugggaacaaagaaaucuuauuccagagggccuuucagcugagacccaucuuucugagagaccuuaaaacguaguggaaaauggaacacuagaaacacuucuccuuuccaaggccuguccaccugucaguguggcgucagccuucacuagauucuaaccaugcuucaugcucuacuuucugacagugacuacuuccagcuuauguuuuagaguugcgcacaaguaauuacugaagucacacacagaaauauacuaucucccaagucaguuuauuuucuagcuucuagaaaguaauauucaacgauaaccaaucuguagcaagaaguaaauuaaaauuuguuagugucaaggaaaugcacaguaagaaaacagccagucagucacuacaguauagacuccgagcacuugucauucacgcaacgcuaacccaaguguggcccacaagugucucagucacuuccccagcagcuugucuaaugagggacuuaggcguggagcuucagaaagguuuugaauuuguauaauaaaaugaucuagagaaggaucaagaccaagccaagccagugaaguaugcacacccuacacaaucucuugucccacauccugccugccuguccacuguuguuaccuaauauucacaacagcuuacaguaugagcgucacagcuuacaguaugagcgucacagcuuacaguaugagcgucacagcuuacaguaugagcgucaccaaccauaaauccuguccucgugcagcuuuucuuguugauuccuaaagucuuccaacuuucuggcgcucagauaccacaugaaauaaagaagucugacagaacguucaauucugaccacacacuagugaaugaauccccaaaaaaagguagaacccagaggcugucuccaaagaccuaacaggugcuuccugugugccagagacaagacaugacaccagguaagacaaaugcuugcuucuaauucauuccuuaagaagauaggcuaagucagcagaauuugauaggaaaggagaaacaaacacguauuuccugaucauaugaaaagcuacguuaacuacguuacuauccccagggaacuucuaagcuucacacagugcagaggacagcacuucuucauuacugauauaaaggaugggaugauacgcaacucacacugcaaacaagcaagcaucuucacggccggugcagcuacagugcagcaguuggccagaguacucagugugacuuucaagcagcuccguaaugcugccagugccacacgucuccugcugcgcaugcugacugaucacagcuuugccuucuccucucaauuccaaagccuuuccccagcauuccucgcuguauuacuguucuccaacccggaguggcauuacaaugccacagcucaccccacauuaagucacacccuggacugagaggggagaaugaagcaccuacaguuguuuuacacucaacaggugacugcuaaacaucagcgcuggaacuauguacgggcuuucaccucagcaggcgaagagaacaaguaagaaagcucaaacagaaccaguaaguuauaaauauaagucagccgagccaucucccuguaagccguucagugcuccuuacccaucugacuguguucgaaguucgaggaccuugaaccgcugccuuccaauugcuuucacuuucacuacuucaauuccaaacuccugcucuucucgauaggcauagaucucugcuguugucccaaacugugcuucccuuucuugcacauuacuucaaagacaaaaauggacagaguuuucagcucuggcucauaauuauguaaagguggcaaaagcgacacagaucgggcaaacacugugacaauuacagcagcuaacccucacuaggaagcugacacacaaggccccggaaggcaaacagcauauuuuagaauaaagguagacuuuuaggcuucacugagauaaccagugcuaagaaguuuuaaaucguuauuucacaaaaugagcauccuuucacuuuggcaggcaaugauggucgcacuaacuggcagcacugugacugucugaggggagggucagcgggggugaugggagguuuccuguuuccauuuccugccuccaccacgguucccucauuugccacaggcuacugaagaacagcuucacuuuagaaaaguaaccuuuauugaaaauuuuaaaacuuagcuauuuuuaaauaaagacaguucugaacagggagguuuuccauuaagugaguggaaguuuuucaagagccaaacacagcuacacuguaaaaacagcgaaacacugaaaaugugacacaagaccguuugcuucacacuccuguccaguaucugcaaauccccguuggcuuuagcugucgcacugacuuuggcagggugguaagcagaucugucuaaucucuuaccuguaugcaaggacugcaaagguccugucuuucuggauuaaguuccgcaccaugcugacuuccugugggugagagagcugcagugggagugucugcccaggaaucaggaucaucagcaccucaggaaggacugggaucaccuggcagcugucgucgucaugcaaaguucucccguggaacuccuccauaucagcucccagguacuacucaagagcacagagucaagacacacacuuacuacacgucaaccuacuaaagaauaaagcagaggaaaacacuaaacagagcacauguuuauuuaaauaaucuguuauauaagcaugccuccaucaaacucuaauuuuugaucuaguauuuccuauuagaacucccaauuuuuaucaagaaucgaucauuauuuuguaauucaaaauauuuucaccaaaacuccucuauguccaaaacugacaaagcauaggacagaauuuuaguaccuauaauaccgccccacaucccagcaguucugaaacaacauuaagaacacuuaauggcucaguuacuagcagaacccuucagaggaagacaauuccucaaagagucccucccaagauaaguuuaaacauaaagcuauauguuagcuuuaauguuuacauaucagcuuacauauuagaaaauagucaagaaucacaugaggauauaguacgacacggcuuccauuucuaaaauuacaugcuaugcacuggaaaauaagucuguucucaugcacggauucuagggucagcgaauaugcaggaacccucuagucaguccccugcacuaguccccuaguguggcucccugcacuuaggaaauuccagccauagauaaagguccgcauacugcauuugcucaaugacuaaaccacauacuguaugugagguuggcagacuggugucaaaguuuaugauauucgguuuucuggcuucuuuacuaucuuggucuucaacuuccauuucaauuucaucaucuucaucuucacugucugcugaaggagaauaauagagggaaaaaaugagauucauuaaaaaaaaaaaaaaagaaaagaaaaaagcaagucaguucugguuccauucacacacccugaauugaagaaagacacucuuaaaaggaaagcugugcagagacagcggcagaggcugggucugugcucuuucugucauggcgccuuuuccuuucuuuuccuuuccuuucuuuuuucccuguuuuuaacaaucaacuaucuuaggacacuuuaagauuuccuggaauguuggaaaaauagaauucuagcaugccaagacuaucuuccuccauuguuagcaugguccaugcaucugguauucuugugacaacuaagucgucgauauuggcacauuacuguuaacuaaaugccuuaucuuauuuggauugccuuugauuuucagcuauucuccauuuccuguuaccccuccaggacaccaugcuauauuuagguauggcuccuuugcugccugugguacacgcaugcuggauguucugucuuccuuaucaggacuuuacacagcaucccucaauagggaauagaugucauucucuauuagaguucugcuagggacaacgccuauuccucaccgcacaucaaggguacguacagucagccugacccaggggcugauguuccccuugauuucuggucagaaacagccgccagcuuccuucucuguaaacccccucgccccugccccgcaguuacaccguacacgguuggaaagcagaucacuagguccagccuaacgacugacguggcugaauuaggcccaucuccugcauggaugagucuuaucuucuccaucacuacuaauccugacaccuuacacaaugaauuccaauugauuaaagcuguuuuuucauuugaaaaaaaaaacaaugaaggcuugaacaaaguaaucuaugagguucuuucagacuuuagcuacaaaguuucucugugaaaaagaaagcaaggaaaacacaagcaggcaagaaaggucuguuaaugaaacugggaaaaaaaauaccauuaaaaccuggcucaccgucauauuuaaacgugaaauguuugcaauuauuuuucauaaaacaucgcuuugucauucucaauuuaaaaauaaaguuggcccaaagaaaauacauuuuaaaggagaugucuuuuuuuuuuuucuuuucuuuucuguuuuucgaguuuuuggagacaggguuucucuauguagcccuggcuguccuggaacucacucuguagaccaggcuggccucgaacucagaaaucugccugccucugccucccaagugcugggauuaaaggagugcgccaccacugccuggcaaaaggagauaucuuaagaacucuaccugcacuuuuuuuuuugaaaugaaaugaaagcuaagcugauccaccugauaacaugaugcugccaagggcagagaugaaagucugaagaaacaaaacacaacgcuacuuucuagaagugguauucuaucaagugugagcuguucuuuuccugcuaacuaugggaacauuuccaacucgaugacuuuguuccuuguaauguuuagaacugucugaagauaucuuugacugucacaacuauaaaaaccccgguaaugcagacuaggaguugucuaggcucuuacacacacugugcugcaacauagccagggguuuuccaggcugaaagggugacagucucaagguugggaaacaauggccuaaacuaagucucauuucucuucaaauguuuuuaaauacauccaaaaaguuuuaaaaugcauaagguuucauuacaaauuggucagcuuuuccauuuuugaaaauuauuauuuacaccaaacuaccuaaaaggauguucuuaugaaaaaacaugaagauuuuacuuuauuuuuauuauaaauuccuagauaaaaggcucugucaaagagaagaacauaauucaagugguaugcagauaguuucuauuuaacauuucuaaacaugauuuuauugacaauagggaaguuuaucaagcgauaaagacgaagcuaaaauaagaaaaacauucugaauuuaauuuuuucaucuacaacuccgagaauguagauuuuacuugacauuuggagagacccauucucuucuuuacuacagcaaguuuaaaguaccugcuauuagcuccagggcuaauacaccugaaauuuccuauguuuauucuuuaaaagaauuugcuuaugaacaggcuauaauuaacuucuccaacuugguuauguuuuuauuugagcacuuaauuuguccaauauggauucuucacaccuaaaauguuaagcaauucccuuagcuguuaaggaugaucacuuuucaaagcaaguuacacuacaugaauucaggggacaagccaaagugucuccagaaauaaaacuauuauaauuuggaaacccacuauucuauaucuacaacaucugugagccucuuccuucuaauauuucaaauugagaaacuacagaguuuucagagcucccgguggcucacacagaagcaccugaugaaugccaauagcgggggagcacccuucuccuacuccaccacuuucccuaaacgucugcuccauucacaguggagcugcugucccugaaaucucuucuguugaaagaugaucaccuuuaggaacugccgcgaguacagcucaauaaccaguggcuuacagaaaaggugcuuucuaugcacuggcccugcacccagcauuucuucuucugucuacacuaccaccaaggaacacauucacaccugaagcacaccuucugaggcaacaaacugaaaccugaaauuauuucuucacaccccacacaaaaaaguuccuaacugaaaugacuaaggaugcacgguuucaacaauguaggacuaaccuaguccacaaaugaacccuaagugaaucuccaucacaagauuuucaaaucccacaauaaucccuacccaugaaaaucacagcaggaguuggagacauagcucagaggauuugggagugccugguauccaauccagcaaaaaacacaaacccaguacacccagcagcaguugcuuauauggcucuaaaugaacugcaccugugauuguaauuauucucaauagccuuauccuaacugugacccuccuaaaaguagccgacugauguuuuuccuacaaacaagguuaacagacugcauggcuuuuaacuacaaccaaaaggcucuggcaauagucuguguuucuacagcauucuaagaacaguccguaccacuaguucauccacuuucagcauucaauacugcaacauaaguugucauaaaccauaaaggcauaaaguaagcaggagaaaucgguaauaccguucuccugaguacccuaaaaguaggcauauuauuugcagaccugagaaaaaccgcuaaauaacuaccuccacagagagauagcuaagagauaccagcugugguggcagaucaguacaccgcgcagcccuaucugcaacugugugaccuuccacgucacuggaugguauacauuuaacaacccgucgauaaguuucuccuccauaagcaaggcucuggacagaugacagguguaauaauaaaagcagaaaugcacgcaaagcauucacugcggggcccacgacgugcaaaugccuacugcauguuagcugucagucuuaugagaaagcagaugagcaggaaaaguaacggcugcuaaugucacccgguucucaacuucgccuacucccacaaaauuuucagggaggccggcuugggagaaagauggaaaggaaugggggucccugcucugggaaaccaaaguccguggccccaacauccccgacagcccaggagacaggccgggaggaaagcgcagagcugcggagggcgaggcucacacgggaggcuucccaccggccgcugcgcccgaguagcuguccccguccucccugcgggaucggccccgguccucggucuccacccacggccaggcgcccgucccggagguuaccaggcagaagcggcaggugguuucccauguugugcgcagcguccugcugaucucccucgccggccaugucuguuuacccgcaaaggagccugggaaag

SEQ ID NO: 3269 - RNA, 21846 nt, Mus musculus
cuuucccaggcuccuuugcggguaaacagacauggccggcgagggagaucagcaggacgcugcgcacaacaugggaaaccaccugccgcuucugccugguaaccuccgggacgggcgccuggccguggguggagaccgaggaccggggccgaucccgcagggaggacggggacagcuacucgggcgcagcggccggugggaagccucccgugugagccucgcccuccgcagcucugcgcuuuccucccggccugucuccugggcugucggggauguuggggccacggacuuugguuucccagagcagggacccccauuccuuuccaucuuucucccaagccggccucccugaaaauuuugugggaguaggcgaaguugagaaccgggugacauuagcagccguuacuuuuccugcucaucugcuuucucauaagacugacagcuaacaugcaguaggcauuugcacgucgugggccccgcagugaaugcuuugcgugcauuucugcuuuuauuauuacaccugucaucuguccagagccuugcuuauggaggagaaacuuaucgacggguuguuaaauguauaccauccagugacguggaaggucacacaguugcagauagggcugcgcgguguacugaucugccaccacagcugguaucucuuagcuaucucucuguggagguaguuauuuagcgguuuuucucaggucugcaaauaauaugccuacuuuuaggguacucaggagaacgguauuaccgauuucuccugcuuacuuuaugccuuuaugguuuaugacaacuuauguugcaguauugaaugcugaaaguggaugaacuagugguacggacuguucuuagaaugcuguagaaacacagacuauugccagagccuuuugguuguaguuaaaagccaugcagucuguuaaccuuguuuguaggaaaaacaucagucggcuacuuuuaggagggucacaguuaggauaaggcuauugagaauaauuacaaucacaggugcaguucauuuagagccauauaagcaacugcugcuggguguacuggguuuguguuuuuugcuggauuggauaccaggcacucccaaauccucugagcuaugucuccaacuccugcugugauuuucauggguagggauuauugugggauuugaaaaucuugugauggagauucacuuaggguucauuuguggacuagguuaguccuacauuguugaaaccgugcauccuuagucauuucaguuaggaacuuuuuuguguggggugugaagaaauaauuucagguuucaguuuguugccucagaaggugugcuucaggugugaauguguuccuuggugguaguguagacagaagaagaaaugcugggugcagggccagugcauagaaagcaccuuuucuguaagccacugguuauugagcuguacucgcggcaguuccuaaaggugaucaucuuucaacagaagagauuucagggacagcagcuccacugugaauggagcagacguuuagggaaagugguggaguaggagaagggugcucccccgcuauuggcauucaucaggugcuucugugugagccaccgggagcucugaaaacucuguaguuucucaauuugaaauauuagaaggaagaggcucacagauguuguagauauagaauaguggguuuccaaauuauaauaguuuuauuucuggagacacuuuggcuuguccccugaauucauguaguguaacuugcuuugaaaagugaucauccuuaacagcuaagggaauugcuuaacauuuuaggugugaagaauccauauuggacaaauuaagugcucaaauaaaaacauaaccaaguuggagaaguuaauuauagccuguucauaagcaaauucuuuuaaagaauaaacauaggaaauuucagguguauuagcccuggagcuaauagcagguacuuuaaacuugcuguaguaaagaagagaaugggucucuccaaaugucaaguaaaaucuacauucucggaguuguagaugaaaaaauuaaauucagaauguuuuucuuauuuuagcuucgucuuuaucgcuugauaaacuucccuauugucaauaaaaucauguuuagaaauguuaaauagaaacuaucugcauaccacuugaauuauguucuucucuuugacagagccuuuuaucuaggaauuuauaauaaaaauaaaguaaaaucuucauguuuuuucauaagaacauccuuuuagguaguuugguguaaauaauaauuuucaaaaauggaaaagcugaccaauuuguaaugaaaccuuaugcauuuuaaaacuuuuuggauguauuuaaaaacauuugaagagaaaugagacuuaguuuaggccauuguuucccaaccuugagacugucacccuuucagccuggaaaaccccuggcuauguugcagcacaguguguguaagagccuagacaacuccuagucugcauuaccgggguuuuuauaguugugacagucaaagauaucuucagacaguucuaaacauuacaaggaacaaagucaucgaguuggaaauguucccauaguuagcaggaaaagaacagcucacacuugauagaauaccacuucuagaaaguagcguuguguuuuguuucuucagacuuucaucucugcccuuggcagcaucauguuaucagguggaucagcuuagcuuucauuucauuucaaaaaaaaaagugcagguagaguucuuaagauaucuccuuuugccaggcagugguggcgcacuccuuuaaucccagcacuugggaggcagaggcaggcagauuucugaguucgaggccagccuggucuacagagugaguuccaggacagccagggcuacauagagaaacccugucuccaaaaacucgaaaaacagaaaagaaaagaaaaaaaaaaaagacaucuccuuuaaaauguauuuucuuugggccaacuuuauuuuuaaauugagaaugacaaagcgauguuuuaugaaaaauaauugcaaacauuucacguuuaaauaugacggugagccagguuuuaaugguauuuuuuuucccaguuucauuaacagaccuuucuugccugcuuguguuuuccuugcuuucuuuuucacagagaaacuuuguagcuaaagucugaaagaaccucauagauuacuuuguucaagccuucauuguuuuuuuuuucaaaugaaaaaacagcuuuaaucaauuggaauucauuguguaaggugucaggauuaguagugauggagaagauaagacucauccaugcaggagaugggccuaauucagccacgucagucguuaggcuggaccuagugaucugcuuuccaaccguguacgguguaacugcggggcaggggcgaggggguuuacagagaaggaagcuggcggcuguuucugaccagaaaucaaggggaacaucagccccugggucaggcugacuguacguacccuugaugugcggugaggaauaggcguugucccuagcagaacucuaauagagaaugacaucuauucccuauugagggaugcuguguaaaguccugauaaggaagacagaacauccagcaugcguguaccacaggcagcaaaggagccauaccuaaauauagcaugguguccuggagggguaacaggaaauggagaauagcugaaaaucaaaggcaauccaaauaagauaaggcauuuaguuaacaguaaugugccaauaucgacgacuuaguugucacaagaauaccagaugcauggaccaugcuaacaauggaggaagauagucuuggcaugcuagaauucuauuuuuccaacauuccaggaaaucuuaaaguguccuaagauaguugauuguuaaaaacagggaaaaaagaaaggaaaggaaaagaaaggaaaaggcgccaugacagaaagagcacagacccagccucugccgcugucucugcacagcuuuccuuuuaagagugucuuucuucaauucagggugugugaauggaaccagaacugacuugcuuuuuucuuuucuuuuuuuuuuuuuuuaaugaaucucauuuuuucccucuauuauucuccuucagcagacagugaagaugaagaugaugaaauugaaauggaaguugaagaccaagauaguaaagaagccagaaaaccgaauaucauaaacuuugacaccagucugccaaccucacauacaguaugugguuuagucauugagcaaaugcaguaugcggaccuuuaucuauggcuggaauuuccuaagugcagggagccacacuaggggacuagugcaggggacugacuagaggguuccugcauauucgcugacccuagaauccgugcaugagaacagacuuauuuuccagugcauagcauguaauuuuagaaauggaagccgugucguacuauauccucaugugauucuugacuauuuucuaauauguaagcugauauguaaacauuaaagcuaacauauagcuuuauguuuaaacuuaucuugggagggacucuuugaggaauugucuuccucugaaggguucugcuaguaacugagccauuaaguguucuuaauguuguuucagaacugcugggauguggggcgguauuauagguacuaaaauucuguccuaugcuuugucaguuuuggacauagaggaguuuuggugaaaauauuuugaauuacaaaauaaugaucgauucuugauaaaaauugggaguucuaauaggaaauacuagaucaaaaauuagaguuugauggaggcaugcuuauauaacagauuauuuaaauaaacaugugcucuguuuaguguuuuccucugcuuuauucuuuaguagguugacguguaguaagugugugucuugacucugugcucuugaguaguaccugggagcugauauggaggaguuccacgggagaacuuugcaugacgacgacagcugccaggugaucccaguccuuccugaggugcugaugauccugauuccugggcagacacucccacugcagcucucucacccacaggaagucagcauggugcggaacuuaauccagaaagacaggaccuuugcaguccuugcauacagguaagagauuagacagaucugcuuaccacccugccaaagucagugcgacagcuaaagccaacggggauuugcagauacuggacaggagugugaagcaaacggucuugugucacauuuucaguguuucgcuguuuuuacaguguagcuguguuuggcucuugaaaaacuuccacucacuuaauggaaaaccucccuguucagaacugucuuuauuuaaaaauagcuaaguuuuaaaauuuucaauaaagguuacuuuucuaaagugaagcuguucuucaguagccuguggcaaaugagggaaccgugguggaggcaggaaauggaaacaggaaaccucccaucacccccgcugacccuccccucagacagucacagugcugccaguuagugcgaccaucauugccugccaaagugaaaggaugcucauuuugugaaauaacgauuuaaaacuucuuagcacugguuaucucagugaagccuaaaagucuaccuuuauucuaaaauaugcuguuugccuuccggggccuugugugucagcuuccuagugaggguuagcugcuguaauugucacaguguuugcccgaucugugucgcuuuugccaccuuuacauaauuaugagccagagcugaaaacucuguccauuuuugucuuugaaguaaugugcaagaaagggaagcacaguuugggacaacagcagagaucuaugccuaucgagaagagcaggaguuuggaauugaaguagugaaagugaaagcaauuggaaggcagcgguucaagguccucgaacuucgaacacagucagauggguaaggagcacugaacggcuuacagggagauggcucggcugacuuauauuuauaacuuacugguucuguuugagcuuucuuacuuguucucuucgccugcugaggugaaagcccguacauaguuccagcgcugauguuuagcagucaccuguugaguguaaaacaacuguaggugcuucauucuccccucucaguccagggugugacuuaauguggggugagcuguggcauuguaaugccacuccggguuggagaacaguaauacagcgaggaaugcuggggaaaggcuuuggaauugagaggagaaggcaaagcugugaucagucagcaugcgcagcaggagacguguggcacuggcagcauuacggagcugcuugaaagucacacugaguacucuggccaacugcugcacuguagcugcaccggccgugaagaugcuugcuuguuugcagugugaguugcguaucaucccauccuuuauaucaguaaugaagaagugcuguccucugcacugugugaagcuuagaaguucccuggggauaguaacguaguuaacguagcuuuucauaugaucaggaaauacguguuuguuucuccuuuccuaucaaauucugcugacuuagccuaucuucuuaaggaaugaauuagaagcaagcauuugucuuaccuggugucaugucuugucucuggcacacaggaagcaccuguuaggucuuuggagacagccucuggguucuaccuuuuuuuggggauucauucacuaguguguggucagaauugaacguucugucagacuucuuuauuucaugugguaucugagcgccagaaaguuggaagacuuuaggaaucaacaagaaaagcugcacgaggacaggauuuaugguuggugacgcucauacuguaagcugugacgcucauacuguaagcugugacgcucauacuguaagcugugacgcucauacuguaagcuguugugaauauuagguaacaacaguggacaggcaggcaggaugugggacaagagauuguguagggugugcauacuucacuggcuuggcuuggucuugauccuucucuagaucauuuuauuauacaaauucaaaaccuuucugaagcuccacgccuaagucccucauuagacaagcugcuggggaagugacugagacacuugugggccacacuuggguuagcguugcgugaaugacaagugcucggagucuauacuguagugacugacuggcuguuuucuuacugugcauuuccuugacacuaacaaauuuuaauuuacuucuugcuacagauugguuaucguugaauauuacuuucuagaagcuagaaaauaaacugacuugggagauaguauauuucugugugugacuucaguaauuacuugugcgcaacucuaaaacauaagcuggaaguagucacugucagaaaguagagcaugaagcaugguuagaaucuagugaaggcugacgccacacugacagguggacaggccuuggaaaggagaaguguuucuaguguuccauuuuccacuacguuuuaaggucucucagaaagaugggucucagcugaaaggcccucuggaauaagauuucuuuguucccacuuccuugcugguccgcugucacuuaaaauagucaagugcuccacaccaugaagccucugcuuuuggcaagugaauaagcuuaaggaucagagcuuacuugcccagagucauacaaguaaauaagaaauagcugacuuguuccacauucugacuucaaacuagcuuuugaccauuauaccagaauuucuuuguaggacauugaaaauuuaacccuaugagaucuguagauuaagauucaauuucuguuuuuguuuuuaaccuaaauuacacuucauauaugaaaagcaguguuaccuucuagccuuuccuuugaaaagucuguuuuucaaauauauacauauauauacauacacacauauauacauacauacauacacacacacacauauauacacacauacacacacacacacacacuuuuuuaaaaguaagaaauagaaggguguauuugacucaggacucuucagaaacuguuuuuagaaguauacagaaaaagagaaauucauauucugcuggaauuacaagauuucuuaucugucauaucugagauaaguaauuuguaguuaaaagaguuugaacuauauaucauaaacacuuuaaguaaaaauuaaaauaguguaacauuugguuuugaagagacgggguugcagauccacugggauguagguuaugcuccggcacuuucuuuauauauuaaccaucuacacuuguguccuuguugcaagcauuauaaaaauagucccuagucggugugaaugcaaaguccuaaaguuuucagauuuuccucaauuucacaugcuuuuauaaccuuuguuauaaaacgauguuacuauagucacaaaguaacugcauaaacacauuugggaaaacagacacacacacgcacacacauaggcacacacccacagacauguugaauaaagaccaagaagacucacuuccucuccaguuuugaaagcuggugcugcgaacauagaggauguugguuacacagugucuuugguauauuuuuuuuuaggaaccguguguguguugggcggggggaguacgcuuguaacgcuguagucuuaacuguccagaguuuguguggguuuuguccauucuuucucuguguuugcucucuggauaauaauaacaaagaguuugugaggcccacagucuaucuggauaauaauaacaaagaguuugugaggcccacagucuagaguuuaggggauagaaaauuguauuaucuaaaguuauccaagaaauuagaugugucaagauaaucuguagccucuaugauguuuauacaauaaauuuugcuucauuugugccugcauauuuaucugaaauguauaaucucuugauucuaauucugagacugaaauacauauuuaaguuaccucauacuuuauauuaagauuuauuaaaauuguguugagaauuucuuguauauaucuaugcauuaccauuuggucaguuugcuuaauaaggggaacuugagaaaaucuuaauauuuaaaauuauucuaugucgagaaacuuauaguuuaacuuaguguaucuuaaaaaugaacaacauacuugauucucuuuauuuuagaauccagcaagcuaaagugcagauuuugccagaguguguguugccgucaaccaugucugcagugcaguuagaaucacucaauaagugccagguauuuccuucaaaacccaucuccugggaagaccaguauucauguaaaugguggcagaaauaccagaaggugagaugcuaauuucuuaugugucuucuagaacugaagacaaauugcuuuuaaaaagucacaacucuuaugauauucuguugacacuguagcucccuugaucauagauggauuuaaaaauaauucgccggccauuauuuaugaaaaguagcuuacaguagugguaaaauguuacacaguuguaaaacguuuugauuuuaugccugucaugcauguauuaauggccuguggguuuuaguuuccauaggaaccagaguuccauaggaacucugaucacauauuuggcuuugaguuaagggcugcagugaagaagggucagaguuguuggggcuagcauucaguggcaguagaaaggauuguuguccugggacuuuucagaggagagauuuuugucaguuauuuuucuccaugcuuccuaccacucagaaauugaugugaguuuaagguauugcuuccuugcugcaggaguguagcucagugguugaggucuugccuagcguguucaagacccuacauuugaucucagcggaggaaacgcaacuauguuugcuugggcauuacuuaugcauuucuuuggcuaaaugauuucaccucuuaggaccaaagugaaagcucuucugccucauuucacuguaggugcucauguacauacagcuuuagguacaaacacguuucugaaauuuaugauuuccccaaaacucaaaaaugugcucauuuguaaguuuagaauaaauugguuuuuuuguuguuguuguuuugguuuuuuuaguacuuuguaacaguucaaaaguguuauuuccauuauaaacaucaaaguccuuacucuuuguuaaguuagaguagggaugguuuacauuuugaugugaguagcaugguauccuagacugauaugaauuaauauuucauuuuugugacaagaaucucauuuucuuuucacuguucaaucacauuuaguauuuaguuucuagagaaguuguguuugauggucucauaacucuuaggguauacaguuaauuuuucuucuuguucuccauucuguuagccauucaugaauaguauggcaugcuuuaguuaguguuucuaagaaguauaauuagacuucuuaaacacgagccgaaaggauaaugaaaguaauauauuuugaagcuuugacauuguuauugccuuaaguugaaggcagcuuucaguuuaucuacaaaguacuuccuuuuccaaacugcacauagagauuuuaaauguaucuacuccuauuuaucaauacaacagcagggaauuauguucacaaugcuuuugaaaauaauucuuagacugugucaaaugauaacucugucaaggagguuuuauuuuucuuuuuuaaauuaagcuauuuaaugcuuaauuuugugucugccacuuguuuccuagugaaguggauauguagaaaauuccuccugucaaugcuugcuuccuacaugccaugcccauauuuaguuguccauucaguggcucuauguuuuuucagcaggacuuaauugagauuuauaauucaaacugggaugguaaugggacuccuuaauuaaucuauuuuuaaaauucuuugaaaaguucuaaguguaugaugggacuguaguuaauaacugacuuuuuggcccuguguagcaaauccugucuggccuacaggaccuugagauucugaacuugaacuucaguuccaguucauaacuuaggaacguuaccauuuguguuacuuacugguuaaacuccucauagucuauggcugaaguuccuccacgugcuuacauugaacacugacuuuuuuuuuuccuuuacaacuugauugcucacugguuccaagagcaaagauuggucgcugcucaucuggggacagguaucugacauuacugaguggucauccuagacuugcccucaguagcccuuugcucauugucacaaggccucaacaggaggaaauaaggcaugggugaggaaggaacaagagaauaaaagaaaaagaauccuucagcuuuugaauuuuuuacauuguuucaaagguuuccuuauucaggucaaaaaaauaaaaaauaaaaacuguuuuuagaaaauguauauuguacccagugacuuguaaacuuuguuguaccucuuagacccgaccuauccuguguguaaaaaguauaggcugugaacaggagugcuccggggcugcuuggucagcacuuccugcuaagucugcauacugugcuuguaagcggguauucaauuacuuugaaaaauggggcauucauugcuuggguuuagacagaccuggggucaguucagccuucaaagguuuuauucacacucacuuguacaucccaccauggagcaaagugcaaaggaugcguccuuucccgcugcugagcaggaaguaagguggcggaguugagaggccgcuugcaugauuugaaggucguugucaagccucuuauaaggaagauaaagggucuuggagacgauggucuuccugggauauaguuaguuaaccuucaacauguauaaacuacucccagaucacuucaaauagggucgaagcucccuuaaguguuuugugcugugucccaaugugacaaguagcuguagagaccugauaagacauacacacacuugaacaugguggauguugagaagggggaaacauuagccaaguuaauugagaaacacuucagacccauucuacaaagagaauugauuuccugauagcugggcuuugaaauuggcauuuacuuuuucuucuuuucuucuguuuuacuguuaaauuaugguaccuuucuaaacucacuaucaugauuggaagaggugguguuggaugagaaacuuguauuuaccucuuugcccaaagcuuauccauauauaagacuuguccuguuaauugcaagaguugacugaaauagaaaguaaguggaguauugaauguucauccacaggguugcccgugugcauccuguagagcaggguaguaaugagcacugaccuacaaaggcagggcccucaaauaugcucccaacggcuaacauuuagucuucuugagugaauaaagauagggaaaugcauuuuucuuauacauuauguaaaaggauaaccacuauccuucucuuugcuaacagugucuuucagggaacuuuuccuuauccuuugacagacacauuuuuuuaaagcuguagccuguaguuacauuguaacaacacagcaaggccuccuugagccugcaggaaauguccagauuguuuuugcacagguacaugugcucagcauugucagugacuuggcugacaacaagggcuuggaguggacuuuaacagccccuuacaaaagauguucauacuguuaccauuccuuguucccaugguuucacagcucacaaccacauuugaugaccugcuaagucuggcuuaugaacuuaacuugaauguuuacuuuuagcauuuuauuuaagggccucguguguuugucuauguaguuucuguuucuuuuuccuaccagcaugacuuuugucauuguaaucacacuuguuuccucucacucucggcugucaucggcuaguuuugguuuuggugugcuauuuuacagggaguuuuugacuuuauguaaguauaguuuagugugcugccuuaauauucuaaauuguaacuaguaacuuccuaagaaaggguaugcaccuauuuuucucuuguaaacaagagcccgcugugcagugguggcgcacaccuuuaaucccagcacgugggaggcagaggcaggcggauuucugaguucgaggauagccuggucuacaaaggcuacacagagaaacucugucuugaaaaacaaaaacaaacagaaaaccaggaguccauguguacucuagaaugagcaucgcugucuccagacggcuauuggccccguaacaguuggccaagaguuuaugccucaaagugauccaagugcucuccuuggaucagcuagguuuuaacuuuuauucuccuguuauucucuauauacacuguacugcuguagcuuucucagcuugguaaacacugaauacaaauggggucucuggccuucucacugcuacuuuuuagugaaacuuccuaaguguucagcuauugacacacaaagacuugauuuuuuucccguugcacacaauauuaugcauauauauuugugcuaccaguuauaaaacacuagaacaguaaagaucaaaccagcucucaguacuaaagaaauuugauaaaugagagaaaagcaaaaaauuguuaauuucaguucauuuaaauaaguuuuaucauuuacuuugaucacuguaauaugagaccaaaccaaaaaucucucugugcccauguaaaggaagucaguagaaugacuacuuuuaacuuuuuuccccauaucuuaucaguuucauugugaauuugauagacuuuucacaacuuuuaaauuuucuuaguuucauuuuaagggccguuaugugugcugucaucaguaaaugugguucccugaauggcaguccuuauccccuugaauaccucaacuuucuggcuaguauuacagauuccuuaaaggauaacccuuuacaacauaaagccugaggaacagcugugaacuccugaguguuaccaacagcacugacacaggagagaagccacucugugcugccaagucaagcggaccaguguugaguucagggcauugcuguguaaaaacuaacaguucucccauuugugugauuacuguuaaaaacauauucaacacauuucuuuguacagaauaaagauuuuuagaaguccuuugcuucagagggaauugagacaccagcuuguuuauauguuggggccaugcaaaaggauggcauuguucaugcauuccuguuacuauguuaaagaugccauuuaucuuuugcuuaugauuauguaaauaaauacauugggcuucucuuuaucuugugucaaauuacacuuuugcacuacauuguguaaugccuugaugcuaccuaaguaaucaucuuaauaugaaaguauguuuuacuaccuaguuaaacauguguccaccaaccaccucaagagaaacuuuuucuugguuuccuguuauuuuguaauuuaaagaauuucuaauuuuaggaaguagacuucuuucccaaaaguauaagccucauggggugugauuuacuuuuuaauguuauuuauaauauacauaauauuccaaauacacaaaaaugaucaacacauugaauaaauacugguuaaauccuagcuacuugauuaugaaaucugugacuuccugugccugccuuuacuucccuuuaaaauggagaugcuucaguaaccaucugguauuauaauagaagaugaaauucuugccauaguauuaauggcuuucaugguaauuacucauuagucauguguuaauuauugguagcacauuuuuuaaaaaucuguaacaacuaugacauuaaugcuuguccuuagguacauggucuuagaagaaaagaacaacuuccuggagaggaccuaagucuuuugcucuggcucauaaggguagacuccugagauaagcaggaguaggaaaccacccagaucauuuuuagguaggaugagauagaaguuuaugccaagcuauauuuuuuuuucuuucgagugucuauauugauacuugaaagaauaccaauggcugcuucagaaaaucucucucuaccaugugguaauuccuaaaauauuugcaaacaagagucauauucccuugaaauacacuucuaaacucucuacuugaauuuuucuugggcaagauuacugaagaaaauaauuuauuuaauauguguuacauauagucuguagcaauauuuagacaccagaauaauuaauagaauuauuaauucuauucuaauucuauucagaauaauccauccaugguaaaggucccauauuagcauagcauuuauucuucuauacuugauaaagcuuaguuuauaguauuguguuuuaguugccuaccauauucaguccauauugccaugugagcuuauagucuaggaguaguguggguguauaguuucaacacucagguaguguugaguguacuuugugaacagcauuucucagaguggcuccuugucauuaaaguauugaaaguauuuacaucucuguuccagaucuaguaaguauuucaaaagcauuaaaguguaauugucaaacauugcagauaaucaccuuccgugagaugugaauacauuugagauaauaaucuguuggugauuaucuuuuuaaaauuagaauuguuuuuguaggacuaauaauuuucagauauuacuauuuguauuauuagaaucauucccuugaguuuuaauaagugacacuuuuuguuucagagaaaguuucacugugcaaaucuaacaucauggccucgcuggcuguauucauuauaugaugcuguaaguaacuugacugaaauuuguauguuacuucaguacuuguaauuuauuaaaguaaaauaggcagguguuacugggaaguugccuuuuauuugaauuuuuguaguccuauaacuuauaacuuagcaaaauaugaugacacacuuugguuacuaaaauuauaaagggucaugugaaaguaagaauauauuuuccaagcaaguauauuguugcuuaucucugcaucauuaacgcgcgucagguacaugaguacagugccccugcuuacaaacccacgaagaaccaauacuaggguaaagaagcuugaugguaaacacauagaccaccuucagagcccgaugccaguuacacuggucugggacagauggguauaguuaacacauaguaagcauuaaacagauguauuucuuaguaaacuccugccaagaaaucuaaaaaacuagaaaaauuaaacaaguaaauuugagcauguaugauguacauaccacugaagggaaauggaguuggccccugccuuucagcagccuuugagucaucacaaaggcuuaaaugcagucugaaagugugcuaaugccuaggaaagccagacagcacuuucuauaaaaaccaguugucuaguggaaaguguagauagcaaauguuacuacaggaacacacugcgauuugcacuaagucaaaaaaggacuugagaaaaguuacaagagggaccaguucaagcagcaaccuacaagagcauccaaaggcauuuagaaucguacuccuuggaauaaacaaccuaaaggggagaagccugggauuuaaauucaaccagcuucaucuuuaaaauacagacaucguacguggucucagguuuaguaccaguguauguuuuuaagggcuaaacauuauggcuuuuguuuuaaaccaggaaacauuaauggauagaauuaagaaacagcuacgugaaugggaugaaaaucucaaagaugauucucuuccugaaaauccaauagguauggcaaguacuugcuaucuaucucuggcauguugguaaagggaaaacaagccuuaaauauuacucaguuuaaaccaaccuuugaauucugaaaaggcacuuacauuucuuuuaguuugaacauuuuuuaaaaaggaauuacuauugcaagcuacaauggaauccuuacuguuaauuuucuaacuuaaguugaauugcagacgugccucucauguagauacuuccuguucucuacagagccuuuacaagugaagcuggcuccaugacuuacuuugauaugucaucucuauuuguuuauaagucacuucaaguauauguuugacuuaaaggaaagugacugaaguguauauuaaugacuccuaaguuuaaagccugcaaaccucucugucuuuuaagacuuuucuuacagaguagcugcuugucuuccuauugaugauguauugagaauucagcuccuuaaaaucggcagugcuauucaacggcuucgcugugaauuggacaucaugaacaaagugaguaaagccuccacgucaucauuuagucagucaggcuacauagacacauaagagagucgagaucacaagcuaccucgacuguguaguaauacaagcagaugcuacaaguacuuguuuaccugccacaguuugcaguaaucugacaugcuuuauaacuuagaccauuucaaauuuggaggauuaggaauguaucaacaauaaagucuuguccaacuuugaauaagguauauucagugugaaaauuugagccauuuauuuuugcagucaauauaaauuugccugcuuagguaugaucuacagcccaagacauuagugccauagaaagguuuguuuauucaucaucuggguaacaugccuauuucuccauuuaaccuuuguaguguacuucccuuugcuguaaacaaugucaagaaacagaaauaacgacaaagaaugaaauauuuagguaagaucuuuauuacauuuuuaauauauuuccauauucccuucugugguuccacuuuccauauuuucuccagugccuaaaaaauaugcguuuaucucaguaaaggagauaaacacagggcaagcugucuuacagccuggaaacaucuguaauacagucuuuuuccccucaauuuuuguuuagacacauccuaucuuaaagcauaauaggaaugcuucaagcauuauacuucagcuaguucugcuacacgggaccaaaauugggugggucucugaacaugugcugaugcugugaagcuuaacacuuugaugaauucauuagaacuacagaucaagaaggucaggaaacugauauguagguaaaguaacuaaauguccaaagaugaaaacaugaccucacuaggcuuuguaaacacauauauuuaccuuugaaucaucaaagaacauuuuuaagcaacagaauaucugccaaccuccuguauacuugucuuacauuuuacacaaaguacuauauaauaucuaaaauucaaagguuaaaaagcauaacuuaugucccaaauaaguaaaaaacugggauuacuauuuuucuuuucauugucuuauucuccacauuauuucuuugucuguaguuuauccuuaugugguccaauggcagcauaugugaauccucauggauauguacaugagacacugacuguguauaaagcguccaaccugaaucugauaggccggccuucuacagugcacagcugguuucccggguaauacagcuguuuacuuuucuuguugacucuucauuuaguuuuagaugaacuuucuaggaagauacaaaacaaacaggacaggaauaguuugaucacuucaugaauggguuaaaagcagggacaugagauguagaaaccaguaaauccugcuuucucuagcuugcuuuaaccuugcucucccuuuuacuuuggaaguggcagaagaauuagggauuagugacuuauuaucuuauuauccuugaacaaaauccucuuauuuggcaucauucuugaggacuguaaagcuaacauuaauaugcagaauccucuaccugagaaaaaugguacccugagagcagaagugccuugccugucuuccagggguucaugcucuccugcaucaccuucacgugcaucuccaacagaaauggagaagaaagcugugagguuaaagcuggagccaacagcaacauauagacacgugcaguaauaaauuauccaguuauaacaggguggcuuuguaaauuugaggugucagagaaaucucacgagaagccuaguacaaaggcuaaaaauagguuuuaacuuauaucuuuccuucauuuuauagguaugcauggaccauugcccagugcaagaucugugcaagccauauuggauggaaauuuacagccacaaaaaaagacaugucaccucaaaaauuuuggggcuuaacucgcucugcucuguuacccacaauuccagagacugaagaugaaauaaguccagacaaaguaauacuuuguuuauaagugcaccuguaggagugacuuccugacagauauuuccucaagucagaucugcccagucaucacugccucugauauauguguauaguggguuacagcauuugccuaccaaguucaagagcauauuuagggaaugagaaagcaguauaaaacauaaggcuggguuccaaaauacuugcuuuuuaguagcuuggugccauggauuauccuguugagucuaugucaugacaggauaggaaaacacaguugaaauaaugggaauggccauggaacaggauaggggcaccacugcucuaaaugaugaagcucuaaaugaugaaugcuccagaaacuggguugguaagcacaagauagaggcaaggcaguguaauuuuaaaaggacuuugcuccuuucaauuuuccuuagcuugucugagauacugaccuguacauuuugaacauauuaaagaguaacuaaguauucugagcagaaauagcagcauuugguguaguugcacuuuugauuugaugagccugugaugugcuagaucccuuuaacuaauguauauguccauuuugcauuuuauuugcaaauauaagugaacaguauauauuucuaggauuauaccauuuaggaaacagguuuacauaaacauaaauauccaaaucuauucuauuuggcugaauuaugucaaaguaaucaaguagaauacugaaaaguguaaguacguaauaaaaugcaacucaagaauaggcugcuccuuaaugucauuuuuucaaaaguucuacuuguguuucauucaagcugcugugauggaguggggaauuaugccuuuacugcugcaguauaaucugaugauccauggacuguuuaccauuacuuucagauaggacuguuuaaaggaaucuuacacaauauagcagcuuugaugucacuccaucugugcagaugacaacagcagaaacuccauaguuuaaaauccagguauuuacugaccugggugaaguagauuuugacacgcccuuuuauagcacaucaccuuauuugacuucaagaaaauucaaaauccaaaagcugcuguuuacuuguacaguacacagauaucuaugagcagcuaugcaguaaguaacuauguaagcuaucagaaagcuaagccauauccaucuaacuuguaaaauaaacaauguguucacuaucuguggcaccugauauaaaggcaagagucucagcacaagcccuccuguuauuccugcaacuuucugaaaucagaacaauccuguuauaaauagaugcuacuauggacucauucaggaaaccacuaagaaaacauaguuucucuucaacaguuacuacauuuuaagaucaacagcacugcuccacaagcauugggaaauucaggagguagacuugagcuuaguuuuucuaccuacacucaugcugguuuuggggucucaguaacacaggaggggagaacaccagccuuaccaagacuuccccuguuucauacagggcucaucuuuaggucuucuuuauguaacuuaguaguucaucuuuuuccauccgguaaccacuuuucuuccacuguucacgcaacugcuguagcagggccccaauuuccuucccugaagaaauacccacuuuccugaugucauguccacucacagggaacggcgggacagaccacugcugcaucucuuugagaagaccaugcucuccuugguacuucagcagcucacaaacacgggcaguugcaucugguucccuagacuaaaugacacaguuuuaucacauacuaaacacucacaauuucauucuacuauuuaaauacuuacaucaaaucuacagugugaaaaaguuacuuuucucuaguuagugagaacuauuuucugcucagaccuaauacauacuuacgucuaucacaaagucuugguaugguuucaaugguucugaacuaucuguugcuuuaaucaagucuuuccuguuuuuaacuauaaauaaacccagguuuuucuccucuuuugaaauuuucaaucucaaguccaauuuugugacaucaucuuguacuuugaauaaagaagccaaaagagucauugguuuuggugaaaagccuucaacauuuuuacugacuuuguuaaauucuucuaaauuugcauuagcagguaaaccuguaaacaaaagagaaaagucauuuuuuucuuaacuacaaaacccucacucaccucuuaaacuaugcagauuuuuaagaauguguaguguucuuucuccacugcuuauuaucagcccauucgucacucccuuaacuccuagaagaaaucuaucauguuccuguuuccuguagcagcaugucuugugaagcucaggagcugugaucauaucagguaccagcauaugccuucucagucaugauccugucugcacacauucccuacucagcaauuguauguucuuguaaaacagucaaaguuacugucuaaaauauacuggcuauaguuauuaauuuccuuucuauauauuaaguguuuugugaaagagcuuauuauacauuaacuuauugcuucauccuccucucuaugaaguagcuuuuauuuugaacccuuugugauuauaaaccaacccaaccugcaaaaccaguaagcuucaucaaauucagguguucucucugaacuauucuuuaccaauaaauaaacuauuuccaucuuuaaucccaaag

SEQ ID NO: 3270 - RNA, 107127 nt, Mus musculus
caugggucacaugacuccgggaacaacauggcugcgcccgcgcgagagccggcucuccgcugcugcaucagacuggcgcgagucuucuugcugcugguguuggcgugcgagguggcgggaagcgaugaggccgaggccagggaaggugcggcgucccuugcgggcucgugcggcugcggaacgccccagagggccggggcccauggcagcucggcggcggcgcagcgcuacucccgggaggcgaacgccccgggccugaccucaggcccgcgaccgcucgcgcucaccaaggugcgccuuccauuccuggggcgugugggugucguuggcuacggcaugaggccucgcugggccagaagaggggggauucggaacuccuggaaagggucgaaccacaucccaagucucucagcuacagaucucauuugacagauguccuccccccugccccccccccccccacugggagaugggcagggguuuguggcuguguuuaucacuaaaacuuaagagagcuuagcuugaagagugcuguccauucuuucuuaccucuucuugcccacuucccccuuccuccacuccgcccuccugcugcagagcuccaggaaaagucugauggauucggguuuaaguucuaguuuuaguaccuguggagccugagucuccaacacugccuuaaacucacugugcucgcagacuuguauuuauucuguagugcuuagcacuccgacugcaaagaaguauggagccgaguguacuuuauugcuuuuauuuaugucuuuguguagugcauagguguguuagauguuaguauguacggaugaaaacagugaauauagaaauggaccuucauucuacuugcuagcuuuagggaauucaccccaggcccucugaauaacacuuuucuuuuguacuccuauccagucuauccuuguuucccaggucucuuuucuuuccucuauguuaauuggcacuuaaguucaggaguuggugagggguaacaucuccugugggucuucccucccuuucaauauuuccauagauugacucagugguagguagcagugcgacaacuaaagaugcuugucuauaaauccccacagcauuuuuuggagggcaguugcccaguggccacuugucuauuuugcuuacugcagugcaguguuguuuuucuguuaccuacuugaugauggaaagaguuuuagaucugauuuauucucuauggauuugccccccuccucccaucccagugccuaaccuauuuuagacauucuguaauaucucuugagugauguuuguuuguuuauuuauuuauugguagcuacacuauugagaggcuauuuugggggugaagguuaucgggcacuuuucaaagaaagccuuuguaaauauauacuucuacuguguacccagagaauccugugcaguccaucgucuucugggucauaggugaggcaacugaagcuucaugagucaaacauuagugcuggaaauuuggaucguauuccaccuaugaggaaugucuguauacuguggcuggaccaaguuuuguguagcuauuauagcuguuggcauacagauuucuuuugccugagccuuuuguguuaaguucaaucaguagaaaguaggcaauggaaaaagagcccugcaaaauaauuuuauaugaguuuauuuuaguuuuaugcacaaaaaaaucauacaguagcaaauggaaucaggauagcuucaaaugagagggagagauuuauggauucucuauacuugggaagauugagacagcacaugauuguagacacagcuggauccagggcaccaggcagcauccccaggcccauuguuggcugucccuuagccaucuuacauuaguuuaggucuguuguauagaggacaucccaccuccuaaaccaguuggaagaggaagaauuccuucuuaguggcuccaggaaaaguucccagguaaacuuugagccauuguccuguucccaguugaauuauuguggucagaagaauuggccaucuggaauagauacaucaaacuaauaaguugucuuaugcuauuuaaacucacugagaaguuugcuugggggugauguuggcgcccccauguuagacccaagcauguuugucuucagaguguucuucaagaucccuuaucccagcauggaugaaacaguguauccuggaauacuggugggggauacuuucccacaagggagacuuagcuacuauuuauuucuugauacaaagggagaaacaaagccuguguugggaauggcuagugggaagucucacccaggagacuuucugccuuggacaguuuuuuguugaucaaaggcuucagcugauucuuugaugcuuugggcuucccuagacaguuucugcuggauacuguaucugaucugaugcucuaaaagccuguuauuuaccuaguaaacucacucacuggagacuggaaacauggcuguccugggucacugugcaugcugaacucaagccuuugucacaagacacguaguugagugauccauguaaaccuaguaguugcucacagugugguucugugauaauggaaugauuuuugucuacuuuauguuucaaucuuuuaaagguacaugguugguaaguguguguguaugguuuuauguuuauauacaugcuucuaugaaggucaaaagacaacuuuaaggaguuagaucucuuuauccgccuuuacauggacucugggcaucauguucagcuugccaggcuugugcaaucaguggccucacacucugagccaucucaccagccccuaugagucuguccugaguaguagcagcagcagaagaagaggguuugaauuccucguuagacacaggggagaguggauuauuggacacuggucuucccaugaagacacaauuaaaaugguguuuucauuugacccaggauccagaagaaugcaacaccuggauguaugcaaugccaccagaauggacuuuacccauuuguagcacagauaacuugauuggauaaguuacaauauaugaucuacuuagagcauucuagaguugguuuuaaucuauauucuucaggauggaaauuugacuuauucagccuaucucuguugguuaaucaaagagggaaaagaaacuagaucaggaguccacagggcaagcaaggugcgaugguguuagaauuguugguauuuaccuggagggauaagaguauaaagaauaacuaguaaucauagagaaguccgauggugcagugugagcgcacagcuuccuuugggcuguggauuugugcugaaggacaugaacuuuauugucuugaagaaacaccuuguugucuguagauuucauuuguuucuuuuuccuacuuucuuuaucuccuuuaugacuuuuuuggggggugauuacuuacagugcagcccaggcugccuuaaauucaugauacucaugcuuuccacgcgcugugauaucagcaccaaauacagcuuugaagacaacuuugaugggaucuuaagacucauuuuaagacuauuuuaauauuuauuauuuuaaauuauguguauauggagugcaagugcccaaaacaguguuguaugacauuauuccuagggagauauaaacaaacaucuaaucaccccugagagagaauugaugauagaccaaaguaaggauaccaccaaaauccagcuugggguuacuuacagcagcagaaauggcucugacacagcugcaucacaagaacacagcacaggaugcaauucacaaaaacugggaaccuggagcacacugcauacccugcaugcaguuucaacagguuggagagcauuggcuggugccugcuucuuccaagcuaguccagcuaaucugacagugucucugagcaguucuuacuacuuaaguaugcuaggaggagaggacucuugugaaucuggucacuugcagggacuuccgucagguauuuuuuauuucuuucugugcuuaaugagcauccccggaggaaggaaugcuucaucucucuuacagaacugcugcuucaccucucuguaagcauccugcauuuuaaggaguuuccuuccaagguggaagguuuuuuguuuuuuuguuuguuuggguuuuuuuuguuuguuuuguuuuguuuuguuuugcaagacgggguuuugucuguguagcccuagcugucuuggaacucacacuguagaccaagcuggccuuaaacucagaaaucugccugccucugccucccaagugcugggauuaaaggugugcacaaccacugcccagcucaaaauggaaggaagguuuuaaucuagccagacagugcuguucaacaggaggccagaagaggcuauuggaucuccugcaguugguauuacagguuguaagccacuugaugugggugcugggaacugaacucugguccucuaaaagcaugugcucuuaucuacagagccauguuuuuaguuccuauuuugaagcuauuauugaaacuucugugugaaaucuuaaguuuuucuacuucuuuucagagcuuguuuuuaaaaauuccacuuuuucccugaggacaauagaaucuguguccaggguauuauagaauauuaagaauaauggguacauccaguuuaguuccugcgccaaggcuauuacaggguucacugugacacaggcauguagcucauggcugagauggucucacaaauggaguggacuuuuggucguuuuacuuaugaauaauucuaauaguaacuuaaccuucauauucauggacuuacacauucagugaagauaauuugcacuuugacuauggaucuugugccaugugguaugcuggagguuuugaaaugaaaaguuuguuuugggcucauaaggcaccuaagauacuguaaggagaaacuguaacugaagaggcagugaagguaguucaguuggcagagugcuugcccagcacgcaugagcaugggccacaauuugaucccuauugcucauauauaaaggugggaguggugacauguguuuuaauuccaguacuagggagaaagcgauaggaagacaccugaggccaggcuagccuaaccggucagcuccagacuaaagagagaugcugccuuaauggaacugcaucgagaucuggaagaugauacccgaaguacacacacacacacacacacacacacacacacacauauacacaggccaccccccccaacacaagccacacacacacacacacacacacauauauauauacacaggccacacacacacacauacauacauacacacacauauacacagacaugcaaauacauaaguaaagcaugaagaaaguauaagauacuuugugaguuuguggggggcgggcagagaggcagagaggaagaggagagaggagagaagagagaagagauacucaccagaggaaacaaagugagauacaccaacauagcuaaggaaaggauguauggcaggaaaggccacagaagggauggucccugaacaaggacauaauucccaaagagacaacaucacuuagggaacuuauacagccaaguucaaguaugagguggugauagauucucaugugagguggugauagauucucaugugagguggugauagauucugauguuuagauaacugcaugccaaaauaugauagacauuccuguauaauuuuauuuuuuuaaaaaaagauuuauuuauuuuaugcacaugaguacacuguaguugucuucagacacaccagaaaagggcaucagaucccauuacagaugguugugagcuaccaugugguugcugggaauugaacucaggaccucuggaaaaacagucagugcucuuaacugaugagccaucucuccaacucccuguauaauuuuaaauagggaaguagaauugaucagguucacacuucgauuuguugacuggcgaguuuguuuauguauuuacuuugagacaagguaucacuggcacuggcugcccugaaacuugcuagguagaccugacugcucuugaauuuauagagauuuacuccccccuaccuccccagugcugggauuaaagccgugaacuaucgugcuuggcucuucuguauuuuuugaaguagauguuacauuuacaugguugguucuaaaguuuaacaaaguggguguggagugagaaaaaugauugcucacuuacacuacucacccccaagcagaggcaaaggaaacucaaagucuguggucccccugucaccuuuacuuaacuucuucuccucgcacacacugggaccaucacauccucugugugcacccugccuuccuucugucauucugucaugguaagacugccccaugccaucuuauuaaaagguuccucuuuucuuucuuaugucugcuuugcuuucuguuucugcaugaccuaccauuugcuucaacaauccacuacugaugcuuuaguuuguuuccuaucuuucuccgagacagaucuguggugcuguguuggauacagaauauggacauuuucaggauucugggaccuaaaugccugagaagugaauggcugggaggaguaaaugggugucaggaauggggagaggugaaugggugaaacuggagccagggagaccaugaguaaggauaccugagaguggagaagagggagguccaaggaagagauggaugggggagaaccgguguggcuaggagaccuauggauacugggauuugggguugagggaguuagggucucuucuuggaacaggacugauacauuggacaaauauauaugaugcaaaucaguugaaaauaacauuguugagaaggcucagugguuaagaccacuaucugcuguugcagaggacccagguucaauuccaggcagccacauggcugcuaacgacccagcuccagaagaucugauacccuccuuuggccuugacacugcaugcgugcacauacauacaggcaaaacacuauuggaaaaaaaccaauaucauuaugacuggaaaauacagucacaugauugaaguaaccucuggcaaagugacucuguagaaauggaagauaggacacguaguucuggauuuccaacuucuguuucuguguguucugacuuuucuaugcuuguggcagccccucccuuuccccagcuaauuaucucuuugauuuucuuuucucuuucuuugguuggaacucuuguuucuaggucagaggcuugacaguucacaaaaucugagagcccugcaaacugacuuuuuuccccucaugauuuuaaaccuauacuuuauaucuauaguguucucacagauaguugaaagccuauuguacuggcuaguuuugugucaacuugacacagcuggaguuaucacagagaaaggagcuucaguugaggaaaugccuccaugagauccaacuguaaggcauuuucuuaauuagugaucaagggggaaaggccccuuguggguggugccaucucugggcugguaaucuuggguucuauaaaagagcaggcugagcaagccaggggaggcaagccaguaaagaacaucccuccauggccucugcaucaucuccugcucccugaccugcuugaguuccaguccugacuuccuuggugaugaacagcaguauggaaguguaagcugaauaaacccuuuccuccccaacuugcugcuuggucaugauguuugugccggaauagaaacccugacuaagacaccuauuuuuaauaaagauauaauucauauaucauaaaauuaacccuuuugaauuuuauugaaguauauaacucagugauuuuagucuuuagugaaaucaaaacuuauugcuaucuuauuccagaauauuucagugucucucaaagauacagcauuuccauuaagcagcgauuucccguuccugauaccucauagccucuggcuacuacagaccuacuuuuuuuuucauuaauuuuuuaguuauucacuuuacaucccaauugaagcccccuguucuccaaguucucucuuuauacaccuccuuccucuuuauacaccucugagaagggagaggccccucuggauacccacucuggcacaucaggucacugcaggacuagguacaucgucucccacugaggccagacaagacgacucaguuaggggaaucggauccacagacaggcagcagaguuggggacagccccuguuccagauguuuggggaccugcaugaagaccaaccugcacauguccuauauauguugggaugggggagcuagguccagcccaugcuugcucuuuaguuggugauucagucucugggagcccccaagaguccagguuaguugacgcuguugcagaccuacauucugaguccuugcguuguccuguuuugaguauuuuauuauuuuaaaacuuuuauguguguguguugugcaugucuguguauucauguuugcaucuguucgagugcauguucauguuguuugucagaggaccacguugagcaucauccucaguugcucuucuaccuuguucauuggugcagaguagccuagucaaagccaaggucucugguaugucuagucuuaguagcaggccuucucugaggacggccccgucuuuccaccuccugggccuggaauagcaagcaggugggcugcccuguucaccacugguuguaacucuggcuccagggcauccagcacccucgguccucacaggugucccacccaugagcuuacaugcacaggaaccaugacacagacacccacacguacauuaaaaaaaaaaaaaagauaaaaucuuuaaguaggaaagaguacaguuuucccuuaccuccuuaguucacuauugcaguuuuuccagaccuguguccuuuauauguccagaucuguugugagguucaacuagaaagaucauuucccagaaggauuuucccuucuuucucugacuugugauucacugucauuaacauguggagugauuuugcaaguguguguguguggugguuuguauguguggguacacagaaauaaaugcauaagugggggccugagguugacauuagcucucuuucucaguugcuucuccauuuuguuauuuuauuucugaggagcaucuaucacugaaccuugagaucauugauucagucagacuugcuggcuauugagcccuuggaauccuccugccucugacccugcauccccaccacuacugggguuacagaucugagccaccauacaugccuuuuauggcugcuaaggauccauacucgggucccugugaccgugcagcaagcacuuuccugguggaucaucucccacgaccuugaucuuguuaguuuugcaaaaauuucuguggugggggguuuuaagcagugggcgcuugauaagcgcugagagcuuugcggcccacacagaugcacuuugcuuuugaugcgugaugccccauguuugcccuuucauugcagaugguccccauuccugcuggaguauucacaaugggcacugaugauccucagaucaggcaggauggagaagccccugccaggagagucacuguugauggcuuuuacauggacgccuaugaagucagcaaugcggauuuugagaaguuugugaacucgacuggcuauuugacagagguaugggcuugcggaugggagggaaaacuggcuguuuucuagaacacucaagaagguuuaauagcuagaaacacugaacacuuugugcccagcacugugaugggcacuuuuuuucuuuucuuuaaucuaacuucucccagcagcuccgugauguaccaagcugugagucaacacugauacaaccuaaccauacuacuacucaaugauugcaagcagcguggaccacagcccugcucccaacccuccgugguacugugguaguuaguguuuuaauccaccugacagggcugcugcucacuaggcuuucugagaacacagauggcaggacauucuccucagcaccucagauugccugucccauaggcguuacacacuucguaaaugugcagggcuccagugcagcaucucguccuguggcuuuaucccagugugugggugacucagcagccuuuuccaggggucaccggauccgugcaaggggguugauuuucuaguugaugauuguuucugugagaaucucaaauguucuugguuccuaaauccuguccccuuuuaucuugaaaacuuuacccuuuuauucaguuuguggggacccaacuuaaaaaaauuguccccuaacaccuccucuuuuauauuuaaaaaauucauuugagagugaaugucaaagguaaaccagcauuuggguucaguucugcaccgccucauuucuuuggaauuuccuaaaauauaccaagugguuguaaauuuugguuguagauauuuguaguaagcuaaagucucuauucuuuuuguuucauauucuuaaaucaauuuauaaucuaacuuaaagagagaggaguaaggggagagguagggagagagagacagagaguggcagagagagagagagggagaauaggugaccauagaggccaggcgagguguuggaucucauggaguuagagguccugguaguuucggacugcuggaauuccacucuauuuugugaaagagucucuguuugaaccugaagaaugcacuuguggcuagacugacagaccagugggccagaaucuaccuagcucugccucccaagccucuagcacugggaucauagauguguguagccauacuuggcucuugcuuggucagagaagauccugauaguucaugcuuuaaccacuaagccauaucuccagcccuagaggaguuguaagaaaggaaggcuuuacagagcauaguucuucuggacgacuagccagcaggggagaauggaaagucucugagaaugagcaugggaaccacgcuauccauagagaaggaugagugacuaaguggcuuugguugcuaggcaucaugguaucacuaggaacacacagauacuaucaggggugaagaaaacuuaucucuggucaguaagaacagucuggaagcucugaccugauguauaggggucaggacucaguuaacuuuaucuggugaggauagguuuggaaggggacacuggggacauuccaaguacuggucuugguugacgugaagagacgggggagcucugugcauuucuuuugagcuuguugugguagaaccacuacauuuaacagaggcaguuugcucuggccuccuuccagcuccacaauuagaaucucugggguuggugagcagcaguuuaagucuuagcaagcugcugugugagcucaacuggauaaccuagggaguugcuggccuaguguaagaaguacacacaggccaggcagugguggugcaggccuuuaaucccagcacucaggaggcagaggcagguggguuucugaguucgaggccagccuggucuacagagugaguuccaggacagccagggcucuguccuggaaacccucucuugaacucgcaccucccccccccaaaaaaaagaaguacacacaggccugugcagagcucugaggagcccaggaaggcagcccucauguuacauggauuuggaagaacaguggacuauguaggaggaaaacugaacaguagagucacaggaaguaagggacaagggaucccacuuucagagcagauaucaaugaauguuugugauaccacuguuaagaacuguuuaaaauauaaauuuccaccugacgcuuagauuggcccaugacaacuguaaacacauagagcguaucagagaaccagccaucagugccguuuaauucuuuuaggcagaucccaggagcagggcagagaacaaacagcuuacuuguguaguauuacaucuacuaaauaaagucauuucucagaguuauuuacaauauugggagaaauauguuuccuuccaugggucguucaucuucuuagaaucuaaucuugugcagccggcagucuuaucagcuaaucuggucucacaugaaaacagucucuugagguacaugaaccuucuuuaagaggaacuuagauacuuucaagacauuuugggaaaacucgcauuuacuuggauaggaagaaucaccauaguagcauugugaagaaaauggcacccuggaugcccugacucuaacauuuucuggcuuuuucuuuuuuacucuccuuauaggcugagaaguuuggagacucuuucgucuuugaaggcauguugagcgagcaagugaaaacgcauauccaccaggcaguaagugauguuuaaauaagcucucaucagaaacauaaguacuaccuuccucucccgacuggugccuagccauucucccacucucugagucacagguccaugggccaggguaccuucucuggcugaaaauguacaggcccaggaagauguuuaguuucugccugucccuuagagcgagcgacacugcacugcagaguagaauucagcccuguacuuuguguuuuacuugcagccauuuuuagaauggaggauaaaugagagcuacagacuucuguuuucaaagucuugaucuuggcaggggcugguguggaccuagaguuucauaaguauucaugaauuccucugugcaaacucaaguccguggaaggaauaccuuugcuguggcuguucauagcagaugggggcugggaacuaacuaguccuuagaggaagggccaugccaucauguacagagcauacaggggugugaauuaagucuguuuuucucagacaucgaggccauugacuaggcucuguaaguaccgugugucagaaagaacuugggauucuuuggucaggcaauuuagcaggucuguaaauaauaucugcuuguguauaucucauggauauguaaaaacaagagaaaacgagguuagcugcgauauugagaguucucacagugggcagagacugaagagcaggagacagagagugggccuugagggccugccaauucaaagaggacagacauggagggugaagauaaagaaauccuaccuuaaucuuccucuuuuaugcaaguuaccuuuaaauaauuuaugccugggggcuggagagauagcucagugguuaugagcacuggcugcucuugcagaggacuuguguucuguucauacugacaugcaggcucacagccaucuauuaaccuuaguucugggggauaugaugcccucuucuggcccccacaggcacugcaagcuuguggugcacagaguuacaggcaggcaccacccccccaacccccucuccccaauaaaaaucauaaaauaacaaaaaguccugccugagcuucagccugaaguguuggcuucacuguguccuguccugggaguagcggcaucaggaaaugagccccuuugggcucaugcuuucucuuuguguuccaauuauuguagcccagguugggguagggggagacggaguaauuaggacguggucucaaaugguauucuggcgagucaggccaauuuccuugcuuguuuuaguaaauguuuaaaugauaagauugaacucuuuuuggauuccaguuuuccagucaauauugucucuuauauaagcuggcagcccuaccuccacuggcuuuuuuuuuuuuuuuuacaagcaucuguguucaacuuaggguaguggugauggcccagcaagcaucgagagggguggcuccuguuuuaagauacgggguucagaugaggaagcccgugugcuccuguuucugcgauuuggcuuucugauggaagaccucaugucucuuaggaaccacuaacaugucaggcaugaaggcagagguggagcauugaaggcuccagagguguccugagucagagugaaggugugugugcuguagcuaggaugaggacaagcgccucucaccuggcugcaggguuggucgcaugcuuaaaugcuuauaauggaaaagcaaaccuuuuaagguuguuuugaaaagguugaguaaguaaagaagucuguugaucugggaggaccuuuugucauuucccuguuggccugacuugccucuacucaucagcaccuuuguaacuucacauuucuauaagguuggauguaagauguccaugagaugacguuaggucgccuuuaagaauggaugagacagggcuggugagauggcucaguggguaagagcacccgacugcucuuccgaagguccgaaguucaaaucccagcaaccacaugguggcucacaaccaucuguaaugagaucuaacucccucuucuggagugucugaagacagcuacaguguacuuauauauaauaaaaauaaauaaaucuuuaaaaaaaaaaaaaagaauggaugagacagagggagagccccaggaguuacaguaaccucccccucucaugcaucuuuaggccuuaagccaaaagaaaggcuccuuugaguucugccaugucccuaacauuucacacuaguuuguuuugagcauaaaaaaagagguguaggaaucuugcugaagcuguaguaccugauaaaaauaauguaguaauuguguuuaugugguuauuuucagaguuauauucuguuuauacugguuuacacuaguaauaugaacugucauuuuuuuugguguuuaauaaaacacaaauauagaaagucaccugauuuaaauguguuaccuaggacauuauccugagguggagcacacuugucccugaaaccuagaucaggaaccugauuugcugccugccccagcagcccucucccacccaaguggguucuuccuuaugcucauuauaguguugucaccuagggcuagaccuuaaguagacucaugcccuucaaagagauuuugcuugaaagcauugcuaguaugcuucccaucgcacccccuuuuaucuuuucauuaauuuuacccuccaaagagcacagagccagcuuguagacuuucucaguauggauuuugcugauugauggcuucaguacaguucaccuguugccuguguucccugcagaugguagcugugcucuaaagugugaucaaauucacgguguaccugugucaugaauaucacagugauggccuccccuagcaccgugguucucaaccugugggucuugaucccacagggcagcauaucauauauccugcauaucagauauuuacacuacaauucaaaacaguagcaacauuacaguuauaaaguagcaacugagugauuuuaugguuggggguuaccaugacaugaggaaguguguuaaagugucgcagcuuuaggaagguugaaagccacugcguuagcaggaagcagcuaaugucuaucucgucaucuuuuuuuuuucauaucagcugaugcuaugcugaguggcucugucuaugaauuuacugggauuguagaugaugagagccuagauuuuuuuuuuuuaguuuauugauggauacuuuaauaaagugauaguuccucccacugcuguuuucuuaacauugcuacagguuacacagaacgacagguaaaugugugauuguuuacuagcuuuaaggaaaugaauuaguggccgagaaaaauggcuaagugguuaagaacacugccugcuuuucuagaggacccagguucaauucucaguuccuacauguguguuaacaaccauccuaaguccaguccaaggggaucugauacucucuucuggucucuguugagcaugugcacagacauauauggaggcaacauacccauacacauaaaauaaaacauagaaagaagugaaucaaagguggcuagaucuacuucucacauacuacuagguaggugugugauuaaauggaaacuccuuuguguguguguauguguguguguguguguguguguguguaugugugugcgugagugagagagagagagagagagagagagagcagagguagagaguuagauggagagauagacagacagagacagauggagcgagacacuaggcuggaacugagagccuccugaaugcuagguaagcauccuaccacugaucuguaucaccuagccaugaacuugaaaaggcuuccuguguucaaaagcagugacguguggccuucagaaaagaucaugauuccaaggaauccauaacauguuuaaauccaugaauuucuauuaaaacaaaacauucuauuuuauucauuuuuauuuuauuuuacugauuuuguuuuccuuucaagguguguguuuucaugccuauccuauguaaauuaauuuuauuucagucuuuaccuuucuuacuuuuuauaagauucaacuauacguuguguucaaaccuaccauauucaguguugcaauuuucuaguuccuguugcccugguguaggaauaaaaagaaagaaauaguauuuuuuuuuaacuuagaaauuuuauuucuuauuuggacauauuagcacacauuugugaucucugcaauuaggaaacugaggcaggaguauuggaucagugcuaauuuuggcuacauaauaaguucaagacuauccuugguugcauaaaaauccaccuuaaacaaacaaauaaauaaacagaaaacaaccccaaacaaaaucuuuaaagauaguaauauuuucuagggaguuguaagaaagggcguguccuuacugaguuuccugugguaaaauuaucuaguuuaacuuuuucaguucacagcuagaaauggcugugauacaaccuccgucucuucaucugcggucaugguuuuauguguauucguuugugcauauguggauuuaguucucuauaacuuugaugcaaccauagauauauguaaccuaccguuuuuucaaaaaaaaaucuuuaagaguuuauggauuuaaaccugcuacagauuucauucacuuagagccaugaucuguuuugaaagccacacguugcuauuuuugagcacagauugaugucuuuugaaguucuuguagguccuguuauguucccuccuccugcuuuaaacaguugcauugagauguaguuuguacaauucaccuuuuuaaguguacaauucaguguugguuugguauauuuuuagaguuguguaaccaucccuacaggcuaauuuuaaguuguuuucaugagcccauaaaggaacuuuguucuuauuuguaagucacucgucacccuuguucuagguccuuuuuaacugagccuaggaguucuuuguggcuucuuugguuuuucugaugguaguaucuguccugacugcagacuaguguuaucuuuugcuguaagaagccuugguuucugcgauaguuucuuuuuuauggcugugauagaauguccaaacaaaaagcaagucggggacugggggagacuuuauuuuguccuaaaguuucagagggaagaguccacuauggcauggugacaggagcaggaaacuggcuuaucacacuguauccgcacacagggagcagagagagaguaagugggaccaggcuaauaaccuccaagucugcccucugaugcacuuccuccagcaagccuccacccugugaagguucaauaaccucccaaguagcacucccagcuggggaccacguguucagacccacgaggcuggaagaaugcucucuguucaaaucacaacugcaucuugaggcaggaggguuucugggucucucuacagggcauguuagugccucugcagugccucuucugugagcagagcuuagagaagauacgccagaguuucaaguugauacuuccauuucuggacuuuuaacuuagccuguucucuauuccaucccuuccuuuauuucuacuccaagaaucccguuucuuagggcaggcagaggugaacagccugcugcuacucaggaugucauccaagaucacagacgucagugccaacaucagcucugauaauuacugagauagaaagguuaaagaaaacucacauucucagugugcuuucuucuccccaagcucugaaauagucagacuacuuuucauccuccuccuccuccucgccaaggccacugcauagagugaggucugcuuuuuaacuccuuagagugaguucuaaaaguaaguuuguauucugcgucuuccuguugaugaggcucagucucuguugggguuuccaggaaguggccauaggaacauggcuccuucauuucugccuguccguagcacagcagagcucacuuucuaauuuucaggucagguuugcuggggaggaaauauuugguuuacauuucuuuguuuguuuguugguuuuugacugcuauguacuuuauuugguuuucuuuuggaauaaaguggaccuguugaaagucauaauuuuuuauuuccuugaaaguugcuuauuguuuuugccugagugcucaaguguuguguuugcaguguaugucuugguuaugggcgggggcaggauucucagacacagguucacuuuuucaaucucuauuuucaguguugugguucaaauuuacgaacauuuuuguugucuuucuaccaauuuuuucauuuauuuacuuuacaucuugaucucagaccccuucucuuuucaguggcccucauacaacacuucuccccaucccuucaucucugagaaggaugaggucuucucugguuaccaacccacacugacaccucaagccacugcuagacuagguauauccucucccaaugaggccagacaagacagcugaguuagggggacaagauccauagauaggccacagagucggagacagcccuugcuucuugggggacccacaugaagaccaagcuguguuccuccuguguaaauggggguagggguguggcuaggugcagcccuuguauguuguuugguugaugguucagucuuugggaacccccaauggucagguuaguugacucuguugaucuucuuguagaguucguauccuucugggucccucaguccuuuccucaacuuuuccauaauacuuucugagcuuugucaaauguugggcugugggucucugcaucuguuucagucaguugcuggguggagcuucuaaggggacauuuaugcuaggcuccugucugcaaacauaacagaguaucacuagucgugucagggauugguucuuguccaugggauggauuuuaaguagggccauuuccucagucucuacaacaucuuugucucugcacuucuugaaggcaggacaaauuuuguuucaaagguuuuagggcaaauuuguacaaccacucugaaaaucaguuuugugguuucucagaaaauugggaauaguucucccucacaacccagcuauacuccucauagguaaauacccaaaagaugcuccacaguacccugaggacacugacuccacuauguucauagcagcucuauuuauaacagccagaaacugaaacaacccagaugucccucacccgaagggauugagaagaaaaugugguugauuuacacaauagaauacuacucagcuguuaaaacaaagacaucaugaaguuuguggacaaauggauggaacuagaaacuaucauccugcgugagguaaucuagauccaaaaggacaugugugguguguacucacuaauacguggauauuaaccauaaaguacagaauaccuaggauauaauccacagauucaaagaagcuaaauaacaaggaaggcccaagggaacaugcuugaauuucacucagaaugggaaauaaauugucauuggauggagggaggaagggaacuggaugggagaggaagaggaggggaacuggugggggugagauauagggagagcagggguggaaugcagggcuggggacuuuagauaaaaaucggcuuggggaagcaccaucucuaggaaguacuagacacuugggauggggguaguuccagggagucugugagggugacucuagcugaggcuccuuguagugggggacauggagccuuaaguggccaccuucuguagcuaggcagggcuuccagugaagggauaaggacaucaacucacaaaacacuccacccaaaauuuuucguugcuuuuacuguguguguguguguguguguguuuugugccuuuacugcccucuuggagccuuuaauuuguaaacuuuuguggguggaggucaaaccuagagucuuauacaugauaagcaaacacuauaucacagaggucuacguucuauguguauuacuuguuccuugaauuaccccugucuuucuuuucccuuaaguuaaaaauuguauucauuuugucucuugaguuucugaaauaaaaguaauauugauaaaaugauuuuuuccuuuaauuuccacuucuuuauugacuuuggcacauauguguauuuuuugagaacacuuuugccuauaauuuuaugacuacuucauuuugcaacagcauguuguggguguguacacgugugcauguguguauguguguggcacacuauuauucuccauuauuaucccauguuuagaugugguuguaccagaagguuaguuucaauaugguaauguggagaagugguagaguuuaaguagacuauugagacgcacuuucacuuucaauaugaggagguaauuaggucacuggggagacagccuaccgacgggauugaugaccuuauaagccuuguuauaaaagggcaagccugggcuggagagacggcccacucaguaagcugcuugucugagaacaugaagaugugaauuugauccccagaucccaugugaaaaagcuggcuucaguaguucaugacuauaacuuuagaacuugggagacaggcagcaggauucuuggugcuuggccugccugucuaacuuggugagcuccaggccacuuagaaauucuaucugaagaaagacauuaagcgaauggggaagacaccugaccucuggccucuagaacuacauccaugaauggaaucauuagcuauggacucauccucuuuuuuuuccccucauuugugaugauagggaaugagcuuuuuauaugguagacacugaacugcacucccaacccaaacuaguuuucuuuaaacauuacccagcagcucauauuuuguuguaacaccgggaaaacaacgggcgccaucucuguugcucacuaugaacguuuggugaguuuuagaaggaggugugucuagagcagcuuuguagcucugcucagauccuuccugcccugucucccuccuguuacucugcuuuggugaggugguuucugguugguuugagauucugugcuggaagggaaccauggugggucagugucaagaguuugugggacaagaguccuggaaagucggcgugugaaagaguaauucauuggacccuugcuggugagggaacugaucuuaggagcagcucagguagaggggcugcugugaccaccugcugugacuacccaccaucauuucuguggucagguauuagcgagcuuccucugggagguccguggacaccauccuucucgcuuguuccagggcuccuugugugguaggaguucucuggcuucuuguaucuucugugcugcuugucuuuguugucaugcgggcuccuguaggcauuucauaaauguuuaccuuacuaggguucaucccagaagguggggcgaaugcaccagaggguuauuuguuuguuuuuguuuugagauaggcucucucuguguagcucugccugucuggaacucacucuguaggccaggcuggcuucaaacucagagacgcaccuggcucggccuuccaaaugcugggauuaaaaguguacacccuccugccccacuuugcauuguguuauuuacuccugugucucuaguacagugacggucacucaguaggugguuauuauguaucuggcagaaugaaagcuuaucauucagguguuggauuagaacauuuaguucuuggaagggcagagcucagaccugguaugaccuguuuaucucucaggcugcaaagacagcucuucuuugguuugagaugcugguuuggugauccggguugaggcggguucagagcuccagaguuauuuggaaagggaagucuagggcuagaugacuggauaagauaaaguacuucugucauuugugcuggauugaaaagaguaguuguuugcuugacucaggagucaguguguggcaugagcucaggaagacaacugugauaacccuggaaggggagagcgcagugucauaggauagcaguugcuuuccuccaaccuggcuaaggcuccugauaggaugggggugcaggagguaagugggcgagcacagagccuguguacagugcacuugcauuuauuuucaaggccuaggucuuuuaaggcucaacguggaucaaggaaaagaaugaguauaaccucagucccccaauggaauguuggucuuuauaucauacacucccuuauagaaacaagguagauuacagacuaaaaauucauaugugucaggugaaugccuuuaaucccagcacuugggaggcagagguagguggaucucugaguuccaggagagccagugcuacacggagaaacccuaucucaagagacaaccccuucaaaaaaaaaaaaaaaggaaauaagaaagaaauguguauauguaaauaagaauuuacagugggccgcuccacaucuguaaccccagcauucaggaggcagaggcaggaucacagguugaaagccagccugagcuauauagcagugcccuauuuaaaaaaaauaauggguagaggauauagcucagugguagugcacauauaucuuuggauuagaucucaggacugugaaagagcaaacucaagaacagagugggagagaugauguuucaguggaugggauuuucaaacucuccuccaagcaaucuuuucuguauaugcuuauuuuucagggucaauguuugaaggcagagcucucuacacacaccauauacacacucuauuguggagaugcacagcccucuguagcugggcuuugcuacuuuguggggucuucuuuuuccuacccuuuaucguucuggguuuacccaugucacuagauagaagagaaagcagggguugggggggaguggauugagggaggaaggaaggaaggggaggggagagagagagagagagagagagagagagagagagagagagaucugaaucugaugucuuuucuuguuucuucuuugaccauaacuacuaacaaaccgcaaccaacccccugaaugaucaacaacuaccuaccccacuuaucggggcccuagcauuuucguaucccccgaaaaguucccagaauucuaaacaucauacaaucacagaaacuaucaucagcuggcugaagguuuuaaagaaaccaaaauuccagaauucucacugcagcccuccauguggagguaauuucuguguuguagucauaguuacucuucugcuauugugcuaagacacugugacugaugcuacuuauaaaagauagaguuuauuggggccuauaguuucacaggauggguucaugaucaucgugauagggagcagggcagcaggauggcaaauggaguuggcuuuugaaaccucaaagcccucuuccuucuccaaguuccucccuccaggccacaccuccucaucuuuucuaaguaguuccacaaaccagggaccaaaccuucaaguauauguacccaggaggucguccucauucacagcacgacagcuggccuguauaagugguuccgucaacuugcuggcugugcaugggaugcagacuuuucaugaguacugucacguuguuuaaagaugggacaugcucucaccuauuugcacauccuguuaaaguuuuuuuuuuuuuuuuagauacuuuuuuuucuuacuccuuuuaagcagucacccaaaucaguaccauucccugugucucucuccaucucaacuggaaaugaguaaaaucaguccagugucagcuacugucggcugcacgaauuccuugagcuguucuuacagggugccugcaaugcuccacccugccaggguuucuauucuuccugugaagaccugaagugugaugggugcuaauugugaguauaacguuccaguaugggggguuucaguaagagcugaaacaaacauuuguugguuucacccuauauuucauaaauauuugugaaaucuguuugaaaaggcauguauuguucucuuaagugcagucugugaagucaucaagguccugacuuaggauuaaucagaggucaugcaucugaccuaccuaccuucccauugugaugauggcuuuguuuccgcccuuuauuagagccucguucugauguucaguguggguacagguugcugaagccagagacauuucagucacuacaaucucccuucuauuugauucuuccaguuguuagauucuccuuugguuauuuauacuuuguggaucugaguagaucugaaagugcucauuguucacuggugccagcugagaaauucuccuugucuguuuuuguaaggauagcugucauguuuacacugcaucucaagaaacuucugucuuuuuaaucugcucacuuaauugcauucaguuuuugaggaagcaguuguaaaauugugaaccugacaucuuuagacuuaaauaugcauaauuacacaguauuuugucuuccauguggauguuauucugggcugugugugcauaagaagugucacuucccaccuuugguaggaauagagcaacuuuugcuaucucuuauuuuuucccccuuuucaaguucuuaccagaguucuggcugugucuuaugagaaagguggaaaccaugucuuugcucucugaagucuauaucucaagcggguaugagacucacagcaguucuguuuacauugccauuggucacuggcaggcuggcacagcuguuucgacuuaaacccaaggcaguugcuauggaaauggcugaguagaaauaggucauguuuaaaguccuuucccucaaguaaaaagcaguguuauaacuucagguugucuugguugagcagcaaauguguaggugggcaacugcauccaacacuuucuuguuuuaggagaugugauuuuuauguuuuuaugccagccuguccaacacugcagcuucuacucaguaaacaaaacacccaguaaagaccaguggcagggguagggucauuugcaguaugauucuggauaacucucuaaguguuuuuguucauaaaaguugcuuuauuucauaaaaauuccuauguaugguagaauagcuuuauuuuuaagacagagcuagaaguucaaggaaaaguuugaaaaacauuaaauuaauaacccugacauuugggaaugcagacugggccugcugguuaagagcacugguuuguuuuccacaggacccagguucaauucccagcacgcacauguaagcuuacaacuaucuguaacaccagccucagggaucugauguccuccucuggccuccacaggcaccagacacacguguggugcacagacuauaaaaaaucuuaaaaaaacaacugccauuugcaagaagaagguaucuggggacacuggguggaguacgccaugaauuuagucagaaaguauucugacugguccagagcaaguuggccaggaugaacaaggccauccaugccugaucuuaucacagguauuauggagugacuuuaauuucuugugucguuuggggacuuugugcaucugaccaucacagugcugaccacagucagucucacacaccgcaugucacugcuguccuuaugugugcuguggcauugucuaauugggagggcaucuuccugcucaccuccuucauagugcaucuugcuguggaggaacaggcugccuuauguguagaagguucucgaugcaagacugugaugaaagacugucauuauguauucuuuagaauauucugauaggauaccugcuguuccuugacuuuguaccccucgggcacuucccacagggaaguccauauuguggaagggugaucugaugggugggugaggcacagacugacugaagagcuauugaugguggguuuuacuaauuggaauaugugcucuaugaaagcuuacugcaauuuuguaacauacaguaacaugaauaaaugauaagaagacuggcaacucacauggguuauucggacuccuuauccaaaugcuuuguauguauuuuuuuauauuuguauauuuguauguuauuuuguuauauaauccuuaugacaacccuaggaaacacagcgauuuugaaaaaaagccuuuguauugauuuuuugggugaguuucacgucaugcaccccuaucccucucaccucccagccccucuguaccugcccucugcccuugcaaccucccugucaaagaaaacaaaaauuagaaauuaaaaguugaaaaacaaacaaaaauaugcccuccccccccccccgccccaaucucacuguggaagcugugguaugucauggugugccacacaauacacccuuuugcccacacagcuuuacuuguacauggucacugcgaugagucauuggucugguucaaggccucugcagcaccaucaguacuggauccucaccuagacucaucuuggauauccuguugcccugugucauggugacccugcaccuuugcuucuguaggacugucccuuucacacacucuaacagcucauagaugggauagauguugggguggacaacucaaagccccggauuugggccuaugugguagcuaaguuggucagccugccagcucucuagcaccuaagccaaccggaccagcuuucucagacugcccagguaaguggcuagacagcuggagagggguaaacauggggaauuuuuuauguccacauaaaaacuuauguaaacuggggccuggagaauauagagaguccgagaucuuaugucuuguagcaugucaggugcuucuauuguggugccaaugugaaguauguguuaacauaugacuaaugguuuuccugguugucacuauagcagacaauuugcucuuuggaggaacacguggccaugucuagauucauuuguuguaugccacaguugggcuaaaacuggggucuuguggguagagguuagaagugcugcuucacauucuaccuuaggccucucaggaggcccuaaccaagacagaauuauauggccuggagaagguccagagugcugaggcuggugaaaccuguuuugggaugcaugcucauuugauucuugguccuucacccuuguuaagugcauguauauucucagggauuuuuuuaaaauuaucucuagcuauacuaacauacauuauuaggcaaauauuuuauggaaacaaaauuagaccuacacucuauagguuaccuuuauaaccguacaugauaaauuuccauguuaaaguaaguuuugcuaacuaccuauaggacaacagaguaauuuuguaauuuuuauuuagaaggucuuguagucugcacguauccuuguauuucuugcuuguguucuauauagucuacauaugccuuugcauucagaucuugcuguuuuuaacuaaagagucuguuuucuuuggucccuguguccccuccuguguaaugaguucuuuuguuucucuguagacaucagcgaaacugaucauugcguagcuccuuuaccuuaaaauuugucaacaguuguauguuuuggguggugugcaagaguugaugugacauugcagacaggaaaaaagugagaagcagagaaggagagggaagcgaugucagggcccuuggccugauguguaaggaggggucuggguacaaggguacauuuugguuuuacaaagguacaaccuguccauaugccaucuuaaacugcacucugguaauuucugguacauagcagcccaacaccaucccuggccugaggcauuuucuucugcauuagggaccuccaccugguaaagccagaucuggauuacgcugcagaaagaguuucaggaugagccgaaguacaguggagauagugagcucauugaguaugucgacaguaagucaccuggggaaaggacagugcacaguaccaagacaugggugcaggguguuggacaguccugcaggacucugcucuggcuguguaugguccuguggcuuucuaaguuacauuccacaacagaaguuauuuauagcaaaguuucaagaauaagcaagacuuaaaauugaagcaaaaaauguaugaauugguuuacuuauuuuucuuaaagauuuuucuuuuaaagcuguaagguaguuuuaccaguuuucgaugcagagaugagaaaggacugagagugugauaagacuaaauguuuugguguucuggcccaggcaagcagaguucauuuguagcuuuuagcuucuuuguuugccaucuuuagaacucccuagagggaguuuuggcaauaucaguuguggacuuuuuguuuguuuucugucuuugacucagcaagaaaggcaaaguagauuccaagacaagggcugcugcuuuccuuugucacaucuuuuuauuuuugccuguuguucuauccugccccagugggacuuggcgguugaauucagugaaaugcuggggacagugaaaggagcggugagccgcugcugcagcagcccuugggucuccucugcagagcucagcuuuguggguguucuccucugaaggcuugcggagcuggaggagcuuccuccuuuuuuuuucuuuagauauuuucuuuauuuacauuucaaauguuaucuacuuuccugguuucccuucugaaaaccuccucccccuaucccuuccccaucccgcugcucacgaacccacccauuugcacuuccuggcccuggcauuccccuauacuggggcauagagccuucacaggaccaaaggccucgcgucuggcauuuguugucuccucuaaagacuggcauauggauaacugaagucuuucacaauguagagugaguaggcauggacaucacccaaagcuacaagcucuuugaagaagauucagccugcuguuuauuacgguuccaaacuagaaaugucuaaaugcgcauuagugggcagaauggauacaaacagauugucuauuuguuuucauugcuaaacguggaagaaauauuucaaaauacaaaauaucaugagagaacaaaaaagaacgaaggcgguccaguaucuaccauccagauuuaauguauuuuguuuuuuucuuuuuuaauuuaagagcuagaaucuuccaucgauagcgcuuugugcugggaguggaguggagugggcagguggagucaugguuauuuugcugcaauccagaagugggaugacuugagcuuucucaagucaucuucccuugacaccgggcaaauuaccugucauuggcaccaaacagaacaaaccagauuagccguagaugaaggguaugcucacaguuccugcgugcugugaaaucuaaugccuugcagucggucauggugaaggacaaaaugccuuuucuauugaaguguuuaaaccaaaagucuuuuuccaucagguuguuguggagauaucuuaaauguuuugauuguguuaauguagaaaaaaauggaugaggguaaucuuggcgcucacagugacagcugucauugucaggagggacacagucccugucaacuccaccucaccagcuuauaaggaugcaauguguugagaauacaguuggccucgggccaaacucgaguccacuccagucuauguuagaagaaucuuucccaaguuucuguucuuuaguauuagcagcaaugauugauuuuuuuguggcucuccuugugacugcuugucauagggccaugcucagugagacugguuccuugucccuacugcuugaucagucauuacccuaaguugcuaagggcagagccuuaaguccuuuauguuagacuucaccguaauggauguuggugacugucugcaaaugaacaagcagcccuggagaagguuauacugugaacagcagagcaauaguucaaaacuccuuuugacuggcaucaaagccuuaggugcuaaccagucacuguucccuccucacccucauuacucuggugagcacgauuagcagagccccucaaaaguggcuaagguucuaguaacaguuuccugaguauuucacagucuugccugauuuggcccccuaguuucuguguuaguugaggcuggauugagauccuauuucacagaaagucugucagacauuuuguugagcugcagauugaaccaugaucuuuuaaacauaguuucuuguuuuucuucugaguuccacuugaucccuggccacuuuggauaaccuuuaaccucauguuuaacgugaagaugaacuguuuccucaucuuuuaaguuggagacauaccucacuuccuaucuaccacuugucacagcuuauagaggauaaaugggcaggacagccuuagaaaaucccuguagcuauguggcacuuaaauagacuuguaugaacuaauaguuucuuguuugacuauguggucacauguaagucuauggcacugauacucuguaaaguuacauauuuuagaacccaaaaaggccucaugacccuaugugagauuuuuauuauuugucuguguguaugaguacgguguauuucuggagucauaguagcugauggaagccuauuuucgguugcuuugagguugcagcugcuccauggugguugccugucaagggagcuaauuggagacacccagaggguccggacuccaguauucugcacaggugagucuggucaugcccuguugauaugguuuguuccaaugaaaauuucugugcucuugcagaacucagcagcucucuucauauguaaaaugaauggcagguauaaucagccacucuugggagggcaaggagaugaugggaaauaauguauaugaaguccuagucacagggucugcucacggaaggccuugacuaaacggacucuuuccugcuucauuuggcuucagaguuccuccucacagauugccuugcuuuggacaggcucucacaaaugucaugacacauuuacucagaacagucuagccacgaaugugucuuuaugugaaagaagacugucacucuuauggauacuaguuguguccuaucagguggccaugugcuuuuuaguccuggacugauacacuuagaagccaaaaucugacuaaaacaaaaaacaaaacaaaacaaaacccagaguggcaguacgucuccgggguggcaaggagguaauuaucuuaagcaaaaauagagaugcacauuauacccuggggacgaagggggguuucaguuaugacuuggcuuccaacagccaggaagcuguucgucuaaccccauucuucagacagggcuuuuggccuuuguuucuaacuacauucaagguuauuccccuuaaaaucagggaacagggaauauauauaugaacuucagcucuagagacacaacccccuugauagauacaaaacuuuuuaaggucugaacuggcuuccucuguguagaaauggacggugagguagaacguugcaggauccuugaggaccugggguggacuuguucucuagaucucaauuuuaccuucuuuuccaggugcaaaguugguuaggaaaacccaaaggagacugcauuuucauugguggugcuaagacuugaacacauagccaucuguuuuaugaccgagcugcacucccaaacuggaauauacuuuuaaauuuaugcccuagacucagagcuacucaggaaccuuuguggaguaaauuaaugaauguccuauaggaauucagagcugcaugaggaguuaggugggccagucuaggucaccuaaaagugaguggugauuucagcuccagugacuuccuccauccucucaggaaaggcugcuagugugaggcagauggugcuagcugacccuuaguaggauagcagaaacaugcaaaguuaaaagcuaggugucuggaaacaggcuaaggguuuggcaugucuuuuagggacucacagauguguaagggaguagaugccaaaacuacuguguaagcccaacaaaguucugguuuacuuugcauggagcucuguggaauguacagauuauaagcugagccucugugggccuuacaugucugcugugauagucacuggaggcucuaaggugccccuaaccauuuugcaaaaugcggaaggagccagaagccucugcugaugacucuacgcagcugagccaauaggggcagagcuucacugugccugccauccccauggaaucugugggccuccaaggcuacaaagugaagagaugcuugagugcagagaggcugugacccauuugggcaucuaaaacuucagaaguccccacugcagaggacaggugugucgcagcuaggcuuugaaaucaugacuguggucacuuucugaaucuaccuccugcuuucuguucaggccguugucucuuuuaacugcgcguguuccucucuaggucaaaucauccgguucuccauguuuccuggaacgaugcuguugccuacugcacaugggcgggcaagagguugccuacugaggcagagugggaauacagcuguagaggaggccugcagaacagguacucaaacacaaggccuugccuugcccugcaguguguugacauucucuucuacaccuucuuccucugcuccucccuucucccuggcucccuggaacuugcuguggucaggaaguugauuaauaacagcuggcuuuucuucuuccuugugaggugcuuuggugacacuagugggugagucacaaacuuuuuacaguuccuaaagccagguaugggaccaaauggacucuguaguggcagagugagcgcuggccacacacccgcuccuauguaucccuccucagagcugcuuggcaggcugcccugcuuuuagcauuuucuuauuuuggcugucuucugaaaccacgguauucucugcuucugcagccaugagacagaaaacucauguuugggucacaucuucuaggaaaagcuccuuaaaauagacagggcuuaaaacaaagugugguacgcagugccugcucauguuaccauauaaguccagagugaugccuugugucuccgaucucuagaaggccucuuucagucauaucauuuaucucaggccuucucagugcugaggagagacugacguuuuacacacuugacaugaguuguuuuaagaaaauuucuaaaaguuccaauuaaaaguuauauuuacaaggguaucuuuuaaagaaacaguucacccaggacagacgugcauuguuuguucucucccacugcauccuuccuuuugacugugguccagaagcccgugcaccaugcugaugccugugucucuccucacaggcuuuuccccuggggcaacaaacugcagcccaaaggacagcauuaugccaacaucuggcagggcaaguuuccugugagcaacacuggcgaggauggcuuccaaggaacugcccccgugaguaagcaggcuucuugagaagggcugugugccugggagccaaggcacugggccuggguuggaagacccgggucugacaccagcaucuggagguugaggcaggagaaucagaacuucagcuuggcuacguagugaguucuaggcaagcuugacuuacaggaagccccaucugaagaacacaaaaccagggccagagaaauucaucaguggggagagguaauuguaagcaaguaugcugacccauguuaucaccuagaauccuuguagugggaggagagagcagaaucucguaaguugucuccuuguuuccacacacacuguagcaugagcuugugugugugugugugugugaaagguaccauuugcucucugaccagcacuguucuuccuucacuauccacccucaagaguggcaaaugcuggaaaucaucagaugucuugucuccuuuagggugcuuuuuuuuugugugugacuauauaaugcacacuauaagaaaaagacucccuggauagaggaagaagcuaagcuggccuggcagucuacuucccagguuaaucucuauuagcacucuggucccugaccuuccacucauccuagggguuaguggugauggugguaccagcuuugcagugugccaggauuacugcuccauuaucaugcauagaucugcucauuuguaauguccauuuaacucuuuaagauggguauuggugugccugugacauucugaggcacagagauguaaacuccuguuccaguuuacauagcugggaaagugaccacagcugauucaaaucccagcuuggcuuguucccaaaucucaugauccuaacuacccuuuuugccagcauguguaucucuggugucuuagucaggguuucuauuccugcacaaacaucaugaccaagaaacaaguuggggaggaaaggguuuauuacacuuccauacugcuguucaucaccaaggaagucaggacuggaacucaagcaggucagaaagcaggaggcuauggagggaugcagaggcuauggagggauguucuuuacuggcuugccuccccuggcuugcucagccuguuuucuuauagaacccaagacuaccagcccagagauggucccaccuacaaggggccuuuccgccuugaucacuaauugagaaaaugccuuacaguuugaucucauggaggcauuuccucaacugaagcuccuuucucugugauaacuccagcugugucaaguuggcacaaaacuagccaguacaucugguauauauguagcauauauauuuuuauauauuucuuuuaaaucauauuggauagaauauuuuaaagauguuauuuuuaguuauuuguguaaggguaugugcaggcguccacagaaccuagaagagaaaguuggguccccuagaacuugaguuguuacaugcaguuaguuuuaacuuuggugcuggaaaaugaagucggguccucuggaagagcagucaugugcucauccaucucgcuggccucgggauggaagacuuggaaucccgcugcuuccccuuuaccgccaggagcguuuuaucugucacgcauagaccaugaucacauugccguucacaggccggauaaccugucguguaaauaaguccugauuugcuuagauaauacugcaguggacaucuuguauauucauacugagcaucucugauuuuuuuaaaaaacagauucucagugcaaucaauggcuaaagguuagaaaaugucucaaaugucucuccauucuccuccuucacuuccucuuccaccgggaaucaacccaauaucuugccuauggcuaagcaugugugcucucacugagauacacucccacccuagaaaucuucucuuggcuaaauuguguccaauagugcccaagguauguuuccuuuuauugauguggaagaguucuucucucauggagcuuuugccaacaguacagccaugaagguauguuuuaaaucaucucaguuuauuuguguggcuauaacaaaaucccauagacuuggucacugaugaacaggaacaugucucacagaucuggaaacuagaaaguccaagauggacaccuuaguaagauuggcauuuguguaucccuuugaagguagcaacaguacacucgcucagucuugugccugucuauaaaagaacucauggcaucagucauuccuuagucaccucccauaggcuacucucuuaguccuguugaauugaggacuaagugucagcaugaguucugaagggauaccauucuucagaccagaaaaacaaaacaaaacaaaacacuuuauuuucucuuaagacaaugaggaaagaaguuuuaugauguagaaauagcccuacugccuggguuugugagaaagaaagugauucucucucucucucucucucucccucccuccaucccucccucccucucuccuucccucccucccuccaucccucccuccuccuucuucuuaaaauuugcauuuuuccucaagaaaaucucgcagaguauauuuauauauuugacacagauauguuauuuggaaugugaccaaaugguuagaaaguuucaguuugaaaacuaaauaaaugagaguaaaagaccaagaaauucugggaaaagaaagagugaagaggcaccugauauaagaaaaacugaaaaucuguuugagcuguuguuggcauuguagcauuuggagcagaauuuaguuaaaaagcaaguugcuugaggauacugaguccuccguagcacaugaugcauuuguguuuguauccaauuccauguacgcgaguuacauauauguuaagccaauacaaacugaugggagaagaugcauuauucaguaaggcagaaaaggcaaaucaagccaucuggucgcugguuccuccuaaguuucuuucaagauagcugcugcucuuccagacacauaguuuuguuuguaaagcauuggaagucuuagaaggcagugauuucuaccuuuccucaugcuuuaaauggauaacaagccaagcuuuuugguaggagcagggcauggagugaggacuuacaggggaccucuuggccagcagaaguggugcuggagcaaaaugucagggguggugccugaugugagugugugugaaaguccaggcaaggaaggccuuggcugucugaaccugucagaugcucaguagguaaagcuguuugccagcuagcaccauggucuaaguuaaguuagaucccugggaucuaaggaugcuagaagaagauagacuuucauuaccugcccucugacacguacagacacauugugcuacaugaguggguacacacgcacacacauacucuuuuuuucucucuuucaaaaaauguaauuaaaaagauauuaguuguuacagagaucagggcaguagcuucacuucuagguccggguagcacugaaacagauagcacuacaugucaaacucauuuccaacuucucuggacaagaacacgugaaggagccuggcaggaagugggaccauggcaggaggggccucccucaaaguguauagugccaccuacagcagcugcaguaaacccugaacccagagcauugcucagauggaguagaccuuaguuguuauaguaacagcauucacaugagagcugugaaggccaaaguacagaaguguccauuguuccacuguugaacaggaucguuuuguccuuagagaugggcaggcuccaucccagaggcacaggugaaagcuuccauugucucuguuguuggaagaagucugugguagcuauaaugaaccagaucaauaauguaagccccagucaauuuuaguaagagacuaugauaaagcugcuuuggacaauuacagacauuuccugugauuaccaccauaguauuguauguguauuuaauuaagugagcugaaaggaggaggaggaggaggaagaagaggaagaagaaaaaauaaugagucauuucuggauaaccuuuguaaacaacauaaagcucagagggccugauacacacacacacacacacacacacacagacauacacacagccacacacacacacacacucacacacacagccacacacacacagccacacacacacauacacacagccacacacacacacacacacagccacacacacacacacacacagccacacacacacacacacagccacacacacacacacacacagccacacacacacacacacagccacacacacacacacacacacacacacacacacacacagacucacagacucacauacagagacggagagacagaauuagagacacagagacagagacagaucaguaugagauaugcacucucuguagauguuuauuuuauuaccuuuauugugguucuugggauugaaccuaggaccacacuagcacuaagcuacacaaaacccugcucugcccuuccauugcuuggcauuaguguuugacaaagaggccagcagguaucugcagaacuuaaccuaaagacauugccccccaguuaccaagauaaaacuguuacaguuaccagcagcucugaaggaacccguucuuaaaguagacuuaaucaaggauggggaaggcuucagauggucacaucuauguuaggugucuuuaaguuuaguugaugccuacaaaaaugaccucgaauugaccugaacuguccuuuauauugucuuaguuaggguuuccauugcugugaugagacacuaugacaaaggcagcucuuauaaaggauaaaauuuaauuguagcuggcuuacaguuucauugcaguuucuaacaguccauuauuaucauggugggaaguguggcagcauccaggcagaaaugguaccauggagugaagaauucuacaucuugauccaaaggcagcugggaagagacuauguuccacacugggugaagccugucuauaggagaccucaguguccaccuacacagugacauacuuccuucaucaucgucacaccuccuccaauaaggccauacuucuuaauagcgcuauuccuuauggccuggaauucaaacacaugaaucugugggggucguacuuauacaaaccaccacaguugucaccgugcucucggaagucgaggacaagaaucuaacuuacuggguuguucucauuuuuaagacaaggucaggcuagcaccggacaccugagacucugaguguugcacacugugaaccuagggagauggagggauguuuugccauucuaccguuccaccaucacuaauucauuuugguuuuaaugcuuagcagcucuuagcauuucaagaaggauuuggcuuguccacuuguuuucaugugagguuccugggaggaagcuugguuagugugauucaugugaccuugaacagugagaauuccauuucccacacugcccugcucacauauaauacguuaguaacuaagagggugcuaccuuccagauucuacuucagauauucucuuauuuaaagggggagggcgaaccuuugaugggcacuguuacuucccuguugaggacuaacagcccaggaagguuaacaugguaccucccaugucccgucuagaaaccuggagauggaucccuucucuagaauguguuucaguuucuuauuccccuggccucguagugucuuccacuuccucccugcagccuacucauuucuucucuuucucuuuccuuccaacuuaguccaggggcucuuucuguuccagacauguuuuauagcuuaugccguggccuccccucccucuuguuucuuauauuuggaucacagauccuauuccagggcaugcguagauccucccacuggaguuuguaccuuggaauuuguguggccuuuccugcccucauacuuucucugucccauucugcuuuguagagcuguauugaaagagaacgagugagugugagugucugauguggccccagcuggccucagacucaccauguagcccaggcuagucuugauccuccugccuccaccucccagauggugggauugccugugugccugucaggcccagcucuuuagagcugaauuuaguuucaggcauucuccuuuugcuuccuucauuaaacucuuucugaacucauuugccacggagccccucccugcccguacuggccgcacauggcauuucugaaugagccaaggcuguuuccauagugaacgcucauuauggaagcagcauggugggguuugacuucccagcucaucuccaugaacugccuuucaguguggcuuccuaacuuggauuaaaaugcacugaauugcccaacugacagaugcuucuguauucauggguagauguaaaaccaucugaagccauuuagacaugaauguuaguuuauucauucuuacagucuuacuucuucaguauggaaaagcaugaauuaugaaaagagaaaaaaauaucuccgaagauaauggccuuuuucaucacaaacauauuuuuuuuaaaaaaaugucuauugagaagaaggcuaaaauaauuuuuccccaaagguuuuuuuguuuuguuuugcuuuuauauuuugacuuugucuuuuuucgauaucucccuguucccugccuauuguggggacaaaaccucggaccucaccuuacacacuuuuccacugagcuaaaccccuaauccugauggggaaaaucuuuaagucaugaaacuggccagugaccugaauucacuauuguucaguguguuuucuccuccugcccucugucuuacauaaacugcaccuugcuuccaugccuguggguguuauccuguacugucugaccugccuuugaauugggccgugauuccuugauggauguauaauuuacugcagacugcugcauuccggagaccugcuguuagaaacacauggguuaaugagcugacauuuuccuuauuuaaugacagugacugcagauuaaagagaaaauggucaacuggauggagcuuguggaggaggcagaguuaguguggaaucuauggcgcuaaaagacacuauuugccuggaaaagcugcuuuccagugacaagacguugauacuaggaggacauuucuguuaaugaucuugaagccuaaauacuguuugucuguauacccccacauacucauacauacaugcacacacacacacacacacacacacacacacacacacacgcacgcacguauucuuacacgcaccucucucccauauuagucaagccuugguacuuauaguuaguguuaguuacuauuguuuccuguuaaaaauaaccucaccaguuccagcccauuuaauacacucucuuagguuuauaaacucccucugaaugcuuaaaguaaaacaaaacagagggggccgagauuuuuauauuuauuuuuccagacugguguuugguaggugguuaugaaaauuggcauuccuauuaugaaauaaaugaucuugauucguugauguaccagagagauuuuuuauagcacuauagauuuuaauagugaauaauuaauuggucaauguuguuuucuuuauuuuuagguugaugccuuuccucccaauggcuauggcuuauacaacauaguggggaaugugugggaguggaccucagacugguggacuguucaccauucuguugaggaaacguucaacccagugaguaucuuguagaauaggcuuguaucuugaugggugacccuuguccucugagcagacagcagcaaggguuucaugcauccgucuugacauuaacuuuccauuucuuuaaaggaauaccguguacaugucucuuguuucagcuucagagcccuuuauaaaaaugucuuauuuuaugugccacuggacugugauaaugguaacuauuuugggguguuuaccuaugcuucaucucauaaauuugagcaaagugugguauauaaauggcugcaaaauucacuaauguuuuauuauuaacuguuaagauauaugacacgguauucuucaugaaccuccucaccugggcugugaugagaacggauuuuguuucagcaguguaauuuggagaaaaugagaggaacuuguugagugagaaacuugagucacuuagcaguuguuuucaugagccuguucauaugacauucauaggagaauguaccuauuccuuggaaaagaagaccgccuugucuauuugaguuuuacuuccccugucuuuuuaaaauaaguuauuuauuuauuuauaucccaaauccccucucagucagucccccucacagagaccuuuccccauucucccuccccuucacaucugagagagugggccccccccccccguggcuaucccccacucuggugcaucaagucucugucacuguaaccagacaaggcagcgcuguggggaacgcuuaccacagucagacuacagcuuuagagaaagccucugcuccaguguuugggggccccacauggagacugagcugaacgucuguuauaugugugcugggggcuuuguuucagccuguguguguucuuugguugguaauucaguguucgagagucccuagaaguccagguuaguugacucugcugguccuccuguuggguuuccauccccuucauugacaaguuccuugccccuaaaaccaugcucucuaguacuguaaacauuuuaauaggagcauguguuuagacggugccuccuuuacaaagaucaucuuugaauacuuguugucguuggacaucuuggggauggguauucaucaaacugaccgaagaacaguauuaaaaccagccccacugguaaugcucugugugcagugcccagaagacggugauaaagaacauuaaugcuuuaguugcuucucauucaaagguuauugaaaaaccuguugaacuccaugccucaggccauuuucagacuguucggauaaguuuccguuugauaugcuuaauuuguuuucacagaaaaauaugugggcuguucaugaauaguccaaagauauauaucuaccuuuuuggaaguacagaugaaaaagaugaauucuuuagaagcucuacccauccuuucuuuucccuucugucaggacuggugguuguaguggucaaacagccugugucuccaagugagaagauugugcagacuuggggaguuugugcuuggagccccucucccuguuggcaagaugugacuuggcguuugcugucagaggcagaaauagauuuucccugucagauuaaagcaucugcaugcuuggaaggggcugugcaaggcuccagaaucuuggcaaguugugaauguagcuaucugagcaucugcuguggcgcucagggcucguuagcuuucacuucugcaacggccugacuuucuccuaaggauuuguagaagaagucccauuuuuccuuucagcuguugcaggcuauuuccugaugucacucuaguucugugaaauugucccauuuauucuagucuuugucacauggccucauuugcuuucugauuugaugggguuguaguucaaccauuuugagaacuaacccccaaauucuugaugccaucauggggauuguuauagcucucuuaugcagcacacauggaaucaucagugucugucaucagucucccaggugaacuccuugucuucacucuaucggcugccuugcaucuugaauggucuuugugcagaccaaaucuaauacugcuacuuuuccacucagauucaugcauacucccucucccucccccuccuccucccccucccccucagauauuauugcacagcucagucugucuuagagcucacuauauagcccaggcugacccaguauacgugucucugaauggcuucuuacugucugcaaaauaaagaaauaaauaugacucugaaagccaaaaaaugguuuggucuuugcugaucucuucuucagacacaacuuucaguuccuuuuaaaaccuuuaacuaugaaauguuacaugagcccagagaaauacagaaagaaauaagauaauuggaaccucuguagcuguuuuucucucuuuuuaaucaaagaaagaggauaaaagagcaagaguuguuuuuaucagcacuugguguugucaguguuugacacuucacugcccugguuaguguuuacugcucuuuuacugugguuuucagucauuuaaaguauuuuuuacucuuauucuguaugugcaaguacuguaccugcauguauguaugugcaccaagugugugaguugugcacauggaggucagaagggggcaucagaucaccuggaacuggagguagagacugcugaaaguuaugugagugcugggacucaagccccugcgcucuggacgaggguagagcauaacuggugaccugucucucugccccacagucggcaguuugcagucuggacacaggguaagaaacaucuggcuaucucuuguucuugauguucggccaugucuuguuuucauauggacauaguuauuucuggcugaauuccagacauaucuugugggaaaccgaggugagguuuugaguucuagcuggugcagucuuucucuagagucuuuaccuuugucuuugugucacaucagccuaaccaguuaggaucugaaguguaugaagcugagcuuucgucccucucaagcccauugccaguucuccuugacucuucaggguaccaacugagagacuaggggauggauucaccauggagacuccuuggagggcucugaacuccaaauuuuguuuucuuaggcugugaauggguugaaagguauucagcaucugcugccauuugaaucagcagaucccuaggggauuuuccugggauuugggcucugugauucuuacagcuguggaggcucaccugacuugaccaauuccuauuuuucugugagggccuaacuuguuugccuuucuucccuaauggcuuauguaucauuagugcuuggcacagaaccuggaguauaaccauuaauuucacaguaaugccaguuccagacauuuagaccuggaacacucaagucgcuguccaaauuccaggugggucaaaagcaaaguuagaaauagacaucuucauggagaguuuugaccccgagugccuauguaaacauuuuaucucagaaccugaccucuuuagugccccgugcucaugcuagccccagaacuggcuuauagcaaauaguuuuaaaaacugcauuggagagcugggggaaaagucaacuuuccucaugcacagguuauucaggacauaucuuuuucuuauucaguggcuucuacagagcaaaaguuaaucauuaguuuuuauuuuauugagcugucaucuauggcaaagcagucuguagaaacagccuggcauacuuuguacacaaaguucuaagaguaaaugagauauuuggccacgugccaugaggaucaguucaguuugcuuuuuuugugugugcaucugcccaucucucaguccauagagcacccauaaagacaacccaaaguguggacauuugcuuugauguaucuuuuuuuuuuuuuuuuaaauaaagauuuauuuauuuguuauguguaaguacacuguagcugucuucagacacuccagaagagggcaucagauuucguuacugauaguggugagccaccauguaguugcugggauuugaacucaggaucuuuggaaaagcagucggcgcacuuaaccacugagcuaucucgccagcccacuuugauauaucuuaacuacauaaaauauucaaguuaaaaaauuuauuuguugcccggccgccaucggagagcaucagccauggcucugcgcuaccccauggccguaggccucaacaagggccacaaggugacgaaaaacgucaguaagccgagacacagccggcgacgcgggcgccucaccaaacacaccaaguucgugcgggacaugauccgggaggugugcgacuucgcacccuacgagcggcgagccauggaguugcucaaaguguccaaggacaagcgcgcacucaaguucaucaagaagagggugggcacgcacauccgcgccaagagaaagcgggaggagcugagcaacgugcuggcagccaugaggaaggcagcggccaagaaggauugaugaacccucccccaauaaaagaugguuccuacaaaaaaaaaaaaauuuauuuguauuuuuucuuucucauuugcuuacaucugggccccauaucaucugugccauuauauagugcauucaaaaaaaaauguagaccuaagaaaagguaagcgauuauuuaauguucugauuuccuaugcuugcugcaucacuauggcuaccaugaugcuaugucgcuggugaugugaugggauaguaugauuuauaguauccuucugguucuaagagaaacacaguuguaucuaaacaggcugcuuguuugcuuguuuguucugcaacaugggacaggaucuuauucuguagcucagacuggccuuaaacagaaauccuucagccucugcugcaauuuuaggaguguauaucaugucuggucugggucagacagcuaucuguccuccugccgugcucccagcgagaguucuagucuuggaacuauccagagugauuuguguuuuucuaacucggcaacaauggaaugcauauuaacucgagugcaccugagccucucucugugugaguuggaaauaggugugcacaccugaugagaucgcuggcagaucaggcaucuuacugugaggagacccuuuccauuccucugucucaaaguauuguuuucuucuuguugugguuugccugucuaguuagaaugcuaccugcuccugucggcugagauaaugagcuuagccugugccagcaaaggggaagaaaauuauaauugagaacacugcuugcuuacucuucucgcccucuucgcuuugguuggugcagugcuuggucauccuuacuuacaaaccuugcucaugcuuccaugcuguuauaguccagacaccuucauccucuccugccugccaaggcuuagcuagacaucugucagcuugcuuucaacauggguuuugaccauauaucguacuguauaguuccagacaguugcgaagugugugucuuuucucucgccuguuuugauguccuagggaauugaucagggaggcucuaagcucauccuuuccgccuucuguggcacauggaguguuuguuguuugcuuguuuuuauggacuccucucugaacccuuaccucucugcacaugguggacuaaguaaauuggcacacacaccaaccagucuucuggucugagagcagcaugguaauggguaguaaccgugcugacuuacugccucugcccagauacuucuuccgcauugcuugguugugcuuaggguucagacuggcuuuccuuuguaaguccuaaagcuaugcuugauuuagguucuacuugcuaugcuagaugucucucauccauaaaccccucugcggccuucuaccacugcacguagaacaaagaccgcaugcugcuggcuggcugucccucucugucuguacgaugccuucauaggcauguucauucaucaagcauauacuuagugccuagucuauacuagaaccaggaaguugcuuuggaauuuuuaccugcuagaagaccuuuggucauguguccuuugugaggaucuucugagguaugagaguucaaaguggaaaaagugugguuguuucuagcgguugacagcuaaugugacuacaaauaugcuuaaugagugccaaggacaaugcaaagugguuguacuguuggcuucuccagacuuucaaaaaauaauuuucugaauguggaaggacauaugggagggaggguuuggaggaauggaaagaaagagagaaauguugucauuaaauuauaaucucaaaaaugaaauaaaaauauaauuuuaacuuuguccuaguagaagcuggaagucuuucuggaggaaguccuuguggguacccacugcuguuugcaauucuggguagagcuuuuccuacagcacacaagaacuacugaggcagagaagucaguguggaugaugucuacaguuccagugucuggcaccuuugacggcauuugcaaacguguucugggggcggguggguguucucaagugaaagugaccaccaguucuagugcugagaugacauuuguuuccaucuucauaauaaacacuuucucagaagccccuggugcaacuuccugagcagggagugggauacuauauaguguccuccccgccuucuucguuagggaauucagucaugcaggacucacugauaacccugaaagcugaagacacuccuggccagcaggaacuccaacgccuggggcagaaaguugcuuuauggaaaggugcuguguccagccaaacacucccugagaguauuuaacuccuugguuuuuauucugcucucuccugaccuggaagcuuuucaagguccugaagguccccauagcauuugccucuuagucuucguuuuucuggguaaguauccccuuuuauucuauuauaucugauauaacuuacaauucagggcaauucuguuacuuucuuccgaaccacaucaguggcagaauguccagagcacgugccaaagcacacugaugcuuggagcuugaaggauuuaaauuuuggaccgugggaaauuuauguauacguuuugcacuaucucaaggguagaauccaagugugcauaugaaaugcuuccauaucauacauagcuuacauaagagccugaaggugauuuuaaauacuauuuugaauaaauuuguauaugaaacagcuuaugcaauugaaccaucagacuuucaguauacugauauuugaaaaaaaaaaauaucuuuuaaaccucagggcagcucuguguagaaguguucagcuuguagcagcuuuccuuuccaguagagcuggcuguuuguacgugaagaggacacugaacagagagcugaagcaagagcucuggagcaccagucagcccacauuggcacaguucucucuggguuacggagcuguccuugcuguggggguugacagacacagggacgcaguagacacagggacacaguagccaggcccuguugucaagaagguucuuuggaggaaagccuuggaaaauccagguccacugugacaagacuuccuguguguguguaacguggaagaacuguuuguucuucacugugggagcugugacggcaucucaagaagaagcacaucaaaugauggcagcacaucacccugcuacaucagugggauccaaagagcagaauggcagggccgggcuuuuuaaggaauuuagaagcaaaguuccccuaccacaaccacacucaugguuuacaguuccucugguccuuggagccauuguuuucaguuuacccucauccugaaacacaguaccuuagcucucccccauggguggacauacuuguuuccucucucuccucuucuggcuuuguaucacuaccccauuaugggagaacuagaaaugaacauagauuucuuuugguuaacuaguuaggggcuuuagaaagugacucacaauuuauguuucuuccuuccaucuacuuaaagggcuuuuaugagcucugucuuuuauaguguaugacaccugauugggccagcaauguugacugagaagagcaggguuugccagugggugcuuuguuguucucaguaaugcgcuuucuguuguacucaguaaugacuguaguuaagcaauggaauagaggucagaagcugugucuccauuuguaguuuaaaaugcuacaaggccagaggugagucaucucacccuuguugggcuuacuaguccuucaucuguuguccugguugguuuugucagcuugacaaaaagcuagaauuuccuggaaagagaaacuccaauugagaaaugucuccaucagauuggcuuuaggccagcugauaggauggaaaucuuucuaauugaugauuaauguggaagggcccagcucccuggggcuggcagcacccugggcagggagaccugggcuguaaaagaaagcagacugagugggccauggggacaaggcagugagcagcauuccucugcugcaggucuucccuugaguuuguacccugacuucccuuggugauguauaugacuugagaguuaugagugaaaccagcccuuucuuccucagguugcuuuuggucacaguguuuuaucacagcaguggaaagccugacuaagaugucuguaaauugcauuaaggauguagcaaguuguucucagggaacaggcaaagugggcaacuauugcuugcuuuugacugggagaguagaggaccacugaagaugguacagcugaucgucuagcaguuggcaggauagcuuguaaaugauuuaaauggagggcugcauacagguaucaccgggugauguaauaguuuugggacaagaggaugaaauccuuugauucugcuuccuguucugugagagaaaaugaacaaaaauuucaacaucguguccuuguauuaaaaagaaagacuagugcugcugagccccaugccuguagcauagucagcacucagcaaaugcacucacaaaugagagcuaauuaccauuucugaguaccccugagugggaguguuuucuuuuugccaguucuucuccucagaaacaccuuuuguuuaauaggccagaucaugguauuuaccuguguuugcugagcagcgccacuaggcacuuggcgugagcuagguaaacaaacaucagcaucacaggccuuggccggcagaugcugagcccugacuguggaccuuaucauucacacagcauuggguggauuucucccuacuaaugccuuaaccuagaccucgccuagaaucuagacccuaaacccagauacgcaguuuucauuugaaaguguuuuacgccuucuuugucccuuucugaaccuaaauaggcucguggggaccaacaaagauaaccagagccucugacccccuuaguugugccuauaacucugacaggacggggcauugaauucuggguagaauuugggcuuagaucuugggucauuugcuugaggcugcuuugucuuaucuugguuuggauggugagugggcugacagcuuagcacuguacugagggccagacuguuuccaccagacuugccaucucugugggccucuugaccaucucuuuguuccugagacuucaguggguagaugguuuuucucaauauuucagucaacccaacaugccacuccguggcauacacuauacucugaaaucuaauacauggauuuuuaaaaaauagaaugccuuuuaaaaauucuuagucaguuucauacaugugaauaaugcaucuugaccauguucauuucaaacuccccucuuccauccccccuggccacuccuaauccucaucccaucaugugagcacucccaccaguaacccaguggguucagucgguguuuccuguuagaauguugagaggucuuguugacuugguccuauguaggcaacuugugucuacagugaguccaugaguaugucgcauccagaaggcagcaucucacagcucucuucucauccucuggcucuuacuaucuucuguccucuguuugcucauguuucuugagccauuggugugggagacagaggcuguugguauagaugucucauuugugacugagccuuaaauaguagcauagccucaacacuuugucagaucugacuuuuuguuguacauuugcagguggagcucugcuuuauuauucucaagucaacacagauuagcauauguuagauucugacauauauauauauauauauauauauauauauauuuauaauuucuuauauaugaucaacucauacuuguggacauuuuuuuuccuugaguacugaucaagccgaaguggaaucauugcagaaagcugccaucucuuucagcuagaagcaggccuccaugugagcuuauagauuuguguucauccuuuugggguuuuguuuguuaaguuugagauaggauuguuugcaguccaggcugaccucuguauaacauaaugacauaauugcuccuuggaaugguuaaaggggagguuuuuguuguagauaugagagagagagagagagagagagagagagagagagagagagagagagagagagagagaaacaugaaugagagaacagcuagaggcuucugggaaaguccagagcagaaagagauagaaauaaacauggccaugagaccuggccugggcucugagagaagggagaccagcagggaguagaaaaaacagaaugagaggagcaggaaggagggagagagagggaggaagagggaagaaggaagaggagaaagggagggagggagagagagauagaaagaaagauagauugauagacagacagacugaauugcaggguuauaaggagaaugaggagcucuggggagggagugugagguaggggaggagguuagaagggcuagaugccagccuggacauugaaaugugcugcagguacuuguccugagggagccuguaagccagcgucuggucugcuuuaauauguuauuaggcaccauaaauagccauuugucccaucagccagugauaaggcaaaggaguccauuugauagggaacugauuucacaaguuccugaggaaugcuggcuuuuauguaacuaccagaaauucucccaacauccauguugagcccauuucuggauauuuggacugccuuuuggggucuggaauuggaacuucauuuggaccuaauagcuucuauuccucuauguggcugaagauggugaacucgguuuugauuugcuguauauguguugcugaagauauaaccgaagacuucaugcaugcuugggcaagcagucuaccacuauacauguaccaagcccuguauuuuggcuuaaacaaaaucauauaaaguuguguaguacuuuuauugagaaugaaagucaaagucaaagugggugugcauuguuuugaugcaaguuucguuuccaugaauuagagugcuuucuuaagcacagcuguguaagugcuguagcacuauccaucuauguccauccauccauccauccauccauccauccacccacccacccacccacucauccaucugucugucaucugucuaugugucugucugccuaucucuaucucuccuucauucccucccccaccucucuuuuucuacacagacacacacacacacacacacacacacgaauguacgcacaucauauccuuaaaaucuuucuaacugugugaaagaaggucuguguucucagaaccauuuuucaugguaauucauggaguggagagaugugcugacuucaccuggccuuugagccucauuuguagucaggacucaauuccagcuuuuucaauccccagacuuguucagguuuacuggacuuuauuucaaaugcacaauacaaagggcuacuuacuucuuuguaguaauguugagucacaagcuacauauguuaguccaggaaguguuaagaauaugcaagaugauuuaggaggcaugaauugcugugucaugagcaccucuuuccaaaagcaaaggggagggauaaguuaugucugcagugucuaugauucugcauagaauccuggccuuccugccaucuccagcucuuacuucugcuagguuacuauuaaaauuaccgauguggcaaauucuuggauuuuguuguuguuguuaacucuggcaccuaacuuguuaaugaaggauaaaguagcagugugucacuucauuucuguaucuuccuuguagugccuucccucugccacacagugacucauuuguucuuucccucaaggcucugaaauaaagccugaugagaaaauagaacagucaaauuaucuuuucuucuuaaucagguuauacugugauuuuuuuuugacgugguucuguggacccauuuuuaauacauguguacguacaucacacgucacucuggcgugaguucauggagauagcccuugauaucaaaaaaguucugcaucuaaggguuccauuaacuaaccugaaaaauuguacccaaaacugcccagaccuuuuggucuuauuauuucucaaacaauguagcaugauagagauuuggguaaugucugugaugucagaaauuauaugaaaucuugagaugaugccaacuacauagcaagauguauauguuauaugccaacacugcucuguuuugcauaaaggauguggauuugaguuccucaggagguccuggguccaauccuccccagauacugagcaauguugguauuucauuuauuuagcaacauuuaucagaaaucuccucauguuccauuuguguguaaaguuuugggcguuuguagacauagcaucuuuaauucaugcaguggagauguuugaaaagcaagugaacacaccuaagcacuuaggaaugcauguuuauuuagucaugugcagggacgcaguauagcgugauguuuggaauaauuuaguuuuaaagauggaucccaguguagccacccacuaguugaauagacugaggcagguuuuaaugcauuuacucaguuucuuugucuguuagugaagaaauaguagucugggccgaggagauggcucagagggucagcuugcugucaucaagccugauaggcugaguuugaucuuuauauuguggauggaaagaaaacagacucuugaaguuuuuccucugacguccaugugugcuguccaaauggauaacuuaaaaaucuuaugucuacaaaagcacuaagucaguuuggucuuaaacacaaguagccagagacaucugcaggaugagcuagacagaagucagggaagaacugcaaggacccagaccugggaccacaaugcuccgauccucacucuuggucuugaggccgcucacuuguuaagcucaagugcuuccgagaggccucggaggucucuuagacugugccuuuaccaccccaggcugugucaccgccuugcucaacuauacgugcacacacaaacacuaaguaaguaagaggaauuagaaaaagcaaagaaauagucuuuuuuuccagucucuugagagguuuuccugguacuaugaggaaaauguuuaguguaaagcugguguguaguaagcaugucauaaaugcuaauuauaacuaguguuuuaauguaaucaaaguuuaaaagaaauauuuguaagcuacaagcguacaccuuacucugaaaucuaauacauggaagagauuuuuucuggacccuuuuagagauguggagaagagcuaugccaucuguuagcauguaguuauaaauaacacuucuucccgugggcagccucuacuucauacccaguacaggaaguaaacacugcaucucauccagugagacaguucacagcacugggcgcuuagcacuuacgcauuuucagacuguccaaauaaaaucacagaaaucuuuaaguaguucuuugaaaauaaugucgaaguuaaaaugccauuugguauaagcuaauuguuauauucucccuuaaguuguugaugaaguaucaggcagagcacugggguugcaugagaauguguugagucccuaggaaaauggaaugguucaucauuuccacuuuaagggaugcuuagaacccuaucugaccuggcuugcaggaccagggcuuucacagucuuauucugagaaguagaagugauggacuuuggagcagguuguuaagucaguguagcugguacccugugauuuccaugguucauuuggguucaacuggaagucaccuuucuuuaagauguaugcaucaugggcuggagagauggcucagugguuaggagcacugacugcucuucccaaggucuugaauucaauucccagcaaccacaugguggcucacaaccaucuguaauuggaucugaugcccucuucugguaugucugaagacagguacaguguacucauauaaaucagauaaaucuuuuagaaaaggauguauguauuguuuacaaugacagaaacucauuucuauacauguuagugcaaaucuauuaggauuggguacaccuggauguacaggaucagcccagcuuucugagcaugaaggagcaccuauaccuuaggagacacugucacagaacaguguacugcuuucguuagacaauggaaaagcaguugccuugguacagauauccaugugacuuguuuucuuucagcaauggcuggaaaaugccucuguauuuaggcugacugguuuuuagcacuuagacucuucauauccuuaauuuuuaaaauuaccgcucauuuaccagaguugcguugaaaccauugaaugaggcauuuaaaagaagauuguaguugcuuuucuggcaucuuuggaagaauggauacacgguuucucuggagacagugagagugugguaugguaaaggcaccgucuaagagcauagcucccauggaauggaaguggaggcagggccuccgaggccucucugaagcacuugaacuuaacagaugaaggaccucaagaucaagagugagggucagagcucuguggucccagguucagguccuugcaguacugcccugacuucugucuagcucauccugcagaugucucuggcuacuuugcaguguguuuaagaccaaauugacuuugugcagaaguaagauuuuaaagugauccuuuccaucuuuuguuuguugguuuguuucugagcuuuacuccccuuguuugccaaaucccaaaucacuggcggacaguuacuccacagauauuuaaguguagagugguugccauggagucaguacaugucuauugacauccccagucucagaugugaacgcucauggugaagugcugaacagagcaaagcccuugcugacagggggccugcguuaugcuaccagaaauacagguagaaugagguggcaaaugcuaguaugucuuuuuuuuuuuucuguuucuuguagcugccucuucuuccuuuuccucuuuuuucucuccucucccuuucacuucucccuuuccuuuuccuugcuuuuuucuuucuuuuuuuuuuuuuuuuuuuuuuuuuuuuuuuuuguuugcugauggggagggagucguauuauauauccccauguggccauaaacuugcuguguuacaggcugguccggcacuugaaagcuuccugcccugucucugcuguuauuacagacgugggucaucacaccuggaucugaugccgcuucugacaucaauguguauacauguagacauguuuucuccuggcaggaagcacgugcuauuuuacuacagcaguucuccaacaccagugaucuuagcucaggaguucugauguccugguguuagccgagagcccaaaaauuaagaucuuagucuuauaagacgaaguccccauuccagacacuagccugaaauagggcagucagaugacuuccccggccccuguguauucauucauucccauaaccacuuucucuaguuuuucauauauaaaauguuugaggcuagccuggaauauagugagccuuucucacucaccccccccccccaaaaaaaaacccaguggggaugugggacaggugaagcuaaucaguguccuuuaaaaucagugacccagucacucaugguucuucaugaguuguaggccuuuuccugaaaagacucuggaaaggaaggcguaugugccucagcuggaacagcugagucauuuguggcaaaaauacgaugcuauaugagguagcccacacagaccaccugacggccugggcuugaacccugaccccgaccugccucugaccuugguaggcuucucaccuugucucguccuuaauucuuuauuugaaaaaaaauggggcaaaugacugagggucugcacaugccugugcuggcaugauuguuaauaguuaauaaagccuuuguuuuuuaaacauuuauuuaaacgauacauuauaagguuaccuuauaauaaugauaauaauugaacuuauuacagugacuggccguuuuacagauguaagacauaaggcaguacuuacauauaguguguaugugauaaguaucagccucuagguuuacuugcaugcuccuuauucugugaguagaauuaguguguuuaauaccauauuuuaugcaugaucccagaagcaaaaauuguagguuuuuagacaauggagugccauccauccuggugugagcaacuuggaugaaguuucaaggauucucuucccuuuugaccuagcaugaguagaacaaacagaacgaaggaaauggcucuucuccuucaccucaaaagcagggggcacugcuugaauucgccacugcaggagucugugcuucucuaaugagaaccugggaagcuguucauuugguuuguguuucucacauaggcugugcuccuaauuugaacuucccucuaccuuugaccuuccucugccaucaccuuccccuuccucuuuuaaugcaauaauuaaacuucuuucucucuuguucucucuccuccuuuccuccuucccccuucccccuuucccccuuuccuucuuucuuuccuucuuuucuuuucuuuucuuuucuuuucuuuucuuuucuuuucuuuccuuuccuuuccuuuccuuuccuuuccuuuccuuuccuuucuuucuuucuuucuuucuuucuuucuuucuuucuuucuuucuugccucugccucccaagugcugagauuaaaggcauuuaccaccaugcccagcuaggguacacuuuucauugauucuuuccuagggaauaaauaacauuucaccuaauucaaaaagcuuuauucucaguagugcuuuuauguacuuacucuuaaaauucccuuucacgugaauacugagcauaaaagaauuauugggacaucuuauuuuguaccuugggaagagauucugugacaucucgaagaugguugauugcuuagaggcaaggucaguuugaggguccaugguguucugauggcguggacucuaugacugcacagcccucucugcucaauagcugugagccuaggacaaggcaaacaugucauuacucucaggcuuccaauuuccuuauccuuaaaauaauacuuccuguuuucagguucaucuuugggaaucagauggcauaaaaaggcaguaauugugauguagaacaauguuuuacauuaugggauguuugaaagcagagugccuuucuuuaaaggggguuggggagcggcagauuugaugaucagcacccaucacucccgcucucaggaugcugcaauauccuggcuuacaguagugguacuuugccuaauaauagaagauggcagaaguggcugaagaaacuuguaggaacggugagcagaaccugucuuagucacacccaugaugccccuauugcuguguuaguaugcaggcauggaugauguuuuuguugcccugggcugcuggaaccuugccuauggaguccaugucaucugccagcuggaaggcuugccuagaagucaagugugccagggaacccagcacacaguuaaccagggcaagggcaacuuaacucccaauucuuagcacucaaccgaguucacuucucaagguuguagagaauaaaaucucucccuuuaaucugcauuccucugcauuuaaaguucgaaggaagucuuugaugaccaauauuugggguccuagaagacauagucuuucuuuucauuuauuuuaguuuaaacacuuguguucuuugacuuuaaaaguguuuuuguuuauagaaaauuccaaacauauaaaaguagaaacaaauccucugcugagccucugugcucugcagucagcuucacuaucaggucacaguggaccuggcugucuccgugcuuguuccuucuuguccccagugauguguaggaggcccagaagccuguuguccguguguuugaagagaccucuucaguaauugcuucagauuuugcguuuuccugaaaacggcuuagucuucuacugccuuacagcuuacgcugacuuucaucauuauauguuuuuuuuccccacucaaaaaccccaauuguggcuggacauucauaccucccagcacuugaaacacagagguagccagaucucuaugaacgugaggcauccuggccuagauagggacuuccaggccagccaggucuccccuggugcgacccaggcucaaaacaagcaaauaaacaagcaaguacuccccagauuaccuugguauaauugauauuuauaugcaacaagccacauauauuugaaguauucauuuuaguucaguuugauaauuguccaugaaauaaucccaaucagaauagugacuauaggagucaucuugugucaccuuguaaccucugugucucaugccucagaaauuugugauccucuuucuagaaagcacagauucuguggaauugauuucaguuuuagauaaauggaauuauauauuaugcauucuauuuugucucgcuuuuuuuuucauaaugccagccuuuuaccuauucuacagauguuauugggcucccaccagguaccauuuugaaagcuauaaaggccuguuaggaggcuauuauaguugguucugcugacaaaugaugguaguuugaaucagagagguugccauggagaugaugagcugccauucauuagaacucuccuuuggagguaaagcuaauuggacuacuuggauguaaggaugaaagagagggaggaauucagaucaucucccaggauugggagauauuuugagauagucacaaaacugcuguuuaaauauuuuuaaaagcaaagaauagcuucccuuguccaauagaaaauuaugaauuucaguuuuucucucugguguugggauaugauuugaauuaggcuagcagaaagaccuuaggaagaaggggaauauuuuuggauuuuuuucaauguauauugaagugacauuaauucugcuaucuuugacccacagguuucuguuuucauuuuagugauaaaaagaucaauucaaccaagucugaugccauuguugagucagacuguacuuugugaugguacuuuagcuaugguaauuuuauuagaguauaaaacagccugucuucagucuacaaguauuauuaacauaccaugaauuuuauuaggacuuggacaacucuacuugggaauugagcauuagacaaacuagaucaaauguucucuguggauuugaaugugaaguuaugcacuaccagggcuauuaaguucaugaguaccuuugggaaaucugaguuaguuauaaauuaauaauaugaaguaacaucagcaugacacagaucuccugucauuuguuuaauguguucuacacauuaucuccuucagucccuacaucuguccagagaagcugggaugguuauuauuucuguuuuucaaaggaggaaccugggggcauagagggguggcauaacuaucucaaaggcucauucagugucaggagcaggauuugaaccuaguuugauugaacccuugguuuucauccuaagcuaacauuugaggugaaucuugaguuuaaugaauagcugggaguagacguguuaggcagagagaguaaguguuccugggcggcugaugagaagugcuaucugugaguaggaagaacgcagggcuucuaggcagcucucuggguuagcugagcagauacuucacggagagaucuaugaggccauuuaaaggaguccuugacauuuugaauaguuucauaaucccucuuuuuaguuucuuagaggcaaaaaagcucauaucguaaauauguguacaugguaugguguggcugauaucaaagacauuuucuaauuucaaacaacuuguaucgugaucuccacugcuucuccccuuucucuuaggccuugauuuccauuaugaucgaaaagagaagucugcagugguuguaaacugccugaucuucccugcacugcccacacucugcaauggcuuuggggcuguaggccaggauuugagcaccacuggagugcucccacacgcuccauauuuguacaugugacauuuucagugucauggcagaucuuuuucuuagagucucauucauuuauuuuuuuaauuauuuguacuuuguuuugcaauguuuuuauuaggaugcaucaauuauacacaauaguaguuuauauaauaauuauaguauuauaauauuuucauccacaucuagaauuaucuuuuucaccucauugccuucuuauccugaucccaaucauucugauucccauagccccauaacuaguccuguguguguguguuugugugugugugugugugugugugugugugugugugugugucuccaucuguccauccuagugaguuucauuaggguugcuuauugaguuaugggugagggguuuuuuggaagauuguggguacucucuagaaacucauaauuauuuucugcguugacugcauugugcucugcaguacuggcuuguuuauaacaagaugauucuaagugccagauucccuuucuuuccccggcuaggugugcaucuuucuuuuccagcuauguucucagcgaucucagggauccacacugcacuaagaaaaacacaaugaaaaauacauuuaagauuccuaaugaacuauaucugauuguaugcaggagcuccuuauuaagccggagaguuuuaguucguacugcacugaaucuguuccuccguuuuuuacgaaaagaguuugagaaggagcucaugauuagcaguuuuagagccucauacuccugccacuuaaccucuguuuucuuucuucuucaagcaauauuacaaauacuuguuuaaugacuccgcuugguggcauuucaaguuuucuguuuugaaaauguucagauauaaaugaaaacagagauccacagcucaggcuauuaacucugucaauaugguucauucagaggugggacuaaccaauagugaaugugugucuguguguaccucuacauguguaagauaaauuuuuuacuaaguuucuuuuuaucauacugaguggcuauaauccuauuuuaaauuuaaaauuugauucugucauacaacauacuguauuaugaacuagugauuuucuuaguguaguguggguccaugagauccucggaggauaacacaguuggaaaagaaagaugcacaccuaguugagaagagcagagagaaucugccacauaggaccaucaccugaaguucaugaaggcagacugaaacugccaaucugucacugcuuccagcucugaaaauguggauuccuauagacaggacaagugcccuucaucccugagccuagagcacacgugcucuggagucaggcuaaaggauggauggauggauggaugguccaagggagguagcagcagcuguagaucagcuuggucuucuucuaucaguguucagaucaugaaaacacuacaauccuucuugcucuuuuguccuccaggccucccaggaaaugucucucauagcuccccuuaaccaaaagccagaaggaauagaauucugggaauacaguugaguagagcugaggcagcacauuguaaagcuucuccauuuuaauaauuauacagucuaguauaaucaaauaccuuuauauuauucuaaaaauauauuagacuuuauuauuauaauauauaaucauaaaauaauauauuuccaagcgcuaugugauuuuuaccuaaaaccuuuaguaugugccuagaaaagguagaaguuuuaaguaauacuuuuaauucuuugaggagaggugggucuugagaacucuuccuugaucuguuauggaauuuugacugauuugauccugugaaacugagcagauacuugcaacaaccauguccuucccagaagucagcucuccuacucauuugcuagcucuuacuucuuuccaccccucuucuauggcauuucuugagccuuggauguuggcaagcugauauagaugacacauccauagaguuauucguccuaugaacuuugaccaguuaugagucuuacauaagaaucuucucugaccaaagaugagaacaacacaaauccauauguguaagcauaaauauuuagaaggcagugugacaguauagccacuuagcaaaacaaaaucaauaggcuucccuuaaggccauggauuucucaguaauggaguuuugaccaaguauaaaauucuuccuguggagcuggguucauauccaaucagaacgcagcugguuacuccuguaaccaucacuccacuguuggacgaaugggcacaucuugccagcaugucaauauuguagcauucaggguucugcacuagguagugauguuucugugauguuucuguuacuguguaggcuagccaucuaggagagaguuuacuggucaguuugagauugauuucucuauguacugacccaaaaugaguagugucuucagcaauaggcucuaaucgcuuaaagauagaacgacaucaccacuaacccauuuauuucuuuuguuuguauguuuaugugugggcaucuguguguuugugugcacacacaucugugugccaguuuguaucaggaagucagaagucaacuugcaugaguuaguucucuccuucuuucauguauaggucuuguggauagaaauuagcucauaacacuugugacaagcccuauaacaccugaaucaucucacccacccaaauuaguaccuuuuuaaggcucuguugaaugugaguuuuuagggucacuauuuuagacacuuuguccucuuaguaauuuuccugcccuuuuggcaaagugguaagcauuuucauagcaaaaccagucucauauauagcaaguagcugagcagguucuagguccagggcuguguuggcugcugcagcuggauuagccugcaguggcuguuagugcugcacugccgugaagagugacacaguuuucaacugcaacuuuaugucauuggaguagcagagagggaacauuaguguuaacaucuucccauuggugaaugacccacuucuuacauguauuuugacaaaacaaaauuagucuuauauucuagcacauacugugauaguuguguugagaaccgaauuggcaugaaccucuggacugacagaauguggacaaccuccaaaagcagcacaugcagggauuuccaagcaaaaaagagucguaagcgauguggucaucuuauaggguagacguguaauuauacaugcuugcagugaauuccuccucuuuucccaucuucuuuuauguguaugaaugcuugcuugcauauguugguguagcaugagauuguaguacccacagaggccagaagaaggccucuaguccccugagacugagguuccaguugugagcugccuugugggugcugugaauugaaccuggguccucuggaagagucaccaaugcuuuuaacagcugagcugucucucuagccccaagugccuuccuuuuguacauugauaaacucacccaguaauucuggucuaguucuagauguuccugaagagaaagcugugauucgagccuuuauuuucacugguagacuuuacauuuucagcaugccaauuauaacaguaauauuaucaaugugucuaaguguuuuagggucauagguauacccugaacuugcaaaggaauuauguagagucaggaacugaguguauaaaauaccuugaaagauaccugcccuucuauccacugugacaagacuagcaugauaguguacugccccucuuugagaguguggugggcauaguccuuuuaccuuucgucuuuuaaucaauagucuuugacaaauauguuuuuagcuagaaaugggaaaaugaagccaggaggaggauugugcccgggcgucucuuauuuucaguaaacagagcagauggcugugugauuaguuucccuuuugaacaacaaaggaaaaacaaaucguucccacccccacuccccagcucuggcuuaugggaguuucuuggcgcuucuuauaugccuuuuggagaacacacuugauguugagacuuuuaucuuggcagcugaagcgccaggauuuuuaucuccauugcccuuuuaucagaacuucuuucuagaagaaacagacauaccuuuuggcugcucugccugugucuuuguucucuuuacuguuccuucuugccagcauuaagcucucuccaacucccugccuuucugguuucuaaggggaaugaaggccgagagcuucagagcacugguccuggagcaaagccuggcucugagucuucacucuucacuuuuccuuucuccaaagggguuauugaugguguaauacaagauacuuacaacaaugccuuguuccaaacggcacuaaaucuaaaguauuuuauuuuuaaagaaaacuguuuuguuucugaauuacauugacaguuacaugguucugaaacuguguaagggaauccugggugaugcacagucaauuauuagccagcaacaauacagcucacccuugcuaucugaaugaauaaguucaguaauaauaaggguaaaucugaauaucagggcggugaggcaggaguugcugccaugcaguuuauggcauguacgcaaaaaaauacaauugggagauuaaagguagauagcuuucugucaucacugucuucaugcagaggcaggaacuuuuuuuuuccauuuuuauuagguauuuagcucauuuacauuuccaaugcuaaaccaaaagucccccauacccagccccccaauccccuacccacccacucccccuuuuuggcccuggcguuccccuguacuggggcauauaaaguuugcaaguccaaugggccucucuuugcagugauggccgacuaggcaaucuuuugauacauauaugcagcuagagacaagagcuccgggguacugcuuaguucauauuguuguuccaccuauaggguugcaguucccuuuaguuccuugggugcuuucucuaguuccuccauugggggcccugugguccauucaauagcugacugugagcauccacuucuguguuugcuaggcccuggcauagucucacaagagacagcuauaucuggguccuuucagcaaaaucuugcuaguguaugcaauggugucagcguuuggaagcugaucauggcauggaucucuggauauggcaaucacuagaugguccauccuuucgucacacuuccaaauuuugucucuguaacuccuuccauggguguuuuguuuccuauucuaagaaggggcaaaguguccacacuuuggucuucguucucuugaguuuaauguguuuagcaaauuguaucuuauaucuuggguauccuaaguuucugggcuaauauccacuucucagugaguacauauugugagaguuccuuugugauuggguuaccucacucaggaugaugcccuccagguccaucagaggcaggaacuugagguagauuguagaaaguugguaguuggacauuuagggucauggguauucagaagggugugagaacauguacaguguccaggacagagacacauggagagucuggguagccacgggaugacugcuucugucaaauuggacuccuuuccauucugugaggagcauucauguuguccagacuaacaaaugauuuuucucuucauccacagaagggucccacuucugggaaagaccgagugaagaaggguggauccuacaugugccauaaggucaguccaacucugucgagcuguucuugugggucacaaacucauuguaacauacugccccaaaugaggaaaaguggcccaggggaccguaagaggagaaacggcugugaacugcguccuguggagcagauuagcugcugucucuugcacugucgagagacuucuuccuguuggccugugaaacagguugggccaucugccucuuccaugcucaagucuaggaccacacccuuaauuucaaaugucugucuauuucugaguucucuguugagauucaagcuaaaguuauaaauggaggguaguuugugguuuaccaaaauggaagcacccaagugugucagguguaaacgugcauuuuugcuccgugagcugugauuucagaguccaaccuggcaauucuugguuaggcugagugaucggcgccucacaaguaaccuucauaaggaauuuggaaauagaaccugaccuuucuuuuuugucuguuugagucaugcauuuucugugccuugagcacucagcaucugucuucuggcucuguacuaagaagcauuuugcaguuuauuauuaccaaggaucuuugcuugguaacugacucaguccuagagauuucaaaccaucuacagugguuacuacaauuaaguuacuaauuuguaguagagacauuagcgaacuuuaacucuguccuaauucaguggcccucaaacuuuaucuuacuucagaaucaucauauguacgagauaaugccuggcuuuucacgucugccacuaucugguuagaucuuucugcuguauagccuggauagcaggauguuuuaaagcucugcaaguauugaaaacacacagcaaaguuugguaauggccugaagaaacucuagcagacauacacgggugaguuuguagguguguguuuucuacaaguuucuuaguucagaauccuuggccaugugauucaggagggaggacguucauucaguucaacucaauucuuguuucaaacguacauuaaacugggcauggcggcacacaccuucaacaucauccaucauccuucaggagacagaggcagauggagcucugugaguucaaagucagacggggcuagccagcugggaccuugucuuaaaaaacugauuuuuuuuuaaaggagaacauagcugcauuaauauaagauguagauaaguuuaacuuuauggaguccuaauuaauuaauuaauuaaaaauuuugaguaaggggcuugguaugcuaggcaagcuagucuccaccuccccaagcaaagcauucuuucugccugaaacccccauaaaugggaguacagacaugaucuaccuuacagggcucaugucucaugcuguuugucaguuuguuugcuugccugccugccuaccuaccuaccuaccuaccuaccuaccuaccuaccuaccugccugccucccucccucuaucccucccuccuuccuucccuccuccuccuccucccccuccuccuccucuuccuccuccuccuccuucuucuucuccuucuucuucuucuucuucuucuucuucuucuucuucuucuucuucuucuucuucuucuucuucuucuucuucucucucucucucucucucucucucucucucucucucucucucucucucuuugagauggggucucacuguauaucucuggcuugucuggaacauacaacauagaucaggcuguccuugaagucacaaggauccacacaccucugccuucuuagugcugagauuaaaggucugugccaucaugcccagccccucaugucccauaggaaauaaacaauuuuuugaaauuaaguauugagcuacuguaguuguuauauuucauaccacauuaaggauauucaaaguuuuuaaacaucaaugaaauagauuuugcuacaugcuuuuuguacaucuguugaaacaguguucuuuuccuuuuuagucaguuaauacaguauaauaugauaacguacaaugauugauuuccauuugccugguuuuguuuguuaguuuguuuauguauuuauucuugacucagugucucacuauguagccaagacuaaguuugaagcccuguggaccccagacucucacauuagcaccagaccauguccagcuugaccaugucucaccucugagccaucacugcgcucucgcugacuguuucacugagucaugauaugcugucuguguuauaaaguuuagacucaguuuucuagaauguugagaacuuuuacauauaguuaaugauaaguagaaccuuuuuguuguuccuaguaauuuuugugugcuuuugguauguugcuguguucauaaauuuaacugcaaaguagucuugaaucuuaagguguuuuuaaaaaauauuuaauauuaaagaagaguucauguaaaauuaacgucauuucuuucugaagugcuugguagaauucccucuuaaagacauuuggaccuagacuugugcauuuagcccacuuuuucauuacuauaaugaaaacccaaaacaauuacuuuuuuuaaaaaaaagagagagagagagacuugggcuggagagauggcuuagugauuaagagcacugacugcucuuccagaggaccuaaguucaauucccagcaaccacaugauggcucacaaccaucuguaaugggguucuauguacuuuucuggucugugucugaagauagcuacaguguacacauauaaguaaaaauaaaauaaaucuuaaaaauaguagacuuuuuuggcuuauguuuuuaaggcuccaaaguugaggaacaucauauggugcuuauauucaugcuggguccagagauuuucuaaggcaucauaugggaagugaugguguguguguguguguguguguguguguguguguguguguguguaguguuuugugugugcacauucauaaugauuguucuuacucuuuguauaaagucaauaagauucaagcauagugacuccacccaaaugacuuucucuaaucccaaucaccuuccccacagcccucaccucuaaacaacuuaaggguaggccucaccccugucagagcuuucagggauauacucaaaucauauggagauaaaauuuucuuguuuaauagaugcuuggcuuuguagauuaucuguuucuacuuggguacacucugguaauucugucuuuuaaauaaucaaaucuuuuauaugaauuuuugaauuuauuauuucaaucucuguuuuuucauucauuaguuaaaccaauuauguuuaaugaaauuauuaauauuauugggcuugaauuaggucucuggagguuuuguuuuuuuuccuuugcuuuaucuguucuuuuuuauucuuugucuuuuuggauuaagguguuuguaucacuuuauuuugcucuccuuaggcuuguuaucugugacccuauuuuaaaaugaguggcugauguagagccauguuaaugauuaacuuuuccuagucaaccuguagaguacaucuugugaacaguagaaggacaaaacuggaugaaauuagaauuuuuccagagaaaauggcaauuccaaaaauaaguaagaagaaugaauauuauaauuaauuuuuaaaauauaaagaaugugguggcgcaugccuuuaaucccagcucuugggaggcagaggcaggcagauuucugauuuugaggccagccuugucuacagagugaguuccaggacagccagggcuacacagagaaacccuguaucgaaaaaaaucuaaauaaauaaauagaaacauaaagaauguuauaaauuaauuuuuaaaauauuuguuuuuauuuuauauguugaguaauuuaucuacauaugucuguguaaaacuuguguguugaauaccauuagaguuauagagaguuaugagcuaccauguagguucuggaaauugaacccagggccuuuagaaaagcaaccaauauccuuaaccacugagccaucucuccagcccuauauuaauauguaaaauucucugacuagaagguaauauacuuuuggucauaaaucaaggucauuuugcauuguuaaaguaaacucuaauaauuaugucuaguuuuuuaaaagagagugauuuuguuaauuaagaaaaucuuguggguauguauguguguuuauguguguguguaguaugguguuguaccuacauggaugucugcauaccacuuguauucucagugccauggaggcaagaagagaucauuggauccccuggcacuagaguuacuaguaguugugagccaccauguggguucuuggaaucaaaccuggguucucugggaauaagugcuuauaacugcugagccaucucuccagaccccucauuccuaguuuuuaacagugugacuaaguuacaggaaggagauggagacacgaaagagguuuugagguaguacagcaaccaguuaagagcauaggcuaccauucccugaucugccgcucacaugauguggccuuaggcacaccauucaugucucuuggccuuggguuuuccucauguguguaaugcacaugcuauuuauaucuuucucauaggguuauuggaagaaugcacagagucaguauauguugaguugagggaacaguucacauacuaaguacucaaguauagacuuugguucuugguguuguuugguugauaccuaacauuccaauguaggaucuucauuccaguucucaguaucagugcuacccuucuaccagaaugacaaaggacuuggucuagugucauuugaaagagcaaugguacguccuagguucugguaccggcuuccugagacugauuuccuaugagauacaacugccuuaaaaaugcccuuuaucugagaaacaguuuuccucucauggaaaccauauuucugucccacuugaguugaagccuccagggugguaggucauuaucuuaacuggauugguuccugagcuaagagcacauccuuagcacagauacugaggucacuuuuacagaguaauuagccauuuugaugaaaucaggcugaaacaggucccuccuucuacucccguucuuaauuaauagaaugacccauuuuccagccacccaaagaccuaacuuccuuuaagaaccacuuuucaugcugaaaauagaaguagaaaucuauaaagaacaaccagaacauucauaaccaggacauuugcucuuuaauugugucucauuagugacccauuauugaaguuuaagagaacuacuuauuaauacauauuuucugagugaauggauguguguaaguagaaugauaguagcaugaauugacucuuugcaagugcugggccugagcucucagcaugcuuguguguguguguguguguguguguguguguguguguguguguacgggcaagagcacaugcacccuaccgcuuggggaagugcuuuaccaccaagugaugugcccauccccucaccacguguauggugaggcuuucuuuuuuggauucagauuuucauaguuauuugguuaauggaaggccucaggcacugcugugacccaguaguaaaaccuuuagugguugcugauuuucuugaaaguguuuugguauacaaacaaaacaauuucauugcauaaaauucagaaaagaaauaaaaugagaaagauggcaaugaaaaaucagauaucuuaugucuuggagaaaaguauuagaugguauucugccaugaguuucauauacuuuaauaaaguauuuuucaaaauugaauuauuuuguguuauacuccagauuuucaauuauggucauaauaacacuuuguauaucaccagucguuuucuagugucuugugucauagaugcagaauccuuucaacacuguucugagcaggcacuaaaaggucaccagcgcugcugcagccuggcuccuguagcauacagaauaauccaugcaaggagcacggcagucccgugccuuagccucagcgcuguccuccagcugugcuucagccagcauguaaccugcuccugccauccagguagcucacguguacccacagcuggagcuggaagaggugugugucaucuucccugcagacaacucagaaucucagaggccugaucuaagcgggacagugaugcucguuucugugaggacaaggcucagugacagaguguguguccccaaaggaaagcauuuguacugcuugcucugcagacugguuuguugguuucuuugggagggcuuuguuuugguguuuccauuuuugccgugcugaggauugcuugcucgugguaggcacgugucgaacagugagcccagucuccaggccaagacgaguguucuuaugcacuuuuauggccggcuuuauuuuaucagugaggacagauucuggaaggcucugccuaagguuaaauaaccacugagauugggguuuuuuuccuugcuggucaaaagauuagcaaaauguuuauuacaacuuucacuuguucugagcccaaccuccucagacaguggacaugguggugugauucugguuauuucucugcucacauagcuugcuuuuuacauuaaccaucuuuggcuaauuuucucuggaauuccaguuuuccaguucuuugggcaucucaacuccuucucagagagucuuuuccaaaccacccucuaaacagcagccacuguugcuuacaguugucccuccccacuuuuccuuucuucagagcugaccacugcugggagcaguguugaaugcuccagccaguuugcagucugacuccucccuuuaaguggcagcccucugauaacagguuccuugucugucugcucugauugcauuccucaugccugaaauugcagcugccauacuacaagcacucauauauuuaguagaaccuugccaugaugugaucaggcuauguagauucugcuguuguuuugccuaauuuuugcccuuuuugugcuucugguaccacucuuuagccccguaaucugccugccauccuccuuuacaaauugcuaaguaggaaaggagauaaaauuugaaauuuaaacaaagacaguaucuaguaaaaagaagauuugaaguuuaaucucaaaauaaauaaauaaauaaauaaauaaauaaauaaauugcugcuauucaaagugucccccagggguugaugagggaugggaagcuuguuagaaauguacccugaggaccacagaagcaccauggaagcagaugucuggaugucuggguauagccuaggagggguauuuggacaaccucuucagucuguuugucugucucuccccccuccuccucucucuccuccccuuuuucucucuucuucuucuucucucgcuuucucuuucuguuugucuauaugucugucuguucccagaguauuaguuacuuaucuuguugcugugauaaaauaccuugguuaaggcaaccuaagggccagugagaagauugguggguggaaggaaguauauuccaggacugaugagugucauuggauaacuggaguaugcagcacacaaacagaauaaauaacuuaaaagcagcuuaugaaagaaaauguuuauuuuggcuaacagugccaugguagucuaucaugacauggaagucauaaugcuuauagcuuaagguagccagucacauuguauccauagucaggaaucagagaggaacaagugcugggguccagcuagcuuucuucuuuuuauguagucuacagcuguaacauagggaccgauuccacugguauuuagguugggucuucccacauuuguuaaccugaucaaaauaaucccucacaggccugggcaaauguuauucuuuggugauucuagauccuaucaaauugacagcguuaaucaucacaaguucauucugagaaccaugugugucaccuaggccuuccuagagacauugacacacugcaagugacccuaaugacuaacuuagcucaaggcuguugguaaauuuuugaugcauacucauuguuuucucaucugucuguggccuccaagaagccaggccaggaccacgccuagaccugggcauguucuccugguguauacagucaggagaugggugcuugguuguuuucaucguguguggccccuucucgggauaagacugccagaguauucagugugcccccacccccacccuccuugagcuugaccuuggcugcaguguggaauucacugcaugugugugguuuccuagaggcguccugucauuucucagcagucuggugccugugcugaggauucuccugucuccucacacaguuccugccagacauugggaagcuucuguugaugccaaucacacagaugcggaggcaucaccuuauuauuucaagcacauucaagcuucaucuucugucugucgaccugagauugggaguacauucugucccucacucuccacacggagaacugguugcuauuguuuuauuaucuauagaagauagagcauuaugccuuccuuuuuuuuuccccguggggaaaaugcaccagagaauuuccaugucagccucaaagauaauuuuuauggagauuagaagcaucugacuuuuugugaaagaaaagaaauaauaggaauuuaaaaaaaaugucuugcaugcugaccuauuuuuuuucccuucccacaaauuaucucuugugugugaguucccaacuuguccaugauucuuuuugaagugucuuuuaccagcuggcagcaguggguucaaugggcuaaaucuuggcugacgcucauggcuuccaggaugacuagucuguucuuauuucaugcuauuuuugaccuggagaaugaccuucgcaagaguuccaugcaugguuauuuuggaaucuugcagguuuaagaugcugugcuaguaguccacagauacguguccuguauguuuguguggaugugugugagcaggcuguguguuagugguagaagaagacaugaaauggacgguacccuuugcaccagaagucuagacuugcuaagaaaggaagcacacuacaguuuguucagaguggaauccugcuuccuuuaacacuugugucaccuucuguaacuuguuccacuugccugggcguuuacaaucaaaauagcagagaaaagugccugauaccaugcugaauauguccuaggaaagcaaugcccauuuugugugagcauuuauucucugcucuuucacaauuagaaugaaguaauccaaacccuaacguauaguguuauuauuacugugauuuaaaauucugagguauugggaagaaagugauuuuccaacagcuuuucauauauuuuaaguuccuaugauaacuuuuuuuugccaguaugucuauuaucccaugauauuugguucuguuauuaaucuuuuuguugccauuuauaucuguucuuuuuuuuuuuuuuuuuuccuuugagacaggguuucucugugcagcccuggcuguccuggaacucccucuguagaccaggcugaucucgaacucagaaauccaccugccucugccucccaagugcugggauuaaaggugugugccaccacugcccagcuauaucucuucuuauaauguuaaaaauugauauaauaugccaaaaauuagaagcugugcauuaaaggauaaugauugugagugugugcauguuauaaucucaugggucuuuuagucuuuuuuuuagcauaugauuauauagguuagaugauacugcaugcacacacacacacacauacauacacaaacaugauucuuacuuuaugguagccugcugacuagacaaucacauggauaaccauggaagguuacugauauuuugggggguguuauaaguggugguggccuuucugucauauguaggugcuacuucuaagguaaaagauacuggcuggcugacucuuugaauaugcucugcugucuuuugccaagcguacagcacacagaauaucuuaagaaggcauuucaggagcagcucuuccuucagguagcucugaguucucuguaccagguauuuuugugaagcuguaacuaacguaagcccuaagccaaggguuccaggaucucuuacggcauguuaucuguuauaguccuauugcuauagguaccgcugugcagcucgaagccagaacacaccagauagcucugcauccaaccugggauuccgaugugcagccgaccaccugcccaccgcagacugacagccaagaggagcuuuuccagauucaagaaggcguuucuuacucgcagcuggccuccccuggaaaucugaacugaucucauguaaaguauucccaucuacggaggauuccauguccacccaguggccaaaggaacugucucgcgugaccaaauggcuggcgagugucagcacgugugcuuuauugugugguguaucuuuggggaucaucgccauguuuuacuuugaaagccuuuugaagaggagagagccgagaaccaggaaguccuggccagacucugccacagggucagacccuggaguccagcaccuugucugccuugaccucugucuccucaugaaaugagggauggucaacgugaucuuugaggcucucuccaacucuauuugaacuagcagauucuauucgaacuagcagaguguauugugauugcauagugagaauuuaugacagauuauuuuuuagcuauuuuuuugccaugugugaaucuugaguaauacuaaucauauaaggcgagaguuaucuuacauauuauuuucagaaaagggugggguuugagucuuuuauauucauacugcacuuuguucuuucaaggaaaucagugucuuuuacauuguugugacaaaucccauugggacagcgaggggacacuuaaguuuggaguucugaacacacaggaaugccuguggagugacucuacuguccuuuuucuuuugacauuaagugccuuuggcucagagggacaguuugaagccuuguuuccccuuugcccccaagccuucaaagaaugugaaauauguacuaauuagggaaaccauuuaauucuaggucuuuggguguugagguuuugucagaugguaugaauuguauuguaaugcuaaaucugguaccugaaggucuaggccugugagugaauucucacauuuacaagauuuuguugugcaaaccuuguuccuuaauuuaaaacuauugguuaaauaaaauuggcuacagccaauuacuggagggauuagagguagguggguuuugagugugguuggguauggagagagagaggagagaucaaggagagaagcaggaagaagaggauaggaggagcugccaugaagaagauggaccauaagccuuuguccagaggaaacucccaaguaucugggaacaccgcugugaggcaaccaggccagcaguuagaaaaguagauuaggggcuacccccaguaauugucaaagccaaauaaaauauccauagucugagucucauuuauuuguaagccaguuggggauaagcuuauauugguaccacaugggagaaaaagaaccaggaccuugaauagacuccauucagggugugugauauauuacaccagagagauacgagaaaucugguugauuuugcgauaucagaugcuuugaaucauguacuaugucaaauaaacuaguaccucccgacucagacuucacuuuuucauucuuuacugggacucucuuucacauucgcuccuuugugccuuucucuaaacccaucauuuuugugccuuucuccaaacccaucauuuuguaaugcuccugcguuuugcucucuagaaagaggcuaguugauaacuuugauauguggguaguuuguagcaguuuuuauucucuagagcaaggccauucugccaggaacccuguuauacccuugcuacuucuggccacaauacaugauacaaagucaagggcauugccuuggugagcaggugcuuccaaagccaggaaagcacuuuguucagaguaaaggcuuucaacucaagauuguuguugcuagcauccacccagguuuccagaguccugagucccugagcuguuuuucccaaaguucaucuuuauguuaguugcucacagugucaaguaacaaugucaagugaccagucaacacuggguugcuccuauuaccguuuuuacuuuuagaaaguaugugagcacauguguacuugugcuugggcaaagguuggaagacaacucauaggaagcugucuuguuccaccacugugggucccaggaaugaaacucaaguccucagguuugguggcaggcacccuuagucucagaaucauuguaccagcccucguuuuguuuuugaggggucuguagcuuagguccaucugaaauucacuagguugacuuugaacuuuuuguccacccucagucuccuaaguacugggguuacugucaugucugacaguggcuguagcuguguauaaccucuuuauaaaguaguccuauugcuuguauaucuagacacauuuaugaccacuucgugaauauaaaccauuucucuaaaaacuucuaugugaugauuaaucccacucagaaauaacaaacaaacaaagcuuauuuauguaggaaauaaggcuuuuauuuuuaacgucaccauuucuccuguacagcuuuuguuuuuacuuauuagcucccaccugugagugagcgcacacaccaccuguauguuuuccaucauuacauuauagugcauauauaugggucucuuucccuguuaauuaauguuagguagcaucaacauucuugggugguuuggggcaguccuuagaacuucauguuuggcagcuccuagcauguucuaggauuuaagaaccacggaugccgguuacuacaacauagucucccaauauuacagacugacguaugagcaggcaggcagaauguagcaauuacaguuuuguauuucagugccauaaaugugacucugaauaugucacuugcuugucuuguccuuggaccugcucgugcugggcuugucaugagguauaccauggcgacagaagcauauggaagaggcgaccauuuacaucauggaggauggggagcagaaagagauugcaggaacaccucuacugaacuaauuccuucaguuaagucccaccuccaaaaauuucugcaauuuuucacaaauagaaccaccagcugggggcuaacuguucaacacaugugccuggguaagacaaucaaaccauuaagacugaagguuuuuauccccuacaaaaccacauauauccacacacaggcacauacauauaagcaagcacccagcugcacacaggcacauagagacauauauacacagacacagacacacacagauguacacacacuuacagaacaggcacacagauguacauagagauagagaaaaggcagugugcacgcgagugcacacacacacacacacacacacacacacacacacacacacauacacacacacacuucucagauagaggcagacuauuuaggaaacucucacaagcagcacuuguaaaauagguguuuaaggaaaccagaacccuaaugaaguuccuacugccauuuguaacuagaguuauagcucuucagucucuugucucucuauccccuggcacacucucucccccuuuaggauguaagccuuuaaagacuugugcuucuaauggagaccauuuccacgaaaagucaaacuuggauccagggacuagacuccuccucaacuguuuuuuuaugaagcagugucuuuguaguuucuuagcugcguuuucugaugccaggagaguuuaauauagcaggaaauguaacaguuuccuaagcuucuaacuaaaccacucauugcauuaagcaaagacaccuccaaaggacuuuaguuguuuuauuuuuaucuucugaaggucuuccuaaauugauugauaaggcuuucucuuguauugaaaggaaauuugugcuugcuuauuucagaauuuguugcaacuccuacagagcccaauacagcuucuggcccuauacuuacugcuuguuaaucacuuagucauuuugcauuaaauaaauacuuugguagacagauugucagggggacuagguccagcauggaaaaccaguuuguuuaucuauuuucuccuucaguugcccuuauuuuggguugcuuucuaacaguuuuuguuccuugucuccauugauacauagaaggaauuuggggguguguuuuucaguuuguuuuggccuccaauuccugauaauuauucuuuauuuuuaaggguguguuguacauauuaguugagugggaaguggguauuuuaucuuucccaaggccuuagaaaacaugauuagaagggacccagagguggcaggagauggggguggcaaccaagagugacacuuccuucuuguagaauauugaauugcaaauugguugcaaacuucacaggguucagccuauaaacucugagaacagaacacaauucuguagcaaugcagauuuuuuuuuucuuccagguucccaccucuuuuggacaaaacauuucaguugcccauugcucuucaggaaaagagugcaauggaagguggcauuuauuucaggacguguugauuagggcacaggcauggugaaugguuccaaaauagugucagagugggucacuucuguuuccacgucuucccugauaaaugaauguugacauacaauagaauaauggccuugagcccugggaacuccagcguucucacucucuggugaugagcuuugcuaaaggaaucaccuuuaucuucaguuuuccaguagcacuuagaauuuuuuccaugcaguuaaaucuauagcugccauaggacaggggauauuuuggaaacaaacaucacuuccuuuuugucccaaaacuguaggaauuuuauaagaggcaugauagaggguauuuuauuucauugauuuuuuuuuuuuccauuuugaaaugaugcuauacguacaccuuucucuccuccuuuccacggacaguuauccuaacacaaaaggacuaaccugaaggcuagcuaucaggaaaaggaaguguggagggagugggggugggggagguacacaaaacaacaacagcacacccaaaaugucacagguggagcaggcuguguguauguaagugaggcccguucuaaagaggcugagagaucaggcuggaacggcuaaauuguccaaugcuauggaagagcuagauauuugcguuuaaaauaacauuucuuaccacauuuuaugcuuuugugucuaugugcuacaacacacacggaggucaugugugggagucuucugcccugguccuggugcucaaacucagguagugguaguuggcagcaagcaucuguaccugcugaucccuucgcuuccuuccuguuguguggccuaagauggagugcaguuccacauccucuggcccuaaggaucugggguugguuccuggcacguaacgugguugcccacagccaccuggaacuccaguuccagaggaucugacaucuucuucugguaccuauggacgcuacacauucucaugauccagacacaggaagguaaagcacucuauacauuacacacauuacacauggggagguaaagcacucuauacaugacaaaaucaaguaagucugaaaaauggauaaagugcacacaguggaaaauucacuuuaugcagugcacuauacaugggaagaaugacugacccugcagugguacacaaggaguaugugugagagagaaagggcagcagcuugccuagggaccucauuuuacucagaagucucugggaaagcuccaugccuccauccccaccccaucacaccuagaaugauuucccagacuugugugaucaguugauacacugacaggacguuuucaggcccuucggccaucaucgcuaaguuuuccgguuaauaccagcugguaccacaaaugucagguuccucugaccgauggcuucauuuuuauugguugaaacuugcuucuuguaauacaaagucccccagaacagaccuuaguuccacagaaucuggccuuugguguuucucaugcuuaaaacaccauggaaaugauuaacuccgagagccugggaugaaaccuuggcaguuagccagagcugcuuuuucccacuguuguguuuagaacauuagagccagaauuuaauuaauuuuuugauuaagcaaaaucauuacagaugauauuuagguaggcuaugaaguaagaaacgcuagauuuugaaacuugcccuacuugaguucugaaaguucaagggcuuaacaccaagggaucgaaauggccagcuucagauucugaucuguccccaaaugaucauugacccuaaagccuucaucacaagaaggcugguucauugggucuuuggaauuucagaauaauugaaggugagauaaaauggcuguccuggccugaaucuagguccuguuugacaaacucugugcuuuaucugcugaggggaauggaagcuaucagagugacuucuagcaugucaguuuggcaccucacuaaagugcuauucaaagcucagaaucagccuaggagaaaaaugagaccagcuaguggcugccagaggaaaagaggugaggcuguccucaugugcugauaaagguuggccugcauuuuguccaugccuguugcuugcuuucucaaaggcuacaagucuuuuuccuuuaugcacuugccaaauaaaaucuuauuuuucuuuaagugacaccggaaaaugcgucuugagucucuuccuucaguaauugucuucagcaucauguugaaggaggccauugcagauaugucccucuguuccuguccaauucccugagccaccauuaggcagguaacguuguuccucaagguaaaauauauuuagugauaaugcccaccuauggggauuauggaccaaggagagaaugguaaguucaaguguuuagcgugguauacuucaugguuuucuagguccucauuucucaauggcucaguaguuaagagcacugacugcucuucugaagguccugaguucaaaucccagcaaccacaugguggcucacaaacuuccauaauaaaaucugauguccucuucuggguuucugaagacagcuacaauguacuuacauauaaugaaugaaugaaucuuugggccugagcaggaccagagcaggacaggagugagaggggccagagcgagcagaaaaaguaccugaagacagcuacaguguacuuacauauaauaaauaaauaaaucuuuaaaaaaaaaagacaaagcaaagaaagagauagguacagucagguaggacuggucagcuauaguuauaucuauaaacaaagagcaaacuggacuaaggcuacaugaacguguuacucagaugccuauuaauuaacaaguuauauuccagaucccugacuuggcaaaucccuccuaugcccaauggucugucugcugcacaaagugucuauacaaaaggaaaguuggaucuggucuuugccguugucuguaauuccgaagcucauccucuuuaaccuaccucccaaugaaagugccucuuauggggcuggccuuguaauucccuggcagagugcuuaccgggcauguccaaggcccuuaguuugauccucagcaucucaauuaaaggagaaguuacuuaggagcauagcaauuuagcaaagagcaggaaagcaggggcagcaucuugguuggugagaucuuggccagccggugaacuguucucugagcugauuugaguuugguuuaguucagccucaugauuuaaauguauccuuuuugcugugauuacagguccaggaucuccguucuaacuucaucagcucccacauuuaaagguuaagauguuguucaaggggacaauuaggguuugggagaaaggacucacaggguacagggcuuuccuagcucagcaguucauguguuaugguuuggggcucugagcuucuccagcaucaucagggucagugagucagcaguauuuucaacauuacuaguaguaguaguaguaguaguaguaguccccuccucuuccucuuccuccuucuucauuccuaguaucacaugaguguacuauagaauuuucaagagacuucaugguauauagcuucuuuugaguucucugucuuuuuuaggagugagaacuuugagagugaauucucuaggagagaagccaggucccacaguaacuaccugucuuugucuuugaagaacaugacucacccuucuccaaccccucugaagacagcccagcaagaacugagcacaaauuacucuaagaacagcuuaaaugaccuuccaagaagcugccaugcacgucacaucuuccacauagccuuugaaacaucauguggugcauggacaagucucauagcuggaaucagucuaaugucagacucccacaaguguuccacaugucaaggaagguuucucaacauggaagccuucacucgaggggacaauggucugggacccucuguguccuuaaugucuucucuuuaggagauggcuguauuacaaagccaguuagaagggccaggcucuugcagucugaagcacccacuucgcucuucccugcugagguuugacuucuuggugcuauggcuucugauuacuauacuucgcagcuagcaauuucaggcaccuccuaggugcucaggagugcuuaaugcccaugaucuaguuugaucuggagcacaguggugggaggaacuaguuguuuugggucauuauucccagugggcauguaggaaacuaggacucuuaagugucugcaaggugcccuggggcagcugugggaugagguaggcucaggacuuacuguuuuuguugcugcuaugguauuggauauuugacuuuauugugccuuuggugacgggaaacauggauggagucugagaaauuaugaggcugagcaaaagguccguagggagaaacaggcaggagggagguggcugagaacauuaacuucaggcugucaaauucaaugauuuaaaaucuggucccaccgcuuguuagaucuaugacuuugacugaguucaccagcccauuuauggcuugaaaagcaagugaaaauauguauagaugacauagaacccaggcugggcuguuaaggucguauagugugauguacgcauagacccuugacuugccuuaaauccagucccaacuuggaaugucucugcuuugccacaucucaguuccuccagugaguuaauaagacauuggagguuaagaccauggcauuuuuggaaagacacacuuugagcccaucuucccccucccugccaaauguaccacuuauuuuuacaaauaauuagaugacucucaagaaagaauuugucacccgggcagugguggcgcaugccuuuagucccagcacuugggaggcagaggcagaggcagaggcaggcagauuucugaguucgaggccagccugauuuacagagugaguuccaggacagccagggcuacacagagaaacccugucucaaaaaaacaaaaaaagaaagaaagaaagauaaaugcuggaaauaauggcaaccacagcauacauugucagcucauuuguguucaagugcgugaacugagugaaacugacagaaggggcugaaauccauucugaagagcaaggggaagaguguauucacugggcucauucgaagucugcaaaaguguacaguucaguugccuggucuuugugaaacaaggcugaccuuuccuauucucuuaccuccgcugcugggcucaaaauggaacauuguuccuuaagaaauaguuuggggcccuuugcuucuguuccaaaacaguuguaaagaguugagugauagugguagaaagccaccaucagggcagucacaaucacguguauaaucguauuagcgaaggccuucgcuucgggacauauaagggaaggcaaagacuggaacccaguggccauuguuuguggucucugagcuuuuagcaguguuugugggcggcaacauuugcacuuccuccuguggccacauuucagcuguaagguggcugccaaaaguacuuuuauguguaacguucucccucuaguggccagaugggcuuuguaguuauuuauuuuauuguuuucuuacuguuuuuuuaauaaaucgucugcaaauuugaagaaccuuucauuuaggggugcuguggauuuaggguugcuaagaggaagaagcuaaaugagaugggguacaucuucucuugggucaauguucagguguuuguuuuuauuuguuuauuuguuuuuaguuuaugugugugagugucuugccuacauggguguguguacaucaccaguguguuuggugcccaccaaggucaaaucccuuggaacuggagcuccaggacaguugugagcacuuuguggguucggggaaccagacuuggguccacuucuggaacagcuagugcucuugucugcugagccauccucucuccugcuccagcugcuagcuuugugaagaauaggcagaaagagagcuuugaaaugauuccucaucuuuucauuuggaguuuuggaaacauuauuuuucuagcaucccuuauuaaagaaacuugucuuugcaguggguggauaccauuauggagaaucacgaccagucagaaugcagagcuggggagccuagucucagagucugaauuuacugaacauccccaaaccuaaggcucagagaacauggcaggagagggggcagaagggucacaauagauacgagaguagaggguuugcugggaaacugugucuucccaugucagaagcuacacccauaaagucucaccagcaugacugcauaguaaugugaggugagcaacggacauuccaaagugcacagggaaagcccacggggccucagcucuacaggaagaauauuggaaugcugagagcgggagaaaugcucuuccccagagaagagcacaccaacugcuuauccaauaccaaaggucccugaaaacauacauacaaguagcauuauagagucugagcagguuauauuuagggaaauaaacauauaugcauauaugcauggaacaacaauuaaugaaaaauagaggcuauguauuugaaaaagaacaaguagaggaauaugggagggagaaaaggagagaaaugaugugauuauauuguaaucuuaagaaaguauuauuaauagcuaucaaguuucccccagaaaaaucuguauuuuaaaaauguaucauauguaaucaauaccugggguaaaacuagcaacucaaaggaguaaguagagguugaggcagggagacuguugauuugaggcuagccuuagcuauguagagagacuuuuacaaacaaacaauacaacauaaaauguugccccacccccaccccugcucucucucuggugcuucucuuuuauucuguaaguucugaucuuucaaacccauggcaguagguuaucauugucaauagccucuuuccagauuauucuaugcauuuauaaacaguacuacauauguaugcuaguuuggacagaaucagcugauacacacaauuaugucugugcucauacauagaaaugauguggauaguauaaaaccuugcuuuuauaaaacaagauggagcuggguuauauaauuuggugaaaaaacacccgcuuaacauuugugauggugugagaguuugauacccagcacugaaagaaaaagaaucuuuagauaauacuauaucuuauacagcuugugacggugcuguguauugcuguggggauggcucaucuuuaaguucacuuaagguuuguauuuauuuauuuaagaugcauuggugguuugccuguauguauguuuguguggggaugguuaguagaucucuggaacuggaguugcagacacuugugaacugccauguaauucugggaauuggaccccaguccucgguagaggggacagugcuccuaaccacugaaccaucucuccaaccccuccuucuuaaaauuuuaaagugcaccuuuuaaaauauuucauuuuuaaaucauguguauaugcuugugucucuguauaugcuugugucuguguauaugugcaugugaguauaugugcucucagaggccaagaaggauggguggcauucucuggaacuagaguuacaggugauucacagcugccaugugauugcugguaaucggaccugaauccucugcacuucuuaaaccauugggccaucucuccaaccccuagauuauuguuguugcuuuaaauuaugagugugugucuguaugaguaugugaaugcagguaccugcagaggccagaauaugguguuacauccccuagagcuggaguuacaggugguuugauucacucguccugggcgugaaacuugggcucucugaaacagcagcuuuuaaccucugagucaucucucaagccuagguauaguucauuuuaaaacaauugauuugauuuaaacauuccuuuacccuaaguaucugcguauuuuaaaaaaaaucuucauuguuaaaacagcagaccaguucuuucuuauuuaucuuuggcaauuuguggcaauauguugguaggauacauuccuggggcccauaugguauauuaaaacacacaauuauuuuaauagugauggauaucgcuagccuuguguagcaguugacagcacagaaaaggguguacccauguuauaugccccgacacagggacucugcuguacuuucuccuacuuugcgucugagaagagccagcugagcucagcagaggggaaauucuacugcaggguucaggaauagcugucuuagggcuggacaguggugguggugaggaaaucaagcccaggucuucuugugguccagcguacagucuucucagcuuuuuguggcugaaauagcagccugggguaugcaacuugguucacucuugguugcaaaugacuccaguuugcagaaaugaugcccuguuaaucaguuccaugcccuggagcagauucuuuccacccuucccucugcccacaauugacagugaccuccuaaaugccugcaguucuaauacagcuucuccgccugugguuugguaagccggaucccuugcugaguuaauaaaacugacuuuuucuacaucuggcucauucaggcacgcucugaccucaugugccucugagaguuaacaagcauggucugagagucagagaggccucgcaugcuacuuagucucaucauagccccacaccucaucccuugauuccaucuuaggaucugcaggauuggucaccggaccaggcccaacuuguuguacuagaagcgcuuuuuaaagagacuguucaaaauccauucuccugaguguucucucagaggacuuaguuuguuggaucaaaaucaguccugggauuauaagcccgaaguuucuguucuuaccuucuuagcugugaaaccucuugccucuugggagauuagguuguaguaugugugaaaaguggauuugaauuauauugaacccucucucuuacagagaaauggaagggagggcuuccuggaaaacucugcauagagacauuagauuaagugaguuauuccuggaucauucugguggccuuguuauucgggacuuccuuaguuuguauuucuugccucuuuuuugaguagcaacaaaacaaaacaaaaacaguugggaagggucaucaccuuuggcacagaccuguuguagaccccccugggaguuaguacaaaggcagugccagccaaagaaaaccugaaaaccugauauaaguagguuauuuuauuuuaaagugucguguguguguguauguguguauacauguacaugugcuagcaugcacaccuuauuuacugcaggugcauguggagaccaggaaaggauauuagauuuccugcagcugaaguuacaagugguugugagcuaccucagugggcgcuaugaacugagcaggcugugauucuuuucucuagucccugaaaccaaggcuuuauaaugcuucaagcaccaguagcuaccauaagcccuaguauagauagaaacuccucuauaguggcuccuacacaguggcugcuuacuaaauauugcuaaaugaccagagguuuuaauauuuaugugauugaggacaaacuggaucuucuagaaacuuccugaugcuauguagccuuuagguuauacuugccaugugcuuuuguuguuguuggaaacuggaggguuuguaccaugaucaugguucccaaacuucuaugucuuguaaucucugcaagacucuucuuauaagcagguuggcacugugacaagaggugaauucuuacucuguguccccagagcaacauucuuuacgggcugaaacuggggcuggaguauuucaaaugacuuucuucguagauagaaaagaacaaaguaaaaguaacguuugugugcccagcaaacccgagauucagacuuuagauucaccuguccccagccccucagccuccaaugcugcgauuaugaguaugucucauuacagcuggaguuuuauguggguuauggagacagaacacagguucauucccacauuacugaacuuauacuuacagggaaucuccucggaugagcuagcucccuaguccccagacucugagaaaaauuuaaagauauuuuaaaaucggauacuguacuauuauguggugaaaagaacacauuuuuaucuguuuggaauauuaaaaagggaaagcaguauguauauauaaauacacacacuguauuuauauauaaguucauagcagaaauggaaaaaaaaaagccuaaccuguauaaauaaaagcuaggguucuagcuccccuuuaaaauaccagaacucgcccugaucuccccaggucucaucaucccaggucccgcuauuuccuguggggagacaugcuugcccaagucccuguuugaucauguuuuucuuuuugucuccucuccuauuugucuccuuuuaaaaugcuguucuaguggccaggacuuggguuugacgagaacaaauuuggcagaugugcuuuucuggcaacaaugccagccugugugauguucuuugucacuuuuuuuuuccuuuuuuuggguacagccaguucagaacaagaugugcucuugugaaacuuuaagucaguuuugaugguuaaauauucaaagaggcagugucugaauaugaaagcuaccgugcagacaucuuucacuaggaguacaggguugggguuaaaaaucaguguuugugggaagaaguagaaaacucaggucauuuuauuuuacuguguguggaggguaaugugugcacguguguguaggcauauuugcaugcuucagguuuugguagguaguguauacacauguguaggcacaucugcaugcuucagguuuugguagguaguguauacacauguguaggcacaucugcaugcuucagguuuugguagguaguguauacacauguguaggcacaucugcaugcuucagguuuugguagguaguguauacacauguguaggcacaucugcaugcuucagguuuugguagguaguguauacacauguguaggcacaucugcaugcuucagguuuugguagguaguguauacacauguguaggcacaucugcaugcuucagguuuugguagguaguguauacacauguguaggcacaucugcaugcuucagguugaaguucggugccuucuuccauugcucuccaccuuguuuuuugagacagaaucucucacugaaccuggagcucagugacugaccagucugacuagccauugaccacgaggcaucccuuuuguuucugccucuggcacuaagacuugcagucccaugcuuggcuuuugaggcucugggacucugaccuucuggccuuacgcucacauggcaugcacuuugcccaggaagcccucuucccagcaucacaaucaagguuuguuggugguguuguucuguuuuuuuuuccccuuuuacaguucacacuugaauuuugugacuaaaaaaacaaaaaauguuguauaaacucuguaucugaggcuucuuguucucccagcuguuucucuuccagugaugacaaaggcauuucagugcaucuucauguuaaugcaccuguguugguggacagugcagugucauuucucagcuugcauaaccuuucauccuccaucuuguccaucucuuguuucuauccguaucuuuacuacuucugacagcuacauacagauucucauggucugccauaagcagucuuguaucuggucuucuugagccugacaacuucccucugcuggucacucauuugugcaaggugucaaguugacaugugcagguccuguacuauauaggcacccaaagaccauaugaaacccaugcaaauggcucucauucagaaugucuguagauuuucuauuaggggagacuaagugcuuugagaauuaagaaugcuuuuguuuuuuaauucuccaagauguaguagauuagggguucaaaagcauuugccgaauaaauuaugagugcaguguccuaacuuuauaaaucuugaauguaugagaauaauuaacaaacauuugugaauuaauuggcugacugaauaaguaacagaauuuuuaagacuuuauucuuauuacuuuuaaugauugacuuauuuaucuugaagacauuaaggaaaaggcccacaauauaauugcuaauauauaacuuacccugaacaagcaaaaacuuugagaacaauuuuagcaaagcacauuuggauggaguggaugcuggugucuguuaaggaucuacauuuuugagcuguguuugaacaucaaggguugcuguggcuagagcuggggaagacgugaguuggcuccuggaagggaaguagaucuuaugcuguuugcaggaguuagguagauaagggauacacaguggccagcaaacaauucuuacaaaaccccaaaacucaaauagaagagauccaguuauguucagauguaaacgaggaggcacaguuugucuuuguuugguuucuguugcuguacuaaagcacuaugaccaagguaauuuggagaggaaaaaauuauuuggcuuauuugugucucagauuacaaucucuugagagaagcugacguaggagcugaaguagaggccauggaggaauacugcuggcuucucauggcuugcucaguuugcuuucuuuucuaccccaggccuaccugcucagggguggcacugcccuaaguggacuggaccuucauacaucaaucauuaaucaagaaaauggcucagacuugauuaaaggcaaucuagauuuguauguuaccacucuccccuguaugcuguuuaaaugauuuguaguggcagcuuaugaagugguacaaccagucaagugauggagggagguguagagagugggcauagugggaaaacaucauuggguauagaguuggaacgagugauguccuugcuuaguaauugguugucuuggucaauucguaugcauauucaacaugucuggaccaaaggauuaucagcuuagccauguaugacauaacacagauggaucaggucauuuguauuuccccauuuaaccaugguuccauguuauaaggcugggcauguggcugauaaagauguugacaagguaacuucaggcugaugaaauugaugcacaauuaggugguaucagauagaaauaagacgugggaugaaauggcaggaggaaagagagggaaggaggaagggaggaagaaaugguggaguagaauauauuacuagcugucuugucuaguagucauguaagacauaagcauaagggacagagagcaagaaauuacagccauauuugaaaagaucaccagagggaagaaaauaaugaauauucuguaacaaagauggugggggaggaaguauaauuuaaaguaacaaguacauacauauguacacacacacacacacacacacacacacauaguauuguccuuugaaggucaaguuaaacaccuucuagaaaacaauacuguuaucaaaguuuaagguaaaagaaagagcuuuucagugaccugcugcaaugcuauguuuagaaaucuggcagccaccuuaaauaaugauaagacacugaauguuaaaggcagagggauucuugugggaagagaugggaggaauccaaagcugguggccaagggcccaggccagaaagaagcaggggguaaggaggaaaggaggguagagucucucugaguuacuuugauacuuugagaacugaauucgacuugccagggaguuguucccuugucucccugauaagcaucaaggcaaggacagcuugugggagaacuguggacaaaaguguccucauaaccagaugagcgaagccacauacaaggcugguugaaaugugagugaaaguuggcagaaacacugaauguuucuaaauuccaucaucuuugcguaugccuuggcguucaccgagguggugauauuugaauggguaauaaaauaaugaccuucuuggauucauaaauuacuauguaguuucuguaaauuuguuuuucucaucuuucaguaaaaccauaaauuguguuauaacaaauaagauuuucauaguguuauucuaauaacaucaaauaaaagaaaccuccaagucauuguaguucugugcuaguguuuaaaagugagagcuucauucugcugagcaggcauugaaaacaaaccaggaaauuuauuuaucaugcucaaauauaauggggucacaaacaaauuaucauuacuacagcaacaauuuaaucauauaaacuauuacuuuuggggggcauuuucaccaucuuuuaaauaugauauugacaagaaucaauauaaaacuuuuuuuaaaaaauuauuuauuuauuuuauauauguaaguacacugucgcucuuuaaagacaccaccagaagaggacuugggaucccauuacagaugguugugagccaccaugugauugcugggaauugaacucaagaccucuggaaaaggagucagugcucuuaacuguugagccaucucucuagcccaauauaaaauuuuaaaaaucacguguaauccacuauauaaacaaacucaaagacaaaaaccacaugaucaucucauuagauguuaagaaaccauuugacaaaauucaauaccccuucaugauaaaagucuuggaaagaucaggaauucaagacccauaccuaaacaugauaaaagcaaucuacagcaaaccaguagcuaacaucaaauuaaauggagagaaacaugaagcaauaccacuagaaucagggacuagacaaggcugcccacuuuuucccuaccuauucaauauaguacuugaaguccuagccagaacaauuagacaacaaaaggagaucaaagggauacagauuguaaaggaagaagucaaaauaucacuauuugcagaugauaugauaguauauaaaaaugaccccaaaaauuucaccagagaacuccuaaaccuuggugugacuuuaacuaagcaagugaaaaaucuguauaagaacuucaagucucugaagaaagaaaucaaagaucucagaagauggaaagaucucccauacucauggauuggcaggauuaauguagaaaaauggccuucuugccaaaagcaaucuauagauucaaugcaauccccaucaaaauuccaacucaauucuucaacgaguuagaaagggccuggggugguggugcacaccuuuaaucccaguacucaggaggcagaggcagguggauuucugaguuagaggccagccuggucuacaaagugaguuccaggacagccagggcuauacagagaaaccccaucucggagaaagaaagaaagagagagagagagagagagagagagagagagagagaggaaggaaggaagagagagagagaaagaaggaaagaaagaaagaaagaaagaaaggaagaaagaaagaaagaaagaaaggaaggaagaaagaaagaaaggaagaaagaaagggcaauuugcaaauccaucuggaauaacaaaaaaauaaaaaaaaacccaaaacaaaaaccaaaaaccaaaaaacaaaaaaaccuaggauagcaaaaacuauucucaacaauaaaagaaccucugguggaaucaccaucccugaccuaaagcuguacuacagagcaauugugauaaaaacugcaugguacugguacagugacagacagguagaucaaugaaauagaauugaagacccagaagugaacccacacaccuauggucacuugaucuuugacaaaggagcuacaaccaucuaguggaaaaaagacagcauuuucaacaaaugcugcuggcucaacuggugguuagcauauagaagaaugcaaauugauccauguacaauuaucuccuuguacaaaaucaagucuaaguggaucaaggaccuccaaauaaaaccagagacacugaaacuuauagaggagaaaguugggaagagccucaaagacauggguacaggggaaaaauuccugaacagaacaccaauggcuuguauuuuaagaucaagaauuaacaaaugagaccucauaaaauugcaaagcuucuguaaggcaaaguacacugucaauaagacaaaaaggcaaccagaagauuggcaaaagaucuuuaucaauccuacaccugauagaggacuaauauccaauguauauaaagaauucaagaagauggacucuagaaaaccaaauaaccuuauuaaaaauggaauacagagcuaaacaaagcauucucaacugaggaauacugaauggcugagaaucaccuaaaaaaauguucaacaucauuaguuaucagguguagucuccccucccccagccugaaaccugcuugcucgggguggagcuuccugcucauucguucugccacgcccacugcugaaaccugaggagccacacacgugcaccuuucuacuggacccgagauuauucggcgggaaucggguccccucccccuuccuucauaacuagugucgcaacaauaaaauuugagccuugaucagaguaacugucuuggcuacauucuuuucucucgccaccuagccccucuucucuuccagguuuccaaaaugccuuuccaggcuagaacccagguuguggucugcuggccagacacaacaauuggcgaaccaacgcgggacugagaaacggcaaaggauuuuuggaagagacgcugcugguucggagcuccauaaaauaaaggauaagggaaauucauaccggagaagguaugggcuaagcugagacagcguuaaacccgagcgcugguucacuuagguucagcagugaggagcuggguaauaggcgguaggccguagcucuccgaagcuacaugaggugugagaaaagaaaggguuuauuaaaaggaauaggcggauugccccaguuaauaaaagaugcaucauaagggaggaaaaugucccaaaaagcagagagaaauaucucucugggccuuauagcaggaguacucuguucccuuuugugucuugucuaauguccggugcaccaaucuguucucguguucaauucauguauguucguguccagucuguaugaaugaauguucuauguuuuguguuggauaauaaagaugguauaaaaaacuuuaucugcaaagccgaaagcugccacguguuucauccaagaaucagacacguggcgggagggccccugcuagaaaaacuguucguuuuaggaaauaaggucgagugcacagccucuaaguuucagaguaaaaaagcuaauaaaugguucaugauuaauguguuugacaaugguaaaguguuuuuuauuuuuaugguuguaacuacaaaaauuauuauucucugauuggucuaaauguaacugcuucauuugguucuuuuuuauugauaaugugcucugaguguuuucacaaucagcucauaaguuguugguuaagauuaauaauuguuacauugcuacagaugguuaguguuaaauuugauaacucaaguuuagaguccuuccgacacauggcauaaggcagcccaagaggcugggucucuaaagauauuucuaguuuagguaauaauuaaugugguucguauccuaaauaguaaaauuuaaaauaagauuuaaagcaaugucucuuuauuaaagcauuaaagcuugcuuuaauagguauucauagguauuaauugacauccaaacuucguaauaugauaguaaugcuucuaauauugauuuuaaagauaauaaauuguuuuaaacuuggguuuugcuuucccaagguuacagguauuauccuaaccuugcacaaaaacuuaaaaauuaugguuaaaacugcuauuguuccauugacugcagcuugcaguuugacuucaaauuuaagaucuuuaauucaccuguauacuguaauuaagauaauuacaagaguaaucaucuuaugagagcgcucauacagcucacuucauacaaaacugugacagaguuaucuaguuauguuugucuuuguaaauaaauuagacaaacaguuugguuauaguugcugccuggcaggaaacugcaguacgggcaauuuuuucacaacacuaaaguugugaagaacguuuuaacuguaagucaucuuaagaaagaguaucaaaauuuggaggcguagacaguuauauuguuucucuagaaucgguccuuauuacaagagggccaggaugcucagauuaaaaaguauuuuacguuugagucaaugcagggcucugggcagccccagagcagcuuguggccuuucuuuuguuuugcaaacagugccugagaaagauuuuucccuguguucaagagaaauucuuuuuaacaguguugcagaucuauucagauguuuaaaauaaugcuuaaauucaaagaguuuugcuucuagugaacuguaaucacuaaaaaauuuugccucuagguauggcuaauguaacuuuacauuauguaagaaaaaauuuuauuguuucugcuucuauacaagaagccaagaguuuuaaucuuucaguguauauuguuuccuaaguaaaagguauuuuauuaacuaaugcuucuuaaaguuuaccuuaaauccuugcucucacccaaaagauucagagacaauauccuuuuauuacuuaggguuuuaguuuacuacaaaaguuucuacaaaaaauaaagcuuuuauaauuguuauuaauugguaauuaaaaauugguugugcccaaaacaauucuuuggccaaaaagaaaacauuauuguaaagucauuuuucucauccucccagcggaucguuggcccacgugggcccaacuagcuucuguggggcggagucuuaagacacaguuuccccuguuccagcacagaugaucuaguugugugcuguagaugguguuuuaaaaugcuaaacaaucaaaccuuaauuuguauauuaauagucaaugccauaucucugagcucgcaauugcuuaaauuguucaucccucagauacuauuaauucucaaauuuacaauugcuuaugcauauuucuaguuaauaaauaaauaaauuaugcacauguaacucuuaauaacuuugcaagccuucuaguuacaacugcuccuuaagaaaauugauuaaaagugcaauuagucacugccccuuuacagccaaguauuuaaaauguuuugucaacuaguuauuaauucaaagguuuagguauuguaaaauuuuaaaacuuuaacuucuuaaaagacaaaaaagaaagaaauuguaucuccgugcauacuauuuagugcauucccaugcacacuauuuaagucuuaccuuuauuuucaaaaucuaauauuuuaaugucaaagaguuuaauaaaugcuuuauaguaucuuaaagggaucuacuuauuggcuuauagauuaauccuaaaacaacuaccuuauuagaaaagggaaaaacagguuuucuccacagaacgcugcagaagcauauuaguaaauucgugugacgagcugguagguaaguugacucauguccugauuguauugacuaaaaaacuaaauuaaauucauguuuuagauccauccuuacuugucauuuuuccaguuuagacuagcuucuagccuuuuaacuuuauggcaauaguacaucagagacuguauauucagacuuaguaaaauuagucauuuaauagagucauaaugauuuuucuccuuucuucagugugaccagccauucuaacucaaucucagacuggucuaauauucaguccaauguuagagauuccuauauucuaaauuaccuagcaaaguuaauucagagcacaucccccacuuccccuagaucccuaaccucagaaggauugcuggccuuacagcuaguagaaaaagcuauuaaagagcaauuguucacuuaauacauuaguaaaaugaaaggacccccugacuaaugaauagaaggguccagauccaguucuaauuugggguagggacucaguuuguguuuuuucacgagauaaagauagagcgcaguggcugccagauaaauuaauuuguuagaugaacacagauucuaaaucuucuaaaguaucaccuugaggacuaaaauuccuuuuuugcuuaaaagucggcuugaggacucaggcuccgaaaaagcuacucucugagccagcuccccgacaggaggcuggagacuagccucagcuuuacaguuugcauuuaaauaaaguaccuagaguuccccaaaagaaguucugcuuuccuacuuucucacugucuuucaagauuuugucuuucaagcagguaaaucaacauucucgaggcggaccaguggaugugcauccccgccccccuagagcacacagguggcagcuguuacccccagucucaggacauuuccagcacgugguuuucagucugaguuaaaaauuagguuuaccaagagggcuagaaaaguagauauuucuauauuaauaaagauugguuuuuauuuugauagacaggcuuagccccuuagcugaccucuggcuuuucacccuugcuguuacugcaagguguccuuagcucaauaggcuguaaaaaaaaacagggaugaggaggaacgacuuccagcuccuauuuuagccacaaaucgugguguuacuaacgacauaauucuugcuuaggcuuuacuaauucugagguugauaauucuccuuuaggagcugcacaacacucagaacugugcauacugguuugugauuguacaaauucaguaugggcaccgcuuggugcaaaacuacuacaagggaagguccagcuugaccauuucugaguuuccugugagauaaacccgguuuaaaagagguugguaucauauuuugguuaaaaauaaaaaauauuuuccggcucuaccucgccuccccaaaagauaccgagagccacauguguggguuuuaccaguacccacgggaggaaucggguccauguccacccaagccaagguuaaaagcccacucaucuacagaugagaaaaucauuugaucaccucaguuaagcguugccuuauuuaacuuaauuaauaggggggagagagauuggagacguacuauugaaagggcaagcccuucacugccucccacccaaauaaaaaagccaauuggccuuguacuacaagagccggucgaacuccuucucccuguuucccaccuaucauccaaaaaagcggagaaauaucaacuuaguguuauaguguauuucacauuuguucagucaaacuuagccaaaguuccaacgcccuacuuaaaauucaacuagaaaguuaccuaccaaguacuaauuagcauuauaaagucagagccuacagcuccaggcuuuucaguuaguuguucacuaagauaagaaaggacagucuuaagccagauacaguuuaccauaagaaaaguuaaagaaucccagugaagcaaguuuuuucuuuagcccuagauuccaggcagaacuauugagcauagauaauuuuuccccccucaggccagcuuuuucuuuuuuuuaauuuuguuaauaaaagggaggagauguagucuccccucccccagccugaaaccugcuugcucgggguggagcuuccugcucauucguucugccacgcccacugcuaaaaccugaggagccacacacgugcaccuuucuacuggacccgagauuauucggcgggaaucggguccccucccccuuccuucauaacuagugucgcaacaauaaaauuugagccuugaucagaguaacugucuuggcuacauucuuuucucucgccaccuagccccucuucucuuccagguuuccaaaaugccuuuccaggcuagaacccagguuguggucugcuggccagacacaacaaucagggaaaugaaaaucaaaacaacccugaaauucuaccucacaccagucagaauggcuaagaucaauaacucaggugacagaagaugcuggcaaggauguggagaaagaggaacaguccuccauugguggugggauugcaagcugguacaaucacucuggaaaucaguuuggcaguuccucagaaaauuggacauaguacuacuggaggacccagcaauaccacuccugggcauauacccagaagaugcuccaacauguaauaaagacacaugcuccacuauguucacagcagccuuauuuauaauagccagaagcuggaaagaacccagaugucccucaacagaggaauggauacagaaaauaugguacauuuauacaauggaguacuacucagcuauuaaaaucaaugaauucaugaaauucuuagacaaauggauguaucuggagggcaucauccugagugagguaacccaaucacaaaagaacacacaugauaugcacccagaaacucagaauacccaagauacaauauguaaaacacaugaaacucaagaagaaagaagaccaaaauguggauacuucagaucuuguuagaaggggggauaaaacaccaauggaaagaguuacagagacaaagugugaagcagagacugaaggaaugaccauccagugacugucccaccuggggauccaucccauaaacaaccaccaaaaccauuuacuauuguggauaccaacaagagcuugcugacaggagccugauauagcucucuccugagaggcucuggcagugccugauaaauacagaaguggaugcucacagucauucauuggauggagcacagggucccuaauggaggagcuagagaaaguacucaaggagcugaagugguuugcagcccuauaggaggaacaacaauaugaacuaaccaguaucuccagagcucccugggacuaaaccaccaacuaaagaaaacacaugguaggacucauagcgguagcuguauauguagcagaggauggccuaguuggucaucaaugggaggaaaggcccuugguccugugaaggcucuaugccccaauauaggggacugccagggucaggaagcaggagugggugaguuggugagcagggggaggggaggaggaauaggggguuuuuggaggggaaacuaggaaaggggauaacauuugaaauguaaauaaagaaaauaucuaauaaaaauaaucacacauaaacacauguaaagcaauaugagcuguauaauaguuugaaaaaucuguuuccaggcagucauaguaaauacuguguaguuugugaacaccucuugaccucuaaaugagaacaggaagggaaaggcacuuaaggugguguuugugcugaagggaaggauuuagugcauuaaugaacgugauucuuuucuuuccaacccaaacauuuuugcaguucacauuccucuugcaucccagugcagcauccaucuauggugauaauggcucuagccacaagcaucuuacaacauuaggcaaagcugugucuuauucugcaaacagaaaggaacuugggggaauggauggaaguaggcuauaagcucuugaucuugcagaggacccagauucgugucucagaagcaacauuguggcucacaaacaucugugacuccaguaccaggagauccagugcccucuucugaccuccuugggcacuaggcauacacagugcuacacagacauccauguaaacaaaacacucauauacagaaaauaaauaaaucuaaacagagacaaaaaaaccaacaccaggcaaguagacaagcauuuuucuagggccuaaagauauguucaggguuucagguuugagguuccuccucuucccuccccucuucucuccuuuucugaaagaagcauaguggagguauaauuuuaaaaaaaucuccccuuuaaaaaagcacaacaaauuacaaaauaguccugaauagcuccagaauauuuuauuauccuuuccaaacaugcuacuauaucucuagcaaucagcagcccuguuuuuaucaagggucucuaaaggaacagaacuuauagaaagaaccuauucauuaucuaucugucuguugucuaucaucuuuuuauauaaaggggauuuauuagaauggcuuacaagcugugcucccucuaguucaacaacaguugucuaacaauggaaggaagaauucaguaguugcuuaauucaaaaggcuggaugucuuagcugguuuucaguauaugcuggauccugaagaacuauuucuucagaauuaaacauuauaauuaaaucuauaaguaaaucaagaguuuugauuaauaaagaaucccucaaugguaugcccaaccauuugcauuuaaguaaaauauagauguagucaaguugauagccaagaauauucaucacauucucccgaugcugcuguguccagucuuuagcaaccacuaauuugucacagcucuguuucgagguuucuugagguucuacauaguuacauuaaguaaggaaaugcuaaacugccuugcaaaauaccuauauaauuuuguaaccccacuaaucauaugugauguuccaauaucucuauauccuugucaacuuuuaucauggccauucugacuuuagcuguuauaguguagguggagugguagcuguggcuuugacuuguauaucacuaauuaaugaccuuaaguaagcauuuuucauugacuuccuugcuaugugugugugcguauauauguacauauauauacauauacacacacacacacacacacauauauauauauauauauucaucagagaaauagguuuucaaauuguuugcauuuacuuuuguaguagaccuuuacggaacaguuucagauuuauggaaaaacuugagaacuguguuccagcacccagagccacugacugucgucauaccuuacaccccaucuuccccugcuacacguguuaacaguuacugaaucaacacugacaugucacgcuuaagugaagucuggaguugacacuguaguuucccaggacaucacaucacaucuagauguccucucuccucugccuccucuuggcuguggccguuucugacuuaacuuuuucuuuguauuuuuauaauucaagaaaaaaaagucuauuuuggguguuuugcuugaauguaaguguaccacauuuauacagugcugaagggggccaaaagaggguaguggauauucuagaacuggaguucagauggaugcuggaauugaacccaggucuuuuggaagaauggccagugcuuuuuaacuccugagccauuucuccugcucugacuuuccuugucuuugaugacguuggcaguuucugaggagcuauggucaaaaccuuuauagaaugcuucuuuauugcauuuaucuuacuuuccccccucaugaucagagucaggugaugggacuuaugaagaucacagaaaugaagugcuauguuuaucacaccaugagagucauauaaauacauuuuuaaagucacagucaaucaggauccuuaaaucuuuuaaauauuuuuacauauuuuucucugacaaguauaagcaucagacuuauaggcuucagcuuuaaccuuaggacuaugguuuucaggaguuucuuuuauuuaagaguaagaaaguacaugaggcugcgucaguuuaaguuaagaaugaccccaaaucguauaguugaauacuugguuuccaguugcuguuagggaaggacaaggaggaauagccuuguuggaggaggugugucacugagagugggcauuggggcuucaaagacucaugcuauucucaguuuucucugucuugugcuugcagaucaagaugugagcucuccacuguuccugcugccaccucuuugccaucauggccucucauuggaaacg

SEQ ID NO: 3271 - RNA, 828 nt, Mus musculus
agggggaagaggcgcccaggcugaaggcucggguugcgaacuugugucugaacaccggacuccccagguuuggcaagcccgacccacuggguauguccccuaccucugugaacccuucucuuuugacuuguaucuucccuuccuaaagucaggugucacuaggguccggagagagaggaagagcucggauuacugcuucgggaaguuuuuacaagcuauuuacccacccccgcgcgcccuguguccuggagccaagaauuucagaaauccgaggcacaaaaacgccaguguuugcggucaaggauuaaagaaacaaguuugucuuuauuaaaucuggucuaguuuuuuauuggauccugcuagugucugcaugaaaaacuaagucuggaaaugggguggucccugcuauugaggaugcgggguaaucgugugagagcccuuuucugaauucgagcugggucugucuuucgucgcccgguaggagguaaaagaaacgcuacccugacgagugagcaaauaaaggaaccauguugugacuugcugauguugugaucgcgaagcaggaaagaaauacaaaccgcgaccucgguccugaccccgcuucuaagaccccuaugcuccuggaaucuguaaacgcuaaaguaaauaaaccgcaaaccaaaaaaauaagggcuucagagaaaacugcuuauacuaagaugagugcguccaggcgaggcgugcugcaagucuucaacccaagccucugggcugaaauggauuuccacacaccagaaaauaguguaggcuccaggcugcaaagugcauagaacuuuggucuugggaaga

SEQ ID NO: 3272 - RNA, 338023 nt, Mus musculus
ugcaguaaccauguggauguucugcugaagcguuuccucaagccugccggggugggaggagaggaggaggugguggugguggaggagguggaggcagaggguggagagagagaaagcgcacgccgagaggagguguggguguuccgcucccauccuaacggaacgagcucccucuucgcggacaugggauugcccagcggcugcuaaccccucuccugguccugaucccccaaaccggcguggcuccccggucaccaagguagcugcuggggccgggcagagggcgcggggaguuggcacuagcucccgugcgcagaaguuuuugcccugaucaccgggaguucuugguggcuuugguggcuuugcaugcacuuggcguguauuuuggggcuucuuucccugugaacaguuuuggggggagguauauauuuuuuuucaggcuuaaguaaccccaaacguccucgacucuagugaccgguuucaaccuccuuccccguauugaaauggcauucccccaaguuggaaacgguuggagugucugcaggaaauaguuuuuuuucccccuggggggggguauuugagggggucauaugaguucgcucaaggaaauaaucuuucuaaaaauguagcuagcccuguugcgcugcucagcugguaggauaaugcaugcguggggguccccguggguuaaaaaaaaaaaaaaggaagaaaaccggaggaaggggggggggggcgaugaggaaagaaguguggacggagcucgugcccaaugaggacgcggguuucacauacuuggccuccacgcggggaaacaagugcuuugggaucucaacacgucccuuacuuccauccaccuucaauccccauccggcguguucgaaguuucugcgugucugaucuuucuggccagcuacugacgggaaauaagcaugcuggguuugcuuuuauuugggggaaagagaucccuccgacuuagcugcuaaauuuggaggggagugggaucugcaggaaaagcggaggcuauaaaagucaaaacuuggauuugagaauuucugauagacccucgcgagauccccuacucagucuucuuucuuuguuaaauauuuaggagcugauuacaagggaccaggauuugcauccuuggcugggcguccauuggcuacagagugccugaccugggucaggugagugugcgagccgagugcuguagucaaaaauggguuuuuguccuaagcauuuucuaaguccucuuguagcugccauagagguaaaguagggaaaagaaagacaccguggucaaaauuggucauggucuugggugaguaaaggucuagugacagccacuuuugaaggucgcucagaagugaagcauggcggggugaggggggugggguggggaagaugucgguaagcgaccacaacgugcaguuaaagggacuguaaaguggguggucccuuaccagccugagaggagcccucauuaguuuaauucccaaagaugcagaacuuuucaucugccaagaucccuaagcaagagugagauaccccucccuuucacaaacugucacuuuguucuguucgguugugggcaugccuguacccagaaugggcugggcugcaagaaaugaaagugacaaauugaaagaaugagaacuuaaaaacgggaaggaagagcuuaaagaauacuacagucgcuuccaggguuucacuggagccaccugaaugucaaggaacccagcgggcuucucuugcuuugggaccuguuccuggaugaggagcugagggcaggcagcauuucugucaguauaauggcauauuuaaaaccaucacagcccguuucuagaaaauaaagcuucuguagguacaggugccacuaugguuucagguuuggccauuggauuuuguuuuuguuuuuguuuuccuaaaaugucugggaauugaguaaacaacaaguuaauagggguggguggugagcugugggcagcugguccuugguaacuucuuuaauguccuaaauauuuagcuguucccugggcuacaaucuuugggcuuuucuaauuagugaauaaaagccagauacuucauuaugguaguagaaugcuuuuguuuccuguugauaagguccucaggaauacuggcagagcgggaaacauuuggaagggaaggcuaguucuucuguggacuuaagucuauguugauuaaagcuuggggucagccuucucuuugaaguacauuacagacgagguuaacugguccacagacucuucucuaucuuuugccuaaaaauaaugaggcuguuccauuagguaguagcaagccagcugcagagcuguaucccagaagaccuuagauguggguaaagaaaccaagauacagaaugaagucacugggcagcccgggcaguaauguguaccgcuuguguuuaaguuuauggagaacugggcgggggguggggggagaugcuaggaaaaauaguaaacauauugaucuuaaugcauuaacuuauuuaugucuuaccaacaauguacaagcuauucuuaguuugauguaugaagaaaaugauagcgccauuggcagggauaaaagacuguagguauuuguaggaggauuugacguugggcugaauucauuuuggaaagcucuguguugaaagcuugaaucaggacaguuaaggaaaaccagaggaaagccagugucuccgugcagccuuaggccuggcucauaucugaaguauagcguggucauucacaucacggcaccugagcagguuugaaggagucaggugugucucuacgugaauaauuggagagcuuaaaccgcuuuaguuuuaccuguggaauguugguagcuuguccuguggccucuggcuugccuggcaacuaguuguugcagugguuuucuucuccauuccuuucuuucuuuccccauuucuuucauggaugugugcauugcaugaguauacggggcaagcacaaucugcucuugacuaaaucaauucggaacagaaaaucucaucaagauuuccuucuaacuaagcaagggaaguucuuuauguuccaaaugaaucacuccggccucuccaucgaagcccgcccaggaaagucacugaggcauuauuacccaugcaaaaagguggcuccuuuugccagccucccuugaggaaugggaggagcagugguggcuuagaagagaaauagguuagugccacaagaacaaucuguugacuuugcccucaaagugguuucagcugcaaaaacacuagaccguggagguggggugggaaugggacacucuggaacuaauucaauggugugcaaggaaaggacuugagaaaacuucacauggcuucuuagcuaauaaugaucucauggagauucuguucuacuuuuuuuuuuuuuuuuaaauacaggcagcucuuuuaaaacaaaccaaaugaaacaacagauaccaaauacgaacaacagacaaaaaaaaaaaaucuuccaaaauaaaagcaguccuggaguuagguuucuaggucaagcuguccuuggauacuucuaauuaaggaaucuacacaaggacaguguucugucuugucugcuauugguuugauguuuuaaaauaaaaugcauugcacuuacagaucccugauaccuagaauugcaugcaguuguguuagcuuuuuuuuuuuuuuuuuuuuuuuuuuauguuuugcuguugaaguuugaggacuacacuuaggcuugaagucaaugguaugaauuacaguacuuguguggguccuucuaccuguuagaguguccaggaguguucugagaagauuccuagugggaaaggagcuaaaugaacaccugaagccgccaccugguagaccaugagauucccuaggcugcucagaguugaaaucaaagcugucggugaacccguggaccucacugacuuucacccugcuacaauuguuaccauucgugugucucuguguugcugaguccacagauuucuugaauaccugcuacgugccaacugugcucuaggugccuuggguauggcaaugagcaaucaaguugguuccucggggcuuuaguaggagccagugggaagugaucagcgaaaacaaacagguaucguaguauggcaggugcagagaguuguggagcaaaagucaacaaggaggggaugaacagagaauaagcgaguggacaagauguggaaaaaugggagugcuuguguauuguuggugggaaugcaagagauacgucuuagauacaacagcaugguagcuccugaaaauaugaaacagaauuauuauaugauuugacgguuccauguguaguucucugaggaauuugaagcaagaacugaagcaguuguuugauauugaaagugaccucacuaauguuagccuaaaggccaaaaugaaaccccaaaguaucuauggauauaugagcgaaaaccaaagugcucuuuauauguucagggagcuguuaguaagcccagaaaaggaagaaacuugguucccaguguauucaaaccaaggacacacuuuguaacugaaagaagccaggcaucagcagguacacauugcaugauacacauaguguaaaguggcccucaugaauauucagauugauagagccagaauggggacugaugaaguucucaggagcuacagaaaggggaagguggauuaaaggacacaggcuuucuguuuuaaacauuaaaaaauccugcaaauugauauguauuaucuaaauaaaaaaugaaaaacaaaaguuugaaggguguuaaggguguauuaggguugggagguaaggcaggguucuucacuguggugacauugaggacagcgcugaaggaagugagccagauaaccauguagauguucuaggaguccagagcagaaagugcaaaaacccugagguggauggaggugggcauguuggagacagggcucaggaggcuggaguggcugcagguaggcagcagggggaagccuugaggugggaggguggucaggguccaggggcaaaggccggauuuugcagaucagcgcuucugaggauuucugaacccugacaggguccucagugugguuuucauuugcagcauugcugaacuccacugugcucucuaaagggacuggccaggcuggcaagaccacaugccagcuggaaacuugauacagggggcauuagggagaccuagauuucuagacuggucugucaugugacauuuccuggcacugaaguccgcuuaaguaggaaaggagucuccucugcugaagaauagagcuggccuuugcuuugcucaucauguccuaagacccaucuggugguccugggguuccuguggccguguggccacccugcugcccaccagacuucacuugggaaaguccugacaaugagcgccauguucucaccaucccuaggugugagaagcuccacauuaguggauucuccuugaaagagacacccucacaggggcagaacucacaccccucacugcaucacuacagagauuacggguucauugucaaacacugggaagcaauggccaagccacacagcaaaacaaugaaucugucuuagccaucugagacucaguucccaggcuuuucaccauguguagaaauuagggcuggagagauggcucagcaguuaagggcgccaacugcucuuuuagaagauccagguucaaaucccagcaccuacauggcagcucacaacugccuguaacuucaagaucugacacugucacauagacaaacaugcaggcaaaacaccagugcacauaaaguaaagggaaaaaaauaaauacauauuugaaaaguuagaugaguguuugaaucucauaaucacagcaccucccacuugcucucuuuccuuuuguucacaguugcaccucuuuucucacuagccggaagauaccugauaccuguauuuuuuuuuuuccuccaaaagucugucccucugaugguauuuuauuucauuaagaaaaaaaaguuuguauuuugggaguuuugccugcauuuauauaagugcacugcauacaugcccggugcccucagaagccagaguagacacuggagccccugaacuggaguuccagaugcugugugccaucgugcagguggugggagcaaaaccucaguccccuggaaaaggagcaagugcuauugacugcugaaccaucccuccagcccccgggaagagaauuuaaguuaugacauauaugggaugaguagaguacaaaaauacuacauccuccagaguucgucauuguugcacaauccaaauuguccuuuggggaaaaagaaaugacaguugaaguguauuucacuuguaaacucucucaguuguucagaauaaccuaauccugugaaguaaauacucucuucuguuuuuuuguuuguuuguguguuuguucgguuuuuaaauauguguguucuagagauugaacuaagaacgccaugcuugcaaagugacuauuuucagcuauuucccuaccacuguuuacuucuaagaaaacuuuuaccauagaggaguucaaacauaauuuagcaguauguguuguggugccugcaaggacugggaaaggcuucuggauuuaauggaacuggaguuaucgacaguugugagcuguacaguguaggugcugggaacugaacuugggucuucuguaggagcagcaaguguucuuagccacugaguugucucuccaaucucgacaguagcuucuuaccgcauggaacucacuuuguuccauccugcucuguguucaacuauugguaacucauggcuagucuuguuccagcuaccaccgcaaacacuauaugacuauuuucaagcacaucuuagaugcacgagugcaucuguauucuagugugaaucuuuaggauuugaauucuuuauguagauacuuaaugcaaaccuuaaagccagcagcccugggugcucuccuaugcaggugcugggggagggacugcuguuggcauucgaugcaucggaugugaguguuaacucagcaaccuacaacagaucguauucugguagauguagaagcucaguccaugcugauucuuauuuuugccaaaucuguuuuguguccuucagggucacagcauuaucuauuucaaaauauugcccgguggugccacuguugggcauuccugcgcaugguauucuuuaagaguacccuguggacucacagauuuaagcacacuuuguaucuuuguaugcuuuucuuuaugugguuacuguuccuccccccccccccccccccacguuguucaagguuugagauagcguuucacugugaagcccugauaggccucaacuugaugauccuccugccucagccucuggagaucuuggauuauaguugggugccacuguuguuguuauugauguuguuaauuacuaucugucauuguuauagaguuuuugaugucagugagggaguucaaguugcuuccugaaacuuugaacaagaccuugagaguuccaugguuuucuuccuuucugugugaccaaauguuccaggcuucucuuuuguauuacuugucccagacugugagucacccuuuucaucaggaagcccuuguucuuuugagagggaaauaaucacauugagagaccuuugcuuaggaccacuugcucuccucuccuagaugauaaagcagaaauacaaauggaguuaacaccugaauccguucuuugacccuuugucuuuccuucccuccccucucccuccuccccuccucccucccccuuauucuuccuccucuuucuccuccuccaacucuccucccaccuccuucuucuccaaguauuccuccaaguacuucuccuucucuucuuguuuuucuucuucauuuuuuuuuuuuuuugacauugucucacuauuuagcccuggcucuccuggaacucacuauauagaccagccuggccucuuacagagauccuccugccucugccuucugaguacugggguuaaagaaugcaccccuccaccuggcuuaccugaauguuuucuuagagucaacacuuccacaauguauuuaauuugucuguguuuaucucaaaggauccuaaaaauaauuugaacuuaaaaaaaaauucuuucagcacauuccuggauaagcaaaaaaugcuauuuguaccucuuaguggcaccccaccuagagguggggaagucaaauuguggaccuugcucaacuuuuacaaugaaguaggacacauagaagacaucaaguguuuuacggugcuggagauggagguaucuuaggaauggagccuaucucuaaacaccgauguucauuauaugcaucuuaaacgcauagccugaagauacuuagacaguccuucagugguuuugugcauggaaguagucuuaugguguggaauuuucuuuguggugccauaucaguauuuaagaaguuauggaauuuugagcauuuugaauuuuggauuauccuggcuuaaccuguauugaggcugggcuguguuagaaucugcgcuguguaugaugugccccaacaucaaaacaaugacaaaaauaacccacguguucacugcaacaacuaacccucacacacacagaagacagcacaagaggacacgcgggcuauuauuagggucaguauuugucuugcuguuggauucagucaaaaguuuaagacacacuguuuacauuuucuauccuugugggccccagaucagcauuuggcaucaccugggaacuuguuaguaguuggacucucagguccuacguagaccuacuggcucaggguggcauucaguaagaccuucagcugauauguacccauagaugcuggaggucuggccuggaggaugccugcccaguucuauuaguggccuuuuuuaguugcugaguuuucauggcucguucuugcccguugaagcucaucuuugaacauggcccuggcagccuucucucuuucagggagauagaaagacaggcuaacucaccaggcagaauucugacaaaaacaacgccaagaccaaaaaaacccaaacccccccccaagaacccuguguuuacauuugaggaugcuuuuauggcuguggaccuagagguacaaagagaccacaggcuaccugugggccaugaagccacauggagaaacaugugcagcuggguuuuaaaccuacuguuguuagacacuugggggaacugacauuuuagaaaguuugaagacuucuuuccucacagaacuucugaacugcuggguagaaaaauguucucaucagaaaaaucugagcaaggaaaaacagcccaggccuccuaguguccugguucauuugcauugggggaggagcuuugucuggggaauaguuuuauuuuguaaaggcagcuuaaaagcauuccauaucuauuuaugaauagaaaaagacuuagaaacguucauuuauuugccuugucuccuguguguguguguguguguguguguguguguguguuauauucugccugcuguguacuucaccaguuucuauaucuucaagucguccucuuccuuaggaucuuggccaaauuccuccuccucugagcugcuuuuccuuuuccuggaggcuucugucauuugaaaacucugccucuugagcucgguuuucuucguagggguuuuuuguuguuguuguuugcuuaucccucaagaguacugaacauauuggaagagcucacaaaauauuuguugaaugaaguaauccauacuugagauccgcucugucuuugaagguugcagguuaccucuaagaagaaacuaauguuuagucccucucugcugauucaaccuuuuccgaguugucccauuacuuuggaaaacccuuuuggugcacaaagagaugugaaaaacauguagaaauauauuacgccgcaccuuugggaggauuuuaagcuguuguucacuacagcucucuagaggaugcucgguuggggaaugucuagcaguagguagcaggagaguggaagugagaacuggguagugaaaccaacuguucucagacugguuggcucugcucuaccacaggaugggggcuccugcaccacacuccuguguacugcaucuuggauaucaccaaaauaggcaacaucugugugucuuuuuccucuuuuguagacuagguauaaaaaugcaggcugaggggugggguggggcugggagacgccucagucaguaaagugcuugcuauggcaagaaggaagaccugaguucaauccccugagccacacaaaaagugagguaucaugcuucauguuggcauucccaaagcuggggagugggagacagcucccaggaacucacuggucagucagcgugucuuggucaucgauccccagauuaaauggagagagcuucucucagaaacaaaacaaaacacccaacaaacccaaccagauugaguuuccugaggagcagcacucaagguugaccuguggccucugcgcaugcgcacauguccuuucuucccaccugcuauggauuguugugaccaacgaucuauguaagcaggcugggaaaaaaaaugauuuaaaaaaaaaaaaccaagauaggucucagcuaggaggcucauuuggccuugucaggagacauuuuuccuagucccaccgguggaucuugaggugaggugcgugcuaguacccaauauagaggccucuguugagguucauucugcuauggugcugaggaaaaugucucuauugugaaaaaacugcuccaaaagucagucaugccgggguugaggaaccaacccauggucugaguagauuuguagauauaguaaaacucaucucuuaggaaacugacuucacuccauggcucagguuagacaggcagaggacuuucuucugaggcuagugccaacuuuaaaaauguuuaagucacauuucuuucuucuuuccuuccuuucuuccuuccuucuguucucuuuuucuuucuuucuuuuuucuuucauaucugcaugugcgagcgccugcaauggcacguguucagaggucagagaacaacuugaaauaaucaguucucuuucccugggggucuaauuugaguugucaguugugguaaaggcaaaaaacaccuugcuaacccuuuauacuggcucuacuugaccgucguaccaaaauaaacacccuuucucucuucucccaagagcucaucuuggucucugaaggucugaggucuggcacuggcuucucauaagcuauaugaaugacauccguaaacucacuggacaguugaauugacuggcugcuuuuucccauauaaaaugaggacuguuggcucaaugcuucuacccacaaauucucugggacuuuaaagagccaagucugagcuuguggcugccuucuuuuacagcgguccuugagggggcauuagaacagauacgaguacaacaucuuucuugaaaaauaacuuuuuguaggagguguaccaguuuccaguguagacuacuuuagcaaauguguguggaaggccaaauagauuugugagugaaauauccgagggacagcucacuggagauggaauccaggaauugguguacgcuaggaacugugguguagccugggcccuaagggacaucauuuaaacuuaacaguuccucugagcuucagauagagaguaacuguuucugagauaaucuuaaaggaccuuggaacuucugagauggucacuuccuuugggaugggccaaaaacgaaaguauuugaauaugguuuccuauguccugaacaguguuuuuuuuuuuuuuuuuuuuuauaacagaauaaauucuaugguggcaggaaugugguguucccaaggaugguuuuugaugggacaagccuacgugugaauguguggugaggcugggguggcauuguguccaacucaaaagucuucugaggcugguucaacguucacaguacaaaucacauccagcaucucugcccagaggauguucagaaauuaaccgggagagagcccagaaacagaaacagaaaggaaacuuuuuccucuaucuugggaaagucaaccauaaauauguugggcuuucucuacccuggguuuacagucauauuaccauauauguaccuggguaaggacauggcggggagacuucugcuccucuggacagaguuuccuuggccucuggccaggagauugaucacaggccagccacucuuccuucuugggacauucccuuuucuucccuuucagaguccuuauggcuugucuuugucugauucugcccauccuuuaucccucccaccuggagacugcuuaaccuaaaagugacauggugccuuuuaguacuggucccugaccucaguucugagagaucugcuugcauuccagaugcucuuaaacaugccuuuaugcaaaaggcccuucuuaccgaccuaccauuagacaaauuuguugauguuguuauuuuuuuuaaaugagacaacaggaaaucagugcuagaggauuuuggcaagagcucauuauuuuuugugcugcagaagagguauacaagcaucuucccuccucuucugugcaugguaccuuugguuuuauuaggaauagcauggagaauauucugcuggagucggugcuggcaggcuuuuauauguguaacuugcagugugucccuuuccucagacuccucaucauuugaaguugcacggaaggacuuauccucaaccaguucuaagaagccuguaagcaagcagcagauuagaaaggacagaaaacagagaccagcgcugucuccccuguucucucugccgugugcuaagcacacaugcuauuuucuucccuugguuuaaucugcagcaugucaccuuccuacaggagaggaagcugcgggccaggaaacuaaguaacugucaaagugaccaugaguagaggcaggaguggggcuggacugugcacaagggaagaaccugcaaaaaauaaauaaauaaauaaaauaaaauaaaauaaaggcccaugcuucaugcuggcuuaugucccuguggccuggcuccauucgucuaaccuuccccuuccccauuauagcugcaugcuuuauggccggcuguuugguuuugaaccaccccaggcccuuuccugccccuagggccuuuguaucaucacucuuuccuucuaccaugcucuucugccugacuccuaccccucccccuuucccuaggauggccucugucuucacuuuaggaucucaaccuaaaugucucagcuggguuuucucucaccagucagaauuaaacugcugccccauucgaugucgccugguuuuaauuucuguucucucuggagguacuguugggggugugacccagggaauugugacuccgaggcagcugcucugcugaccuacccccaaggcuggcucggauucuuugcauggauguauagugaccaaauccacccuguuuugaucuuguguguuuacugucugccuggacuuggaugugugccuuaggacaggauccuaacgugcguguugaauguguaugucuuuaggacaggauccuaacguguguugaaugucaggacagggucuuucuaaguuuugaccgucuuucagugucuuuguggguugagucacagccaauguuuggccaaugccaaucaaagagaaauucaacucaguauuguuuucaaauucuugggucccacaaguucuuuacaugcuuaaaaacuuuugagaaacuccaaacaccuccauagauauuagauaugagauaugauauauguuagccuauaucuaucauauuagaaaacauuuuuagaaauuacacaugagcauaguaagauuuuuuuuaaugcuaaaaugauaaugcccucuagaauaaaacaaagcaaaauuuaacaagaaugcuggguaugauggaguauaccuuuaauaccagcacuccagaaguaaacagguagaucucuguugaguuucuggccaguaugcucuacauaaacccccucucccuuacgucucugguguugaguagauuuauaaagcacuuuaaggccuaguugaauggaagagucacauagugcacaucugcauuggucuccagucuguagugaugccaugucuuacaucuucugagggucucuaauguacacacaagggacuagauaaagaaacagaacaaagaagugccuugguaauauugugaaacugauuuugcccuuggaucuugagagaaagggucuuggggaccccauugaagccacugaauuaugggacaaaugaacucuuugagauguuggguauggcagggaccuucugaaagagggaggagcugaaggcuuugguagcaugauacaacccaacaucccuaaggcuggaggcuauaucauuucuuccuuaccaggaagaagugcuuuucagcacuuagcaaaacaaaauugcucugagauauuguaaggggguagcgugugucuccguucaguuucuaaggagcagcagagcaaacagccuaggagcuaugcagugggcgccaucauucggggacugagaauagcagcuugaaaauaaaaccucaucagcugccacuccacagcaucuacuggacucuucuugcagcucugggcuacaauaauagucuacuauagagauuagauugucuucgcuguaaguguagcuggcugguagggugcuugccaacaugcaugggucacagaguucuguccccaggacuagggacaagaaguccagugggaauuaaaucaacuugagguuuugugcuucucagucucugcugcagucagagcuagaaggaucaagguggacgcuguugauaauacaguggccugcugagauguuuaagaagguuuagacuugugggggaguauuuuaugugucucugggcugaagcaugcaaggcugucacugggaaggugcauaucagagcaucugugagggacuuggucaccagaaaaugaauggugugcugaggaagcuucuaaaagccccauuuuuaaggucagguugucaguggacuuauguccuccccaguuacugaaaggcaacuguucagcuccgauagccaggugccuucaucuuaccauagaaaaugcuugcuauucuuggcacaaaugugcaaauauguggguuuuuuucuuguuuugaaaguaggccuuauuuuguagccuacguagaccuaaaacucgugcuaaaguccaggcucgaaccugugguuuuaaaguccacggacuggugcuaaguuggcuucuguguuccuugagcuuccuguccacuuguaaggaucuugugacagacgacaggugugguguucuggugacuucucaguuaauaaaaaguguucuaauuuagacuuaguuugaggaguucccaacuuuuaaauucugaguuguguguguacgcgaaaguuaaauuuuuuuuaaaggaaaaguaauguaagugcuauuaauuuaagugugugcaggagaugggaaaaugauaauaaaugagguuuuuuuuuuuuuuuuuugucaucccccccccccaucccccaauuggagcuuuuagaaaaugaaauguaaaaccuaucuggagcugcuuaaaauuaaaugaacauaguucuucuuucaguggggcugugcuucagccuguuuuuacugcaaaauaggagagguuuuuaaauaauuaaauuaucagcccuuugaagagcucucucccauccccccuucccagcagggccucugguuugaugugggaagaagagggagagggaguggaguuguggguugacucucuggguggugugaauucggguaccugggacaugcuguacuggcaacagacaccccaugggcuugcagaggauuuaaauauuuucgggccuguggguccucuccccccccccuugcauuuuuucuuagcacuagcagcuaaguaagaaguguauuucaaggggaaucaucacaagguaagggcauuggagaaagaacguugaagucaguguuucuguuucagcuugguuccgagaugcaagagugaccgucagagccaggcgguaugcuugagcucguucuguggauuguuugcuuuaugccccaaauacuauggaaaguugcaaagaauuccucccuccuuccaccugcuuaguauaagggagcuguggaucagagaagcuagcucuauugcuuaaggacacacagccagagugcucgcauuugagccgguguuucuaagcacacucucuugccagcauucaggagccauuuuggacucgaggaguagaggucaacagggcagaucugagagcaguugucccagauuaaaaagagguugguuucuuguucuuuuauuucucacagaaaucuaaaaagugccacuagauuuaaguucuauguaucacugauccaagaguuuacaaacuuagcuuuaauuaacuuuagaagauaaucgcccccaaagaguaucagcaggcaacuuuggccacagaugagaggccacccuggugacauggaaucccagugaggcugaucaccacauuccccggugcugggcuguuacagagugaggccauugugguccucuccuugugaguuugcagagcugagagaacaagucagacaagugauggggagacacccaggagagugcucgggugcaguggagggaaguguguguaugcaacucagguuugggaggagagugguagcagggcagcagaggugugggaguuagccauguuagggagggaagggagugccauaggcaguaaggauucugggaaaugugcauucuguugagggugggcgggagggcaagcagggcugcaguagauuugggguauuugggguuuuuuugaggugggggucucuggucuaaguuacaaggcugucugcaaacgcuugcacccuccuguuuccgccucaugaauaguuuggacuacaggugugcacgcugcacuugucucugauuuuggagaguuguaagaaaugaucuaguugcugggugugguggcgcacgccuuuaaucccagcacuugggaggcagaggcaggcgaauuucuguucgaggccagccuugucuacaaagugaguuccaggacagccagugcuacacagaaaaacccuguuucgacccccacccccccccaaaaaaaaagagaaaagaaaugaucuaguugauguaccuacaagauuauguugacugcguucagaauagauuaaggggaaacccaugucuuuugaaagauaaguagauguccagguaaguuggauccacaucccacaugugccucaagauaguuauggauuuggcucaacacaaaauuguaaauuuacuuaaaacaugaggguuuuuuuuuuuuuucaguuuuguuuuugcuauaacucaauuguguaguuuuggcaugugaauuuuaaagaugccaaucauaaguugaaaugucagaaggcuagaccuuucaagaaucuaguuaagaaauaaaagggacggggucuggagagauggcucagcaguuaagagcacugccuauucuuccaauggacucggguugguucccagcaucuccauggcagcuugcaccuguccuuaaguucaguuccaggggaucugagacucucacacauaggaugcaagcaggcagaacacuaauaugaauaaaauaaaaauaagucauuaaaaugaaaaaaaaaaagaaagaaaugaaauaugggguggagggauggcuuugugguuagaguacuugcugcucuggcagaaaacccaguuucaguuccagcacccacauggcagcucaugacugccaggaacucagcccuagaggauucauugcccuuuccuggucucugagggcacuaaacgcauguagcacacaugcggacaagcugucacacauacaugcauauuaauaaaaaaauaaguugaaaaaugguauuugggacuggggagauagcuuaguaguuaaagugcuugccauucggagguacggauggcaguucagguuccuggagcccacauagccaccugccuacaacugcagccuugaaagauagagacagaagaucccugggcacagcuugugagacuagacauccuggagacucugggcuugauggugauuccugacgucaaccucaucuguggauguguacacacaugcauaugugugcccucacagugcucccacauacucaaacuuauguacacacacacacaccccacaggcuuacacacaagugaaaauggggaaaaaaagaaaugaagcuggcugagacugacggaagcgaggcgagguuaggagaaaugaagggcuuaguaauguugagauuuaaaaucacgaggaguggauguucaagccaagcucuucagucuuucaucugacagcaccuacucuuauucugugagcaccuacuguaugcaaggcauugcuguuggagauacaguuguguagagagcagagcucuagaauugccuaucccucaagggugucagacaagcaucacaccgauagaugugagcuugugacagaagcaagcugaggagagaagaucucacaggcagaguuuguggaaguugcagaaggauuugucuucacccagugaucgugggaauaaugauugaacugagagccgaagggcuugcuuucacugaagcuaggcaggugacugugaaugccguaaagcuugugaugaugcugugggcaaccaggagcagaacccuagaugcuguugccagugacagaucuguggagauccuaguuaggcaaaggggccagcagagcacacagagaguaucugggaggcagagaacaacauggacacugagugccacucccucugcucuguucuuagaguagaucucuguguuuguguguuuguucuugcccugucccuaggagugcagccaaacacccccuuuucuuuacccauuucuuaggcagugagaagcucggacacagggggugggaacuccaucuggcugcuguggccgcagugugcagaagcaccagggcagcuauccucuacucuggccagcuauucuggaaaaauccuguucugacaggugccuuaggcagcaaucagccggggguggugaugggugguggcgcuuguaggucauagagauggugacacagcuuuauaccaggggcauugcuggugcuugucacagucauguacccaaaccucaagauguauauaguguagagcgggggacagcaggguuuagggaaguugugaauuccuacacugaguaacucgcagaacugggagucagugcuggugcuuugagcccggagccuucugucuuccuguacgcugagcuuuggagaccauacugugucagaguggaaggaaagugguaagccauugugagagagcuaugcagcccucacagauuuagaagccuuugaaacuucagaagacaggugagaaggaaaaguuuugggagguggcugccucccuguggggacagcaguaauugcuguguacuuaagcaggagcugugagcuuccagaggagacuuuuuuuuuuuuuuuuuugcuggauuccagcagugcacaagagacaugcaugaugacaugcuuagccagugguucaagccacuguguguauucagucuauaguucugugccuucagaaaggccugcgggccucaugauugggaguugagagucguucuguaccguucagcuuuuucccaguagaggaauuaggaaggauaauuaucuuucccuaaaguaaaauggaucaucacaggucuuacaggaggucauuuguggcaacgccuagcugacauuuuauuacagaggaaccccccccccccuucauggaggucgagaucuuagauucuuucagaauuagucuuuaucuuuuaacugaagaaaagagcuagcagugaacgcugaaagcaugucagcucgugucucaggcacuuugcauucauggccucaucccuucccuaugacaugucucugaagucuauccccaguguagagauauguacagagguccacaucagccgagaagucuuggugggcuuagcauacaaaaauaccuuacacauagagagucaggauggagucauaggucgacuuagucgacuacuaagccuguuuuguagagcuguuggcauggagcccuggguguccuuguaguguugggagcugcaguuaugacacaguuaggacagcauggcagguugguaccugcucuguuuuucucacagugaccgggucauuguguuugaggacuacugggagcccugcguguggcugguagaggcauacaggcagaaugguccucaaucagauaaagaaguggccucccacccagcucucuaacaacaggaagucuuccugaugauugcugccaggccuacuuccuaccuagucccuccagccccaaacgccuguuguuuugacucugcuagccccgguuuucccuuucaguacacaacugauaauuguuucagagucucuccuccuggcccucuccuaucccugugugccauuaaaggcagagcagcgggagacccagguguuuccaaccagaccuggaagugguucacuuacucaacuuauccaagaaacaaaucacugucugaugccccuggggaugaaucugcccuaaugauccuuaauuuuuuuuuuuuuaaaguugggaccuuuggcagauggcccaguugaggaucauuaacugugguggguguacuggccucuguuuucaggggaaauauaaacuauggcaaaagguuacuuguucaauuaucuugucuacuuaauaagcauaugggcaagaaagaagacgcguacccuuucuucugacuuaacaaaaguguuauauuugacuaagguaggaaaaugaggaauucagcaguaggaaaaaaaugaauuagaauuguccauaaagaaaaaaaauguggagggaggagaggguguggcaggauguauuguaugagagaagaauaaauuaaaaaaaaacauuaaaagugaacaguucuccacugccacccagagaauaagaacaguggacauuuuccauuuucccagggauuacuguugaugaagaagcccauguaagaacucaguagaucucugugccuccugucugacuaauuaucuaugaugaacaugugaaccuuucuguucuucaguuuccccaacaacaaaagagggguggaccuaugucacgccgugccacaugucuggaggauucugagacaaucuuauucucagcacagagguggacacgauaguccuugacaggcguuagcuauucagcuuaaugguggggcugaagcguucaagcuccaagcuacucagagaguuucucaucugcucugaucucagaagcuaagccggguggggucaggcuggaaccuggaugggacaaauaggacugcuguagauucuuagugucaacugaaguccaggaaccuguugugauugucagguugcagguucacucauucugucaugucuugccauugcugucaugucccaggccuuacagguuaugucacacucugcuacuacagaacccuggguuguaucugcugcuuuacagugagagaaacuuucaguaagauacccagaagaggauguagauuugaaggacaauaucaugcugcugcugucuggcuuggccuucaucggagccaaaugcccuuuagaaggauacggccugggaggagagcuuuagucacuccgaauuggcccugcuugucuugccuaagcacauuccugcccuccugcauccagcagcuccccguugguccucugggaggcccguauguacagacacaaauuuggccugacucagaagucagucaaacagaacuucuuuucuaauaaccaguccuacagcccuacagccgggagauagcuacauagcagagcacuggcuuagcauaucaagauccgagauucgauccccuagcgcagaggaagcaaaacaaucaucuugugcuuuuauuauacauggucucuggccucuucauguaaaauuaucacaaugugggguggaggggauggcgccgagguagagcacuagcccaguauacauagagcucuggguuugaucccuagugagguauagagugccaacuuuaaucucggcagagaaucugagucaguagucucucuuguguucacggccagccugggcuacgucauaugaugcuaucucaaaacguuuauaaccucucucucuuuucuuuucuccuuccuuccuuccucccuccuucucuccuucccucccucccucccucccucccucccucccucccucccucucucucccccucccucccuuccccccucucuuucuuuuucaaaagaaagaaaauauuggucccagaaguauguuaacuuucuggucauuuaugauaaugcuuuuaaauagaaggaccuaaagugcauuuuuugggggguggagggauuuccauugguauuucuuuuuugcauguuguucaaaacauugguuugacucuagauacaagggccuuaggaagaaauagcaguaugagugacaggguucuagagagcaguagcuggcaucuuggccccuccgcaugcuccuuggguaucuucccuccagaucuggagaugggaguugcuuugucugagaguugauuauguucucgguugcugacucuucuauaaauaagccugagucuuugucucuccugaaguguccggguugucagagcagugggcagcuuuccccguagcgccucacagucagggaggcaggccgcuucuccuaacgguuuccuugccgcaucuggcauuccugccgaaggaggagagugcuuccagaaguuugccugccgaggaaaacuuggcacccagagaagagcugaaggggagagaggacauuuuccccuuccgcaucauuacaacucuuguggccugugcaguaaaugauuuauuggagucaguagaaggggaaagguuuccagagggcucugggcugagaggaaacccccaacacuucaugcaucaacaucccagaugcagaggaaacgcagggaagcucugcaggccccaccagggccgcugcucuccucauagcugagcgcguuugcuaaaggucaguucaacggcuugcaguuggcuccuguuccuccauggucauggccggggugaaagauguuguuaggaaucacuucaauauuuuuguauauacauuguguguguguguguuuaauaguuucugggcuuuguagagauuuccuggaauagaggaauauuuuucuugaauuacuucuaccuaaucccagccagggaaucuuaguauugauuagugccugaaucggcauguuugggccuggaccuggcugggcaggggucuuacuacauccaggaguguuuccugguagagaaggcaaaacugaugcagcauuuguguggagugugggcuaucggccuccgaggcauugugauuaucacucagucccagguuuccuuccauuaacgucaucuuguugcuuugauuccuuaacccagcccccauggcuuugccagagcuaaguuuuuaccaggugcuuccuuugacuuaccauucccugaggcauguugaauauguuaaugugucacacgucagacuucccagcuccuuaaucacuacagaguucuuggcuggguucccuggugucugggcaguucaguauuagggaaggguccucaaagcguugaaucugaccugggcguggccuuguuagaagccagugcuaaugugauuggaauacccagaacuuuaauaugcaggacagaauguaguugcagauguccucacuuggcucauggaaucgccugccugucaaacgccuauuuaaauuugaauuuuaaguaaugcgcugggggaaauugagcuaagccaaaucuuagugacauuuuuucccccucaucaugucucuucugcuaacaguguugcauguuuuacuuugucuaggcuuuccaacacggacaugucugacaaaaugucgaguuuccuacauauuggagacauuuguucucuguaugcggagggaucuacgaauggauuuaucagcaccuuaggguaagagcauggaaguccugaugcgucgggguuuguuuaagacaucauaacacugauuuguguaagauaagacaguuaucacauuaaguggcuuuuccaaggcugcuugaaagcacaguuagcaaauccugcguuagucacuucaccuuucacacagagacauuucugucaguuucgaaagaacaaaaccuuuuuaguuaggucucuauucacuuugaauguauuauaaucuacucuucuuauguaagagggaacguacuuaagaauagagaauuuaaaaaaaagaauagggaauaauaaauauauugacuaauauacauagauccaaagaagugccucuggcuuugugcaaaagccuuuuggcuugucuuuucacacaagugcccggguguaaucggagccaagaccauuacugcuccucugcccaucucucaccuuugaagcagacccuuuucugcuaaguaaccaagcgcacuuggaaguuucaaauugcacuaaguucccuaaaacguuuucucuucauuugugcuuccuccaaucagucaucacucaaccugggagaauagaaacacaugugugccucucggcucaguuucccuucucccuccuguuccugccaucugagggaggaaguguaaaguguaguagccccugaagucacgcagaggcagaaugcagcaucaagauggcucauuccagaauaggcaggaguggccuagcgucuuuguguaggaaggaguagcuaggcccggguggcauuguugauuuuggcaagacguagucucaaauaaaugggggcagaaggcaggcuaacagauuuuccaaaaaccucauucuuacagcagccagaauguccgcuguaauuacagcuauuacuggaagcgugcuuauuuucugguauuugugcagagugaguguuguuaagggcucauucaggguacucuauccccacugaggaaauuauuucagauaacagaauuauaucucaguuagaccuguguucucauucuagagaguuuauuuucagaagucaccauggcuucuuccuaugccgggucucuguguguaguugaccuuacccugaacguuuaucuacuguggcuuggggcaaacaggcuuccugcuacucuggccucuccagugauggccaucuuggcucccgccuuucucuuuuuauucccugugguuaauucaccccauucuuauuuuucagcauugacuucaguacuguacagcagugguaagcacucugagcccgguggguguucacugugugcuguucugaguccugggccucccuuauuccccuaacucccaaucagcccucuucguggugagcacuggggucaucugucaucaguguguguggaaacgacaccugagugcuucgggcaggugccugccugcccaggucucagagcuccaaaggcucgggucuccaaggccagggaugcuaacacauaaccuuuguagggcagguuuuuucugguuucccugugugcucccugaggucugggugccugucagaccucagcuccaucauauaccugcuuuuccucucucuggggccucugaccuuauaguuaacuuggcucagaugcugaggaccccccuccccccagccccuaaaaucuuagccuuggucacaucuucccuuucagcuccauuauuuuauuaucacauuauuauuuugagccuagucugaccuuaaacuuguaguacuccugccucgguuuucugagugccaugauuauaggugugcaccauucuuaaaauucuuagguguacauacucugcuuugauauuuuucucaagaauuauaugaugacucccucauaaagcuaggauguauguuuuuuaaaacuuuggaugcuaauucuuccuucaguuuucaccuucaggaauagcuugcauaaaaccuggcuugguuuggggagaaaaaacccauugauuuggaaaguuaaauuugaacccucuuuccccuucuuugaaaugugcuuaacauuuaaggaguaccagucauagacacgagugacugucagucuuagugggacguggugucuggcccccagcucuauccuguuuauauagacuauuggggguugccucucaguaacuugacaccuccauugaacuuuagaauucuggcaggaccuuggagagccaguguauguguguggaucuacacuaaccuuuggugugcugcugaaccgccucuggaacuuguuaagaacccaacuucuuagaucacuuccuagagcagagcuucagugugccugggcaggagggauggguuuugauggggcccccuggaaccgguauauuuagaaucaguaucuaaauguucucugaguugagaaucccugagaacaauuuguucguuuuacaaaugaaauauugagacaaggggagagugaaauggcauacugucaugccauuagcuggcaucucaguguuauuuacaagucguaaucaaugaggcuguuccuccuagcauuuccucuuauuaggacuuaaccauuaguccagcuuugcauuauguauguccugaggggccaaguccagugucugauacauaguaaguaaguauucuaccacugaacuaugucacuagcacuggaaucugggcccaaccuuuuaaauauugggucaacuuuggugaccuuccugaacuuauguucuaauuccagagcccaggguagagauuuuucauaugugcacauuauacuuuucauuuuuguagaaaacccucaggcugcuugcugaccacacuguauccuguggcucuuguaggugcauaguuugaucuuguauuuugagggcaaaggugggauacucuucauacuuggauucacuucccuugacagacacugagcaucacgaugccuugggcaucuucugagccacaaaguagggaguccauugcauugucuccauggagcuugguugggacaguggaggaggagaagcaggccauuuuuaggcaagaaaggcuugugugggguauaguuuccuuucugaaaugaggauuagaaucagggcuuugaaugcagggcaguuuuggaggaggggucaaaguugaauauuuaauggccccuggcauuuggaauaagaggcagcauaggccgaaggaagaaguuccaaagauccuagcaugguaccugggacaaagucccuugguaauguguaaaaugagcuggcucucacaguuuuaggaacuuggaaaagucauguaacuucauagugucucaaaagcucaaugaugugcauauauuuuuagugauucuccuaaaaagaauuaugcaagguaaauugguuuuuagugaaaucagaauuugaguuaucugucuuuauguaaucugggacuauuacuuauuuguaacuugauugugcuuuugaaacuccaagcucuuccaauuugcacuggguucccuccaccuaaagaugcucuacucacuggguacucuccaccuaaagaugcuccacucgcuggguacucuccagcuaaagaugcuccacucacuggguacuccaucuaaagaugcuccacugacuggguacucuccagcuaaagaugcuccaguuuucaucuccccaccuuuguuuuggcucuuucaacaauuccgauacauuuucuuccguccaaagcuucagaaggcaucuggcacagaugacuccugccuguucuuucuuccuuccuagauuauaccuuauuuaucaguuugcuuuuauggcuucuauacuuaggccuugagcucuuucagggccgaggccuggcucacuuuaguccucaugccaggacuugguacagucccuggcacagaguuggcuccucgccaacuguuaggcaaaugcauuaacgucuuccugugucuuccagacucagcaguauuguaugcugugcgcaaaucucccacagaugugguucuggggaaaguggcugcagagaacaguaacuugaccugccuaucacagagugcuggcccuuggguuacgauuauuucacuccuugcacaggaaaccuccuuguccaagagcucccugccagagggacauggcaguaucaauuuugcauaggaaaagcccuggacuccuccauuuuuacauacuguuuauugaggguuuuauuuuccuaggcuuguuuuugauacagcauugauuuguuuuucuuuuugcagcuugguugaugaccguuguguuguacagccagaagccggggaccuuaacaauccacccaagaaauucagagguaaaguuguggcuuugauggagcggucaccuucacuuacuugauuauuuagaaaggguguugcugugccugugaggccagcugcccucucccccgccuucgccccgcgcuuccaguccuuuauccuuuucuguagcaaccuuaggguuauuuacuugaaaucugauuuugaaaaagauacuuaaguccuggcuuuaaaacuucucaaaaaaauguguaaauaaauucucagucaagauuggcauggcuuuuauuagggccuuaguuugucuacagaauaaguauugccaaguucuaauucaucugaaagcuuuucaucagcauagcuacgucuccaaaaaaaaaaaaaaaaaaaaaaaaaagggauuuaaggguccagucacaaggaacauguuuuuuuuuucagcagaucucaugaucccucuuagggccuugcuaauucuuagcugccuuaccuggaaugagacauucuugcuuaguguacuuccacuugagcuauaagguacagcagggcaguguuccuauuaauguugccuucuaugacccugaacuuguaguuuuucucagaagguaucucagcuuauugcagggaguauuuaaauggcauuggcaucuuagcugccacggcuuuguuucugucuccuguugugacagugguaggacgugguccucuguucgagccacaucuuagaauuaucugaggaagguuuucaguucuauagaugcucuggacugauggucgggaacuguuuuuguuuguuuguuugcuugcuuguuuucagaguagaaucucacuggguaguucuggcugcccugaaauucgcuguguaggcuagacuggccuucaacuccaccgcccucagucuccugagugcugggauugaagguguauaccauugcaccucgcucagcacugacguuuuuaaggcuuccaaaaugguuuaaaaauuacauuguuuuguuuauuaauuuugcgugugugcacuuguggccaucuuugggugaggccagaggacaucuugauggaguugguuuucuccuuucaccaugugaguuucaaggauuagacucaagugguuaggcagaaccagaaggcauuuuuuuuuuuaaaaucccuuacaaaaaggagaaaugcaugcuuauuggagucccacugggaguguaugguucagaccccugcagacuaaugucuguucuauuuugagugcaaugccuuaaccauugggccacccugcugacaaaacugauucuucuugcuagugggccuacgcaccgacuugacugguggccuggucacagagaguucagcuuuugcuguuugcagacucucucauuugaguucuagauucuccauguugacugauuuagaaaauguuugacuccucuggaugaaagcuaaagaaauuaggaugcaauggaaggcagacguucggguggaaaggagccaucuggaugcauggugguguugcgcuguauccaguuggcacgaggcuaucaggagaauauuuucaccugaagaugagggaaaacuauuuuuaaaaaagugaaucucagaaacuugaaggagcucuugcuucugcugaguuuuucuucacaacccuuccccgugucuccuucuaaaacaaaaucuucaguggcgccgaaaugaaagauguuaucuaauggccauaaugucacuuagagagucaauuccccacccaguguugaccauguuggucacugggcugaaagaggaugcugccuguguuagcucgguuggaggucagaucuccucucuacugggaaaggauuggcuagauucuuaccucgugugucaccugaggucacauggcuagaggcaggagcguguagggguuuggaucucaaauuuggcugcacagagaaaucacccagagagcuaugaaaagcacugauaacugcucccacccaccgcguuccugaguuaauugggcauugggauuuuuuuuaaagcucccuggguaauucucuugugcaaccacacuuaagaaccauugcuaauagcuacaagcuaccgacuuccuugcugaggaaagggcuaaucuaagcuuggcuuuugcaccugggacauugagaagugaugauugucagagcaggugcuggauccagggggaccucuuauuccauccuagccucgggggucaagcaggaagagaauuuaauguaaugacuaaaguaagccaauggcuauucagcauuguuuuaaaaauauuguuacauauuaaugacuuucauuucuaagucaucauguaugauuugaaauuggcagaccuugcagaauaccugauuuggucuaacuaacauagguuucuucaagucacuuuuguguugugaggcguacaaguauucaguuuguguugaugacuauuguuaccaugcugugcaauaaauccucccaucuaagugagaugcuguagcuuuugaccaauacccuugccaaccugccaucuuaaccccaggucuugguaaccucucuccuacugucugccucucugaguuuaaguuuuuaagauuucacuaauaagugagauuauuauacaguauuuuucuaugccugccucauuucauuuaacaucaugucccccaggguugguugguugguuuguuuguuuguuuuaucacaaaugaucaaguggcuguuuggaugcagggugaggacauuaaaguaaauaggacugcugcaaaggaugucagaagguguguguguucccugguacuagggucagugugggucucacuuggaugugucucuggugucugauuugaagagacuguuuugaaaucaaagcauuagucugguggaggccauuuggaaacagucaaucuccuuucaugucuugacuuaguucuacagguaggaaccaggcagugacuuggcuuauugacuuucuagguaguuucuaggcugugaacugcuuugugauaguagggacaucugguucaaaaucaguugugcugcaggcaucaugaauauaggucagaaguuccuaagcucugagugcuaagguugauugcccugcauguagguaagaagccugggaaaucugccucugcaggcugugggagugcuggagucuucuccaccaugggacuugggcaggaagcauuuucaacguuuuugaaaacaucucuucagcugugguguagcuugucuaugucaagaaguccuccacguccccacaugaaggaaaaagaucucucuuuuggaagagauuguugucuuucuaacuauaaguacauuuugacgaacgagaucauuuugcuggcuuagaaacugcgccugggcagaugagucguuugcagacggaucuggucaugguuucgcucauggagccuuugcaacugcaguugaaacaaacacguauggaaaaagagaugcuggcgagcagcuugaugggaugaugaagucuuuauccaaguaaucagcagagcuaugcugagucacuugggucugugcugguucucauugcuggcucaccaacugauuucccauccugagaaccauuauaaacugugcugcaguaaauggggauuggaaggagccugucuguugucugcuccccuucacuucugacuuuggggaguuccuucugagauuugcagcccugauguuuauccauacagaaccuuagaccaacgagccuuucuggguucagagcaaaguuccaccgauuuuugccuguaugacccugacuaaagucaccucuguguaccuggcuacaacaauuuuaauaaaagauagaugcgugugaagaaugcaguacuagucagaauguuaccaguugugacaagguagguggaccuggaagacacuggggcaaugaagcaagccagggacagacagagagacaugaugcuuuuacucauggggaauccuaaaaaauuaccucauaaaaauuuaguguaaugagcuguuggagggcaacccgggagggggauaaugauuggacuguuaaaaaaagauuaaagauaauuuuuaaaacauugagaguaaaacagugguuaccagaggccgcagagggguuaaaggaggaaagaugagagcgauuaguuaguggguacaagguuaggagaaacagguucuguuguauuuuagcauagacuaggguagcuauggcuaauuaucacauagaaagcauuuagaaccaccuagaagagaugauuuugaauauuugcaucacaaagaaguuauaaagggguagggcaugaccccaugguagaauucuugccucagaugugagggcguggauuugaccuguuguagcacaaaaagaagagaguaaggaaaccauaacuauguaaggugacagauaagcuaagggcacugauuagaguccuauaaacaugaguugaaacaucacauuguauaccugcuaggugucaaagagaaagcaaagcagaaacauaaaaugagaagaagaaaaaaagaguaaugcaguacuuaguaagucuucaucaugcuuaccuugucugucuuaccuuauccagucccuagauggaacccauaaucauaaauggcaucagaaggcaugacuccuucagugacaugagcauugucuaccauucgucugucugucuuucccugucucgggccuaggguguacacaggacuucccagccuagauuccagggccauugcugcuguacagguugaguguacuugagagacuaauuuucugagcuuguuugcccaucuguagaauggggccgucgauguuuccuuccuuacaaagguaauagaauugaagguaguguggcuaaacauagugcguaggacggaugguccccugguccagucccauagcuucucuuuuggacaguagaugcagaaggaguuaagcacggagugcccuugcuucucucugaugcuuucaaguacauuuccaaaaugaauuucuccuuucauguagugauuuccuuguccauaucuccugacccccuccccaacccccaaacugugugugugugugagggaaacuuguacaucuguuuccuauuaggcaaaucuuucucaucaucugcaugauuaugaauugugucauucucugugaugacaagaaauagcugagaucuggagucguuaggguaccuuguuuuuguuuuuguuuuguuuugucaguaugcuaccauaugaaagugcuagagucuaugcacaguggggcagaaucacuguuuucucugaugggaguuagcuuugcccauaauauagaaagaauaaggaagacaaacaucagauugaaaccaggaauagaaacuuuguggucagugaauuccuuucucuguauuaucuuuugcucuucccaucccuccacauuucucccccuugaagauacuaaauauaaaaagcacuuucucuaagggaagauggaaacugacagccagaccccauuuuccucucaggccucugcuccuuucacaguaauaaccuccaggguuguuggaguagaaagaagggauugcaggcuuugagggaaucaaacaggcuuguagaauugguuacaccaucuauuguguaaucucuuuucuacacuggggcaauggucaaguuuuuguccuuaaacuuuucacuguacuggaaccaccuuggccucagagccuugaccuuggacauauguuaccguaucagcaucaacugaacugcagcguuuagauuucuagaaacuguugagcuucugaaagaagcuguuagaaguuuacauuugaggugggaagccagccaugguggugcuacauacuggacuccagcacucaggagacugagggaggaggauggugaguucaggccugccaggacuacagagggagacccuggcccacagaaggggagggagaagaaggacagccggguaagaagggguaggguaggagaaaggggaguuggaaagggaagaguuguagugaaggagacaaacucauauccaugaauggggcgggggggggggggcugcaucaggcugcagugugcaagcagguucugggugucuucccugcccuuggguuccuuuguugucccacagugucacagaucucaaaaccuguuauuccaccuaagcugguguaugacuaaggcaacauugugcagcagcugauggcuugccuggucgggucaggugguacaaacagcaaguugaguugaacagucguugccuuagcugggugugcuagugcaaguuuuaaucccagaacaugggaggaagaagguagcagguuuauguggguuugaggccuaccuggucuacaaaucaaguccuggauagcuagggcuguuacauagaguacauagagaaacccagucuggagaaacaaaaauacccccacccccaaacaaacaaaaccaacccaaaaaagagccuuaggguuuucuggagagacugacccacuacauuuaucacacugauagaucauccaguugguacaaagcauuguccugaugaaugacuucuuucuaaucuugcugugcaauccacuuccuugcggcaggucuuuauguucccauuaugcagaugagaagauggaggcuccaagaaguugaguaacugucucauagacagucacuugcccauccuaggcugguuaucauuuacuccacaaacauuuauugguuuccuucuacaugcagcuacaggccauuuauucuccagggacaagaguuaccagaauucucugggaaggcaucuguucccacaccacagcaguuauauaugcaaggggaagagagccggcagaguacuuuccuaugggacgggggcagaguagaugaugcucuacauaugugccuucucucuggcucugcagcaccuccccagaucaggacacaucuguuucauaccuaaugcuauuuggguuaacagauguuaggaacugguccagugucaugucacgccugaaugccagaguccugagggcugacccuguccuuucccaccauuugcccuauagauugucuuaaaccccuggccugaggguucuguaagggcauggccuuugucacuggcauagcuucuaauugagacuagacaaaauguuacuucucuguucuugaauucuaccuagcuuuuauucagacuuauuucaaugaaaagcuaagaaggaaggaaaaaagaaggaagggagggagggagggagggaggcaggcaggcaggcaggcaggcaggcaggcaggcaggcaggcaggcaggcuggcuggcuggcugccuuggacccuuuguuacaaugaaucuucagcuguucccaacacuagcucaggaauaugcauaauguccacaugauugggacauguuuguggagccauuaagggucuagcccaaggcaguguaaccagugucugagcauuucaaguugggugugagcugaaagucucugguuccucagccugggcuccgagacacgacagccugcgagucuagcucuugcaaugagcaugggagaagcguuacuuuccucugugaguuggacugaggcccagugcauagcuauggauuugagggcuaagccucuggccuuuuuccuuuugccagaccuuuguucuccuuuucuagagugcuugcagaaugucagucccucucugaggggucuuggagauuuaauaagcugucuuaaugggggaaggacugaaguguuuuauauuugguccauccacuuuguaauuagccuugaaacuuccuggcaacguugguaggugucuccaccaggaguggccuauuucagggucagugauacaaauagucaaaaccuacuuacuggaucauagacuugcuugugguuuaggccuagguaggacacugagaaaaggaugucaugugaggccagagcuggaggcugguuggcuacugcaaacggcuucauuaucuuggagaaaccaccgugucuuuaugugucuguuuccccauucguuaagugcagguuuagugaaauaucuccccauauccauuccagcucuagacacugcagccggccgggacuggaaaugggcagguucauauuucacaagaaagcauugguauucaggagccuggagcugccuagaaguagaucuccuuuucccugggauuacaaguugucucugucuagauaaaaaggaaacagacagacuuucacccugaggccagaaggagacacagccaggaucuugggucacaaaggucuuucagggugacucuaacaagccugcuggcuuagcuuucuuucaaacccuguuccuuugcugcacauuguuuuaauuguugcuaagcaacauucucuccuacccccccccccccuucuuuuuggcaaggcauccaaggaaugaacccauaucuuauuuaguuuuaaauacccacaugcaaaggggagggccuaacuuaaauuuuguuuguucuucugauuuuaauccaugacaggaaugcagagcuuacucuuugccugucuuguuagguaagggaaaaaaaaacccaucagucuguugaagguacgcgucagaaucaugccguggggcauauugaagauauugccuaugugugaagcugccuugcaggagaggcucuugcaacguguucuuuauucacaaagucaauucaaauuuaaugaaaagauuaguagguuuuuauaaucuucauuucagauuugcuggcuuaucucaaucuugcaccaacagacuccauugaaagggaacaaagcuguaauuuaaaucaauucccugggcaaccuagaaugcuuccaggguguuacacaaucaguggggcugguuccuguagcuugauuauugcaggagucccacacacuucuuccaguagcuccccguguguuucugcccacuuucuugacgauaugagaugugugccuguggccucucguauaaugaauggacacaaguacucuccugcucugaguccauuuauuuuugaauauuugagucacccuuggcaaauagaacucaagugucuguuucacauucacuuacccuaauaguuaauuuacuuguuaaugggauuaauuuucagcuguuuuauccugaaaauguucccagcaaaauaaauaugauuaccguguccucuaauucaaucccgcugaugugauguggcuucuuccauucuagaacaaauggauuuugaaaucccagccagaaguaauugggucaauugucauaucauuguaugguccuucugacagcagaauguagugcuugauuaaggacuuuucuuuuggcaaaggguuuuuauaguccugucuuaagggcaucaaugaagaugaacaugcggugaaucacuugagccuaugauaacuuugucucuuccucguuugccaagugagaaaaucggacugggauaacuagggugcuggagacagagaaugaugcugugucagaauugggauuggauuguacccaaagcuucccuuuguucuuuggggucauggauuaaagcaaaauaaaguuuugucccguuuuccuguguuaauaaccugccuucuguaaacacaaauaggugguugugaauacuuuguucagucuuuacuuaaauuaguuaaaucaauuuauugaaucuuauaguuuccuuuauauacaucuguuuauuuagucuuagaacaauucuagaaggaaguugcucuucuauggauggagacgcugauauacaagagguacagugcuugguuuaaggucauacagcuagcaaugauagaaccagaauggaaauccaagcagucuggccccaacacaacuacuuugcccauuuuuguguccuucccaaauaugucaaucagagcugcguucauagacuagagauauaugcuaacuauaacccugaccuucuagugugguguuuauuacagcugccuucuacuuuugucuuuucaccuagacaugggacauguagaaguaccacagauugcccugccugucuggcccccacgccuguaguguugauccuuagcaaaagccaguuguagaagagucaguguuuuuccugguaugauauuuugugguucccagcccaacuguguuuucauugaugacauuucaagucaacuggccucuggucuucucaguaugcugucucaugcuguaaucuuuuuccaaacuacacaagucugguacucuauaagagguugucuucucccuggaacuuugggcuguguuuggucucauuuuuugcuacauguuggauuuugauuagcccccaaaggcucauauuugaaaggcuugggcaacaaggaugugguggugccuuuaagagguguggccuagugagaagacuuuaggucuuugggguggggagggggaguggggggggguggaaggagagaugcucucuccuuuguuuccugcugaguugacugucccaccacaagcucuuacucuuacuggaaaguacugcucugcugcagggacaaccagucaugagcuccaaaacugagccaaacaguucuuucucuuuauaaauugauuaucucaagcauuucuuuucaugagaggaaguugauccauccucagaaggaauuuguuuguuugguugguuuuucuucuuuuuuugaaccauuauguugacucuucauugccccuuugauguuuacaguuucaagaugucuuggcugccuuguaucuggucugauauggucauaggugcaacccugugauuguuccuauuugacagcugggcaccuucucuguugagaggguaaggaaaccaggccggacuuggauuugaacccacaucuggaaaacugcagagugucugucuguagagugaauuuguagaguuguguuucucagggacuaucuggggccucuugcuuaccuaucaaauugagcaggcauauugcucagugaaaauuaacacagggccaucaagagguuaggucucagauaaacucuagcaacacuucucauuccuggccacacaccccucccuuguugggcgcucccaccguugugccuguggguggacccuguuucauuccuccccccugccccuagaggagucacagucgagcugagggugcacuuggguacuuggagcuagaugguuacuugcuaacuccaguuugaauugauauuuugugucucaaggacaguauaucugaagugggaccuggggcuuuguguuuuuaacagauucuugagcuccugcaggaugccuacagagacagugauaggugccuuccccuagucgggucugugggacuugguuaagagugagcagagugcuuuaacuguacagagcuugggccugaacaaguccugauuuguuauuccugcauccaguuguuuccuuugauucaaaagggacugaacaucuguugaggaugcagaaagaaugucugcucugggacagagguuagguaguuguccucuuuugacaggcucuguuuuugcaccaaaggaccccagcuguuuuucuguuuggcuucccguggaaacccuaugguugggacaugcgucugcaaacagcuggagagagugcagaucgagcggucaugcugagaggcucuugggaaaccaaauggguucagucuagugguggagaggguugcagaggaauggagaggugggauuacugaggaugugaaccgauaagcgaauggcagagccaaagccuuccaaguuaagguccugcugaggguguuuguagugagugagaacguugcuguggacaccaguagagcagagucugucggagucccagcgaugggcucagcuguggauucaagccuuugccuugacucuuuaccagccagguggcuauggacaagccugguaagcuuuccaagccuuggcuucccuaccugguguugguaauaauuaauaguacagacauagugguacuguuucaggacgagcuaguuagugugugugagauccuguccacgugggcagcacggguuaagugucacauaccuagaaaugaccgaauaugugguuagcagcuuucaggggaucucucagaaugacccaacauagcucuugcugucuucuaaaacacugaucuguuuuaaaggcucuauucaugaacccauagaccaaauuuuuuuuuuuuuuuuugagacaggauuuucuguguagccuucgcugcccucgcucuguagaccaggcugggcuugaauucacagagauccuccugccucugccuccccugugcugaaaucaaagguguaccaccauuauuaccuggcuaugcagaccagcucuaaucuuucugaauuuuauugauuuuuauugaaaauggcagucgauaggaaggacauuuuagacggacacuggccuuuaggaaagaagucaacuggcauuuccuuccacaagucuugaucagccucaguacaugauacgucauucacuuguggcaguaauccugucuucuuuguggacuuacaaacuuagcagagagagaagaggaagcagaauuucucuugucugagcagcaggccaaucugcucuuucuccagagccaccaggggcugcaaauuuagagagguguaggccauuuggcuugcucuaucuggcuccaagggcaaucacacuucuaaaaggguuguugacugauuacuucuucugcaguauugaccauaaguugacaacucucucucagagcuguguguggcucauacacguggccaaacuuacgcuccucucaauagcguugguuuggagauauuuuaggaagagcauccaccggugaggaaaacaagccccagcucuucggagagccauucuuuucucccuuucuccuugugagaccaauagcuggucaucaauaugaagaaaacuaaucugaguaguugugcaaauuacgacaauaaacucagcaauuauuccuuuuacuaauguguaauuuuuuuccuggacuuguauuuuuccagguacauuucuguucuacuuugggugccucugaaaugucuggauguuuuaugcugcuaaaauuauaugggucuaaaaauguuacuagugaugacacuuacauagaagcucacuugggcucaugcuagcaaauugcugcaacugggcccucuacccaccccucugccaucccacuaaugugguauuugaggcaaagggaagaaagagaauuaucgaguucaggugcagccagcaagccugucaugagaauuuuguuuuagucuugucggcagaaaaguagugggguguuguugccauaguuucagugaaaaauuugaccuucgcuauaauaacauacaguuagagagaaccagcuaacugguuuucuaaaauuaguauucucuaguacauaaggcagucagaacagaguuuuuaauuaaauauuauccaaggccauaaaagcccgagggaaugcaguccucugaccugggcaggggaggacggaaacccguaaucccucuugauuggucuuuuggaagcuaggagaacuggagugggguauuggguuguuuguuuuugucuuguuuuuugaauauccucauugguuuuauucuugagagcugucagaagcgaguuuauacagcuuguugagagagcccaacaacacccuacaacucacagagcaacccggcagggucuggcagugcugccgggcuggacuggggugcuggcaaggucacuccuucaggucagggaguguuugcagugaagguugagacuuccugagugaaaucuugguguuuugagcaguuccaacuuguuucuaaacucauacuccuuugaaugcuuaaugugucauuaaauggagucagcaucucuguguucuaaguagagcuguguucugccuccuccagcucuguaguccuucccucacugagcugugauccagucccaaaccgugaucuguacacagauuagauaauauuugguaucucucaccaauuccaguuaagagcuacacgaguuuguuuguuuauuuauuuauuuauuuauugaacuugacuggaaauauugaaaauaccauuauuccauguuuuguaguucagaaugagguuucucuaauccguugcugccuuucucgcccuuucuccuuggcauggucaucccaguguaagccuagcaaugguggaagucggaccuugaguucacaggccucccuauuccugagauuacggccuaggccagcagguccagaccaggcgcaguugagugcuggaguuauccccaggguuugaugaauuucucuugugaccgaccguuccacaccaguugccuuuaguaaguuuucuccccuauacuuuuuaugguuuagcuuuguaauuuuaccuucggaugguuauuaguagaaucugaaggauggaguguacaugugggaagauggaucaccuguuugccucuccucucucuugcgauuugcuuguuucuguacuggugucucagcugugguaaugggacguucaucccuaggaagacuugcagaaaagcagccccauaggugaguggauuguaaaagcgccugccugcuccugaggcugucuaccugaauuguucugaauugccucugcccugcaggaauuagagucuuagggcaagagacaagccggaagugcucaguggauuguucuugggagugcuggagcucaaccaugcuuuuauuccauuaggucaguguguccaaauaauuugaauccaucucaguaauaauagcuuaaaaaugcaauuagagcgcucacuggaaaagcuaggcaugcauucuaaagcacuuccugguuuccauuaugcacacguccucaggcccuucuguuaauauggauaacagaguugcuauuccguaaaccauccaagagguagcuuguaacaggcuggcugguggaauguucaacuagaaagcacucuugauuugagggugauaggccugacccagagacuuuauuggcucagauaaucuccacugagugacaugagguacuggaaguuaaugaucuccccauacacccuuacuuucuguggccuuacucucuucgguguccuuguccaacuuuuccuuuguuccuuuguccugugugcuugugguuuuggggaauggaaucuugcagguaaguccaaagacgccugccucagcuguucaguuugaccccaugugaagacuuacuacuggcugagagucucucugucuuuaaagggcugucucauuuuaagucaauaucguacguuuauucugcuuuuugaaaauguacugucaucuuaagcguuauuucuuuaauuccugaaggaacuuguuuguuccccaacuucccucaaugacauccugcuaccaaauccccagagccugugauuaugucucuccugugguaaaagaaacgucacagauaugauaaggacccugagaugggaaguucucuccuauuuccaguuguucuccggaaaucacaaggggcgcugaagguguagaguuggugaggaucagaagucugaaguuuguggcccucaagcaacagagugagugguacacagaaagccugaggaaacuuucuccugaagcuucauaaggaacuccccugccuacuuucaaauuuaauguguguguguguguguguguguguguguauguguguguguguguguguaugugugugugugugugugaugugcaccagugcaugcaugcacuugggaaaagcagaggucagauguuaaguauuccuugguagcuuccuaccuuauggugugagaugggggucucucagugagccccugggauacuccugcuucuccggcucuguucuaggauuacagcugcagcaugcagcuugagagacuaaguagucuuucagccucuuaauguucucucaaguugaauaauuaauuuguaaauuaauuuacucuucaaauuaaguuguuaagcaucauaaacuaucaagugcccucuaaauaucgcuuuacuuguauccuacacauuuugacguacaggauuuucuguucuuaauuuuaauuauuuucaugucugcauuauaauuuguuuuccauggcuauuuagaagucuuuguguuuguggcuucauuuggggguagcuguguguguguacacaugugugugaguauagaggcuaacccuggguauugcuccucagaagccauucgccuugcuuguugagacagaaucucucacugggaccuggggcucccccauucggcuaggcgggcugccuagacagccucaagaucugccccucugcauguuuccacuguugggauugcaaggauggcugccaccauggcugucuuuaugugggugucagggauugaacucagguccucaugcucuuggcuaugcuaucugaagcagcuuuauauuuccaauuauauaaaaaguuucuguuuguuuauuuauuucuauaauuuuaggcugacugaguuccacuagcuuuuucugucuguuggaucaaacauuguugaaaguuguuuaagauuuuguacuauuaauuuugggggaauauggaacugcucaacauccuaauugcaguagugauggcauggauuuaugugugugcucagguucacaaaacuauggaccaagcaagacagugaauggccaacacauaacauuuguaaaaaguuaaauuucaacaguggauuaugucaguuugcccuacaguuuguuuuuuuuuuuuuuuuuuuguuuuuuuuuuuuuaauguauagggagguuauacuaaugccugauaagacugaaacuguuugucauugggaagggcguuuuuuguuguuguuguuguuguuguuaaugcuuuauauacuaaagcuuauuuuggcuuaugcuaaauaaaacauuggcaucaacccuuuuuguauuuuuguggguaaaacuuaaauggucugccagauuuuagaaauaugucucauaagcuauaucugagcaaauauuuagacgccaucccaucuuugccugcucaguaaaaucuuuaguucauuuccauuuguugaggacaucagcauauuuagaguuaacuuuuuguauguguuccuuuuguuuguuuucuugcucucuuucuuugaagauuuuuuuuuaauugcuauuucaccuauuccaugcguuuaagcuguguuggaugggguuuagacucuguguguuugccuuagagauugcccaaauguuuuacugugcacgucucauuaagccugaaguugguggccagucacucuuuccuacaaugucaggacagugaggacgcuuaugcuacugucccccacucagaauaugcuuuuauuguuccuaaugauagggcuucuuguuguuguuguuugcuuggccuugcagaguaaguauaauuuuguuuuauauugccauuuuaaaaaguuggccugacuuuuguuuuuacuaaagcugugucucagauaauucuuuucugcuucaagaagaucccacagcucuggggaauccugaaaguacagucauuucuuugugucuuucucuuuuauccuuaaguggcaguuugcuugguagagauuuguagauuaagaaugccaaacaccccccccccccucgccucucccagauuuggccuagaaccucccuugucuuuucucuuugcugaccuucagagcuucucucuuccugugauuuuugcagucuuccuccugcgacuccaagggcucacuucccuccauuuguuauguacacugcuggggagaucuccagaucccagguugguuuuuguaaacaauccuggagaacuaagaaccaugcaaaugcucucuaguuuuaggauaucuuuuuuuuuuaaauuucucauuuuugcuaucuaguuugaacuuuccuauuucacauaaucuauucuuguuuacuaagucuauccuaugaucauuagagaaauuaauuuuguauauauuuuuauuucaaaaaaauuacauuuuugucuucuccagauguugaucauucuuguuccuccaugcuuuaagccuucacuuuauuuucuguuccauaaagauuuccuaaaguaguuuauuugucacaguuguacuaguuaauauaggguauuuauguugcaauuuuaaagcacuguguugugcuuuugaucacuugcuugugcauuuuuugcauuucaucuaugagcccuggcuugaacuuauacuccuucagaaggaaugauuuucuucgccuguugccugaagugcugccaccaaaagauuuguugaaaucaaguuuuuagguuuuuaauguuuuuuuuuauuuuguuuauuuucuaucuaaaaaaucuacagauuuccaauggggcaugaauucuugugacaaaccaauaugagggcgcacucugguucuaaauuauuauaacuguugucccccccccuccccuucgugggcacacugaauguaaaaaguaaguuacuauuauauacgacagacuuguuugguauuuaucauauaaacugagucuauauacucaaggguugcuccucagaauuugaccuugagugggacugaagacagccagagauaccuaggguuucuagaaucccuuagaaguaaugcuugccuaaggguagacuugagccccuaacagcuucucuggaugcuuuuaaaguguguuuuacuauuuccucaagcuuuuuguuugaguugagaggcccauucaggguuccccaucuguuacacuccaaggaaaggaaaugcaaaccugucaagucuuuuguucacaacaaguucguuaucuguaugaaggaaggcagaguuaccaggaucgccuccaaugaagcacuguaaagauagaaucuuuagaaagagucuggucucuuguuuuugaauauucaaauuauaggaaagggacucaaguuagucuuggguuagauuuacuccacuaaaucagucucacuucaggcucaaggauuaugguguuuugugguaauauggaagcucacauggaaacucugcacuaauaccaggucaaacuaaacuaaacaagcagauaaaagagugacaagcuuacaaaaggugcuaugcagauaagauauccacugccguggauuagggcucuagaagguuucuuuuaucugcuaggggugcuuuucauuacaaagaggucuauccaucuaaccauagcagcauaggggcuguuaacuguuaggcagaaagcuacagugauacccucaguauucguuuuaacuucucuauuggccaggucugaguucuuuucauagccuugucacuucguggcuuacagaauggcuguggcagguccagguuguguuuauuuuccuggcaaggagugagaggggagagcugcagccugaguucuggucucacuccucucucuuccgaggcccgucguccguccauccguccauccgucuguccguccgucccgcccucccucccagccagcuacuuccacaggucaaagcuguguuuccuucucucucucuuucaaagagugugggggaagugaggugcucuuucucucacaggguuaagaagccacgaaucagaaagguauuggaaguuuuuagcauagacaacaggguacaucuuguuacauuauugauugcacacggaggagcccacccgaguuuacagguuuuaguguuuuucuuuuuuccuguugaagaacaguggcuuuuagcagcagcaucuguuaggaacaagcaguucucuaucuaguugaagcugucugugaaaagggaucauaaaugaauacaggcaacuguauguuuccccagugguuuugucuugucacuuuucuauugcugugacaaaacaggauagcaaagcuuugaaagaaugcgauagaugugggacucauggcucaagagcauuggagcaauucgcagcacauuugaaugugcgguccccacucagcaaugaccaaggugaucaugagguuaaucucccccucucuuuuuguguucuuccugaguuggaagaaggaacucuccaacgggcucagaagggcucagguagcuagcaggaguaucgugucuaggagcuguuagaagaugcaguugcugauacauuagagcaugcguguacuggaaccuuccacuuagcucucugucuuccaguuuuccucaucucagcuugguggaauuucccccuacuagguguggggugauggugaacaacauuuugugacacuugagucagcuaaaaauuauaacaaaaacuugaguauuugacccauguuccgcugcccugcccggcaguggcgugcgugcacucugcccucagcaccagaagccuucgggccuuauuguguucugcuguuguugccuuguuucaaacaucacacacuaucuaaaaagauugugagguuuuucuaaagaauggaaaauuaauugaauggugcauguauaggaugguguuuaaaagucaauaaaauaaaccagucccggagaggacuaggccucuuuguugucuuagacuugcugugugcuauauucugaucuaagucuugcaugaccaccccgaggaagugcuaugugaggaaguaugagcauggcagauaggacaaggaaaccagagagcugacuaucgguguucuggaaacagcuuugccucaggagcuggacaacuugaguccauacuuugcuuugccugugacuaccaacuugaccuccuggaaugccauugcccuaucuggacccuugguucuucauccaugaugugauagucuauuaggcuugauaguaaagcacagcccagcuuccugcaagucuaugccaugcaggccugagccaggaauaauuuacauugugauaguauuugcagucauucuuaucucuugguaaaauuuaaucucuggauuaugaaagaguaggccugacauuuuguucuuguuucuuaucuuugagaaucauacaaucagauggauagugguggcacacaccuuuaaacugagcucucagaaggcagagguagagaggcaggcaggucucugaguucaaggccagccugcucuacugugaguuccagaacagccaaggcuauacagagaaacccugucucagaaaaaaaaaaaucacacaaucuuuaaauuagaguagcccauuucucuucauauuuauguauaugagucaccaacauaugcaugcauuuauuaaagucacguacuuagccaagaaguuaaaacauuuuucuauacuuacccacaaugggaagcucuaacauaagcaacgaaaagacugguuaaugcucucagaaacccucuuucaguuuuucucuaaauagcauggauuuggcuuucuugcuuguaugucaauucauggcuucaaaugacuuuugcauguagggaggcgaaacgacacaguaaugauaucaugguaagacucagucaaauucuagucaccacuuacuguaagcgagggcuguugaagaguagucacccuguaaaauaccauucccagcagagauggucuuuuauguaucuuauagguacacaguaauuguucauucccguauaauuacacuagcaauauaauucauuuaccugccacgggcauuagcuuugaucuccccagaguuggggcaguauuuugauagauagggccgaagaaaagguacaagaccauuuauuuaaaaauauuaaguucauguuuuuaaugaacucauuaaaauucugcaugugcacaggagugggcaugugcaccuguguacauguggcagccagagaggcuuuucauugguucugcaagauggaguuagaaacacucgcaggaagcguguacgcagaucugaacucugguccucacgauuguguagcaagcauucuuaacugcugaaccagcuccuccugccuaauuagaaaauuaaaauuuauguaugugucuguaugaguguuuguguuugugugacuagcacauuucuugacuugcuauucuucucagugccaggcguugaauccaugacuuuuuagaugcuaggcaagcacccgaccauggagccacuuccuuagcccagcuauuucagggcaaggggacaaauuauauuguuuuguuucauucugcuauuuuagauuguuuuucaauacuccaccuaugaaguaaagcuacaagucuuuuuuuuuuuuugguuuuuugauacaggguuucucuguguagcccuggcuguccugaaacucacucuuuagaccaggcuggccucgaacucagaaaucuaccugccucugucuacggagugcugggauuaaaggcgugcaccaccaucgcccugcucaaagcuacaagucuuugaccuucugccaaacgcacucaguuacuucucauuugaauucaaacaucagacucuaucuugacucccagcguaggucagaaccuugaagagugauugaauaaggauaggcaaaaaggcuuuuagaagucaucauuaaaaacuguuugcggauggagucucuccuuggcucagcccagguuuguuuucaguaguggguaaaguuaauaagacuuuaaucugacuguaaguggaaagacacugccaagauuaaauugaaguugaauuaaaaccagggcaauugaauuugucuaauuaauugagaauuacgucucagucuguguucgucuucaguuuuuucaccucugugccaggcaaacacccaguuuggauuaguuacacauuuggaugaacuuucccagagguaucuguagcaacgucauccaagaacugcacgaguaucuaguuguacgcgugugugggaaauaaggauguucuuaucguuuuaguaaauagucagccccgcaucucucauccuuugaugguguuuaacuuaguccaccaggcuuagcagauguuuaauuuccgucacgaagaaaauaagguucaguaccuuucccugcaguuauuuaccucuucaugaaauguacaggcagcgaugaaugcauucuuuguccuguugacugggccagugccagugacuauauuccauguccucucaaggggacgugaaaggcauuucauggagggggaaucuuacuuagguuaugaaucucauuuuagggcuauggcuaaguggacuuucagauuugguuagaguuuagagccccauauuaucucucuaaaaccagagaaacaguucccagcugugaaauuugcacuugacagugguggguagcugguccaguucucaccaccccuugggacauuuggguuguuuauuuccccucucagccaaaaaggacugcucaauucagaagcuccugucugcucuccuguuguuauucagacaucacuugcagaaacacgggcuggcuuuuccuagagugcagauagcguugcugaggaguccgggcuggaaagucagcauauaaaaccuuagugugccugaguuguuuguuguuguuucuuugagacuaggucucacuauguagcccugguagggcucaaacucuguaugaacaccaaacuagccucagacucagagaccuaccugccucugccucuugacugcugggauuaaauauguaugccacugugucugauuuaaacauuuacuuaucuaucuaucuaucuaucuaucuaucuauccuuauagaaacgguuggcuguuagaagaaguauaguguguaaauauuucauauguuuauuccaaauaucaguuugcuuaacuaguuuaaauaaauaucaugagggcugcuaagauagcugccuuggguaaagguacuuccugccaaccugggcucugucgccauuucucacaugguggaagaagaagauggacuauucaaagucgucuguugaccugugugugugugucucuguguguguguacacaaauaaauguaaaaauaauggaguuugcuuuuuguguguguuaacaugcuuauauguagguuuggggauguguguguguguguguguguguguguguguguguguguuucucaguugcucuccaccuuugguuuuuaggacaggucucucacugaaccuggagcucauggauuugacuggacuaacuagauggcgagcuucaggcauccaccugccccugagcccucagagcugagcuaacagaugcaugcugccacacuggcuucugacaugagugcuugagaucugaacucacagguccuccuguccugcagguacucuacagauagauccaucucucuagcucccaaagcaauggcucuccaccuuccugaugcugugacccuuuaauauacuuacuuccucaugugguacugauccccagucccaaccauaaaauuauuuuaguugcuguuucguaacuaguuuugcuacuguuaugaauccuaauuaaauaucuguguuuuuugauggucuuaagugaccccugugaaagguugucgcuccaccccauccacacucacagaaugacaaccauaggaugagacccacuguccuagauuaaauauacuggcuuaaugcauugacaggaaaaguuuaugacauuuaguuguguaugaggagauugaaaucaaagucacaagugaccuucaaagucacuauggcuauuuaaauaaaggggguauguauuuuucuuucuucuagcuaaaaaccaaaucaacuauuuuucuuuaguaugacauaauaaagaaauaauaaaaaacaauuaaaagacccccuugaguuguuaagccccuaccaguuccauccugaaugaagcccagaagcuuuguuccuugugagcaucagugugccuuuugccuccuucccucuuuuuuuuuuuuuuuuuuuuuuuuuuuuuuuuuccauuuuuuauuagguauuucgcucauuuacaucugcaaugcuauaccaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggauacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauaugguagugucuacaugguccauccuuuuaucucaacuccaaacuuugucucuguaacuccuuccaaggguguuuugcucccacuucuaaggaggggcauaguguucacacuucagucuucauuuuucuugaguuucauguguuuaggaaauuguaucuuauaucuuggguaucuuagguuuugggcuaauauccacuuaucggugaguacauauugugugaguuccuuugugaauguguuaccucacucaggaugaugcccuccagguccauccauuuggccaggaauuucauaaauucauucuuuuuaauagcugaguaguacuccauuguguagauguaccacaucuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauauccaguuuucugaggaaccgccagacugaucuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugagcauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuuguccuauugacggugucuuuugccuugcagaaacuuuggaguuucauuaggucccauuugucaauucucgaucuuacagagcaagccauugcuguucuguucaggaaucuuuccccuguacccauaucuucaaggcuuuuccccacuuucuccucuauaaguuucagugucucugguuuuaugugaaguuccuugauccacuuagauuugaccuuagugcaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcccuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguaaauugcuuuuggcaagauagccauuuuuacaauguugauccugccaauccaugagcaugggagaucuuuccaucuucugagaucuucuuuaauuucuuucuucagagacuugaaguuuuuaucauacagaucuuuuacuuccuuaguuagagucacgccgagauauuuuauauuauuugugacuauugagaacgguguuguuucccuaauuucuuucucagccuguuuauucuuuguguagagaaaggccauugacuuguuugaguuaauuuuauauccagcuacuucaccaaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuauuauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauuucuuuaauguguucuuggauucgguuagcgagaauuuuauuaaggauuuuugcaucgauauucauaagagaaauuggucugaaguucucuaucuuuguuggaucuuucugugguuuagguaucagaguaauaguggcuucauaaaaugaguuggguagaguaccuucuacuucuaucuugugaaauaguuugugcagaacuggaauuagaucuucuuugaaggucugauagaacucugcacuaaacccaucugguccugggcuuuuuuugguugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauaagcuuuuguagaaggaucugaugguguuuuggauuucuucaggaucuguuguuaugucucccuuuucauuucugauuuuguugauuaggauuuugucccuuugcccucuagugagucuagcuaaggguuuaucuaucuuguugauuuucucaaagaaccaacuccucguuugguuaauucuuugaauaguucuucuuguuuccacuugguuaauuucaccccugaguuugauuauuuccugccgucuacuccucuugggugaauuugcuuccuuuuuuucuagagcuuuuagauguguugucaagcugcuaguaugugcucucucccguuucuucuuggagguacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaauguuggcuuuccauucuuaauguuguuauugaagaucagucuuaggccaugguggucugauaggauacaugggacaauuucaauauuuuuguaucuguugaggcuuauuuugugaccaauuauauggucaauuuuggagcaggucccgugaggugcugagaagaagguauauccuuuuguuuuaggauuaaauauucuguagauaucugucagguccauuuguuucauaacuucuguuaguuucacugugucccuguuuaguuucuguuuccacgaucuguccauugaugaaagugguguguugaggucucccacuauuauugugugaggugcaaugugugcuuugagcuuuacuaaagugucuuuaaugaauguggcugcccuugcauuuggagcguagauauucagaauugagaguuccucuuggaggauuuuaccuuugaugaguaugaagugucccuccuugucuuuuuugauaacuuuggguuggaagucgauuuuauccgauauuagaauggcuacuccagccuguuucuucagaccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaagguaauuguugcuuccuguuauuuuuguuguuaaaguuggcauucuguucuugugguugucuucuuuuagguuuguugauggauuaucuucuuguuuuuucuagggcgugguucccguccuuguauuguuuuuuuucuguuauuauccuuugaagggcuggauucguggagagauaaugggugaauuuaguuuugucguggaauacuuugguuucuccaucuaugguaauugagaguuuggcuggguauaguagccugggcuggcauuuauguucucuuagugucuguauaacaucugaccaggcucuucuggcuuucauagucucuggugaaaaaucugguguaauucugauaggcuugccuuuauauguuacuugaccuuuuucccuuacugcuuuuaguauucuaucuuuauuuagugcauuugguguucugauuauuaugugucgggaggaauuucuuuucugguccagucuauuuggaguucuguaggcuucuuguauguucaugggcaucucuuucuuuagauuugggaaguuuucuucaauaauuuuguugaagauguuugcugguccuuugaguugaaaaucuucauucucauccacuccuauuauccguagguuuggucuucucauuguguccuggauuuccuggauguuuugaguuaggaucuuuuugcauuuuccauuuucuuugauuguugugccgauguucucuauggagucuucugcaccugagauucucucuuccaucucuuguauucuguugcugaugcuggcaucuaugguuccagauuucuuuccuaggguuucuaucuccagcgucgccucacuuuggguuuucuuuauugugucuacuucccuuuuuaggucuaguaugguuuuguucauuuccaucaccuguuuggauguguuuuccuguuuuucuauaaggacuucuaccuguuugguuguguuuuccuguuuuucuuuaaggacuuguaacucuuuagcaguguuuuccuguuuuucuuuaaggacuuguaacucuuuagcaguguucuccuguauuucuuuaagugaguuguugaauuccuucuuuauguccucuaccaucaucaugagauaugcuuuuaaauccaggucuaccuuuucagguguguuaggguguccuggauugggcgaagugggcguucuggguucugaugauggugagugguccuggcuucuguuaguaggauucuuacguuuaccuuucgccaucuggcaaucucuggaguuaguuguuauaguugucuuuguuaaaagauuguuccucuguugauuuuguuacccucuaucagcaggcgugggagacaagcucucuucucugaguuucaguggucagagcagucucuguaggcaagcucuccucucucagggaagguguacaguuaucugguguuuggaccuccuccuggcugaaggugaaggcccaaaacaggaucuuucccagaagcuguguugcuuuggccaggaagguggccaguugucuggagucgaagaugucgcagccucagaagcucuguggcucuugccgggaagguggcugguugucuggagcugaggauggugccgccccagaaucucugcgacucucucgcccgucccagaaacggcuggcacucuguauuccacacggucacccgugcagccugcccuccgcggagucccggagccaagaaggcucccgccggcgccugugccacaaaccucucaggccaggcagaccccgugcucucaccaggaagguggccggcugucuggagcuaaagauggcgccgcccagaagcucugcgacucucucgcccgucccagaaacagcuggcacucuguauuccacacggucacccgugcagccuguccuccgcggaaucccggagccaagaaggcucccgccggcgccugugccacaaaccucucaggccaggcagacccccgugcucucaccaggaagguggcaggcugucuggagcugaagauggcgccgcccagaagcucugcgacucucucgcccgucccagaaacagcuggcacucuguauuccacacggucacccgugcagccugcccuccgcggagucccggagccaagaaggcucccgccggcgccugugccacaaaccucucaggccaggcagacccccgugcucucaccaggaagguggccggcugucuggagcugaagauggcgcugcccagaagcucugcgacucucucgcccgucccagaaacagcugacacucuguauuccacacggucacccgugcagccugcccuccgcggagucccggagccaagaaggcucccgccggcgccugugccacaaaccucucaggccaggcagaccccgugcucucaccaggaagguggccggcugucuggagcuaaagauggcgccgcccagaagcucugcgacucucucgcccgucccagaaacagcuggcacuccguauuccacacggucacccgugcagccugcccuccgcggagucccggagccaagaaggcucccgccggcgccugugccacaaaccucucaggccaggcagacccccgugcucucaccaggaagguggccggcugucuggagcugaagauggcgccgcccagaagcucugcgacucucucgcccgucccagaaacagcuggcacucuguauuccacacggucacccgugcagccugcccuccgcggagucccggagccaagaaggcucccgccggcgccugugccacaaaccucucaggccaggcagacccccgugcucucaccaggaagguggccggcugucuggagcugaagauggccgccuccuucccucuugccccaucccuacuuuggagccucugaacaggugauuuucuuaagggucuucuuaaaguguugucuuucauuacuccacaaaauaggguucuugcacuccccucuguugagauuugaaagucuaaucgaaucaaaacauaaucucgcucauccuggguuuucaucaauagcuucuggcucuuucuucgccacgggguagugucaguugccggagaagcaacauaguuuuaacucucacucuguuucucuccacccguuguugucgucucuccuccugugaagugggugauuuuuauguagaaaagguccagugccacgauagccugggucuuucuauuaauggaagguccagacugagucuuucuucccuucccccaagaaaacgaugugcuucccuggagacaaccauuccgugcucugcuuuucccuggagggcugcuccuacuccucuaaucaaggcugaagcauuuccggugcucucucaaucuacuguuaacagccaucaccugccggaggaucugcugacagcuuggcaccagcaggccuuugugggcuucauugccugugcuuaaguuuuuuuuuucuaagaccccaggucccuuuaagaagauacuggagauaucuagcccauggguuauuuauuuuaaccgauuuauuuuuuauuauuuuuccauacuauauauucauaugggcuauuuaaagacacccagaggcugcagcaaacuaggcccuugagcaagaacacuaucugugcauagaucccaguguaacugcccuacuuauagacauacugacauguaccugcuaccacugugguaacuauguuauugggggcuuuguguaaaucauguagucucugguacauaauugcaaaccaacauuaucuuugugcuuuggcaugucguauauguuccuaaagcauuaaaugaaaacaacaaaaacaaaaaaugaaaacacuugagacuguaaugagaccaauuaacuucacccaugcuaugacuugcauguuuugccaauacaugauggaagggguuaacaggaagcccuguuuggcucaagaguaaaaugacuccacaaagacccgaaguggcugaagaagagaaagauugcuagacuuuguguucgcauggucucugguguugcggucuacugcacacagcaggcaguagaagugcuguguggaagugcuggccuauggagagggauggaccacagcagcacgggggauggaccacaguacgggagacgauuccagcuggggcuucucacaguggaugucuggaggccaaggcugcagggaaggaccuuaugugcugcauguguuuagcugcucuccugauuuuguucuacauguaucaaaaacacaaaaaagaccaucuggugucuugaaaggaaaaauaaugggaacagagggugguaggaucgugccagcauugcuguauuuaugggguggacucuuuuacucgccucucguuugggggacugacguugaggguugagcaaucaugaacccagaaagguuauuuuuuaaugaacacagccucaugauagcuuuuauguauaggacuuuuuuuuuucacuuuuaaaccagaaugcuuagcuuugccaagaacugcccaugcuucuuaucucgagagcauaguuugcauuuuaguuaugaagugucuaguagaugucucaggguuggacuaaggucauagcaaagcuagccuuggcuuuggucaguggcuuaacauuccuuuagcaaaaauaccacuaacauuugcaauaucuauagacugugcucuuuguggugcgguaggcagaaagauaauaccccaccuauagugauuuugauaguuuguaaauguuucuucucuuauuuaaguguaaacccugaaaacugggaaggucaggucauggcuguguuauuccuccucuucgcugucugacacguggauuguacucucaaacaauuuuuaguagaaaagacaauuugguagauccaacugaacucuuaucgaguagauuuuggaggugcuguguugagauagauuugccauuguauccuaacauagcagaaauaaucccauguaucuuuuuugaaaaauguuuuaaaaauucuuuucuuugcauggguauaguuguucguauaugugcauguauaccacaugcaagcagugcccaugagaucaggguacccuggaacuggaguuaaggagugguucuaagccuccguguggggccuugaaaucaaaccuggccuucugcaagagcagcuuguaguuuuauacagagucauauauucagcccucuuugaaucuuuuaaauucuguuuuaaguugcuuauuguaaucuaaaggaagacauuguuugaaggaugcuuuguucuuuccuaccuccccugguagacugugggcagagacguuaucuuucuuguuguccucugcaucuccgcuacaaaagggagcaucuuucugaaaacucuggcagucaucaaaagcuuguugaaugagugugcuauaaaagcaaagaccagcacuauuucauucauguaugaacugucauagaacaugccuaaagucuacuuggagacagacagggucauuauuagagaacuuacaaagauuaaguugggccaugaaagaugaguaagagauaaagauaagaagagccagugaggcuggaaugagggaccauucucauacagaaaucuuuuccuucuucuuucuucuucccuccuuccuucccucccucccucccugccauuugcccuaguuacccgagauuaaaccuuuuaggcaagcauucagccacugagcuauauucccaggcuauuauaagacuauagucacagauggaugaaguacaaauguacuauauuuuaccaauaaacucugugugaugcugagguuggagcaggugaugggugucagaucugaaggcucuuaauggauaaggacaauuugcuuuuguugauaauaguauuacuguuaauuuaaagauggccuuucaugguaaguucuuaugaugaaugaauuccauacaaucaccuuauuuagccaacagagcaaucuuauuacagugagcauguccuagcuuaaaaguuugacgagugugugaaaccuguucagccucauagucagcaauggauucuauucuugguaggaacagagguccacugagcccaggguuucucugugacuguggaagugggauguaucccccuuuguuugcuguuguaugcaugucuguggggguguuggcugguauguguuuauguguuugcauguauguguguguguguguguguguguacauggguguuacuuuaacuauaugugcacuccugcauguggaagccugagacuaauaccaggcaucuuccuccaucacuaauuuauucauugaggcaggguuucucgguugaacuuaaagucugaaaauacagcuaaucuagcuaaccaacuggcccuggggaucccuuuucuuccucugagcccugaauuucagguggguuguuaugcccaccuggcaaucguaaguaaguggucauguaaguguggucuuugcuuuccucacauuugcguccuccggcuuuaggguguucuucauacugagauaaaugggcaccauguuugccacauuccaggugcucuaagguuugggaagaagaauguugcccacuuacaggucuggucacugcaucucuuuuaagaugagucuggugucauaagcauuaacucuauugauaaauuuggugaggcuuggaucaaugaauaauucucgugucagcugaaugcaggcaguguuuuggagcugaucuacagugaugcaaucagugggagauugggggaggggcaggggaagaggaggagguggugagaacaggaugcugauuaaacaguaaguucuuguguuccuguuuguggcuugcugacuuggauugccuguguuuaugaaugauaggauaaacauguuucugaugacaauccagagagggagcaaaaauggcagcaaaacaaggaacuguugcucaugcaucaacugguaagcagcgcuccucgguagcagcgcauggcagucuugugggcguugggaaggagggaaggaagagucuguuacugagagcacgguccgggauggagcuguacccacgcaaaguauacccaccaucuggccugggcugugcuuccgaaacaauggcccacggcuuauagagucugauaaauccugagccgaauggcagcaucgaguuuuuaguguauuuaguuauagaaugcacugguccuguuagggagaaugguggcaguuacaggaauugcugaauccuaguaucccuaagaugugugagccaccuuaagcaggucuaaguuaggggacuuagccaagacagacagcuaguuaguauggagacaggacuacggccuuugagagacaucugaugaucaugcuuagcaguuugcugucuaccuuucucaaagaucuccugcccaucugaaggcugauaggaaucagccuaagagcacaguuuuaggaguuuucuugccccguaaugacucuucuggaccuugcucuugacacgacaguacuucucggccuuccccgucucucuuggaguugguaucuguaucuacacguuuacuaccuagcucuuuuuaaguguugcagauuauucguuuuauaguauaauuaugccagaguggaauugucuacacucggugguauauauacauuuaaguuauucauuuauuacuguuaggaguaguauuacuaaguuacuaagcaaaaaauuguacagcucuucucuucaugugcuuugcuuuucuaaaggcuggauaaauauuaacuuuuuuuuuuuaauugcaucaugaucuuuguuggucuuacaggaaaauaaguugagucagggaagaaguuaacgaauuaccuaaugucccauaagcaugcuguuaggauuucaagccaggcugauuucagcacugucacugugcccugagcauugugcugcauuugagcagucacagccuuccccuagcucuuuguucacucguccaagugcugauaugccgggugaguggcacagccauggaguuaccaaagcuuuguuuuccuaauacaguuuuaaaaaaaaugaacucuguuuugucaauucgaguucuuaggaaaagaguugagagaaauuuacaguguuuucucauugacuccgugccccacaacaccuaugcaguuuccuguugugcugacaccaucuaccagaguggcggaccauuaggauagaugaaugacaucauuguuacucgaagcucauagugugaguauuucacccuggacacgauguauaguaagugguguugggcauauuugugauaguguguccacuauugcagcaucucacagaagaguugaacuguugugacagccccucugcucuugcugucuagccucccaagucccugacucuuggaaaccaucagucuuugaacuguuucuauguuguuauuucccaccaggaagagacauguaguuaggauaacaaugcuucuuccacauugacuuuuuuucaguuacuaauacacuuuuuaauuuccucuuuaucucuuccuggcuugauaggucauuuccguuuuagcacugaguaauacuuuggagagacccaaaucucuauccuuaucucuaucacucucugaagacauacaggaugcauucaaguuuugccaguuguaaauaaagcugcuauagacacccauaagcagguuuuguguggagauguuuucagcaccuuuggguaaacacuuagaaacaucaagauggcuucuguugaaaaucgucuucaacgguguacuccuuacuuagugcauccagccucuugucagauagaaaccaucaauaauuuaguaaaguguuugguuccaguuuacucauuuagugaguggcaguuagugacuugaacccagagccucaacuuugaaaucacccuucaguuucuuuuugacuguguucaguuccuucucauugggaugaacuauguuagcaggugguuugaugagaccugcaaauagugaaguguuuauuuccagcugaaagaagaguguguguguguuuuguuuauguauguguguggaggcugaaaacugaaguuaucgucuucgaauuugcuuuuuuucuucacauuaauuugacuuaugguguccuuuucuccucuaccagaggagccguacaggacugugacucagcccaggaacggugggacagucccgguucuaaaugugacucugaauuugggguuucaaguggugauuuuggccugaguguaauuucagcaacagucacacguucacagcauaaacucaucuaaauuuaucagucacugcaucguaacaaauccaugucucauuccguucucuguuuucuuuccuacaagaauauucugcacuccugaguaaguucugaguagcauuggacuauccucaaauuggccaauuuauuaauucaucuugaaaacuuggaaaaagaugcuucggaguggauguucugaaugagauuuuucuuuuauuuggcaggcagaguuauguaaauacaaagauaguguaacugaaguaaaguaauucuaauaggguaggcgaucggaugaugaguuucaacaaugcugaggacgcacuacggcagaugggacaagaagaacuaaaagcaacagcaaacucagggcaggggucaagauggagcuaaaggaaauuccugaauuuauuuuauauuaaaauauguguaaauauuaauugauuuaaaccuuauaauuugaaaaggaaauguacucacauuauauuccuuuguauacauuaagggaaagcggccagauucagaacaauaauugccacauuuuuuucccuuuauauauggaaucuaauuuaaacaagcaaaaaagcaaaaaacccagaagguaaaaagaggaaaccacgugggauggaggaggaaugagggaggguaaugauggcaggacucgaaaagagggcauggugcaggcacagggaaaugccauaacaaaccugccauuuuguccagugaaugcacaaacuuaauauaugcaauaaagcaaauguuguuacugaaaaacagaaauguagccauacuauauuacuugauaugcacagaacaauacuuucaugaugcuaguuauauaaacuaccaaccagcucaugguuagaaagcaguaaaucagccuugacuaugaaaaagaaagacacagacuugagauaaucaggcauagaaggauguggagauguguguguguggugggggggggggaggggcacuaagagcuuggaguuuaguggcugagaguuacuguaccacagguaaaacccuaugaguuacaugggcuccuaaaaggcuguuaccauguuaaacuuccucugaaauuauagcuggguccgugcuuuucugucagagagagcagcagaaacuucguucuccuaaagcccucaaaacuaacaagagucuggguggacagaguagcuuuaccucacagguuggacaaacagauuuccuugccccguguaaacuaucccauagucucugcagaggagaaguggugguggauuguggcaauauggccaagcgacuggugguagcuccagauucccuaucuuggucuaacuguugauauugugguuguuuaaaguucagcagacuagagagcuuggagaccuggaaucacuuggcagcuuugaggauucaggguauuauugucuuagcugugguauucauugauaugacuggaaauguccacaggaugaaguggacuuguuccaaaugccuccccggacauuuucugcaccugaccugguuggcuacgaugugcugauuauucuccuguaguggugguuuugguugaagagucucaaaagaguggagaugcucugccgggcuagguauuggauuuucuuauaacgauaagucagugaaauucuguuuuauugaagaacuucccuaguugagaaggacugugucaaacuuccuagguucucuuaaaaauuuucagccaguucuagcaacugauaaugauaauggugggucaagaaaucuuggcacgauuuuuuacuuuuuaaucuagauauuugcaggugaacaauuugccagaauuuauguaccuuugugauccacaagucauuauaauaccuuuuugggcuuaaauguuuugauuuugggaagauagugugauaaccuucacugacuguaacagagggggaaaauaaucuuuauuacauacuuuuauuucugacuuuugaauccgaaauggguuuuggaaaaugcuauauuuuccuaggaguggcagcuauaaucacuauugcugccuucccaccccuccuacccuaccugccuuccuucccguucccaaccacccguuucugucacagcauuagauuauaauauuuaucaucuagcuugaauaacuuaaaggcuuuaaaaaaugaacuuggcuuaaaagaacaugaguaagcagauaacuguuuguuuuccuguaaaggucacauccaaaauucagugcuccugacuuuuagaauggccauuuuucuuagaggaauaauuuagacaaguugaauugaauagcucuagcaucuuuggcauuuauucaacuuugucuuuaacucccguugucugaacaaaucuuuuacagagaauggaucguaaauacacaucacaggaucccuaaaagaaaagaaaagaaaacaaaacaaaacaaaaagaaaaccuauuucauuuugucuuuuguaagaaaaauuaugagauuguaauguuaaguugcauuaaguaggcuugcauuuugaaugaugauaaucccauucgucuuaaaaucuugacuugugguaaccauagauuuuuaguuuucguuuuacugauaguguguaggaguagggggaaggaggaggcacugagugggugcagcaguuggccuaauuguuuaaacugagauuacuuaggaaaagauaucugacauguuuacuuuacacggagcaaguuguuuacaguagagaucauuuaaaugugaguuaccaauaucucaaguuuuacauuugccaacccuguauguugagauuuuccagaaucuuacagugacagccgguccucuaauagacaguaggacuuugcacuuagcuaaaaauagcucaccuuuggagguagaacuccuuuuccaaaaaauauuuagcgcccacagugaaguaugcuaagcaugggagaggcgaggguagguugucucugcccuacuagggcuugcucucuuggcaggugggauaagaaaccauacaaguaaacaguggcuuguaagaucgcacccaacacagacaaaugccuggaguguggaguauggagauaguuuacaguggugcuggaggcaaugugcuagaccagcacuaacuuggcugaugagggaagucuucuacagagguaucaccuaggcugggguuugccuuaggcagcugcccauaugagcuuauauaagaaggaugugcaaggccccaugaaccacaaacauaaaagccaggucaugaacacauuagcacuggagaaaggaggagagcaucagggaaccaaacggugacuccaacucagucauacugcauggaguccagcuguguccagcuguuuuucuccucuagucagggaaucagaaucauuugaugaauuugaguuuucuaaagccauguaaaguuaaggugaagaaaaucccgauuuccucuuggucucggaguuguacccaugcuccacacauuuaugcugcuccuccuucccuuaccugcccuuuuugucaucauggaucucacaggauccuuuaggcuccugcgugcaggccaauaaaucaauaugcauacacuuagaaugcgggugcauguguucaugucuguuuguuaaaugaaaaaaaaaaggguauuguuuagguguugguucacuugcuuaugcugauagaagugguuugaaagacagaaauguauugucucgccgggcgugguggcacacgccuuuaaucccagcacucgggaggcagaggcagguggaucucugaguucgaggccagccuggucuacaaagugaguuccaggacagccagggcuauacagagaaacccugucucgaaaaaccaaaaaaaaaaaaaaaaaaaaaaaaaaagaaauguauugucucaccuaaauuaaagucuuuguaggcaagcuuguacuuuagggcagagagagcaucaccggauccugcugugggcuggcuggcgguagucugauggcggcuuuguuauucauugcuuugccuacuuuuaucaucaucuaccuugauagucaugugacaugucacuuacuaaagaauuauuaaagacuucauuaagcuuuuuuuuuuguaauuuuuauuuuugugugucuauguguaagucagaggacacuuggcuggagugcauuuucugauuuccccuugcaccgucugagucggggauugaacucaauuguuguugggcuugaugccaagugccuuuacccacugagccgucucacuggcccugcaacuauuuacaaagauuuauuuuuauuuuuuaauuguguauauguggauggaugcgugugaggaugcccacggaaguguuggauucccuacagcuggaguuaaaggaaguugagagcugcccuguucugggaaaugaacucugguccaccacaagaacaguacaaguucguuaccauggaucuuucucuccauucccaauuauaguuauuuuaaagccaucauauaaaguaggguguacucugcauugguguacacucaucuauagugacccuguaaugucacauuuuuauguacuguauauaguuuuauaugaaguaauucuuucuauggaacuuaagaucuguggcaucaggacaggaugccuuugggaagugauucggucaugaagguucugcugugguaugggugagauugguacucagugugcuugaugugacggaauaccuguuugguucauuggcuuuggcuccuuuguaccauuagucuucuugauauucaugugacauguuacucuccaaauguaccucaaauauggaauuauagcuaaaaucguauuacaacuuaagggaggaagaguuuguuacgaucauugguguuaaggaauagaguuuguccuugugggcaaggcaugguggcauaucauguuggaaggaauguggugguaggaacuagcccuuacugugugucacaucuuaguaaauuaggaagcaaaaugugugggcaggaacaagaagcagauaucaguacuaagacauaggcccaugaaagaacuccucauuggcaagauugacagagcuucuauaaccuucuaaaacagagcuauacuuugaggacgacaaguucaagcacaggagccuacggggacauuucacauuuauaccauaauggucuucauuauaaaaagaagccuguugguuuagaguuuucaaaaucuacuucaauaaggguucuuacaugcuuuaaccucccuucuagccuaccgcccugcagagguaguagaaaagagagguuauuagucccugggggaaguggaccugcuuagaacuaguucuucuggagaugccaaucuuugauaucaaaauaucagcaguucagucuacuagcaaaccagcaaacaugaaucagcagcuucauuccaguccacuuggcagacaccacacauuagccgcaguccacucaacagacaccaugcauaaauuggcaguggcagcuggauccagaauaccaugagagguucauuggcaaguuacugucuaugaagucaugucaagcaaagaucagcaaugggguauaagacuccgggacccagagcaucauuaucagacacuaacaaguuggugcaaggugaaccaaagcacaagccuuguuccaccagcuguggucauauuuauauucuuucuaagcaucacauauccuuucacgugucugcuucagcaaaacauuaucucaccuguuucugcuucaguaaaacacccuuucaccucucugccccagcaaaacaucauuaugaccuaacugaaucuccaaagaaaccauaaauuuccacuucagagacccauggggauggaguaguggcucacuaguucagagcacuggcuccucuucuagaaaacuugcauuagauugcuaguaccuacauggcagcucacaacugcuguaacuccaguuccaggggaauauaagguucugaccucuauguguccaaagcacacaccuaugcccauccacagcuucccccacccuacacagaaagaaagagacagagacaaagaaagaaagaaaaaaagaaagaaagaaaggaagagaaaggaaggaaggaagaaagauagcuacauugaucgauaagguaaagccugagagagaaaccuugucuuuuuuuuuuuuuuuaguaccuagcaaagaagguccuuuguguccaugggcaacugggcucucaguaaacuaaaauuuccagcaauuuuauuguacacuuuucagaguuugcuuaucaaccaucuugaauaugguguuuuguugugugguucaaccuucaaccaaagcguguguaaucugacagaguucacaguuuccuacaaauaccugccaauuccucggagcccuugauccuauuuuugaggguaaguaucugggaaauaagucuccuuucuacucaguagcaacuaauguuuacugcgcuguagcagacucagggguccuuggcuauuuguaaaucacccaaagcauccuuuggagguggcucuaagcucuuugucuuugcacuugagggaacccagccugacuucugugaggaaacuuugcccucaccaccauauggauucuaguuucaacacuguucuucaagcugagcuuuaauugguagguggaugaaguauccaaaacuacuagcaggagaguccguagucaccaauccauuaagcguuagagaagaaguuucuuguucugccccuggcuucuuuagugaacccuguggaccuuaucccaggaagauaaugugauguauaguagcacuguaugacuuaaccuucagguuaugacauuacuauuucugaagcacucugaagaugaaauacuugugaucacuuaaauugaauuuuguacccuacugccaagaaguacacaggcuaucuccauccuuuugcagcucucuuacaugcaggacagcguucucccaaggugagaggcugcauugcucauccucccuggugcucaguagggacacuucugagugguuacugcuugacuaggcaggauucuguaggccauugaacuguagauacuauagacuggagaugugcugucgaaacagguuuuaaauucaaacuuuuaagaaauuaaguugaauguaaugagauuuggcgaucaaugccaaagucauuugaaaagcaguucuuaacauuuugcuagguauuuuaacuuggaaauugauaucaguauucaggaauguugggguaggggagguaauuuccucacucuucuccugucuuuucauuuugucuuaauauguguaccaggaaguccagaguugccuaucaugaauccaaacagcauaauggcugacuguauccugucauugcucuggucgacaaaucccugcacaauaguuuguggcaugcucucagugaacuucgggaaagugucuuggagguaggagaggauaccagaaacccacaggacaaauacauaaagaagucaaugcuuuauaagaauuaugaaccaagaggauuucugaguucgaggccagcuuggucuacaaagugaguuccaggacagccagggcuauacagagaaacccugucucgaaaaacaaacaaacaaauaaacaaacaaaaaagaauuauaaaccaaauuggaaauugaucuucaaucuuuuaaaguuuguucauccaguucgagagaguuaacaauugcuuuucaaauuucccauuaaggaacaccgacugugugugugaucaggguguugugacaucauacuugcuuucuccagaaugcaggaaccaucauuccugucuccccugggagugggcuuguguccaauugcauucacgucuagaaccucagcuccaaauaaauacagcugaaagguaggauacagaugggccauuugaggcaagaaugagccuagacacuguuauaguucaaggcaggaagggaaagaaauaccauugucugguccaggacacacauauguagaacuuuuaaauacacuaaagaagcagagcugcuuccuaaguuacuugugcccaaauuaucuucccucuccacuccgcguccugaggugauccaucucucgggccugcaugacuauggaccggacaguaaccagccugaccagggccaugaguagugcuaggugcuuuucugcaccaggagcugcggaggugguuuucuuuucuccauguccucuguugucaggagacuugagaguuuagcaggugacaucuuccccuccauuuuccccuccuuuccaaucucuucuuccaggaugugcauuucgagcagcaagacaagguagauuacaucugagugucuacauuugaauccugccucugccacucaugacccaggaagguauuucauuuccuacucaucuguguugguaugaaguauugauaccaguaauaccuauuucguuagucugcuguguaaagugaguuagcacauggcgaacucuuaaaccacacuugcuaaugucuucaguuagcauuacgugaagaugagaaguacucuugucaguucuucccugagugacagacgagugaguaucucacccucauuauuuuugcucaucauuauucuauaguagagugguaagacauaacagagcugguugccaacagaaucguuccugguugaacuuccugagaugcuacagguuggagguagaaagauggaaaaguauaaugagauaaauuccuuucucuuggaacuuaaacuguuguaggaaagccgacuaaucaacaagagauugcaguagaguguagagaauguuaggcaucaugaauaaaucaagauucaagccaggaaaagaagaacagauuagcuaaauggaaugggcuuggucacaggagccaucacagaggagauggaacuugagagagagcccgugaaaggugugucaaaagacaaaauuaacaaugaauuuaguuguuagaucugauaggcuuuuuaucucugagucauaacucugggcagcauccauccuacaaauagaaugccauugaucaauaauagaacaauggcuuuuacaaaguaugaauaagagaaaaauaauaacuagugauuaucauuauuuaauccacguugcugcauguaacaguuaagauagagggacuugcuuauaaagucagcuauaauuggcauggcugggaauuuggccauuauuucuccuuuagcaugaaugacuguacaauuggccuaggacaggugcuuagaccaaaccaauuuuuauuuguuuugucuguguuguguguguucauuaaucuuaauucuuaaugaguaagggcauagauaguggaauauuuccuugacucuauuucuccuaacaagucaauuauguugagauaagaaagcugacuguugguuauagcagguacauggucacuggaaaucugcaaggucaaugcagugggugggaugaaucagagcccuaagaagaguugauccugaugagauuuuuacaauaaaaugaccagugauguugcuuaggguaacuagagagcacaaggcaguacucuaccuguggucccccucuguugcugguguccacauugucccucagggugugugcacacacuuucuuuuucuaguucagucaggguguguguacacuuuccucuuuuucaauuucagcuucuauucuuguccuuuucacuucccguuccacagagcucugcuguuaccugccacuccugugcaggcaaagaucccagcacagaugaaggugccuuuccugccucuuccccaggcagggaggucccuggugagcaaguucaguguugacuguggguggucauggggagaacagcgugaggaagagcuugaaagggccuuuggcugagagaugggcagagcuccaggggcgugaaguccuacacaugcaccaggauuauucuguuggauaaagucacucuagccaacgcagggagcuuacaaaaaggagaucaaaaaggccauagcugaagugaugaguguucucaguguguggcuggagugaagggagacccaaggauugggcaggacacgguccagaugagacuggaaauguugaugaaggcucuguagagaaagguuuuuuuuuuuuuuuucuuucuguauuuaaaugauaugggccucuauguuauucuggggauggugaaagauguguuuccuuaccuucaguuuuucaugcaaaauccaaauuuuguuuuuaacauuucuuuuuguuuaauucuaauguuauaagaguguuggagcauaucuauauuucuaacgguauacugugaauaaauuaucacagugauuuuuagaaauguacaagcaaaucaccuuuuagguuccuagaacuacuguuacuuuuguguccauacuuugucugggauagagauugcugucgucugccacugaccagaacuuagugugugagaagguuugcuuuacuugucguccauguugaccccuccagaagcuguagggcaauaguaaaccccuggucccuucuaaacgcaucucugagaacacacuuucuuguguaucaguaggauucauggacucuauagucccccagccgugaauuccagaugagggaagucuacagagcuguuuuacagcaucuuucaauggagacguggauauuuugguauuugagaauaggucuugaagcuugucaugggaguuuccaaagaccagcuguugaaugcauuuauacauacuuaaugaggauuuuuaugaauggcuauuaaaagaucugagggcaguuauauucagguucaaagaaaggauguccuaugggaauuuaauauuuuugaacuguuggcagaccacaaacugguauuuacuggcauucuuguguucacgggucuaacauaacagcugaagguugcauugccaugcauuuccucuccucuuaacucuacuuuuguguuccuuuuuaaugugaagcaucaaauauuuccacacacuugaaaaaaauggaacucuuuacguuuugugccuguaaugaugaauguacaugccugauaguuugugugggugcacacggagcucagcauguauggagguuaacggacagcuuuguggagucaguucuguuuaaccuuaugugagcccccaaggauugaagucaggccacuaggucuguguggcaaucccuacgcccacagaacaucuccccagcccugcacucacguuuggaggcuugcuuacugucucacuguacaacacaagauacaguugguagaagaacgugaccagaugcccagcucugucucaggugacucugagguuguuaguuaggugacuuaacuuucauaagcucagcagcacaguaaccauuaaaugaaugggccagcucacucguggcaguuuauugacaauuuuaacacuucuugaggaguaguggcacucuucaaaauuuguucuagugugugagcagcauuuaugaaagcugugcuaacacgagcacauuuagcacggucugagagucaugucaccuaaaaggacaagcagggcuacuauaagcacucuuugaagaagaaugaugugucuaugagguaagaauuaaagaccuuuuaaaagaaaagaaagguuuugaauauucuagccacuuggauagcaagucuuaaauaggagagagucugaaugccugauaggcuuuugcuucauuuuguuugucuauuacagugauugaucaaucaacuguaucuuguaucaucuauccaguaugcccagccuuuugacguugugacaugacccugucaucuacaaaguucaugacugagaacugcccaguugaguugcaaaacaacaauaacaaacuaaaauacaaacgaaacucaaaaucuuauauaacaguuuaagaauuuuguguuggucuaccuuuauaguuuaaucuuggcugcagguuagacauguucauauucuuguggugcaaauuacuuuuagcccauauggggaaagggguuugccuagcuuuucugcuuuuucuacagaguaauaaaacuaaauauuaaaaauauuaucccauagaggugucaaaagugcauaugaaauauaaauuucuauaaaaucucaaaauuauaaaaaauucuucaugacauaauuacgaguaggaaacaaguuaagcacauccauucacuauuauuaucuuugacauacggugauuacaaaacguuaguaguguguaguguuaggcucauuguuaaagugucuggguuugcagaggcucugcucagcuugcacaagucuguccaugugccuugggguugacugacuacuuaccaggugaccuauucaacugauccaaagcaugucccuuugggcagaacacacagucaagggcagacaaggcacuccacccaauagcaauuuggcacugaaaaguuacaaggcaaagggcauggacacaggaaggaaugagaccugggaccaaaagcaguucauuguacaagagccccuuuucaauuuuauguuauagucuuggcgguuuaacacaggccucaaacauguuagacaaguucuguaucauugaacuguaccccagucuaucuuguaagacugacaaauuuuauacguacagcugauuucauaucuuaauaucauacuugcaguguugcuuuuccuuagcucuuuaucaggaauuaucugaugaucagaaaaaguuagcuucaagauuacuauauacaugauagauaagguaacaacuguauggcaccagagaguagacggggaacaccagaaaggacgcagauguguuagacuccaucgauugucucuugugcaguagaguucaugaacauucuuuucuuucugcucuuggcucuucucuuuccaucuuuauuguauguaggacucaacguggucgccucagucucaauucugucaagaauugagcucuggggaaaaagaaaaaagaaaaaagaauuugagcucaacccucacaguuaccucauugucugggucuaaauucauauccccaacuccacauggacuuuuuauuucccaguccacucuugaguagagcagaguuuugucuucaucuuuuucuuuuuagucacucauucuauaguagaagacuuuugacuuuauguuaccaugaugacaaaggcuuacaaguuucugccucuagccuggacuucucccuccaaccacagacucagcauacaguaaggugcauaucuuguagacaucucaaacuuauaccuuaccuggacaacuugaauuccucuucauaaaccugcauuuaucagucaugucaauguuuugcuuguguaagccuugggauucuuggcuaaaugguuuuuuuguuagauugguucuguuuguuuuguuuuguuuguuugugcuguguggcucuugagucuuucccagucagucuuuauuaauaucaaauacaaaaugauuauagaaagagcaacgaaguccaguaauaggaacaugcugugccccaaauuuuguucagccuucagccagcugugguuuaagaaaaaggacaucucagaguggcuaagaggauuacgacuaguuuuggauaauucaaacacuaaaacguugcuaacuggaauuuaaaggggcauaggcuuauugugauacuucuuaaaggcaauuucaaugaauguuuacagaaaaaaaaagaaguuagcaacuucuuuucccauuuauugcuaaaucauuuguaauaugcauauauuauaguguuaauauacuguguauguauuauaaaggaaaacagauuggaaaacauaaucuaaugcagaugaaauaaaauaguuuuagauuucuguucuuuaccauguuuuguguucucauuuccuggcaucuuaaacaaaauggauacauauuaucaucuuauuuauauuuguguuguuuuuuaaaaguauguugaaauuuuccaguuuguacucaaaauuccaucuaacaacucgguuuucuuuauucuuuuuccuuguuugaguagccacaguucugcuucuguuucuaugaauuugcuuacuuuguguuuaggcaggauuuugcuauguggcccagaauggcuucuaaauuccccuugcugcuccagccucagccuccugagugcuggacuugugguugucacagaaugccuagcuaauuuagguuccacgugugccuaagaucagaaaauaucugugguuuaugacugauuaauuucacauaguaauccuguggagcuuaucuauguuguagcacauaacaggauuucuuccucuucaugggcaaauugcuuucauuguuuauucaucugccagucacaccauuuaaacagugugacuauugcugcugaggccauggugguuacacagauauccuuucaaagauaucucucacugcauccugcuuucaauuauuugaacauuuauccagaagugggcuuugcaggaucauaauuuuuauuuuuaauuuuauuuuaaaaguagucuucauaguucuuccauaguuguuuuauaaucccaauaacaguguacaaggauucuaacgucuacacauuaagccaaaccuugagaucuuagcuauugucugucugucugucugucuaccuaucuaucuauagacaggcucucgcauagaaaauaggauuuuuuuguuuguuuguuuguuuuggcuuucuuuuucuuuucuuccuuuuuaacugucaaugccagagcucacacagauugcuuugcacauacaagguagugcaaaacuguaucccuaguccccuccaccccuucacguuuccuaaacuugguccauaagcaagcccacuggcuuuagauacauagucuaucugucacuugauugcuuuuuauccugcacauacaucacugcuccacuucccccauccccgucaacucuuuuuggacugcuacccuggucuucuagcugggacuuucuguuugcacccuugcacagugauaaauugaacaaauagucuggcacucuccuguccucuauuuaaaacccaguugacaaccaucacucugcagagaaggccugacauuuuuuccuugguuugcagcauucaaagcaucccaccccauaagaacuugcuuccuugucaccugccuuaagcauaguagauaagauuuuuuuuccugcuugcaucuggugugcccucaaugugaggggcuguguucauggacauuccuugacucacaccuuccuacaauucaagugcuacugaguuuaaccucuucagaguguucccaacccccuucucugaaaagacaaugucugugaacugcuucuagcuucucugcuuucuuugguguaaguacuuucucccuucaaagauaucagacuguuuauauuugugacuuuccuugcuguguuccccugagcaaauguaagccuuacauaugcagaaauuccaucucgguaucugaaagauggccugcucagaaaauauucaugugauaagcgaauaaaagaauauaugugugugcucuuacaccugaacagcgcuuggcauagagguagcgauccugugggcacaugugcgauugucaguaguguuaguuuucagggagaacgccuuucacugggcuccacuucuugcuggacuccacuucuuggugauuucugcagcucaugaguucuagaccauugucaagaacuuugagcagaaaaguagagaugccucaucuaacugaaaacaacucagggauugaugacagcugucugucuagguucccuuggccccagaucaccuuaccuaacuugaaucuuggcugcuuguuauuaccugcaauccugcuuccuauuguccugugagagcagagccucauuuguccacagauugcuuguuggaagcgagcaucacagcacaaagccagaaauuccuccugcaggggaugguucauugacaagucuguggauuauacaauggaauuuccucuuaccucccuuuuaaugacaccauaauauaaaacuguaaacaaugggcuuuucuuccccauuuguuugggauacuucugaaauucucccaucugcuguucagaacuuuggggggcugugggauuagaauccuguauacuugcauuguuuucucauggcuuuguucacugauggagauauccauuuagauaugagggcuuuuaugguguugugagaacagcucuucuaccuuacauggucuuccccacuggggcaaaaugcugcugcugccucagucccagugauugugucauaggccuggagcauggucucugccuguucugccuccucucggcauggagcuauuucagucuuaccaguccugguguuuaaaacagaacugcagguugcuagggccuugauagguaaccaggugccuacugauugcaagagacccauggauguuuggacaucagagcuggagggauacuccuaggguaccagugucauuuaacuuggucugggggcuauuuguauaaaugaguuuccuuugaaaaucaaugcucucuacuuuaugaugaguauacaugcuacaaacucguuuugccucaguaaacaaaaaucuauucccccuuuaaaaauacuguaugauuauugugugauuauugugugucugugcaugguauuugagaaugugugugauacagcacacaucuagaagcgugaacacaagcauacacgucuguggaguugguccuuucuuuccuccucugugugguuucucggcuugucaggcuugcuugauuacccacugagguuucucaccacucucuuccccccucuuucuaggacaggagucuuaccguguagcccaggcuaugcuugagcuuacagaccucuuggcuuguccuccaaaaugcuuagaucagcaucaugcaccaucugauuaaagacguuuucaugagaaaagaaaccaaccacaguccauacuuacgaggucuccugcuguugaagagaaucaaagcucauaugggcucagacuacuguuaagaguuaaaggcagaauauuauaggaaggcaaauuagauggcaucaaacucaucauuuaaaggaggauugagagaagucagcuaaaauuuaaauaugauuugucuguucacuaccuuuucuuggccucuacaguagaaagauugggaugaugaagccagaauaagccaguuacauuugagagcuguaauaguacaauacaaucucaucgccugaaaggcauccuauccaugcuccaggaguguguugcuugucaucucuccagacuucacguuagcauagacagcuuagugaauguguggauaauagaaaccaagaguggguuuugacuauugcuguacuguguuauuaguguauuauugauaucuuuaagauugaauggugggcugcagagauggcucagcaaggaagaagaagcguguuugcugcucuuccagaguacccaaguucaauucccagauccauaggucuauauugugguucacuucuggagauacagcuuccucuucugaacuccaugggccccagcgacacacaugguccauauagguuagaaaaauacucuuacuuauccuaaaaucuaaaaauacucauacuuaaaucuuaaaaaacaaaacaaaacaaaacaaaacaacagccaggcagugguggcacaugccuuuaaucccagcacuugggaggcagaggcaggcggauuucugaguucgaggccagccuggucuacagagugaguuccagaacagccaggguuauacagagaaacccugucuugaaaaaaacaaaacaaaacaaaacaagccaaaacaaacaaacagaaaaacaaacgaaaaaacccaaagcaauuaaaagauugaacagugacuuuguauuggagaagagugguguugguguuucuguguguguaucaagaaugguggaguggaaaugucuaaaaccccugcugcugcugcugcugcugcugcugcugcugcugcugcugcugcugcugcugcugcugcuucuccuucuccuucuccuucuccuucuccuucuccuucuccuucuccuucuccuucuccuucuccuucuccuucuccuucuucuucuucuucuucuucuucucucucucucucucucucuuuucccccuuuuauuugauauuuucuuuauuuacauuucaaguguuaccccucuccaggucuccacucugaaaccuccuauccuuucuccuucccucugccucugugaggauccucucccaccuacccacccacucccaccuucccgcccuggcauuccccuacucuggggcaucaaauccucucaaacccaagagcugcucucccaccgauguucaucaagaccaucuucugccacauaaguggccagagcccuggguaccuccauguguauucuuugguuggugguccagucccugggagcucugaggggucuggccucuugacacuguugcucgugcccccccccccucauugggacugcaaaccccuucagcuccuucagucccuucuccaacuccuccauuggggaccccaugcucaguccaaugguuggcuguaagcaucugccucugcacuugucaggcucugauagagacucucaggagacagcuauaucaggcuccugucagcaagcacuuccuggcaucugcaauagugucuggguuuggagacuguauaugggauggauccccagguggggcagucucuggauggccuuuccuucagucucugcuccacacuuggucuccauauuuccucccgugaguauuuuguuucucccucuaagaaggacugaagcauccacacuuuggucuuccuucuucuugaguuuuauguggucugugaauuauaucuuggguauccgagcuauuguguucuuuugugaccggguuaccucacucaggaugauauuuucuaguucuauccacuugccuaagaauuucaugaagucauuguuuuuaauagcugaguaguacuccauuguaguacuccguuguguaaauguaccacauuuucuguauccauuccucuguugaggauguuucuuuuucaaaauggugcuggucacagucuggggagauagcuuauaggcaaggugcaugcugggcaagcauggagacuugagcucagcuccugagcaacgauguauaagcuugagcuguucauuuauaccuguaacugcaguacugggccagcgaaggguaggaagagacagaucuagggaccagcuauggggcugaaauggucaucuccugguucagugaggaauggucucagaaaauacggugaauauguaucacaguuucagcugaggaacauuuuuauuguuucuauuucuuaucuacuguggauugugaagagaugagcauggccgagcaaguaccugugggggagaaugacuagaucuuuggacauaugacaagaaaugguauagcuggaacauaugguagauuauauuuuuagaugauuuaucauugcucaagcugauugaauucagaaaagggagcaaggugggagcauggaagggguugagggaggaaagggaaagugauguaauuauauuugaauuaaaaauaaaaaaauaaaauuuaucuccaggguauaauaguaguaauaauaauaauaacaaaaacaacaacaauaauaauugaagaaaacaucucagugucaccucugaccucagcauucugcuacaugggugagcacaccugcacauaucuguguaugcaacacacacagacaacacagagugcugguuggguuuauagucuaggguguuacagaauguuuuaauugcucauauuuugucuugauauaaauaauauuauacuagguagaggcuagcauguagaaacugaaguucuuugcugaaaugcaaggaacaauuguaucuacaaauagaggauugguggaugaacacugagacccuuggcaucacccaggcaggacugagagugacucgggggcaagugagaaaaaaaacccugcuggucauaagucaacagugggauuccaguccaagcagaugugaguggaucauagauaggucaugcagaaaggauuucuggggagaauccacaccagauagggaaaacacauaccugucaggaagaacggguggcauucugagagaaagcagauaaauuucugagacagaagagggaccugaaaggagcaagugcagaaggacucguagggcaggucugguaagaccggagcuugcugcccacccuucuucauugcuccgcuaauguuuuuaucugaagguggguucaguacuuaaaugaaaacugcucuuggcggggauuuuuguccauucguaagaucaggaacaaaccuuauagaugacuucuuccaccugccauguaggagaggcgucuugcugaggggugagcagaggcugcuuugcuuuguuuggugcuuucuuucuugagacagaguuuugcuauguagccuagguggucucaguacuaggauuguaggugugcgccaccaugcucaccuuuagaacuucuugaugggaaaauauuucaguuaauucauauguucaucaaguacuguuuaagcauguagcuccuaugggcuuagcucugggcucagccuugaaauguugcugcagcaaggaucccuucccugucagaaccacccuuggcuaccucucagagucuauacaucacagggguuucuacugcagugagugccguuugcaagaugcuagcuaaaugugacaagguuuggguuccauaaaucccuccuguguuuuuaguauuacugaaauggggacuugaggacacagagagccauucagcugaacugugugagaugcaggcugcuaucugcccuugagcucuuucaugccaugucaucugcacugguguuauuuggaugauguagacuguugguuugaaacuuuaccgugcaaggcugucuuguucacaguguagauucugcagaucuacggugcgaguugaggucucacaucuugagcaaacuaccgguaucacugaugccagagagugggccacccagcauagcgccguuauagaugccuaaaucugcaaggcugucuuuggcucaguaaggagcucuuuggugguagcuugauuuucauuaguuuggguuaucuuauuugaacuuuucuagcuuaucaugaaaagauauaaucuaauacauuauauacuuauaucuguacauuaagcaagauugcccacuugaauccagagcuugacaguuugccuaguucagacagaggacuuauuccaagcauccccugucugugcuccagagcacuggauugaagguggccacacccacccugcauguaugugaacgcuaggcaugugcacucuaucccucaugcuuuucuagcaagugcuuacccacugagccccucugcagucacacuccagacuuacaguaguaauuaaaccauucugugcuggcucagagacucgaagggugguaaccuucuuaucugaagcucauacaauaaccagugacagcaaaauuauacauuuuacaaacaucuugaaauauuagcccuuccgacucauaauuuguuuauggcauguagaacgagaaaaauuauuauuuucgcauugcucuacuccuugacaacccuugggccuuuuaaagguugcaaaguacguagguguguuucuuuuuacaaaaauuauuugauauggguuuaaaaauuuuaauuacguaagagcuuauagaaaacagcucuuuuaggugauuuuuuuucaaaaaaguuucuaaagugauuugauuguuguuguuuucuuuugagugacaguauuggggaauucagcaacguuggagcaaacaguucagauucaaccuuuucaguuaauauccuaccuuucuggugcuuaguaauaucaccugucugugaaguuucuagaugaaguuaacugugauaggaagaaccacucuaauugugggugaaacuuucccaaggcagagaccucaaacuauauaaaaacaagaaagcagggacugaaggagcugaagggcuuugcaaccccauaggaagaacagcaauaucaacaaccagacuccccagagcucccagggacuaaaccaccagaguacacaugaaaggaucuauggcuccagcugcauauguagcagaggauggccuuguugggcaucaaugggaggagaagcccuugguccugugaaggcucgaugcccaaguguaggggaaugucagggcgaggaggcaggagcacccucauagaagcaagaggagaggggaugggauaggggguuuccagagaggaaaccgggauaggggauaacaguugaaauguaaauaaguaaaauaaccaauuaauaaaaaaaucaagaaagcaaauuugagugucagcauuccuccagcacugcaucuuaaacuguuaaagcaauauaaccagauuccccaaacugcaugcuguccuugacaggauuggccccaugcucuuuaacuauaagcccaauuacacccuuuucuguuuaaucugcucuccuuggguacuuuugucacagcuggaauguaacugacaccuccugggcuuacccguggaagucccucaaauaacaagacugcaaauugucucucuaguccagauugcccugccagugagaauuggggaguuugagaucugcucagagcuaggaaagguagcucuaaguaccugcagucugggcugagcuucucuaggguuugaguccuuguugcuaauggagccuuucgugccaugaucuucccuucgacauuugugcaugagguacaagcguugagaugucccugagacaguuauggugaaagguagaguuccuguccugguuaguguuugguugacuugacacaaaucuagacauauacgggaagauugacaugacaaaaugccuccauaagauuggucuguaggaaauccuguauucacgugugauguggagggcagugccaucccuuggcaggugguccuggauagaaugaaaaagcaugcuaaacuagccaugaggauaagccauaagcagcgguccucuaugucuucugcuucaguuccuauuccagguuccugccuugaguuccuguccugacuucccugaugguggauugcaaggcugugagcugaaauaaacccuuugcuccccaaguuguuugguguuuuaucccagcaacaagagaaacccuaagauguucccaagaacaacuguuacagauaacguaucucagaagguuugcuguguugaagguuuucugucucuuagauuuuauauguaagacuacucagucuuuguguaaccuugugcuggaagacauuucugugaacuacugauuuuagcauauuguaacauuauguuuagcuccauguagucaguacagugaguggcucuaugaccacugcugucugaacuuucagacucaaaugcaguagcuuugagagcuuuggaaggcaugguggggucaaauugccauggguuaguuccuggcugugugauacuaugaaauuccuuaaguucuugcagucucagauuuugcuaaaggauguuuguuuugauaauuaaaugagacaauuacugugaaguauuuauauagcucauaaaacauugccggaaauaaauuaaaguacaaguagguacuuuuagcauuguaauuauuaguuauauaaugauaauaccuuuuaaugccaauaacucuuuauaaauagagcuauagcuugguagccacagagaauuaauucuaggaccauuagagguagcaaaagcagccacugcucaaggcuuuauauaaaauggcauaguaucuucauguaaacuaggcauaaucuccuauauacuuuaaucaucucgaauuuauuuguaagaccuaauaucucaucaaugcuauacauuagugauaaaauuuagauaacaauaagcaaacuagcuuuacauguucauuauaagcacaacuuucuuuccucaaagguuguuucugccaguguuugauuuaugcauauggaaucccuggauacagagggcugacugcacuuguuauuuccauuagcuuaauguguguauguguggguguguguguauagucauaucacauguaucauauguguuguauagcaccaaaguuaagaauaauagaggaaggaucauauagauuauguaaugacccagaggugacuuuacggaaaauuacugggagguucuagggagguuauggacagcuccagggagugaucgcccucacuguuacagcucgugucugugaugccgcugccccauaaguguguuuuccacaaccacccuuguucuccuucccuuugccuauggggugaguuuggguggggcgcucaucacagaagccucucucaucagacagcuugcagagacugagcuaagcaugcacagacuuggcagucauuggacagagcugccuuucacugagaagaauugagcagacgcacagaaaccaggacugguggccuugaagguagauccuccucacuaugggagacgucagcaaaaaggagugaagguuuccucuuccagccagcaaaccccauuuccuaugaacagcaagcauuaugucagcugccagagcagcuugaauuuaccucucuucccuggauuacguaacgcauaggauucaacugugaggacccugggguguaaagcagucucuuuuucaggguaaaaccacucagaguuucagaaaaggaaaauaaccaccuauaucaaguagacaaaauuuccaaguaauucuauggagaaacuuuggaaggggcucagcaaccaugacagccuggcuaccuuggagacugccuuugugguugcagcuagaggcagguuagccagaccagugcuaaaggcagcaacugcaguaaccagaggcuccaagguccagucccaggaggaacccuuguaugggugaagcucauccccggagaggaugcguuuguuauuccugagcugugcugucuuuaggauucauagcuccuggcaccagggcucucggcuccuagacaagcgugguguaugccguuucuuguguucagauugcuugccauguucuacauaagucucuuuuagaaagaugggagaugauagugguaaucuauauugggaucaucucaauucaguauuaaauaagucugggacaacaaguaacgcccaccccauuacaagcuuuauaugaagcaaacaucuauuuuugcuuugugcagacuccacuguaugaagugcuaaaaauaagccaaugcucagaaaucauuugcgaugcaaaaaugacuguggugguggugguggugguggggggaaccauguuguuuucuguccuggauauaaguuaaucuuacaggucagaaaucgugcccuagaacuguaucugcuaggucauugcaaggcuuugcuggguuggagggaccuacacugcucccuguggacuagaaaugccaucucgucaacagaagcugcuaucagauucucuuuccgcuauuuuuuauuaucuaaaagaaaucuacuugagucuuggguuuuaaagguuuuauuuuuguuauuguuguucccccuuuuugaaaaguaggauaggagcuagauguuuauaaguagagcacagguuagagucacugaacaucaggaucauaggagcuuuuaaagggcucuguucauuuccuaauucugacagugucccuuaaacuuaugcucuaugccaggccucaaaagauccaauccuggccuuaaugcauugacaaauacugagcugucaagucagaucaagugugcuccaugcagucacacaacuaaccuuagauaucaaucuccgaaccuagagauuggacaccucuuugcuuuugucaaguaccccuuccauccccguaaugagcuuucugauguagcaacguuggaacgcgccagagaaguagcuggguaguuuacagccugagggcuggguuuccgcugagagugagacaccuccuaccucccucaguguguccagggugagccagcugacccaguuuugagucuauuuaggagauagauggccacuuucuccucucccaccagccuguauaucuugcugcuucugccuucggucagggucaagaugcagauagccuugagcaucuuccuacacugcugagguuggcaagauucuuuccagacucccgaaacauaacuaaugccggagaaugagugagagagggcauugcacagaaaggaaguggauaggccggacucugguccuggaaggcagacacuguuaacuaggugacagacuguuuucugagcacuuaacccuuuacaaaccucucuucccgacugaugguuuguuaaugguuuguuacaguuuccagugagccgcuuugcuuuuagaaaucuacauggcucaaggagaggaaaagcagggcuagguuuuucuggaaaaaucuauggaaugugcucucuucccaucugucugggugcuucugucuucucuugucauaugcccacacucuggcuuggugacauuucuaaaaacccacaggagacaguggcagaaucuaagcuugaacccuguauuagagaguuuuguuuuccucccccacagccaaccuuuauuauaacaauagcaaucauccccucugcuauuuauuguaaauuuucucagcauauaaaggacucuuggcauaagggaggaggaaaauauaguuuaaagaaccgaguuguuucuucuauaaggagaguuccuaaaacaugaacuuuggacuuaguuuggaagaaaaaagaaaaaaacagugaaauaaacacuuagaugaaaucagccuuguaaauguuuuuauuugaaagauggaaauugauuguguagguucauauguaacaccgagguccuauagaagcuguagacuaugagucuguacuuggggauuugaaaaaaagcaguuacuuuugaauucuagugccagacucugcccguuugcacaguuucacagggucugugcacagcagcgcacagugucugaagguucccaggccaagccuguuccccggcuggaaacagcgcaccccggcuucuccuuuggcucccuccguguuuucgcuuuuguagcucuuagcauuuucucuuccuguccacaauccagacaguccaggcucgaguuggggugugugucccugucccuuauccggcugcuccgaggaagagccucccuggccuuuugcuuucauuugccuuauauggucagcuguggaguucguuauuccuggaaagggccuuuucacuguuucaagcacuauugcccuccaccaucuccugaggagaacuagagcuugcuggaagcuugggguuccugguucuaauggggauccuaauggauucucacugguuccagggcaggugauguuuggaccucaggcuaaugagauguuuaacaauagguguauaguuaagaauaaacuuccuuuugaaaccagggacuccagaguguuccgguguuuuguuuguuugguuucuguuguuguuuguuuguuugguuucuguuguuuguuuguuuguuuuuccuuucuuccgagccccaagugggcugguccuucucauuucccaggauccugcugccuagauugccuuuccccucguuauucucucuggcucugcuucuuggagggcuuuaucuaccacaggauagaugacauugauuucagucagauccauguccucaguuaucuucugaaguacggcuuccggugucauaaagaaacagucaucuuagugguucccacucaggcggcugccccuccccuuccugcuccucuuccuggugggaucuagccucccgaccugggcaagccgagcagcagcacuuuaaaaauaauuagacugaacacaagagugacaagaaggugugguuuaucuuucaggccaugguuaguuugugcuuuagccuaaaaaggaaguuuguaguguguugaaugcaaguuagauguuucuggaugaaagguggagcugaagaugaggguggaguuaauggaguaguccuugcuccuggcucagacaggaacauuucucuaaaaaacuuuuauuuauuuuuaaaaagggaaguugaauuugguaaugguuugaggcggcugccuagcuacccugagaccgguuuuucccucccaucuuucauggccugccucuccaugguggugaggauugggcaagcuuugaagucacuuucguuuucuagaacuuguuggugaagccuaccccccacacccccuacccccggucaccccucuuuuuuuaaagcaugccuacauuucucucuuccagcucugccuguccaaaaugacuucccucuuuucccaaauccccagcaguucacugucuggcaaaggagugacaucuggcagcuugcuaggguagagggagagagauguagaagggaagacugcacguguucaauaccacaauuacccugagcuccaugcugucaggauguauuacccacccacccaagccagggggggggcacacuggagugacccaccugcacgauugugugugcgugccugugugccugcuugccugcgugccugcuugccugcucuggcagguguuugggcagaugaauucuccauucacuccuaucugguucauguauuucugucugcugaugagaaaauagcaagccaacuugagaagauucaaagccgcacucaagaugugucaggaacaaggcugccugaugcugagggaacaacaugaaaccgaccaaucaccugucuccauagugcggccacccaaagucauccugcacuaggaugaccauuccuuggguggagugagugugucuuuguccuuugcacauauucucuauucuggugcauuuucacauggauaaugaugauuucugcuacagcgacagguauugaguacuucaugguaccuggacuguacugaaguucacccauauguaaauuugcaaacaugcucucuuaugaggagggugcuggucacaucuuuuauuuuucggaaacacaggccucaagaauuaacaugcucagacccacaguuagacauauacaccugacugccagacuuaggaaguggccuuccagcugccugcacuaagggccuucucacagcugaagccccugccugguccugcguagaaagccuugcaggcuuucucuccaucggucugaucguccagugcuggaggcugccuguaugauuugcaugcguucuucuggugauugaugauucuuccauaaaaucacugcugaccuuucuuuagcaccagguucucuuugcaugugugcuuugugugcugugugugagcacgagcgcacggguuuguguaugcacagauguguagacauauguauauauaaugcuuguaacagccagaagucaggcugcacugucgaucuucaggagccauacaugauugcuuaagguuuucuuuucaagagagaaucguuuacuuugccuggggccuaggcaaguagguugccuagauagccugaugcgcaagcccuagggaucugcccgucucuccuucucuccuuccucggaguugggguaauaagcacacauuacccaggcagccuuuuuaugugaguuguggggaucaagcuuagguccucccaaguuuugaccuaucacccuggccugccacugucucuuuugagcuuccuuugucuuguuacauuacuguguuguuuuuuguuuguuuuuucccugacuuuuuuucaucugcuacuuggaacugucagauuuucagggccucucagguguugguugcuaggaauaauuuccuaggagauuaccacauuguuucuucguguucugugucuacaguugugaguugggcuugggcauaauuuuaaagggacauucucugggagaucaugcugaucagcuggccuugcuuuaccuugguacuuuauaaguuauauguaagaugcacagugaugucauccaaaugaagauuguagacuggccucuuuucuguuugaccugcucuggggcaaaagggagaacauuucuacucgcuaagaaguucucaggauguggcugcuaugaguuuccauuucuucaccugaggagcgggccugagcucacugguccugccuuuggaguaucccuuauuuauuuauuuugugggauuuuccccuuuccaguucauuauggagcugucucuagugguggcuggaauuugugacuucagcagccaucuggaagcuuugcugucaccagugugaauugagaauagggagaagaaugcacgggggauugaaggagaagcuguugccauuuggucaggacuugcuaaaaaggcaggcgucccuaauugguagcuuagcagcuaaugguuaucacugaaggcuguaaaucacacugccuggagucuucuugaagacagcuucuaacugcagagguucuuaacaccuuucaucugacuuuuugcuaaauagccugcuggaguccaaaauagaagcuguguagggagauuacccuuaagcagaucucagcugccaagacugcugugguaaaguuguauugcuccccacgccccuggcaugagauuggcagacaaaaauccccaaauggaaggcuugggagaugguuuggggguggguaaggugcuugccuugcaaguguccggacaugcguuugaauuuccagaacccaaauaaagcaagguuugguaucaugcaccugagauggaggcagggaaugccccagagucuguaugucagcucagaauucgcagugguacaccacagagaagagaugcuaagacaagguggaaggugacagccaacacggacuuccacugacuuccuggcccugcaugcaccucccugcaggcauauaugugugcuugccuuucucaccucuaacuguuggccuggcccccugcuucccucucacccuugccucuucuccauucacacccacuugguagcugaucuuagaggcuaaauggauggcuaacaugguuaguuucuccuaucagcaucuguucucccaggagcuaaaucuguauauccaucucucugagugacaacuccccaggaacagaccucagugauagugaaaccucgccgugaugcccugucucaaauugguagagucuccccgugcccucgcccgcuccugcucuuuccuaucugaccuuugcucugauccuuauagcgucugauuccucuucauccaucauccauugcauucuagccaucugacgccuguuuucugacccaggaugguguugcugaucgacucacaucccugugcuugaccaccccaugcucuugugaaucaccaucgucugucuccuagagcagugucucacuccucuuugauaaggagcacguugcauccaggagacauagucaagaaaaggcagacaacauacuuaaccuuuaguuuuuguagugcauugcugugauauuucauuugugugugugugugugugugugugugugugugugugugugugugugugugauauuaguuuuaaucuauuuaauucauuuucugacuugcuuucaaauguauaugguaguuagaagagcaguaguucacacuuaguguuguaggcagucugugaaguuagugacacugguucuaacuggaaaccuuuuagaaguaugacugucacucccuguaggccuguggaaauagcuugcucugagacaggcccuccuuuugccguggaaugagcacagucguccuucuagcucugcuggccuccuugccauccucuccacugggccagaguuguaguggucacgguagaaccauccagauuaugauaugguugcacagugaugacagucccucauggccagcacaacccugcaggccucuguaucccaugagggccacuucuggagaugcugcagguuaagauuauuuggaggaaugaaaaauacauaagcaauaaacaacacuagagcccuagacuuggagaaugaggaucccuggguauguagucaggauagaugaacagcuugcaucaucuggucccugccucccucccacagcggcccucucugugguacuccuggaccgcuaggcucuacacccauaguccaccuuauagcccuuguaaacagccagcugcuuucuacccacaggccuuugcauucacuguggguucuaccuggaauuuucuucugucaccugcuucaugacucucuguagaugccaucaccucagagagacccccucccuuccuguccugucaccuuuaacccuuuagcuguuucgugguguuuuuaagaccccacuccacucggagcucugcauuuuguguugcuucauuucuagcuuuccuuucuucucuaucgaauuuaagguggauaugagagacuaugcagagauugugcccaucuuggucaccacugugucuuuuguaccuagaacugugucugauucaaaggugauacagaaauucauauugcuaauggugggaaagcucaaugguggagcgccuucuugcaugccugaggcccuggcuuucauucccagcccugaaaagucaacagcuggaaguagcuuaaaagacuguagaauggcuuuucuggcucugugugucuucccuggcuggacaagggacgacagaugcuuuguucuuaguugucacacugguucauguauuugauucaagaugacauuuuucuuucuucuccuggggaagaauauaaagaggagaauggaaacaaaacaaaacagaacaaaaaacaauaacuaggcaaugucaagcagcaagucugcauuugguuacaaggucuuuguccugcauuguuuuuguuuugucguaggccccgggagacauguucauuucaccuggccauuuuucuuucccagucacgcacagcauuugcacugucaacccgaccacuuuugucagagguuguucuggaguggguuuagagagcauguguuucaugugauggcuuacuugggcuugguugaauuuuacacuuuuuucacagucuucaucuggagcaaugucaguugaucagucagaucugacauaaucaucuuauguaaucagacuucucauggaugcagauuggaaggcuuuugcagcuagguuuuagaacuccuucuacugugccugcuuugagcuugggcuuccugcuucugauccuugccccuugauacagccuucucaggagguuaauucagagcugcgguucugaaggaugcuugggcuuuugaaagaggaugcugagacacgugucuaugugcaauaacaaaauuugggcaaguacagaagaccacaucaguccuguuuauuuacuuauuuauuuauuuuuaagauguacugccacagccaucuggcuauaccugggaaggcugggagguguuuugauuagcuuuugaguaguuuagguaugaaacgcaguccaaugcccuuggucaaacuaugugucuguuucacacaugucuuugaguacuaaugcguggguggugguauucaaguacaucaaacauuuugccagauuuuccucauuguauauaaaauguguggucauugaucuacuggaggaaggugcuucuguuuaaguaaagagguuccuauugcuuuuuccucauggccuucuuauuaaucauggaccuugaagguacaaacaaccaaaacucagcucauacauguuggcuuacauaacugucaggggcagagaggcuguaggaauggcuccuuguccuuugggccuggauucugacccuucuccacauuucaucuguucuccuaugagugauucaguucugaguccagucuccucucuaugaugucuaaaccccuuuugguagcucuggauaugaacccucuuuauagcuaggcuggaagagagagaaagacucugcuuagcuccucgccagucuacuaacuaugaggucaaagacuuaacacugaggccauggguguguucugucucugacuagugcugacucauagaguuccuuuagcauagagagguacaauaucuucauuuagacucugagugacaagacagagacuaguucccaaggaaaugggauuggugacauuggaagaccugggcauuggucuuuucuggguaaacacuucuuggcaugaucauuggacaggggucuguaguuugauaacugaggguguccuguuugucagaagagaacaugucaagagacccucuacuuccguuugcuucuuugacuuguaaaauguuggauuucagcuuuucuaauuguugucuuggcccuggguggucugccuacuaacaccuauuacaugugauauuuauccacauggcuuauacuuaugugaacuuauacuuaccauuucuuuccucugaguagcuauucuacuuacaaacagaaggcuuagacauagucacuuugagcccuaaaacuugacauuguuauuuagcuuacuucauccauuuuuagaaacagaauauuugacccaagaggucaaguagccagagaugucagagcaaagucuggguugcauuuuucauuuuauugaagcccugggauuucaaagcugugagcacaggucuaugguuuauguagcucagugguagaguacuuauacagcacggauguaucccuggauuccaucaucauguaagacauggcaaaugcucaguagauuuguauagcuuuaccaagugaaccuagugugaaagagaacacaaggcauguaauaaagacacacaagaggaggguagaggugaaacuggaaaagugcggugagaggcuccauuaccuugagggaugauuguauggggcucaggaccugcagcuuagcagaaagaaccuuugaggauuucuggguagggaaggauguggucagucaacaggugcuucagaaagcagauguuggcagucaccugagagauuggagccagggagguugcaggaagagucacugaaugagucaacaagcagggguucaaagcucucaaugaggcagcaggaaaagugaggguggccuuaagcagaagucaguaucucuggggcuuguucacuaguuuuggaagauuugaggagagaagaaaauuagagauaauguaagcagccuuuucugauuccaaaaaaugugggauuaaaaauggguuaaggcagaugguuaucagaaugacuagauacugaguaaggcaggaacaggaaauuauuuaauccugauugcuauagacaaguccaugagacauccaugucaaucauccagauuccagaaggacccagccgagucugagcagccauggaguuagugcagggaacugaagcuccagucuggagucuagagugcuagauggaggggagagcugcggaggaaaugucucuggcucagcaguggcaguuaggucagagguguaagucucagcacagacgugcaguuggugcugugggugcuuggccugggagcaucccaugcacugcuuccuaguucugugguucuugcugccaggcucacccucauaaagccaccuuuccugagauucagcaagccuacagugcuggggacugggaccacugguagaggagauugaaagcccaguaggacagccugugcuucaggaggcaggagcuguauaccgaguuguuaccaagcacgcugaaaugauuuucuguagacccucgcugauauccacccucagagccuucaccccacuuguuuccuucacuucuuuccagcuucauuggaagaacauguucuuaaaucaguaaaucaguucgauguacgccuuuguuccaggaccccccaugcagggaccauaacccaaucuagauguugauuuuucuccagguaaaugaaauuuaggucuggcucacuguuaacaagagccucuugacguuguuuuucuaccccuaguguguaccuguccuuagacuguucuuuacccacugagccaucucacugcgacugcuuuguuuuaaaucagcuccauugucucggugauaaagugguuggguagcacggaaaaugaggaggauggacaugggguaagcaacgaacuguccgcuaccaguguuuaaggagaaacugagaugcuaucaggcaggggauuguacggugggagaccugccaagugcuugaggguauccauaauaguaguaaauucagucugcaugaaacccuuaccuacucuugccauucccaugguguaugccuuacaccaggagauaguaugacuuuacccaucuaaaacgggaggcugagucuagauaaugaguacagcuacaaagguuaaugaaagucucaucauagugcccgcugcagucaauauugaacaguuuacauaugaagacgagaauaauagaauaaucaauuugcacgugugguuggugucuuucucuggccucuccaucuuaguuuuggagacagagucucaugacaacuuggaugucauuaguuagguuagacuggcaagcgucugggauccuccccuaucugccucccagugcugcugucugucuacaucucagacaaguguuugcaguaaaacuucauugugagccaagaacagagaaagaguucccaagggauuguugcugagggucuaacauuacaauugaaagcugaguccauauacaaacaggcacccccuugcuaugaguuauucuuuuucgucuuuuaaaguauuaguuccuaauaauauuugucaucuuugauuccgaaacuuagacuuauuagcagaguaaaauuguagcuuguuaucccuguaaaguuauauuuaugauuugucaauccccuguuuauaagggccuggauuggaacucaggauuuaucuguguccagaggguugaacaacuggucauagauaggcucucauaucaagauguacuaaagugucuagggcuugucugcaucuuugcuagggugcacuucuguaugccuguuauaaaaucuuaggcagugucuuaugaucagaaauauuccuuggcagcugcucauccugcccaucuguacacuaauuaccauuaaagccuucagcaucucuaugcugauuauauagagcaggacacaagccacuccuugggccaacuguaauucacacugaagcacguugacuuuuauuguuucucugggugaguagaaggaugcuggcgcuuacagccugauuaucucugugugcugauaugucacuggggcuuuguggcuaaugcauauucaacaagcuugaguuaggacugucgauagaacaguaagcaaguaaauaaacgcaaugaggacagagcaaaugagcaagcaauucuauggccagacucaagagguccucuugcuuccagcugcuugcugccauagaguguugccaaacacugguuuguuuggcuucuuugcuuguuacugaaaagcuggagagcuggguuuuuuuuuuaaugugaaaucacugaguuuccaaauaguagcaauuaauaugagucuguuuaaaacacugaagaggccagauagaaucuuguguguggguuuuagacugaagucuaagagcagucagauuuuuacugaaaauaauguuuccuuaagugaaacaacuauuagcucaugcguacagaacaguguggaagguauuuuguggagcuuggaggaaggguaggcaaggaagacaucacuccuaguguagucaaauugggccagggccauuuauaagaacccuuguuaagagggaggacaguguuauggguguucccaaguugggaagauaauuccuggcucucauuaccaaggaagggggacauuuggguguuuauaaagaagauaggcaacuggcaccugugguaggcagcuguccaguauuauaacaaaacaccagagccaaucaguuuacaaagagacacucuuacaaagucaacgaucaguugaccuuugggucaauaguaaggcaguccaaaauugugggggcugguaaauuaucaaacugguuuauaucaugaucuacagagaaaagagaaaggaacuaaggaagggcccuguuauguuucuguggcaaaugaucugaaggccucccaccagauucuacuucuguauggguccaucgcuaaauaguagcauuauccuggagacaaagccucaacacaggugccuagaggagacauuuaagaccaaaauuuaggagggcuguucuagacaucaaggguaugguguagaaaucagagcaaacuuggguucugaaaaccauugaugacuagcuuggcaguaauuugaaccuauaacauucuggaaagacucaugugucaaaacuucauguuucaacuugcugauaaccaaaggagguaguuugaacuuuggagagguagggcuuaguuugauaucuuccagucauugagguuauguguagaagaggauugugggaccuugguaugucuccuucuuucuccucuuccuccuucccacccucaccucuguuuugaucuccccaaucccagucaugagguaacuaugagaugaauggguuuuucauccaaauaaaccuuuguuuugaucacuugacauucaucucaguuauuacaguaccagaacacuggcuaguacacugucucgggcuguuguauacuucugugauggcuuacuacaaauuuucugaaggcaauuucuaucccacucuucuggaagucuaagaagucgucaccaguuuuuggcaagagucucugugcuguguuauaauguaacagaagggcaagaaagugcacaugaaacagaaaauugcuuuuauuuggaaccuacucuugaguugaugccaugaguccuauuaccuaaggacccuuuaaaaguuccaccucuuagugucaucacaauggaauuaaauuuucaaaugauuugagaagaaaccuuacaaccaucgcagaggccuucgguggaaaauguggacaggcucauugaagggcccaggcuagagcucagaaagaacauuaucacuuuggacauuccuauuuugugguauuuaaaagaaugauuuaaaccaguuucaguuuuaguuucaaaguuagaaacauuuuccuggcaugucuuaauuauaugugaauguuugaaucugccacaugagaugauggccugugggcuguugaggaauugugguguggagaggaugagaugaagugugggauacugagaguaugaagucagcgauggaagaugcagaccuuggagcgauguuaggguugugucauaagaacucaccagccccacggggcaucauuugccuucacagcucguuaacggagagguagcaacaugagcaccacuuaguuucuuggcuguguguuguaacguaugaaaccacauugcgccuuugugguccucagcaaaaugaaccuggugcuagcauuuguuuuuacuucuggaagacaacuuggucagagguacuuaaccaaauauggcauuguauucauugccugggaaguucuuagagaaaaguggccauggaaugcccuguugccuguguaucagcaggcugagggcccuucuuccuccuccucuugucucugcaaagcuagauuuucauacccagguauaucacuucauaaugaauagcacuuugugcauuuuucuauuauuaggugcuauguuugccuaauuuuagagaaauuauaugauuuuccccccaaaucucugugauuauauuuuuagacuugccuggugaguuuuuagcauuuucucccucuggugcucaaaaguacaugucugagcugccugccucacaccuagaauuuauuuuuuaaguugauaauugagauacuacuuuuuccuuuauuggugauauuggguguagaguggguuggguugauucgaaucauguguucuaggaguuaaggggaaggaaaccuguaaucuguggccagcugauuuuuagcagauuccaaaaugaugaguuacauuggagauuuuuuuuuuccugcaagugcuaccaagacaaugggauuucuacagaugugggaauauagaagacuauuucucuggcucucagcauuccuuauuggcuggucagucuuuaucuaggguuggagccaagugaaauucccuccuucuacaucaugucuaugcccucaugucuauuggccucauccuugcuccggucuucuuuagguagccaugguggugagaugucaggauugcaacuucucugauauucucaggggacacaaucucacagaaagcuuucuguuuccucagccccuccucugcagcuaccccugagccuuaggugcagaagcugggcuguagaugugucaugugguacugggcuccaugacugugcuuugucauugguuguaguagugguacccgucuguugcaaagagaaguuuacuugacugggguggagaacuauacucacacguggguauaaaaauucacacuauaguuaugaauucuguugguuuagcaacaauugguuaauacaaaauagcaauuguuuaauacaaaaauggaccaaauguuuaaaacauaaaacuaugagacuccuauugaaaacaaaauacagcuuuaauucuucaugguuuugggcagguaguaacaaaacaaaacaaaacaaaaaaaaaaaaaagaagaagaaagaaaaaguaaguacagaaaaacugagcaucuuuuaaacucaaaacacaacuaagggaggaaauauuuauuaaugagguuuugauugggaacuagcauucagaauacauagagaaugaucacauccuaacaguugaaauagaaguaaaccaauuugaaaacacaguuguccaaagcaauuccacaauuacuagaaauuuugaaagauguucugaaucguuaacucauuaggaagaugcagaucuuaaccauaauuggaagucaguugcuguaaagaagauggaccauaaagaauguugcuauaggcuggggauacaguucagcaucagaauguuuguguaguaugcacaaggccugagguucauuccucaguacagaacuggacaugaugcuacuacaugucuauagucuuuugucuuagggagguagaggccaucauuggccacuuaaacacuaucuaaagcaaaacaaaagaagcuauggcagaaaaacaaagaaauacuggcaagaccuuguagaaaucguaaucaucauauggcacgguuagaguguuuaaaauugugcagugacuuuguaaaacacauaggcaaaaggucagacauagccaagccauaugaccgagcagacacacuucaaggcaucuaaccaaaagaauggauauucauaguggcuuuaugaaugauaaguaaaguauggagauagcagagagguuuguugauugauaaauggagaaacaaacacaaugaaauauuuuucaugcauaaagaggaaagaaaugcugaucuaugcuucauugugcauggaccuuacacauguaauaaugauugaaugaaccuuguugcaaaaggcugcaaagucucuguuuaugugacguguucagaauccauacacuuuuagaaaguagauugcuaguuaucaggccucaaagcaugggagaauggguagugccuacuaauggacauggguuuuguuuuguuuuugccccuaggguaauaauacaaauacucuauauuuguguuguaguagugaucauauaaacucugaauugucucaaaacugcuaaacuauauuguguauuuuguuagguuugaaugaaaucuuaguaaaaguggcuauguguaagauguuuaagcuuacuggucguaacacaugcaaguagaacaucagagacacauuacauaaaauaauaaaauaucuacuuuugucuaaaagacaagaaagugaaaagagaguaugugggggaaggaaauaagaugaagucugcucugagaaugaguuuuugauugugucugaauauauguuuccugugggaggcaaauacauugcaggcauaugugcuggcaaggaggcuguuuggaaugaaaugaacccaggguuugugcuuugggguuuauagaguuaugaaggcaggaaagaggucaagaagacagaauggaggucagaggcuuagcugaagcacuggcagaaaaaaagccacaaguggguuucucagagagcugcuucuauguuuucuucauuugggagcauaaaggcauaugcaauuuucuuguuuucuuuugagauggagugcuacauagcugugcuggccucugacuuguuauguaacugaaguugaccuugaguggcugagcaucuugccugggcuaucugaugcugacauuuucgaugugaaccccuggcagucgagggaucugaccaugaaagcagaugucuaggguuugacaagggcugucuagcugucaugacaaguggaauaaagaagccuuucucuucuauguuggcagcaguuugacuaaguaagggccuccugauuucuccaggaauggguacaagugagggaacuggucuaggaauccuauagcugugaagaaagcaccacaggagguggagccuaugggaggaaggcucaggcuccuaaggaacagaugcugugcuucagauaugggaaugcaggggagggaccucuagcaaugucagccugaucaccaagaugccuguggaagugccagugagaacagauggccacugggagucuucagaugggcggcccugcgaaggaaaccaaauccuguauguaguauuccagcuggaaucucaccauaaggaaacaucagauaaacccaaaggaggaacaaacauguuuucuuucuuucuuuuuauuuuuuuccuagucuggacaaaaaauagcuguugaaagauaguaucuaaguacaguacugaucuucaguuggauccugaacuggaggucagagagagugcugggaaaacauugaguuaaaugacaaaacgggaaugugaaccauaaguaacauaaacauaacaccauuaacauuaaauuugguggaacugauagcuguccaggaauacauauaucuuacauuaaaucuugcaugauguauacaacucaaucucaugaugugagauucuggaaauaauuucauguacacaugagauuacuauguacauaucuguauaugugcauauaucucuguaugugagagagcaaagcuagggucuuacucgugauaagcaaaugcucuaccaccauaacccaacacacaugcauaugcguaugcacuaagagugaaauguugaaaggcuggugcuagguuuaaugcuguuuaccuuguaagcuuccuauaacuuuucaacucuuucugaauaaaaaucuaggaaaaguguguccgugaaugaagaaguuagccuuuauauuuuaauuuccugcccuuggggccagaagggugaaagguguuccuguggcucaguuugcucuacgauacagauggaaccagagaggauggaacacgggaaugcccucaggauaauggagggaaauauaagacaggagagagccagggaggcagguaguagagucuuagcuugagacaguacugggagcuuuaauugcucaugggaccagagacuguucaugucuugaguugucucuuuagcaacucuuccucucaccagaggcauggugaaguuuaaaacaacaguggacgaugaaagucaaagguguuuucugauuguaucauauauguuuuuaacaucuaacauacccauacauauauucuaguuauaaggcaguucuagaguacaaaagcucuccaggguaggauguaggacaggagaggcuucuuuagaaccuggagaacuugacuuugaggugaguucagacuguuauugaugagugaagauaguccuuggcauguagugguacugauguggguaagguguuguggaauacaguuucuacaagagagagagccuacuugguaaaggcccagaagggugauacauggcacauacuugagaauuguaaugacauggagagggccagagugguguauucauggaggggguacauuuuaaagaaauggaacaggagagacagaugggccaaaugaagggcugacacauguggcugaaguucuuucuacagcggguaauaguaguuuucaaagcaucugcucauuugcacugacaaacuguuuaagauguccuuagacugggagauccacccugauugcuggcagugacuuagugacucaagucuguggcaguucuguucuuuagugagucuuagaccaggaucuuuuucggaauauaggugccuggacucuccugagccuacaucaaagaucauauuuuaucaagaucuccaggcaagcuggcugcauggugcaaucugagaagugcuguauuuugaaaacucagccaaccuuuacauuguguguuucucaauauguugcggccucuugaaucagagucaccuggagaauuuaugagaaaugaagguuccuaggcccauccaucuacccugguaccaucuacuauaugguaggacaugugguauaaaaucuuaagaguugcucccaauggcaaccaccauggagagcuggauggaaagcauucuucaugaugcaacuucccaaaugaugggccaacgaacugcauugcuuugaaggcugccccagugacuaacacaucccuaugggguuuuagacgggggaaguaauuuuagaaagugaauuacauucauuauguuggauggcaugaugcuucugagacaucauucuaaagguucuaacauacccuaugcccgagucuugucuucaucagucaccuucuccuuuauagcuggaggacauugguuuguagaaaaaguggggaggaaagcuuaauuuuacaauucucaugggaagugauuucaucccccggaggacauuuggccaacuccugcaggaguggagugcaauugacaacuaugguugaaagcccaaggaugaugcuugcuuagcaccucuucuagauugcuguaucaaaaugccugagauuggcuagcucaggagauagaagguuuauuuggcucaugauucuaguguuuguaagggcuuaauauccucugcagaacuggcacuuggaagggcaagagagcaggagacuggagaagagccagccucccucuguaacagccuuccuugagugaacuaauugaaucuaccagauuugauucacuccuaaaagauaacauucaacuguuuggugaauggagacuggagcccuagauuagcuccguuucucacugcucuaacaaaaucccugacaaaggaacuuccagaaagaaagguuuguuuuggcccaugacuuacgguugcaguccaucauguugcuauaggcgugccaucaggauaaaaagacgucagaacagaaccagggaguagacagaugcgugcugcucuuagcucauuuccucuguuuugaaucucaaccuguaggauggugccacccacaucuaggguaggucuuuucccuccacaauuaagcauuucuggaaacacccucauaggcacauccaggggcguguuuccauggugauucugaauccacuugacaguaaggauuaacuaucauaagccccaugaccucaccacaaccuuugcacuaggagccaagauucuacauugugauucuuugggagauaaccaucucuaaagccuggcagcguccuuuaguacaaagcaguccucaccucuaagggauuauuaauggugcccaaaauacauauagcauugagcaacucuguucuucaaagcacaccauuuguauguuagaaucauuuguagcaucuucuugagacuuugugauuaggccccaacaucugaggcaggacuguacuaaaccuuugugguaggagaauuuugacagucauucuucuuggcagauauuuugaauuuuugaaaagugcuuuaguagugggcuguguuugcuaggcuaaaaauaauguguaagcacaugaagcauaggucaugaaagaaaguaagaaaacaguuuucaucuucagggcagacacuggaugucuguaaagugagccccaauguaauaguuucuguuuagcuaggcauagaguuaggguuagguucacugaggguagguauaaauacgugcaaauaucaaaugugguacugugcaaacugcauaucuacauguaggaaaaugaaacuaggucccugucucucacccuucaguucaaaaugaaccaacaaccuuaauauaacaucagaaacucuaaaaccgucagaggggaacacuugaaguuauaaguagaggcaagacauuucucgaagugacuccaguaguucgggagauuaucccaaguauugacaaaugggauugcauggaauuagacagcuuuggcacaguagaagaagugauagagucaagagacgagcguacaggcugcgagaaaaucuuugcgagcuaugcacgugacacguacaguuggagaucaauaccuagaauauauaacaaaguaaaaaguuuaaguccuugaaaaaucaucauucagucaauaaaugggcaaaugaauugaacaggcaucgaaggaagacaugaagaguuaacagcuguacaucaaaaaguucaaccuucauagccagaagggaaaacuacauuuaaacuagauuuggauuccaccucacccuggucagaaugucgaucaagaaagcaaaugacaaauguuggugaggaugugggggaaaggagcccuuauuuacaacuggugggaauguaacuucugcagcaaucgcuauggaaaucagucuagagguuccuucaagagcuaaaaauaggacuacccggugauucagcucuuccacuccugggugcauaccuaaagggaucuaagccagcacgccaccaagaugcuuggggacauggauugugaugugcugguuacaguggaucagauacggaaccagcauagaggcucaacccuagaugaacagauagagaaagagcggugcacauacuagugagagugcaguacgucgcaggaaaaggggugggucuaucugcagguuggugcgauaagcaaaaucauguuuucuuuauguguaggauccguauuucaaucuaucuguccacgugacacgaaauuaggaagggguugcuugggagaagaaaacagugagaugggaagaaagaaugacgaaauagauaaugaacaaaguccagugaucuguuugucuuuaaauaucucagugaggcugaugaguuugagugcugauuaaaaaugaucuuuucugaauggugagggcauggccccacacccaccugacaggagcugucucggagugcuggguggagcacaguccuggggugguccagguuagguucucaucgucucucuaaguagcaagcaggaaagaaagggauagcaaaguauacaugggcaggcauccuuguucucuuccuguggagaacugaggcaaagccgucugcggcagcucugcucggcuguugguuccuuuucuauuuccaguccguacccacugcacagaugaggaaaucaucuguggggcuacgggccuggcucccgagcaacugacuccucuggcuucuuucuuuguguacacagugaucuuccuucccugccagcggccuguaccugccaagcuccgccgagggcuucgcuagauggcuuucgcaucucggcuugcuuuuguguccccguguccccgugaugcagacacucuucaggcuucccauggugccugcaaccagguuuuacugacuuuaagugaaaggcacaucacaucguggggcagaaacagccuacuuuccuuuuguguagugaaaaaaaaguguacuuuuccaggagacucugggaaggaccagccugguaacuuauguaacuccuuucaugccaggcugccuuaagccuuccaaagcccuuugguggcuauaagcuggcguggcuaaggcugcagguuuugaaacaccaggccuggugcagugagaucucuuugcuuuugacucugagaggugaaaugaguucaauauagcaagaguuuucaccccaaagccuacaguguuguuugugucacaaaugugacuuuucucgcucuacccccgacucuccauguguccauguguuagauucuuuuuauuggauagauccauccagcauuccuuuuuuuccccccacaaccuucucucauucccuuuauguugaauuacagcuucaaaacaaaacaaacaaacaagccaaaaccuccuugaaccaagugaauucuuuggguuugguuaaaaaguguaagcuugaaaauaaauuucaaaggugguuuuuaagacuuucuauugaacaaagaguaaaaccuggagacuggagaacggucggacgugcagcgccgaccuucagcagugacgagccagcaccuugcuucauggacuugauuaacgugaugucauuuccagacauuguguuauuugguuugagaggacauuuucaaguugcuuccaauuccagcuguugggguagaaucggcaacccaggaaagccguccugugcucuguugcaggcccccugggccaaaagggaucaggccugaaaaacugcauugccugagugagucuguguuggugacacagaagacugaagccauaggggaaguuggugaugucaucucucucgcuuuccccuccccuucccacucccaacccugaacccugaccaaacaaagcauauuuuucuagugauagaaaucagacacuuuugaccuuuuucuugaagggaaauuuuguuuuucuucuuccuuuuccuuaucagcaagaucuuccuuuucauggaaccauaaaaagaaauucauuguuugaggucuuuuuaaauacauguauguauauauacguccaucuauguacacauauauauguacagacguuaaauguaucacugauuaaauuuuaccuacucauuucauucccaugcuugaauauaccgaaaauuacucuuucccuaaaacgcaucugaucucuccaagcaccagcaucccacuccccaacagaggugaccacuguuuugauauugucaggaauuucauauaaauggggccacucugugucaacagacucauuuuguuaucacugccuugugaccuuucacucaaaguaaaauaauauuugugaaaccugucccugcuguuuucgugugacacuggcuugcuuuuuagggcagcauggccuccccgcaucucgguguugcgugacugugccguuugccugcccacuguuucacagcaaugguauuuaauugacucaucacuguguuaggauguguucagaggccuucaagugaaguagcugauuucauuuugaaaguuaacuugugaucuagcucuuguggcuauucccuguggagauaagaaacuuaaauauguagauaauuucccccaaauuauucaaaauguaagcgauggagcagacuauacuccugaacguuggaggaugcacacagaucuucacuuccucuuaauuacagggcauugaauggaagcucuuauaugaauagagagggcuuugcaaucuccaagggaugauugaagggggaagacaggaagacugggaaaaguuuaguuuucuggagaagauugaucaggcagugagcagcagagacagguaggaccugucucuguggguaccugcacaccaccaccaccaccaccaccaccaccagcagcagcagcaacaacaguuggcguucucuuuggagucaguguaaguuuugagagugaaaaauguuuugucauuuucaagucaccuaggacuguccauugcaaacaauaaaaaugacuaacaccggcugaacaguaagacccuugccuagccugaacauucuguguagaggcugaagucaguacugaguacagugaaguugugauguuucugccagauuugugauaugaacccugugguccuaugacuccaucccuacucugucuugaagggacucugugcugcccuuggccaugugaccuugcuccuuaaggugcucuuuaguagggcaucugauguccuugcagacaucuccucagguguagaggccaggaugcagcaucuaacuacacagguguaggcagguaucuauguucugcuggugaguagaguuggguagaguugcuguuucagcugauugguagcugccauucucaggaccagugccaaucuaaaugaaaaaaaccugaauucucagcuagaggccagauaaguaguucuuucuuguacuuccaguuccagaagauguaugaaagauugucccaacacagggaaggugacaaaaggugacccuacauguaucaucuuaaguuuucuauuuggagaagacaucugggugucucaaauggaaaagcaguaacuucuuguccuucgucuccuaaugacaauguuuauuccuuuugcagacagguaacaccagguuugcuuggcacucccaauuggaaaaugucacuuaacuucagaggccacagcuugggaagugugauuagaguucaguagacacaacagugucuaaccagcuuccgcuacagugaccuggaguuaauaacuugcuuacugaaaggcguuuguuagacauaggaguaaguuugcgagccguuuuuuuugagggugcccuuugaucuugcccgucuucccauugauuuguuugcugcauguuuacugaaugcacgagcagcagacucgucaggaagagcaacccuccucucuguacuaaucguguaguaaguuugagacaggaugggucuuacguaugugguauuuugcauuucuuuuucauugauaccuuagugguaagaaauuauccuggugaggaacugacacucauaacacccacccccuucugaaacuuauucugcugguuuuuaucuuuucagaaaaaaaaaagguauaaaugaucagcagauguuguuuguuucuuaauugugacucucucgauaagaguccauuuauauauacugggucaaugaagaguuuuuauuuuuacauuuugugaguauauguguguaaaagggugugugugugugcccacagaauucagaaguugaugucaaaugucuuuucucaauuguucuucaauuuauuguuguuguugagacacagucucucaccaaaccagauacucaccauuugggauaggguagcugacuagcaaacucgaggaaugcaccuucuucaugcuccugacaccaaacccugcucccacacccugcucugggauugcaggcucaggccgcugugucugauaguacaugggugcuagguguccuaacugaaauccucaugcacgugccgccgacacuuaccagcagugucaguucuccagcccuuuaagcagugguggcuuguugggugcuugucuuguuggucacacaaguccuuguaacagaaacuguaggcaggcacugagggagagggcacugcuucucgcaaggcucagcucagcacucuuguagcugcugugccucacgagaucccugacgaugccugcaagcuuuggguugcuucccagcuaguguacugagagccagcgcucuuugcugcucccuagaucauguccuauacauacccuugucagggaaaguaaaaucccaggacagaaugaacaacucaguaccucuccugaucucugcggguaccuguacucucaugcuuguaccuccacacagauagauauauucagaaaaugucuucuccuccuucggguagagcuuauccgguaacguccuaacuagugggagacuuggcucucaagccuucuugguuauuuaguacagucagaauccucgguugacaaucauuauaagucaguagucugaugccaguguuuugucggaauggaaucccaggauaguucauauaaaauguuugaugguauuguuguuguuguuaauguuauuguuugagaguugauggcuuucccacuucuacuaaaagacucaacuaucuucuccuuuuccccauuaaucuaaaaauucuagauacuaaccauauguaggaauguggugagguuuuccccaaacuagaaagucuucgccacuuccaggauguuuucugugaugauuucugcacucucagugucucguucugaaauccuagggugucagggcuguggguuuuaccugccaguuccuuuucucuuuuacuuuuguccucucugcuuuuacuuuuggagaaagucucuuaaccuaguuuccaaaacuuccugugcuuaaaaacugcauugucauuguaugccaaguuccugauuuuaaauuccuuuccuuugucacaggguagggccucaugcauauuuaagacgauaaaucccagucuuaccugugaggaggcugacuguggaugcuugcucccaaucauuccuuguauucucuguguccucaguugcauuucucaguugucagauaccccuguguagcaucaggaaguaauucugcgucugcugaucuugguugucuguguagauaaggugggaagaggggaaccagagggagcuaauugaguagccuguagauuugggagcacaugaguugguagggcuuaugaaugguuacuuucacucacaaauuauuaaauagcaagccaccuuucucauuagagacuacagguaaggcaucucucuggagcguuacaugucuccucagaaggagccucaggucuaaggucagcauacauuuccaguaaaggaugagacaggaaauguuuuuuaaaguaauaaaguaacacauuuacuucuuuacuacuucauuuauuuauugugagugugaaggucagaggauaaugcccaggaguugaaucucuccuacgcacccuaacccuuaccuggguuuuaggcuuuggacucgggucaacagauuuguauggcaaaugccuuuacccacuuagccuucuugacaaccuugagacaggaaauguuuuaugcuuugcaguuuaguaggcagaacucagaguauuauauaacaagagaacaaauguuccuaaaauguuuuuauuggugagagucauucaucuucucuaugaacauugaaauuugaauuugacauaauuuuauguuauaaacuaccauguauuuuguuuccaguaaugugaaaaugugaaacccuucuuagcuugugagccauacacagaugagcugagauggaucacaguuggcccaggaaucuaugauuggcauuuccuguucuagauucccaccugagaagaaggcccuggcuaugagugccuguguaucucaccaucccccuugugauuuguauuugcuucauuuauuucuacuuccaucucuuacuccuucacuguaguugguguucaggguuucugagccucugugccuacccccaccugcgguuguccuuaguacgugugcauagugcacugggugcuuaguggugaugccccgcaagaucuaauggccuuuucuauauacauuuucagaccuaacuuguaccaugcuccgugucugcagccuccagcuccugagccuugcuggaguuuuacaaacucacucugcugccucuuguuuuccucugcagcaacacaggcuucauuucacuccaucugucuacuucuacccuccuccucuuuccaucuucauuguaaguugcgaagauaaauuuuaguuucauggaagaugauauugaauuuaaauuuuccuucauuuuuuuuucuucuggagguggaaaguaaagugcuuuauucugucuguaugaacaucguuaaucaaggucaagguucuguaagucucacgucaauguauuuucuuaauuucaauagagagacuaugaugucccuaguuucugauggguugcuggaguggauuuugaauccugacuuccuugccuuccccuccuuucaucauuccucugugccuuugccugcugacagccuuagguugcuguuuggcauucguuguauucuaguugcugguugaccugcuugccacuuagcauuuucacuuggauauugucugagcauuccaaucuugauguaguccaaauaaaauccuugguuuuuccuccucuccugaauacuugcuccuuccugccuaauuucugcuuucucacuaggcuccaugguguguaagaacucuuccuuaggagcuggagacaugccuaguguuuaagaguguauauuacucuugcagagaagccauguuugguuccuaccacccauaccuggcugcucauacccaccuaugacucccagagaccugauguucucuucuggccaucucaggcacuugcaugcacauacacaccuacacacgggccacacagugcacauaaugaaaacuagcaauugaaaaauaaacuuaaaaaaaaaaagaaaguaaguucccauguaacuguaagcagaccaagcucuucugucuuugcuuaagacucucuuuggcuucccacugcucuuccaagacucagaugcccagaccucaggccuccgguacccugcacgcuauagcagcucugcuugcuucuagagccaaagcucuuauaacuuauuguuguccucuacgugucagccgcuuguuuucauucugugugugugcgugugcgcguguguguuuuacaugcucugagugugugggcacuccugaauccacuuuuuccacugguccaacugggguuuauaggcaugccuagcuacguugccucuaaauauagguacuggagagucuaacucaggccuucauuccuguacagcaaauguuccuaccauggagacaucaccccagguacccccuuuccuguucuuuuaauguuguaaacaucauuuccccucccaguccagggccuacguauuuuccaugccuucugcuuggaacgcauuucccccagacugucuccuccugcacuaauggcuuuucucacgguuugugacaaaguaccaaacaggaacaauuuagaaaaggcaggcuuuauuuugacuccuguuugagguacagccuaucauggcgaggaagguguggugguggguggucauuguugcacuagcauccaggaaacagaaagaggauucuaucuauugaccuguccuagacacacccagagcuuugucuccaaggugacucuaucaaguuagcauuagcgauugcccaucacauauccuuucugcccuucaggucuaccuuuuagaugcucuaguucuggagauacuuuucugauggccuuugggaaucucugcuucuccaugcauccuguuuggguccaaaggcagugaccucuaauuccugcccccacuggaccagucacauagcaaagacuaacaggcaagccacugauuugccaaacaucacauguuaauugcuucaucuaguuuucaagcagugcgagcuugcugugauuuaacuugucuguuugacuaguuugccucugucgcugaucgugauguaagaagcugcugugucuaguucuauuuucaguacgcaguaccugcacauagcaagcacaucacuaaacaggaauuaguuuugucaguguacaucuagaagcucagagcuuggaaugccuucagacaacccccagccauuguuucuagagcccaggauuagagcaugcugggaacagcuagcugcuccccaccccauccccacccccagucccuggcccuuagggaccuagccuugggggagcgugggugcuguggagaccuuuugauguagucucugagguuuacacuauuuucuucccuuccauuugauuccacuuggcuaggggcaugucugugguuucuugcacucucauuuuucucuuaagugugccccccaaguccuucuugcauggugaccacauuacacaguucaucaucccuccaccagcugagcuuuagagugcacucaagccauggaagguuccugacucccuuuuucucugguucacccaguccuaagacauuuaaccaacuccucagugcugcugaguucucuccuaacccauuguggcauaugcuaaugcuucagaauaucccuaaguaauuucuuuugaaagcuuaauuuaguuuauuccucaaaagccuaaaauaacaccuaucauauaaaauuuucuuuguggcauauuguuggagugagaccaaaccacagugugaguggguguacauguguguguguguguguguguguguauguguguauacacauauauacauacaaacaugcuucccuccccuccuuguagauuguauguauuauauauucuaccaccuaguguccuguaucugagugguucuauacuuagcaugguguugggacccagcagaacucuuaauuucacucugcugugccaucuacagagcaaagggcaccauggagccuuggaauugcaaaauuccagaaggguacuuuaacauuauauuugaaugcuuaauuuaauuuucacuuuggaucuguugcuaggcaaccaggaagacagggcaaaaucagcaaggcuaauuugguucuguuacuaguguguuagcaucucuuauauuuacauugacaguugguuguaaauacacuugagccaaugcagugcuacauuucauccaagugaggcaggcagguuccaucaugaagugcuuaaguuccugcucucacccuuaggugaaguuaccugaguuuugagccugcugguuugcuaagugcuuuggccccagcacacacgguauaaaauguuacuucccauugcuuucuaucccuucacaccaugaauucaaucugcuccucacaucaacuucaguccaguuguuuguugcuguugcuuuguuuuuggcaauguauagugccaagcuauuggccugugaaauaaguuagagguuuaaagaaagaaggccacuuaauuaucuuuaucuuaauauuaauggaaaucgaaaacguuagucacaucguccuuauauguuauauguaagucagguguuaaaauuuagugccgcuaauuagauucugugacaucaaaaccaaacaaacacaaacaaagcagggagcgguggauguggcuggaaagauggcucagcaauugccaacauuugcugcucuuucagggcccuaagcuuggcuccuugauucugggcauucauguuggguuguaaacuuuagcuacagaggauccuagaaccucuucugucuucuguggacaccuacacauauauacaaacacacgugcauaaacauguagacccacauaaaaucuuucuguguuaaaaggacaugaagcugggguguggcuauuggggaaggucugagaggaauugggggaucggugaauaugaucaacuuuauuacauucauguaugaaauucucaacgaauauaaaaaaucagugcuuauuuauuuauguaaaugcuagguuagcuggacuuggugcugagguaggagagucacugaggauguagcugcaucccgugguagaaugcuuccgagacgugucucaggaaggggcugagcugcuaccuggcuucugugaagaagacaaggcguucaguccucaucaguggugugcuuauucaggugguagauggagaguuuucacaugacuugcugguagaaaaaccaucucucaaaaugaugucaucacuuuccauugacucuguaaauggccaugacuuaucccuuuuauaaucggcauagaaagcagcggccacauuuucaacauguuucuugccaugucuuugcucucuaaagaccucucauaugucaggaaaguggcugucauauguagugaagauuacuuucagcagacaagucagauucuugguaaaggggagucucgacauucccagguuuaccuugugacuaacuaacucucugggacuguauagaaauacugaguugaugagaaugucaaauggagcagguuccuuuuugcuucuagguuuaaaauuuuuuucuugaugauauagaguaugugcaaguauaguacgcagagggaacucauugaaucucagcaaagauucauuggagaaagucugagucugucuuaaugagcagagagaaauaagugauucaucaauucugauggacuuuaaagggugugguucuucccaauugggccuuugcucuagaagaaagagccaugugaaguagaggaaggucuuagggguuauaaguugcucguagcuaugugcugccuggcuugauuagagugacuaggaaacaaagcauugguaaucacacagacacguagaccucagggauugauuggucugggcuuucagaaggaaagcugcagcauccaggaagcucagcuucuuucuuacauacaguuggacagggaggugagcuuguugcauaaaggcuggcagcguacaguggaauugaggagguggcaggcauagcuaaucucagcaugaguagucucugcagcggagcaguuuugaggcuguaagcauugggcacgggugaagcugcugugaacguuuucuauacacauugucaacauucacacucagaucaaaaggaaguguuuccaucccuuugggccuugcuggagucauuuacccuugacacgacugugccucugucagcaaugcacagucacucaggacucagcuugauccccauaggacaguguaugaagguuucuugcuccaagguaauuaauuauuugaguaagguaaugugucggauucauuggagaaggucuaagagacucugucuucaugaacagauaagaauaggugauuuauugauucugauguacuuuaagggugugguuuuuuccaguugggcauuugcucuaaguuuauuaacuuugcuuucucuaucauacuauuugaguauccaguaugucaaaaugaguuucaggguuauugguauuuuccuaaggaaauuauuuuuuaacucuuguuguuguuauucugguagcuauuuucaauugcaugcucuacugcuuagcucuaccccacccccagcccuuuggacuuuuuuguauagcccucuugaaauaaauguauguuuaaaaaauuacaucuacguguuacugaucuuaaauauguacauuauaaagcaagcagaacuauagaaacuaaugagaaagaugaagauaaaacaguagugucugguuaaucaaagcggccacauaguugucuuauaccuuagcacaggccgugggcuugucuucgcuccucuucuaguuguuguaauggaauaacugagagaaacuguuuaagggggaaggaguuuccuuugcuuuuuuauuucaaagagugucugcccaucagucagggagggugugaugaccgggcuaagguggcuguggcuugcagugaaucccaucuacaucucagcagacaggaugcagagcauuugcucaagaagcaggaugagucugaaacaguagaaggccuaucccuaguggucugcauccaccaccuaggccacuuguuuaaagguuccgugacguccccagccccaagacagugccaccugcuaggaccaaauguucaaugugaauuuguuucugaucaucaucacucagaucauuaccacugcuuugggguaagauuugucaucagaacguaggaugauaugggugucuuuaugguuuuuaccuucuggacggcuuugacucagagcugaccagaucauuaucuuuuacuuuggaguggcugacaagaagaguaagaguugggucaugucugccucuuucuuguucacucaguugcuuagcuacuauagucacuucgucuguuucuuugcagaaauccugacgccucuuguccaugcuguauaagacaauguaauaaaaaucacagaaacccaggcuuauuaacuggaagaaauuaggauguacucucacaaggggcaagggcacauuuauuggucucaaucuaaauuuugcuguuuuuugaaauuuuuguguaaguuuucuugcacaugacucuuuuuuuaaaauuuuuuauuagguauuuuccucauuuacaugcacaugacucuugaaagaccucugccuuaggagguauuuucaaguaagcuagauauaggcuauuaguuucacauuaaaaaauaucaguaagacaaaagauccuugcauugaauauaguggggcaucuuuggccuuagaauuaucuaccgugaauggauagugguaauuauagagaaagguuaacagcacuggauugugauaugugauuccagcuuugccauuaacugccuuggugacaacuugccuuucuguaaacaucuguagcuucacgugauaaugaaaauuuaagacccaaguuugugaaaauaugugucguauauuguaacaccuuaguaaaacuggaaagcuuuuuuccccccuaggcuaacuauauaugccugcccaguaacagucuuugccuuuuguuucccuucuagacugccucuuuaagcuauguccuaugaaucgauacuccgcacagaaacaguucuggaaagcugcuaagcccggggccaacagcacuacagaugcagugcugcucaacaaauugcauguaaguauggagguggcguguaggugaugugggugucaugaguggucaccugaaugguggcugacggugggaaaaggaugguuaguucagccucugacacacucugcuggcuuuuaaaauucaucaucaucaucaucaucaucaucaucaucaucaucaucauuaucaucaucaucaguaucguguguuuugccuguguauacaugugugcacugugugugugcagugcccagaagagggcuuuggaucccuuugaacuggaguaccauaugguugugagcugggaauccaacucagauccucaaugugagcagccauugcucucaccugcagagcagucuccuucuccuugcuuucuuaaaaaauucuaaggagagauggacuacagucauguuggaauauuuugcagggaggcagcacccccccccaacuuuccagggguggcuugaggcaaaaugguggcuagaauugaaucuugguucugccacucauugacugugaacuugaucaagugauccagcucugucuauagacaccuaaaauggaaacaguguucaugcccaccuuuaaaggaaguugugagaaucacacuaaaggauacauagaugucuuuugaacaccaccaggcauguaauuaaucacuuuuguccauuccuuaauaaauuuugaucauuaucauuacauucaccauauuaauuggcauguaagagaagugcucucugcauugcugaugucuugugugaccacagcaggucucggagccucucugagauggucauccuauaaaacuaggaggcaauucuucuggugccugaccccuggagguugagcugugcagaagcucuccgagaugcgcagaagggggauccugccauagagccacugucacauuauugcauuacugaauacuccguuccucuuacuguuuuauuuuucuccgugucacuugucugucuucuuagaauauaaagugcacgagggcaggugcuuguaacacuuuggguucgugcugagucccucaugucuauagccaggauccacagacccuagguacuugagaaguagguaggagaagcacauagacauaauguuccuuggugcuuagucauaacgugaagaugggcccugggcccugggcccugggggagcucaaaaaguccccaggcucagccugcuguguuucagcuuagguguggcaguaucauaaccaucuguauuugaugagguugaaguuaggagaagagacuucuguccuuaucuuuccuuagcauauaauaaaaauucuguguucaggcaacaucuacuggcgcagggaccaaaccccuaccagcucauacugaagccagugugaaacacaagagucacucccacugcugcagacucuuucuuaugugugugguuauuugugccugggcucuaaacuucucugguuagcuacugcugugcagcccucuuaugacaguagauuuauucacuuucuuuuacugagcuccucgcacucaugaccuucacacucagaucauccuauguggaugauccuucugcagggcauucuucaacugagucuucacauuccucucugugguuucacuggccucccagcagaguguucucuacacacucaucauagagauauugccugcuuuuuccacuuuagcuuccuguuuaugucuuucuuggugcugauuauagucugcaauuauguguaauaaguuccuuaauuauuugucacucauuaaaaugggagccguauaaggacagggacauugccucucuugugcaugcuuguuacuagcuucccucaugguaucuggaauagaagaggcacuugagaaauacuggcugacugagcauuguacuaaguaccagagguagaauugugucagagccuuaaccuuuaggaguuuccuugcugcugcugcugcugcugcugcugcugcugcuucuacuacuacugcugcugcugcugcugcugcugcugcugcugcugcugcugcugcugcugcugcugcuucuucuucuucuucuucuucuucuucuucuucuucuucuucuucuucuucuucuucuucuucuucuucuucuuucuucuucuucuucuucuucuucuucccccuccuccuccuccucuuccucuuccuccuccuccuccuccuccucuucuuccuccuccuccuuuuuuguuuuuugagacaggguuucucuuuguagcccugccuauccuguaacucauuuuuagaccaagguggccucaaccucagaaaucugccugccucugccucccuagugcucagauuaaaggcuugcaccaccacugcccggcuuagacuucagcuccuuaugacuaaagaauaaagagguaauguugccuuacaguuaauaaagaggcaguacagagcaacauauccuuuauuguguaagagagugcggugcaaugaucagggaaagcuuccuggagggagagggagguaacauguaagccucggucugagauauuucccagaauuacagagcagaagaacaaaagcaaagaccuuggggggggggcaagauuauguaaagacugaaagaauuaugucauuuuuacagaacucaucacauugggcuuagucuccacuggcccauugcuaccucuucauagaaaauacuguaguuuuccaaauaugcgauggcuuccuagauaucgguuuuuuaaaacagaugacaaaggagauagaaagggaaaugauaaguuauauaauaaacugcacacuuaaguuaacguguagugacagcugcucugggagaugagaagccucccaggcuugugggacugacacagguagcuaguacuugccaugucggaagccugcuguuguuaugggacuuucaugaugaccggcagcucuuggcucuguuaggaagaccguacagugcacuuugcuguauucaacaguaccugcaguacuugugaaugcauauuggugauaguacuaaugaggcacacagaauuaugcccuuuccugagguguaaaguggaguaggguccaggguucugaaaggugcaggugcauuuuaauucaggugaaugucuggggagccacgagauuguguaggaugaaauggccacuuguugcacaggacugagccaggcaucucaugaggaccagccugucuguccacugaaugucacuugcugugcuccauccccucuaaucguugugccagucagaagcaccccacaacccccaagccugugaugggcacaugggcuuccuguugaagggauggaaaggucuuuccauucuccuuccuccuagggugcagaugccuggggcaguaucuuuguggaugcccuaggugucuuuaguugucucacuuucacaaaucugguaugaaggucaccccaucagugagaucuuagcaauacaucucaaacucuuucuucuucuguacuuuuuaccauagggguugagguucauaguucucuuaaccagcguggagucuacaugaauaaagggguccuccagagagugcugcucuugggguuccugcuccugcaggucuggaggggagcagcaccaccucccugcugugcugugugggaaggugcauugagagcugcacauggcuaccgccuugacaagugaagauagaaaucuaugcuucuguguguaaugcuucgauuuucaaacugugcugccagcuaauucaguuaaggcuuaugggauaagcuccacagcaacgcggaauaauggcugggcuaaagccagaugugagucuuuagugucauuugcaaccugugaucgaugcauuuuuccaucagcacuuccuuuugauguuccauccuacaacuacaugaacaaaauacaccauuuuuguuuuuaaaagucuauucuuaaaggugauuaagaauauucaucucucucucucucucucucucucucucucucucucucucucucucucucucucucucucucucucucuguguguguauguguauguguauguguauguaugagagagacggggggagggggagagggacagagacagagugagaaacacuaaagacaagagacagagaaagaugugggagauguauuauggcuauaugcuauuuacguuuuugaaguaaaagggaaaacaguucccugcccugaucugagaugacuggcauggccuugcugucuuggcaauggcugcccuugacuuuguauggcucauacuuucuugcuaaguuggaguuucuuccccuuaucccaaaaaaucuucugcccccuuuagugcagucauuaaaaugugguauuuuggucagugccuuccuugccuuugggggcuuguggcuggucucuaguggguuuucauuuuuauuuuggucaauuaccgggcagcacccgagagucggaggucagguuauuuuuaauuaaugccauuuaaggaauuuguugucuagaccacucaauguccuugugacagggguaagcaauuugcacagcccucugaaggagaaugacaucuaguggcugcuuacugugugcucccugcuccaacagaagcuggguuuugacucuuuagguaccaauuucccagaagucuuguggccaagugaguuaacuuuaccuucauuaucacauuaguuauaaaggcucuaguaauguuuucugagaguaguuugcccauaaccuugaaaugcgugugggcacgguuuggauuuugagaacugagcaugucauuaagcuauuugaccuaagcuaagcagaggaaugagggaucuauauuguuuucuuccaagccuaggaguaacuguuuuucuggaucuuuaacucaguuugcuauugugucauugagagcucagugaccuuaccuuuaugaccuuccaguaccgauuuaauaaugcuuguuuuauuucugaaauaaaauaauaggugacuauaucagaguugaccuucaucuuguuuagagcauaugauaaugucagcagcccagaaacugucagauggaauacuuuguccuuagaaauuaaaaauggucccuaccccacuguguaagggaaaugaauaguagguguuacucuuggcaagaucuugaaaaaaauauaaaaaauuuacuuaccuggcuuaaaaaaaaucuccaagucaccugccauagagacccccccccccacacacacacacaaagauguagcuccagaaaccauacaaaugggcacuauaggaaaagaauuccaaaauaaauuucaguggcaaaagugaagaccguuaacuccugggauccugaaugugacgugaugaagacuaauguugaucuccaucaucuguaugcacuacuccccgaauggaaugggagauugucaaacucuaggcaaagggacacgauuuucucuaauuucgugauguuucuguaguucuuucuuuguugugaguaaacagaagguuuucuguuccuuuuaauggcuacacgguuauuuuguuguaggacaauauugaaauuuuagauaaccauucccuguggggaggggaggaagggagacuuagucaagauccugcaaaaacaauacaguauauaacuuugugcuuuugugagguugccuaaguggaccaacuccuagaaauaaaauuacagaguaaaauuuccuccacugaggaagcacaccccauuauccuuagaaagguuaugucaauagacuggguugcaguauauucauggauguauuuaaagaguuuaauaaacuuugaccucauuauuuucaaggaauuggacaaccucagucuauaggcccaggugcaaucuggguuuugauacuuucuaaucuaccuaucuuguugccuauugaaccuaaaaaucaugauggcuauguuucaaaaccaaguuuuguuuuggaaggagaauuauuuagggaccaauucaugaacuugaaugaauuuuauuuauccugugugugugugaauguguugugcuaugugauuucauucacauguguaauuguguguguauguguguaaaggcuacaaguuaaccuuggauggugaucuucagaagccagaacuguguucgucucuucucuucucuucucuucucuucucuucucuucucuucucuucucuucucuucucuucucuucucuucucuucucuucucuucucuucucuucucuucucucucuucuuucugugacagggucuugcuugaccagauaaaaccaggaucugugucuacuuccccuacauucagcaguggaauuacaaaucugugccauccugccugacuucuagggauugaacacuccaguucuucaugaucucuggcaaacauuuacccaacuaaggcaucucccaguccuugcacugaacaaacauauuuuauauucaagcuauuaguaagagcaaauuggagacuuuuuuuccuuguaugauaagaagcuauagaagcaaguucaaaguggcccagaaguuccugcuuucuguguuuguucaguacugacggcaugcaccaucaucagugugcagaaugaaagagauguaacauagucugacaaacuuuuaacugugaucuuccaggugucuuuagguaaaucuuggcuucuauucucuaucugguuucuguugaguuucccuuuuauuuuagacaacuacccuugaucuccagauccacugccuuguaauuaauuucuguuacaucauauuaucuuuugaaugaccaguuugacacugauuugcacccauucagcauagguaggaacugucuuaguuaggauuucuauuauugugaugaaacaccaccaccaaaugagcucaggguggaauggcuuuguuuggcucacacuucuauauugcuguucaccacuaaaggaagucaggacaggaacucaagcagggcaagaaccuggagacaugaccugaugcagagaccaugaaugggugcugcuuacuggccugcuuccccuggcuuucugagccugcuuucuuacagaacccaggaccaccagcccagggauugaaccacccacaaugagcugaguccucccugaugccuuacagcuggaucuuauggaggcauguucucaauagaaguucccuccuuucagauaacuuuaguuugugugucaaguugacauaaaaccagccagcaagggacuuaauauuuuuaggcucuuaagucuuaacugaggcuuuuggaauuucuggggacuaagaaaagguucaugagaaauuuccaucuuaaaaucaugugaggccaagaauugcuacucaagacuuuuguaugccugaaccuaaccauguucugggcauagaaaagcuguacuugcuucuucuucuucuucuuuuuuuuuuuaauauuauuuuauuuuccugaguucauugauuuuuuuuuucucccuaugaccuuuuuuuuuuuuuuuuaacucucuugaacuucuacucauuguuaccugagaauagcuuaguagaaagaacaaaucacaauguaggacauguaaacucugauuuccaaugaauccagcccauggggacuagagagagcucuaggguauagggauacaggguagauauugggagaacaaggauggggagggguaagacuggcaugcugugauauauguguuagcuuuuaaauacagcuuggacaacaaaaugagagauuuuuguacagaggucaucauggauacugagugcuacuacauugucugcaaggcaccaugucuggacuagacauaugacuagaguuccguggcuguaucuuuguauuagugagaguagaagacugguauaucauucaaaaagagaaggaaagaaacaggucccucucuguuagcucugguauauacacgauuaccuugcagggauuccccugauaggcaggccauuaucucccugcauaucguccugccugugaacugggauuucguccugcaaucuucuccaaaucuucccuuuguaagucacaugccucacaggcagagcuagggaagaccaugaacuugaaggaaugguuaagguuuuggcccagcccaccuaagucuuguuuuaaaauuaucuuuaagacauuucuuaguuuuacaaucuugucacuaauaauaaagauugaauuauugucuuagucaugugaagucuuagucuuugaagagacaccaugacuacagcagcucugauaaaauaaaaguuaacuggggcuuauguacaguucuuagguuuaguccaauaucauuucgggaaauaugguggcacacaggcagacaucguacuuguucuacauaaggauugcaagcauuaggcagagagagagagugagagagagagagagagagagagagagagagacagagagacagagagagagacagagagacagagagacagagagaaagaaacagacagagagaggcagagagagagagagagacugagccugccuuggacccuugaaaacccaaagcccauuuccucggugacacacuuccuuaaagcaggccacagcuacuccaagaagccacaccuccuaacccugucuaguaguggcacuccugaauguccaagcuuuucaaucucugagccucugggggccauuccuauccaagccaccacaauuauuuuauugaaagacuggcuuaugagguagcucagagguaaaagcauguucgaggcccuagguuuuaucccucguacuaaauaaguccauaaaaaacuaauuaaaaugaaaaugauugaaugcuucuaucuaucauccaucuucugucuuauuuaugguaguuugcuaaugcuugugacauaucuugaguuuuacuaacauauagugaccuggucagaugauaaaguuucaguguaggaccucuaacaugaugucccccaaagguccugugaaaaugaagguaugcuaccugagaaagggaaccuauaggcaucugguagcaucuugccugaagaaaggggugauucucuagggagcagacacggcaaagaaacacuucugaagcuucccuacguuaucugucauugggcuguccccuuccaucagguucugaaugucauuucuucccucucuugucucuuugauccauuuuaaggaugaguaaugggcuugaaugauagucugcuuauuguccauaauguuaguaguuucccauuggcuuacuuugauguauaugauagccuuuuuaauacggcuuggacaaaaaaaagaaugagagaugucuuuucaugauguuggccccaacacccucuucuaggaccuucuauuugguuuugucaccuuucugagugugccuuuagccuuauucaucacuguacauauuuggagguuaagccaaacacauuuuugaggguuaccucugccauuuaguaaauguuugaugauaauaacugcaugucucuuguuuuaaaauagggcuaucuuucuuuuaaggaacuaaaugaaaauuaaauaaauuaugaugaauuuuugacaguagugaauaacaggccacauaugaaacaaucaguagccacuaugcaaggugauuuauaugcauuuuuauccugguuuuacaaauaaggaaacaaguuuacagauguuucauaauaaaccaaaguucccaaaaccacgugcugcccaagaucggcuuuucaauucaguuuuauuccaaagauuuaaagaacauuugcaaaucacaagaggaaugcagacuccuuucugaucuuacucuuuguguguguguguguguguguguguuugugugcacgcacgcgcauacacaugcuugcuugacuaguuucuuauaagcaggugcccaugacuuccaagcucauauuaaugaagcccccaaagcccugaaagcugaguccaaguacauaagcuaagcugaguuagaugagcuucacaagcuccuggcucauuuuauagagccuuaggcugcacccagggauucgcuugcaguguguuuuggaucacugcuguugcuguagaggaauagaacuauuugcucuuugugaccauucuuccuugucaauguuccagcaugcugcagacuuggaaaagaagcagaaugagacagaaaacaggaaauuguuggggaccgucauccaauauggcaacgugauccagguaggcgcagcugcucuugucuucuggagcugacacaugagaaagaaaaagaacugagcaagcaaacucgugauaggggcaauggcagcuacuuuauugaaaacaaccaaaacaacaaaacacaaccuccuuguguuucuuauuauaucacuuggucaugcuauugggucacgcauaguguaagcauuuucuuucucagccuguugcucaucacuuucaugcagaugguucagaugggaaacuugaugacugaagaggauagauacuacuuguuacgguuuugcaucacugacagucuuagggaguucuuagguuuggugaaaguugacuacauuuuagcuuuuguuuaggagcuguuugccggugaaaauaaaaccaguuaugugcacacacagacauauguauguauguaugcaugcacauaugcauggcauguauguauguauguauuuauuuauguguguacaaggcuucacugagcccaaacuggccuugugcucaccauguggcugagcugacucucaacuuuugauuauuuugccucuacucuauaaacacugggguuaugggcuuguaaaggcccagguaccuucacaaaauuuuaaucauauauauucuuuuaaauaaguuuuuauuaaucaaaaguauuucagaacugucauauuguagaguuguuugcuucaccuguuaucuucuguauccuugaaccugcggcagagauaacaccauccaaacaaggcuuccacaggucuuucccagaaggugcugcuaaucuuguaaacuacuaauuaggaaugaauuucuuccuguuuuuauugcuauugggauuagaagagugcuaaccauuaguauggaaaaaaaaacuacuaaaaguggguaaaaauaacuuucugugaauuuuuuuuuuaaguaggggauguguaaaaguuaacuagauagagucuugcuaaguugucuaggcuugccuugaucuuacuguauagcccaggcuugccuugaucuuacuguauagcucaggcuagcauugggucuucuuccugcuuuguccuccugagugauaagauuguagguaugcgggccaccauuccuggcuaaugcuuuuugauuaaauguuuacuuagguuaggucuuauucauagcuaucaaaagcuauuagaacauuagauaaucaacccaugugcccuugugaaguuccauccuguugucaagcgaggccaguccuuugaggcugaguaggagauacucaguugguuagauugcagaacuggcugcaacugaggauuuaaaaaguacaugaaggguacuggcagccaauacauuccaguccugugagguuucaaggaagacaugccaaaccaguugacgagguaucugcuuuuagaauggguuuaagagaucucaguuuuauuucuggucucaggcuuuggaacucaccugugggaaggugagucaguggaugaucagaggcuguuccuggaggagcaucaagggccugggaggacauuauugucucaacuuaucuuacccacaggccaucaagaauucacaaaugguacagguuauuccucuacucucagcagcccuaucaagauucguuggccuuuuaaggcugcugcucuuguguuaucaugugaacaagagauggggcagcagcaaugaagucacaagcuggccuucccccucuagggacugagaagucaugaguuuguguuucucuuugauccauaaacaugggaagccaugguaaugcuuacugguccagauuacuagauaaacucuuuuucaucugcaucuucccuccuuuauguuucauguaaucaacaucuuugagugaaggaugcagcagucagugaagguggaugcucagggcguccuucacagagaaugauggaacugccuuuuaaaucagacuagugcauagugacaaaacgcccuuccuucauuccccucuggaaucggugccuagcuagacuacagucccuuagccccuauccacaguaugaugccaugccucucuagcagccucagaugauggaauaauuggcuuccacagugucucucuugcccaaggccauguugauggaaaaaaaaaaaaggcaaacaauuuuuccuucucccuggcccucuucucugccucuguucgcuguuccuuugcuuguuguuuccagguugggcacuuuauguuucuucugcuucucagcagcuuaguggugggaggaaugucuguuacaaaauuuacuugacaaagagagcuauggcagagaguucacaggcccgcucauaucucauucucuugauggauuuuuagcuccugcauuugaaaagcaauaaauaccugacugugaauaagaggcucccagccuugcuagagaagaacgccaugagggugacguuggacgaggcuggaaaugaaggguccugguuuuacauucaaccauucuacaagcuucgcuccaucggagacaguguaaguagagcugacccuggaaagcccuccacaagcuuccagccacaacugugccugaggcuugacuaggaaagguuuagaauugaagccccaggcauaugaggagaucagaucgccauggaaacuaguguuugggaaacaaggaaaugaagagugaagugugaccuaaauacagucgcuauguuuuuccuacugggccucugaaaaaaaauccuauuaccuccguaauuuuaccaugaaaacauccaucccgaauuaauauccugguuaaggaucccuugccauuccacuuccaugagugcagcagcaguguucagcuauuuuggaaauacugaaggauggaaaguggaaaagaaacagccuuaguagggaaugggauuguuuguucaccccaugcuuccugugucagugggugcaggcagugucuccaucgccuccgcaaaugcagaaagccccuggccugggauucuagacaauacagagccaccggaaucccuuuaucaagggaacugagaacacuucugauauuuguaaguuaaauuagucagucauuacgugggcacacacuuaacagugaauauguuuaaaugcuaucagcuauguacuugaccuuguuaagguucuaaaauagaugcuuuuaaaaaaacaagcuaaaaggaaauuggcaccuugagaagcaugaaguauucuggaaauacuuaccuacccuuuacuuaaaacuagauacugacugacugacugacugacugacuauuuauuuauuuauguauguauguauguauguauguauguauguauguauguauguaaugccaugcuauagaaaauuucgucauauauuuuuccgaaauguaucauuuucaaaauaugcagguuuuuaccucauaggaagacaagcaucucuucuacuuccuuuccuucuacuuccuccguuaaaagcaaauguggggcugaggagauagcuugcugugcaagccucaggaccugaguucaaauccccaguggccacauaaaaaccaggcuugccuaugucugccuuuaagccgagcacugggagagcagacuaggcaaauaacccugcggacucacucgucagguagucucaccucaccgagcaggagacuuuaggugugcucagagaaccugucucaggacauaagguggagaugauauagguucuucuagauccuucucuagccuccacaugcacauccacaaacauacucacauacaacauacacauacaucguacaacacacacaacuuuccaauguaccugguuccaaguuuuguguucaauaaaucguugcuuuucugucauuuaguaucuuaaucuaugaccuacaugagaguauaauacuaauaauuaucuuuuaaaaaauaguuuuucuuaccuguagggauuggcccagucauacuuuuaaggguguccguuuaaauaguggaguggaauaaaaaguaucaggcuguguuacacauaagggcagguucgaguuucuggacagacacauuuguuuaguuauccacuacuguauucaacuaucucuugcugggggcuggagagauggcuuggcagucuggaauugccuauacuuuuaguugcagggaaucugaagcccucuucuggccuccacaggaacaucaggacacacaugguguacauacagagaaagugggcacucacacauacacacaauauaaaaauaaacuuuaaaaauguaaaagcuagcugggcagugguggcgcaugccuuuaagcccagaacuugggaggcagaggcagguggauguucaaggccagccuggucuauagaguuccaggacagccagggcuauacagagaaacccugucucgaaaaaaaaaaaaaaauguaaaagcugucugucuuuaucuaucuaucuaccuaucuaucuaucuaucuaucuauccauccauccauccaccuaucucucucucucuaucuaucuaucuaucuaucuaucuaucuaucuaucuauaaauauaguaaucuaauaauagaaaaaaaauuuccuucuguuguagucacaauuuugaagaucagugcuuuagaaacaugauaauggcuucauucuuucaaacaaaaaaacaacucaaauaguauauugcuuguuuucccccaaauugaguugagcuuauuuauacaagcuucucaacugaauaauaauaauaauaauaauaauaauaauaauaauaacaauaacaauaauaauaaaaacccauuuuucuagugcucuggaccaacucacagauuaucaaaguaugcaauaguugugcacugaaguccuccucagccuucucucagaacacaaaccacgcugcacaggucaagcuuuaaaaguucacacgugcugugacaggcuugcugugauggguguuccagaaccguggagcaguaccuguccccuaaaaagcuguguuccuccuuccuuuccagguggucauaggcgacaagguaguuuugaauccugucaaugcuggccagccucuacaugccagcagucaucagcugguggauaacccaggcugcaaugagguaaggacauuggaaaaguugaagucugguauaugggugaggguuggaucauagaagcaggcuuuguggggaacugagagagagagagagagagagagagagagagagagagagagagagagagagagugagaguguguguguguguguguguguguguguguguacacacugcaugugacuugagcagaaauucaggauacugccaguucuucaggagaagagcccaaggcccacuguugacugugaugagguuuugugggucucugcaugaguggugaguuugauaaacuuugcaucacugaagaaucauucucuaauugguuaagccugaaaaugcuacuguugccauuuuuuuuucccuagcuggaggaacacauuuuuuuuuuucaguuugacucccuaaggagaguguuuuaugguaauucucaggagguuacauuacagguuguguguagccuugcuacagucucuuauuuucaucucuacaucugccaaucucacugugucucccugggcaguuacagacacagcauccuaaaucucuuaugauacgaugucugucucauggagaggacaugagcucuggauugugaaagaugugaauucauaucucagcccguggugccugagcccuggaacugcagaugaguuacuuaacaucucugugcaucaguucccagucugaaaggagguccaguuucuuagggugcugcuggcgaguacgugaggugcugcucuugcuguuaaugacaaccuuggcgguuucaaaugugugcaguggaccaguucuuaccucaguaucucauuccauuuuauaaguacuuuauuucauuuggcauuuauacauguggcuacagagccagagacuuagaggagagaaacauagcauuccgaaaggggcaggagggaaccagggcuuggagcuucaggucagauuuggagcauguguagagacgggcacaaacgaaccguuuguugccaaauguucuuccccgccacgugcguucugagguucuuucuucgggauguauuagggacuuuucucauggccuuuacucaucgacaaaauaccuggggaaaauaaagcaauuuaagguuuauuguggcuaagauguaugguggggaagacacagggaugggaguggaacagcuugaccagucaggcuguauguccguccauaggaaggaagcagagagaguggccaggaggcaaggccaggccauccaccucaaugccuuucacucuagagaccaacuuccugaagcuaggucccuccucuuaaagauuccagauccugccaaaacagcuccaccagcuggggccucugccuucagacacacaaaaacucaggggacgcuauagcucucugaacuauauauaacaagauguuuguacugaagcccagcuggccuuccugggaggaacuuugggucuauaugacauggcuauucuaggagcuaugugaaaaauuaacuuugauuugcuuucuaggucaacuccgucaacuguaauacaagcuggaagauagugcuuuucaugaaauggagugauaacaaagacgauauucucaaaggaguaagugcgacucuucuuggcaccgugcgcuucucagaguagcagguuggcuuuguuuccaaacccguuucccaaacccuucccuuccaucuuguguucacguacagggugauguggugaggcucuuccaugccgagcaagagaaguuucucaccugcgaugagcaccggaagaagcagcauguguuccugaggaccaccggcaggcagucagccacaucggccaccaguuccaaagcccugugggaaguggaggugagcagugggcuguggagguaaagcgugaggcaggagaggugagggaagcgacuggggauguguguguguguguguguguguguguguguguguauguaugugugugggggugugauggagcucagaauuaaaccucucagcagcuguguuucuaaaucauaccaagauagucauaaaaauuaguagacauggcccagggaagcaagcacaccgugauguagcagacggaaguugcaugguuuuacggagaaagauacacauucuuuccccaagucaccagaaaugucuuuuucuuaccuuccccuguccuccucugauuuuuuuucuuuccuuucucuugcuugauguguauguauauauccugcauaugauggguaagcugcacucccaaaaucucaacaauaggguuaccuaaacaagcucugaggaaacaccaaagcugacgugccucuguggauggggguggggguuccacaugaccccaccccuuggugaaagcuccaggcaaauuaguggcugcugagagaggggagauccagucuucuccagggaugagccagcugauagguuauccaauccuaagcauuuauaccuaugagcaggcuaguaauaauaauagacuuaaaguagaagaggccauggauuugagaagagucgggggcaagggaggaguugaaggaggagggaaauuauguaauuucaauacccauacgugaaauucucaaaucauaaaaagaaaagcagcaagcgucuagacaggugugcucagcaggagggccugggugccaggagggcuguuccuggugcucuggagcuuuggggugacuggagagguguuuuggggugacuggagagguguuccccgugcucaggagguuuuaguaaggaaggaagaacugauggggugaggauuaagacuuccuaaaagacagugggugucccaguacacuggucccaaaccaaaagcaaaagucaauguguggggaaagggaaggcagaggggaagggcgaggguugauagugaaggcagggagauuagcgaguuggcuggagggggugaggagaaggaauuagauacgagugcuaaacugucacaagaccuucaaagauugaaagagcgagcauuugacugauguuuccuagaugaucugcauguggaagggagagaagugggguaguuccugccauguaagggaaaggcuuggacccggaaauauuaugagacaggcuuggcacaacacugaguaaccuggcuuuuggagcaacacgggaugaacagggggaaaugaccacacuggagaccagcgcuucaaauugcaacugccaaagcugcggggcacugggaauguuccucccaggcagggagaaguccggaaagguguucugagugacagagucggcacagucaacaagcugcuuacagaaagcagcgauucugucugaggaauaauaggcuugcaagaccaaggaagaggcugauaggaguguucgacugagagcaugacggaaggcagggcuguccuccaucgucucccgcugaguguagugcauuucugccucuauuuguuaccuaugccccuucuccugccuucugcccuuggcaaauauaguagaaugcccaagucauaaacacagaauuauguuuuuuuauauuccacucagcuaagaaccagcaccuggaucaggcaccagaagaacaauagcccauacgaggucccccagccuguucccgaguacgucccauuugcuccuggauaggugacugcugauagguggccagccucucccuugacuggcacggagcagcuuucagccuaugcagccuguaaauuugccaguuguugaugacuuuugaguucuuuauaauuuggagcuguuauccauaaagcuucagggacacuugugcuuagacauaaguuuucauguguuugcaugcacgacagugggauaacugaagccuguauuggcuauaggaucaauguuauaagaaauugccaauccaaauccaguggggacgacaugcugcuaauuucggcauuuggaagccaaggcagcaggauuaccaugaguucagagucaagcuaggcuagcuguagacacccaaaccaaaacagaaaggaaacugagaacaaggaugaaguugccuaccugucuucuaaagcagagggaguauuuucgaauucuucccugagcauucaagauucucuguucuuuuccauggcugccacugaaacagauaugacagugcugcuccucguggccuuugcccucccuugugauguugcugauuuccuuugugcucaucuuuucuuugugcagccuuucucguauaguaucugcucaaauacuuugcccauuuacaaauuuccuuccuuuucuuugaccuggauguagaaauacgcucauccuggcauuggguagauaauuuccugcaguugccaugauaaagacacaugaccuaucuaccuacauucaucuuauccauccaucucuccucuuuguuugugugugggggugugugugugugggggggguauguuagcuuguccaucaguuuucuuugcuuuuuccucuccggugucugaagcauuucuucuuuggcuguucacaucuguuuagggacagucaguccauuuagcuuguuccauucagggaguucccugagagcuagaaagaacuuugucuuuauucacagauauccuccuuguucacaguuuguguuuguucuuuucuuugcacucaaaauaguguccaagaagaaaguggguagaggaagcagagaagguacaggaggaggaagucagggagugggagagggaagcagagaggauacaggaggaggaagucagggagugggagagggaagcagagaagguacaggaggaggaagucagggagugggagagggaagcagagaggauacaggaggaggaagucagggagugggagagggaagcagagaggauacaggaggaggaagucagggagugggagagggaagcagagaagguacaggaggaggaagucagggagugggagaggaaagcagagaggauacaggaggaggaagucagggggucggggacgggaggagguaagagaggaaagagacagguaggacagcagucucccaagguaacuagaaguggaaauacaaaguaaggaaaaaccaaacaugucggaaguagagggaaagcagacugucuccugccuuaacuacuucucuugagccauuucuucaguggacgggauaguuuuguacaguuggcacuuuauaaacagauguucacucugcugggacaugguuaagaaaauauguaagccuauagaaaucagggucucugacaccagugccuuaaaaaccauucaccaagccuuccuuauucaaaauugauugagauuaauaaaagauugacaacuuuccgaggaaauuuaacuugaaaguucccuugagggcauuuucuuuuugcucugaggacaaccagcugucaauuucuugcuucauuaaaaucugucuccugccaguuuuuguuuguuuguuuguuucuuugucuucuuucuucugaauuuccuaugaaaaaguuuaggguuucuuuaaauuguuuccggccuuacuggaaacuguccuucaaaauaagaaggaaaauaacaccauguguuuuguggaucuaaaacacuaagguguccuagagagaagagcacuaguagcucuuguagagaaccagagcuuaauucucagcagccacaaggcagaaagcaacugucuguaacucccgucugcuucuggucaccaugggaauugcaugcacacagcucacggauacacaacaggcaaaaacacucauacgcguaaaauaagauaaaaauucaaagaaaauuucggaagagcucuugagggucucacguauuagcauaggcaccagcuuucguuagcgugauguguugguaauguguuacaguaguuuccucucuucuggucuuuguguuguuguggucauauauuuuguuucuacauggaucauaaacuucaguuuacuuuauuguaugccuugcucccaggggugucuagccaguagccuuuagaucuucauauaagcauauauauauauauauauggccuuguuuguauuacaacccuuugcgugguauggcucagagaagccgaaacacuggacacccaaggaagcagcaauuguuuaugucucaaggucaugcagacagaaucacgcagauguucuauguuugcuuucauuguuacacccuaagcccuguguuccuucauaaagauccaaguuugcauagaggauuucauucuucagaagaacuucccauguuuguuguaguucaacaaauugucuguauucucauuuguguggaaguaacuuuguuuugcucucauuuacaaauguuuuuccuucuuuuaauuaauagcuuuauugggaugcaagucacacuguguauucacacugaaaccuauucaauuccauaauuucuaauagguucguggggcugugcaauuauuggcccuauaaacuuuuuaaaaccaucucugaggaaacccuaucucuaauagcagucccuagucauccucaccccagccccaauuccaucucagccuccuggggcaaagucaacuucuuccauggauguucccuguaaacaauucuuuguguguggcuucucuuacgcaggggaguguuucacuguaauucgggcugcuauaacaaaggacuggaaauugauuucuaaacguaauuacauagcacagugaauuaggcagcucucuggggucuuuugcuugaggguguaguguagaucccuucagaaggcuccgagcccuuagcuuuggggauuagaugucaacauaggaaucucuggaagggcgcacacauucaguugaugcagacucugccuucagaguucauccacauuggcaugcgugaguacuuuauuucccuuacacccuguaacacagcaguauaugaguuaaaccuuuucucuauuuacuuaucauuuagaacuuuugggucauuuuuacauuuugguucccaugaagaaugcagccaugaacauuugugugcaaguguuuucacgucucaaaacuagaaucuugggugacagauucaaguuggaccugugacguguccccaggcuacccccacccaccccgaaacuucugcacaccguuacuucccaucaguguguuguggugcuggucucuccaugcagcuuucauuuccugaagagugguuuuguugcauuucgaauucuaauuaggcaguaaugcgugguuuauaaugcuugggaugcuaguacaaugguuuugaaaucuuugccgccccgccccccccccccauuugcauugucucauaaucuugacucuggugcuccuugagcgugcaugucugugcuuauccuggcagaguucuuuagguuucuugacuguauggguaugugucaauaaugacacaggucauuauuucucagguauguuuuugacuuugaccaacccacccugacauaagcuggagcauuuaaugucaucugacugaguuaaugggucaccgccuuauggcuugacagugcaggcaggaguuuguaauucucugaaggacacauaaaggacauauaaggacaauaaaguguagcuuuauuggauguauaggauuuguuguucuuuuuaggaggaagcaguuuuguuuuguuggagucaccuuccugugaaucaguuugguccuguggaagaucauucucaugcauuacuaggucaagguagagcagucuacauugugaggcuccguuauuauugguaaacgcccaauauggaccacaggaucucucugccaaggguugucaaucggaaccauucccagccccaugggaacucugggagcauugccauuucagggacuuguguguauaugagguacauucauguguauauguaugugcauaggugugaauaaagcauggacuuugugugugguaggcaagugcucuaccacugaacucuuccucuggcaaccuuaaucauuuugcguggucuuauggggucuuuaguuauugguguuuuaauauucagucaaaaauuuagacaaacuucuggaacuuucucuguuucuagcauuauaucucuauagcucuuccucccaaacugaucuucuucuuuacuaaggccuuguacuuagauauauucucacugggcugcaacaccuauucugagggaccacagaggugcaccacucccuaucuaacaaauacauguguuucauacaucaucuguagacugcagcacaauaguucuauaugucaguugcaguauuaugacugaauaauaauaauuuuaugguaaauugccccagacucuccuugcucucacauuugagagcacagcuuugcaaauguguugcaauacccaaguacaugcaugggaaagaucucugaauuuuuauuaaucaacuuuugcauuuuguggguggauuucagaaucuuuugucuugggguaagggaaauggcucaucacuugucaugugagcaugagggccuggguuugcauuuccacugccacauaagggcuaggugcagggacagagacaggcagaucaucagaugcgugcuggccagccaaucuagccagaacggaagucuccagguucagagagcgcaauggaguaagauaccugaagucaaccucuggcuuuuacaugugcaagcacaagauggaugcaugcaugugugggcacacaugcacauauacauauacaacuagccaaugagcuuuauaauuuauuaguauuaaggcagagaucuaaauaguguuuuaguucuuauucuagacauuuuauguuaaccaggagacaaucccuuauauagagaaacgucauuuucaugauucuguaucucuaaauugagguguuccaucuugaaacuuggcauaguuuuauagaaggaugcuaaccccuuaguaauaccgcuaguaaacugugacuugucauugucuccaguucaguggcauuucauugugggcugacaacuuuuccacacccacuaaccaucuucgcucuugcagguaguccagcacgacccaugucgggguggagcuggguacuggaauagccucuuccgguucaagcaccuggcuacagggcauuacuuggcugcagagguaaguagcagcacaugguuuucucuugggaagugaguucacuaugauuauuguuuuucacucgccuguagcagcuggacgccuggagguucaagggagcccucagccaccgggcuuccucgucugcccuucuauguucuucuuucucauuucucuagaaaagaaaaguuacaaaugacuggcauacugugggacuuggcagggcuccugagcaagauguaaggagaaggaaguuagaguguaaugcuauuguagguuuguagggcaguucaccugcuuugcucuuguaagccacuuugcuuauagucaucugaaaaccccacaccuaacacauguccuggucacaugguaaauaaaaucagaagcacugaagcgcauggagaacuagagcauuucauagagaaaucggauucuucggaguguuauggggagacauaggugccaucagucuuguaagaacaucacgaaucaaauaacaaauuauuuugagaaaaggucucacuauauagcucuggcuggccuggaacucacagcaauucacuuaaccuccccccaagugcugggauuaaaggcaugugccacuacacagguacguacuuacauacauacauacauacauacauacauacauacauacauacauacauacauacuuacauaccccuacacacacauaugcuaagcaccacucaaguuaacuuuuugagucagggccucacuuugcagcccaggcuggcuuucaauucucuauccuccugccucagccuuuuaucuacuguauuuagcuuaugaaagcuuuuugagaaaaggaaagacucagugucgaaggaugcguggaauuuccacuucaguuucuguauuucguuaagggacauccugcagcguaacugauguggaguuuuccucugaucugagggaagauguccguccgaucauuuucacauucuaguaguccagccaaagaccccacgggugucuggcaccacuggcucagaauuuguaaggaucugugucaggaucaguccugcuucuguugccacgggcccuaggaauuuggauucuaaauguguaaacuaccuggagugucuugauacuuggaugaacugaugauuuugaaauacugaagacccaaacaugaagaaguccaaguugacauuuaagauggaaucuuuaggaggaagagagccaucuaagcagcuuugaaaaaccuuugguuaugagguuaaagauuaaguuuguuugucuuuccugcuauguuuuaagguaaauguagagguguccuaagcaggguaaucaaugacuguguguugacauuaucuuaggucucuacuguugcuuuccuagugaauuuguuguguuuucccugucuauucucagagcugaacugucuacuagugauugguggauuguuguguguguacuguaacugugacuugugucguuguuguggcaugcugguucuguaaauaggggaaagggacgaguucuuagccguucaaggaugacugcagguauugacgucuccugcagaugggucccgguccuugagaaagaaauggauguuuuaauuuccuaaugauucuuuuucaucagguagacccugacuuugaggaagaaugccuggaguuucagcccucaguaaguacaggcaagagccuucuugucuuugucugguagggauaaggccaaguaaucuggagccgcauuuaagaaauugucaaguggccugugagcguuggggaaggggaagauuuaggucaccuucaccaggcucuuguucuguucuucucuuagagaauguccuaccuuccuguggucuugaugguuugccuguguguucggucaagagucuacacuucuaaguuggagaagugcaugcgucucuuggaauauuucugggugggagaugguggugguccuuaugcaaagguggccucuaaccaacaauagucucuuagugcuguugaccuugaccugugacucauccagguuuugaagugauaguguguaguaucuuuucgacuguugagauaacacaugaagccugggacacauguccuccaaugggacaaucagauggcugaccucuaacuuugcuuuuuuacaaagucaaaaugguguuagguucugaugugauuuggaauuuuauuacaaauggauuuagcuuuggaaaaaucgugaccaaggaauauugauuugugcguaccccagguaggggaugaagaaagcagugguuauguuucauggacauaggauauccacagaaugguucuauuugcagagugcuugguuaugcugaauucaaaccaaacaaaaugccagaccguugcugucuguuugacaaguuaguacguguccuggucucaguggcugguguggcaguuagacucaagggcacuugcuuuucuaggaaauuugggaacagcacauaaaggaggggaaguaaggcagagauaaguccaaaggaagggcccaggaaucuugugcuagugguuaacuuucuaguuauguuuggguagagggcuggcaauaaaagaaagaaaguccauuguggcugaggacuucuggccaugaaugacuacauagacuucuagggcuuuacuagugacaucuccuccucucuguccuacagagugccugggacccaucuccaucuucccauugccuuucugucaccuuuacuuaugcagacaaguggaaagcuugucucccacagcuaauccaucuuagaaagcagaccuaauccaguuugcugcucgugugagcccuuggccugacuguuuuuucuuguuugauauuucuuuuuuuuuuuugguuuuuuugagacaggguuucucuguguagcccuggcuguucuggaacucacucuguagaccaggcuggccucgaauucagcaguccgcuugccucugccucccgagugcugggauuaaaggcgugagccaccaacgcccacuuuguuugauauuucuuauucuuggacugucauuaucugagagaaguaacugccauguauggcaucaacgcugccagcugagguaucacagagggagucugaccuuuggcaugaagauaaaucauuaaucauuagaaggggagaugcuaucuaagugagccaugggcacuauaggagauggcaucauuccauuagguucuguauaugaaggaagacacuauuugcaggguaagauaaaguguggugcuugcaaacccaaggaggaagaagaaagacagaccuuuauuuaaauagacugaucaucgacaagucauaugaucuugaauaaguagcuuucccucccugagccucagauuccuucuuuguaccagcaacauuuucacguugcacaggaucaguaaggacuuuagugugcucauauccagcaggucaucuugacuucacaagagguaggaaaugccuaggugaguggucucacaugauguguaucucagguucuuuuggguugaguggucuuucugagccucaugcuuccuuauagugugauacaccagcaggcugggugaggaucaagauggcaguucucuaauggucccaagguugcuggaccuugggugcacauggaaaaugaguguguagagagugucucacuuguauccaagagacuuggaagcacaguauuggucuucauaggcaaguauuagccuugagagggcccggcuucccuucuuugccuguuuagcacgggagugagaaagggaaggguagucauaaaccugggugaaaagcauccucuucucaccugcguaugguuuuccuggggcuuggcaucaaggaagagguagaccuaacuagcugugcgcugcgccuucugaaaucaaugcucacuugccuggcccaagagagcaaaagcccaaucagaggcuuguucucugcugcucuuugcacaugugccuuucuucccacuagauggcacaugcacaccagcgacucugcugcuggguucccuggcuagguaaagaaaguauacugaaggcacaguuuuccucaggaucugcugcuaucucugaucugucacugccuguaaccaugcccuuaguuauaguugguucagacccuguguugagagugguguguaggacaugugacagggggcaggaauuuggugcgaacagauguccaugguuuccuuccugaauagaggcacagaaugugcuugcuccagauguuccuuuagugaagagagaguaaaaugccuuggguuuuuagguacugagaauuucuuaaauggauuuuuaguugugguuugguuuuugagacagagucuuccuauguugccagggcaggucuggaacccucggguucuagcaccaccacaauccccacaagccccagcaucccgaguagaccuguuagccgagacuacagauauauacaaggcgagaucuauuuucugggcaacagaggcuagaucucagccguauguagcuguuuucuuacuucuuuuccuuucccuuugauaugacuuccugguauagauuauaguaucuuccucuggguguuugggcaggagacgauguuucauccagagagaagcaagccagggauuaggaaagaguacuuccccagcaggugcagggcauguaguccuacuaggaaugccaagcauuuauaagaauugcaugcauggucacugagagagacauuguagaguccaucuggucaggcauucaggcuaaggccacuugcuaacaucucugacauguggccuuugcuuuggagacccaggacaccuucauuguucaucacgucuuacuaugaaggauuuuccuucauuucaaccaaaucccgcuguagcaugaguggcccuuugcuucagcaacaguggacuucuuaaucaaugaccaguguguuuuuagagcuagagugacuugacaagcuauacuggaacuauuacuaagggacacuuggauuagggcuuauuucuucuucuagaaaauaccugugccuuauuuuugguagacaaccauuacuguaucuuugcaccaccacaaauaaaaggcugacaggccaaguuuccuuguaacuauauggagugaaggucuucaguucuuguagcucuuuuucuauagucauaugcuguuauuacuucacagugcuugaagauuuuguaugacaguagagaauguguggccguggucacugugcagggcuacucugaaaccggaccuucuccugccagccgcugacacucacugucuccucucguuucuuccuguggacuggacagaugauguugagggaggcuguaaccuacugagcuccucacuccacaccuuuugcccccagguggacccugaucaggaugcaucucggaguagguugagaaacgcgcaagaaaaaaugguauacucucuggucuccgugccugaaggcaacgacaucuccuccaucuuugagcuagaccccacgacucugcguggaggugacagccuugucccaagguaugauuuuaaaauuccuuauuucaagagaaucagggcggucuugauggcccgaauccaaagcagcauggacuuuaaccgaagcacuuaugaagagguagugaaucagccuuuggacuggcucuaacaugaccuggaguuucguaugggccaucaaugguaaguuguugauaguuggguaaaagguccuauauuuaugaggcuagagacauggcucagggguuaagagcacagaggauccagauuugguucccagcacauacaugguggcucucaacuaucuuuaacuccaguuuuaucgggucugauauucucuucuggccucugugggcacugcaugcacaagaaacacauaaacacaugcaagugcacauacacauacuuuuaaaaaaauucuucuuuaaaguguacuguaccugggcuggggagaagcacaggggauaucaugcuuggcgcucaagcuaaaggaccuugguuugagucccugucaccaaaguaaagcugaguguagaagauguaaagccugcaucuguaaccacagugcuuuucugacgaggugggaacuagagaugggacaugccuggaagcuucugaggcaggcagccucgcaugucaguggugagcaagagacugacucaugcaaagugugcaaggcgagaauuaacaccgaagguuguccuuccuuugacaucuguauucaugcaggugcgcgcgcgugcacacacacacacacacacacacacacacacacacacacacacacacaccauuuaacagugcgauguuuagguuaacaauccauaccauaagcaguucaguaacuuuaccccuuucccuccuuccccaaaccucagcugucucuuaacuggcuaaaaaauugaagagaaaaauuuaaaaagugaaaaaucacuggguacauaguaagcuuauuuaaaauauuaggagguuaaaucaguguuccuuuucauguauuuuauucaacuuagcuauuacuuuuguugccuaagaguguauuuuucauagcagggcagugguggcacaugcuuuuuaguuucagcacuugauaggcagacccaggaccuuuguugaguucaaggccagccuggucggaagugaauuucaggacagccaaggcuagacagagaaaucccaucucaaaaagcaaacaaacaaaaacauauucuuauaucaugcuauaaauggaagagccaaucuuuaaacaaguguuggcauuguguuuaacaaguauuguauugugcgugauguguguaaauggcugugcaugccgcugucagcauggugaucagaggacagcguuucucuaggcucuagggcucaaacucagaugccauucuuuuucuuuuaaaaauuuuuuagaguucuguauuuuaauacauguguauggauuuuucgccugcaugaaugucacugcacaaugugcuugccagcugcccacagacuuuacagacaguugugagcuaccaugugggugcugggaaccacacccagccagaguucuuaaccacugaggcaucucuccaaccuuccccaagugccauacuuggguuacuaugauugcuuuauguauugaaccauuucacuagccccaaaagucacuuauuuguuuguuugcuuguuuauuauuuauuuugagguagggucccaguuuguagcccuagcuggccuggaacucacauaggucuuccugccucugccuuucaaguccugggaucaaaaguguguacuagcacaccuugucaaaaaucuguucuugacaaagucaagaacaaucuuauucauugaguuucagugacaugggaagcauagugcuaaguagauaguagacucaucuuacauaauuuauaauuuugucauguuugaagcgcugugagcuaggaauuauacauucucuuauagaaagacauugagacucagagaguuuaagcagugucauaaguuagaguccuguagcagagcucguauugguaaauggcuaggauaucauugucucacggugacaguccuucucacucuuccgcucuacauugggugucugaugucucacugguguugacuggguuuucaugggacccuucacugaggacaccucugugcuucauugugccugccuugucauuuuccugcucagcccgaggaugacugggaaacuuaaccucacccuguguaauugcggucagaauucaggauccuugacuugugcucauuugcuauuccugucccuucccaaagggagaaguguaagguaguguccacagagaacagaaccucucaaggcagccggccuuuguuugcucuacagccagauuccuuguuguuaagcucugcuggcuugguaaccccuugagaaucugaggcaggcuacagguauccgucuguaaaagccugcagguauacacagcuuucuucuagaucuguaaccuguuauuuuaguuuccuucagaauugcucuaaugcagguaaccauagauacuguaacaagcaugucacggccagaaggcugcauuucccaacaccucuuccuguucuccagcuuuuuuuuuuuuuuuuuuuuuuuugcuuccucuucuguauguucccugagccccacugguagcaguagaauuaacuagcaauauuccauuuagguugaacacucagucucuuauucucagcacacugaucaggucugccucccuccguugacuucuguccgccacaaaaacgaaccuucucugauucaaaagucgagugcagccuucaucugcugugguucuauggguauaagcgugacuauuuacaaaggcaugcugauagugugaccauuccgcagcauaagaaaaguagacucugcuuccaggccuaugacguccuuggucaugcaugugcuuuugacaagguuuacaguguaaggcauaaaauuccuuuuagcagagugggccugaaauccaaucagaaagagguuaguugccuuauaacaacugugccacuauuacccaaaugggcacaucaugccuggcaggucaguaauguuacauaaaggguucagcacuggguaagaccauggaugccuguucucccucaucugccugcacagccccuucugccaccuuaaaaguggcaaucagggugaaugugucuugggagguuugggauggacaucccuguguccuacagucagaucaugugguaucuucagcggcaggguccuugccaugugguuaugcuggguaagcaagggcaauccaauagcccaugcuacuccaugcuacuuuagggagcacuaggaguuuucuuuaccaacaacucauagggagguaucccaugucuuguacugcagugcucauuuaauaacccaaggcuuccggaagcagcauuguccucucaugcagaaugauucuguucaaacuaacuuuuuuuuuaaguuggauuuuaaaaugagcuuacuaaguggcggguuucuguuaggcuuuuucauagauccugagcuuugguugucccucuggcuaccccuucaucucugccauccccacucagucuuuaaucuucagucuccuccucucacuucacgguguccugcuagcccggcucuuacucuuuuugucuuucaguugguguacaucaagugugacuuucguguggcuagcccuccccuucccccaucuucugagucugccccccaccccuguucccaccccugcuuaagccuuuccuccccugcugccuuccaccucccuacuuccaauucucccaucauccaccuccucccuuagcauccucuucccccuacagaaggccccuuucuaguugccugccuuccaucccugcuccaaguuaaacacaugaaacaaaagauuugaaggcaggaucugucuacgggagagagcaagggugaccgucuuucagggucugggguaccucacucaguauaauuucuuagaguucauccuuuuaccugcagcuuucaucuugccuuacaaguggguaauaguccauuauuauuaguauauuauguauauauaccacuguuuucauaucuguucuguugauggauguucauacugaacccugguuccuagcugcugggaauagagcagccaugagccuggaugagcagauggcucgcuagugcagugguucucaaccuuccuaaugcugcuacccuuuaguacagguccucauguuguucuauauuagcuauauauccuuuuuuauuauugacuuguguguuuucuagauccaaauauuaucugauccaugauuugcaaauguuuucuugcauguuaucuuucuguucuucgaugguauccugaacagguuaaauuuauuuuuuagucugauucagcuuuuagcuucuugacuuuaaaaacaaaaaacaaacaaacaaaaacaaaacaaaaaacauggccacaaaauuuuauacugauauauucuuuuaagauuuuauucauuuucauuguuuacauuuggauucuuggcucguuugggaauauuuuaaaacauauuuugaggucccauauauuguauuuucaaagcuucuguucucauugacuaccuauuauguaaaaagguacuggccugcagaacauggcaguuuaaaugauuuuccguuuuaucaauucugaagauuagugauuuuucuuaggaugucaggaaccguguugaaagauuguuaggcuagugaagaacugaacgaugugauuuaaaauaucacauggcccaugagacucuucuuuauugcauuccuuggcaaagagagaaugaggcacuagucagccugucuucuccaguggcuuggaagcucccauaauccugaggagaagcaaaauuuacaguucuugucagcuggcuaggugguguuugcugguggaggccccugccucuguguucugcuucacccuucccuacugcuuccucguggccaccuuucuuugugagcagguguccuaacgcugauucuaauccucagugaggcaaggacucgcccacaagcagccuuggaggagaagagcccaggugugguccgccaauguguucauguaugagcuugcuggaucuuuacccugacuuuuuucuucauucuugcucuuggcugccauccucagagccagaagagaauaacgucucuuauucauuaauccugugaaaauuaaguaacccaaagagcaacacauuccauucucugcauauuagcacucugccgugcagcagugccauuggaggaacauagcagaacaaaauuuagcgacauaggaguauuaggaugccauccugauuccauaugacugugugugcuaaccuacuagucacuuuaaaagugcuggguuuuuuuuuuauuauuauuacagauugcaguguuuaagguuaggcacauggacaucugucaaaugguaccaggaaaugcauuuuuguaacagucaguagauggaaugcuucagagccaagcaggauaauaacuaauccuugauauauugagccagauaauaaaacuacaauacacacauaguuagauauuuuaagugagcauugggggaguaugaacuuguaugaguuuuguguacuugucccgacaacauaacuuuugaguuaaguauugggaauucuucaacuucagaagaauugauugaauguacuuugugucuuugauggcauuuguuauagaacucuauggaauauaauuauccagcgaaaacuaugcuccaagcuuugguuacccucugaaaauccagaaaaugaauaaaacucaaguagaacacuacaaaugccucuguuuaauaucuuguccacguugucuaauucaugcugaucaaaguaaauaauauuagguagggcuuccgucuucuggcuuuagaauguggaggggaguuacagcaaagaaagcuaaggucuaaugaagguuuagcuuagucucuuccccacgaauggggcauggucugccuugguccuaagguacucuuacuuugaauguuuuccacuaucgugcuugccucuagcacaccagugucaaguucuaguccagucaucuguuuucugugucaaugcuuucaggauucugagucccccucaacugucucugaaccacaugcuuucuagugcccguuuccuguuguuucugcuugcuugaugcgcugucaucuugucuuacuaaugcaacagggaguucuugaagggcaauacuucuuccauuguuuucugcuacuuuagaagugaagcagaguugaaaaaugucuuaaacaccacaauuugugaccaucaaauaaagaaacaaacauaaaauaauuuuuaggccacauagaagacaaagaagcaaguagcaacuaugugcaauucaauuauccagagggaauugguggcacuuaagauucugggucauguagguuccaacaggucucugggcacacacguaacaugugauauuccauacaugaaaccaucagcuacuuugcaugauccuaguggaauucugcauuguauaaguguuuucaaguaagugacuauuaucugucaucauuuuaagaaacuggcaauacuuacccuguaauagacugucuuaugaagcauuagauaguauaguucuuuagucuuauaacacugaagugaacaucuuuauaauacauguuguaccugcgcuguuguuucuuuuagaaaaaaaaaucucaauuuggaguugguaauaaaagaagauauauguguuuguguucuuguauuccuuuaucaugcuaucccagcuagcggacucauuucuagaguuaugacugauuacauucuauccaggaaugcacaagggcuggacugcagcucagggauauaacuugugucuaaaaugucaaggccccuggucaguccuaugacuaaagcaagaugccugccauaggaagucauucugucuuaguuacauacuaaguugaauauuuauuaacaauugauauuugucauuaaaguauuggcuguguccuuucccaguuucauauuccuguuucuuauuguguguguguaucaauaacuuuuaaaauauguguguuauucuuuuguuuuuucagguuucuuggucaaugauaguuuuauguaaugcacacacacacacaacuuccucuauagaagauucaaauuuucgaucauguagucaaauucaccccuuuuuuuuguuuuaaaauuuaaaauuguacuuuauuacauacuuuaaaaagcucuaagugcccacagaauaaauaaacauuuacuagucucuuuuuuuuuucagaaauuuuauaaucucauuuuuuuuuugcuuuaaacuuuccguuauuaacuguuaugacaaguccuaauacacagucauuuauaccuaguucuguggcucuggcucaugcuauuucuaguauucacuggcagaguaucuuucagaaauaucacauauuuccaaaaccuuggacuccuucggagguuacuuuuuguugucagcacauuggugacaggagccacugauucccaaguguaucccacccagugucuauaguagaaaacuguuuugguagccugucccccuuugacagaaugcuauuuaacuguagaguaacccaaaaugccccccgucugaccagugucauugcuucccuucaggaacuccuauguccgucucagacaccugugcaccaacaccuggguacacagcacaaacauccccaucgacaaggaagaggagaagccugugaugcugaaaguaagcccagagccugcucgucucccuucgucuccgaugaaagggcucuuuggucagaguagggucauggccaaacuuguugugauuuuuaaaaaaauguauuccugaggaucugggugaagcaagcucagggcuuugacaauaaccaggccuuuuguuuuauuccauuggcauugagcaguucacugcauuucauguuuaacaugacuggcuaugagaauguuugcuugugucagggauacauugauaucuuauugauuuccccuguaucuuuaguauuuucccccucagucuauauaaggcauaaauauauauauauugccuuuucuccagucucuaaccuuauaaaaagcaugaauacaccagggauuuuucuuuuuagaauuuuauuuucuccuaugggugugcucagguuacuuagcuaucagaaucuuccauccucccugugaccaaggagacacuaagauuauaguugcuccuguugccuguauucacccccauuuccuucugcucuuucccuuucucaccauacagugugcacucccauggcucuguguaacacaguaguuccaagcacaaggaauauacacaaugcagauguuaaaaaaaaaaaaaguacuuccccacuuuacuauuuaccagucucccccaaaacuaauuuucuauuuggagaacauucuucuagaagcuuccuaugucuacuugauauuaaugcaaagagaacuucaaguuccuugcacugcccaauauccuguaaagaaaguguuugauaauccucuuacuuucccaauugagguucuccuccaacucccuugccuuuuagauugguaccucuccccugaaggaggacaaggaagcauuugccauaguuccuguuuccccugcugagguucgggaccuggacuuugccaaugaugccagcaaggugcugggcuccaucgcugggaaguuggaaaagggcacaaucacccagaaugagagaaggugaggguguccucacggguggcuagaugggaaaagcccuugggagcaagagcaucaagacugcagagcugugugcgagaggggcaggccugagcuuuugcgggcagcuucaauuuaugauguccagauaugguuacuuuuaucuucucauaugucuuguuuuguuucaguuguauuaugcagcuccguuagccccagcugcuagaaggcugaguucucuucuguuuaccuuguucuuaaagucuggcccuuucuaggcaaggcuuuuagccuguagaaguuugaacccuaacuuuagcaagcucugucucuuaaggucugucacgaagcuuuuggaagacuugguuuacuuugucacggguggaacuaacucuggccaagacgugcuugaaguugucuucucuaagcccaaucgagagcggcagaagcugaugagggaacagaauauucucaagcaggucggugagccaugaugcgcuuuggggugggcucugugagaagccugugggauccgugcucauacaaagagacagggaugauuuucaucccuaagacuuggaggauggacuuuuaaguacugaguucuuagaguaguucuaaguguguagcaaauacaagugacaggagaguguccuucuguauccccugccccagagucaacauccugcagcagaauggagcauuuauugcaggagugaccauaggucaauagaucacuguuacucaaggucuauacuuuuuggaccucucuuggaaguguacaugauuuguuuuugacagauaacaauggcaugcgugcacuaucacaauaucauggccugaaaaguucucugccccccagcucuucugcuucaccugucauucaucguucuucaccacgccuuccacccacuccuccuuucuguguccauguucugccuuguucagacuaccguauagauggcacgauguagcuggcagccuuuucagauauguacaguucuccgugccuucucgugacucaaugccccagucccauugacaggcauugcacuugcugaacaugagccgagugagcgcucacucaccuguuagguacccuaggaaguguucaggugacgccuuuacauucuucaaaacuaauauaaugugccacauuuccuuacgguuacuucagauguuuagggaauuugcaguacuugacaaacacagaaggccuguauuagcucucacggacagcuuuagugaucacuucuaaauauuuucaugaagaaggagugugaguuuacaggaaauaucuagaugacauuuggcuuguaggagucagcuguccugucacugugacgacacagcuggaaaaaaaaaucucacagagaaaaggucuguuguaguugcaggaguuucaguccauguucacuagcccugucacucuugggcucugguaugugauguugggcaauauguggucugcuaaccccugccuggggggaacagagaggagcuuguuccugugaacaugccucuccuaugaaaccuauuaagcuaugaaucuguugguggcuaaggacucacaucucaacaacugccacuuugggaaccaggcuuuucccgagagcuuuucaaggccuuuaggauucugaguauggauaguguuaacuucaauaaguggacgaauuagagggaggagcaugacaaauccaaguggaggacgcacucugagcaugugccgugcaccucucuaaagcugugagauuugcuuaguuauuccuuggaccuugcuggugaccaaaaugaaaagagagacaagcuccaaagccccaugguucuccaugagaacuuggcauguagaaauccuucuuccuguuggacuggguuauacaaaauucacauuucaacaagguuugaaguccaagaaugaaucauacccagauguuucauguguugaaagccagauuacaauucuugcuuagcguccuuguucauuuccaugcuagccaucccuugagggguuaaaagaguguuggucacuuauauacggagcuguacuucugaugugcaacugcuaucuguuuucauccuuagaaaacuuaaauacuuuagauacugugcucuguguucucccacggagagagcaugguuacuuuggacgugaucggcacgguuacccaguguuccugagauccaguucaccuggcugcuagcaaagaauuacauucauuuugcucuuaccaggauuauauucauuuuggucuuaccaggauuguaguccaggaggcaucaaauccagcagccgucugagagcacugucaaugaaagcuguuuuuauagcuuaauccacaaacaggcuggcuaacugcauccuguuugugaagacuucugguugauguggccaaggucacacugccuuacaggaaaggggucggauagucuuaugaugcuaggcagauaauuccaaacuguuacaaaaccuacugagucuccucccaggaguugcaggucagcucaguguuugagguuagccuauacgugugagugcaugcaaagacagcuaaguucaaaaguugaacuguggacaugugugacaccuggccuaacaaguccucccaacuucaguuuuagugccuggaucaaugcuaaucuauuuugauuuugucccuggcagaagucauaaaggugugugguuucaacauaaauccuucccugaaugcagcuagacaaugcucuguccugugaauggggaccaauaaaugagugggugcccagcccagcugacugacagauucaggugucaguuucuugauguguuuggauagagaaaccuuuucauauaaucccauuaucccuauuguugugguccuuccuggaaagaguuaaaguuuaaaacacggaguggccgggcggugguggugcacgccuuugauuccagcacuugggaggcagaggcaggcgaauuucugaguucgaggccagccuggucuauagagugagcuccaggacagccagggcuacacagaaaaacguugucucgagaaacaaacaaacagaaaaaaaccacggagugauggcagccugcucuuucuuucacaaacagaucuucaagcuguugcaggcccccuucacggacugcggggauggcccgaugcuucggcuggaggagcugggggaucagcgccaugcuccuuucagacauauuugccgacucugcuacaggguccugcgacacucacagcaagacuacaggaagaaccagguggggaucaagauggacaggaagugauuguuggcucugcagcuaguuuuucugacguuuuaccacgcugucuuuucaucuacccuguugaucugcguuucuuucccuaaaaggaguacauagccaagcaguuuggcuucaugcagaagcagauuggcuaugacgugcuggccgaagacaccaucacugcccugcuccacaacaaccggaaacuccuggagaagcacaucaccgcggcagagauugacacguuugucagccuggugcgaaagaacagggagcccaggugaggcaccagaggggacucgagaggaggccucugugcaccuaaaugcggaacuguagcugucccugguguuguggacugggccugcuguccuggggacuggcagcaaucaguuuccagugucccugugauguguagaggcaggaacgcaguaccugaccccuugcugcggccccaacgucaggguuucccagugcccuccuucauuugcuaaaugagcaaggguaaauaucugugagcugucguucgcaggacacacaguaaaagacauuuauuuuugcucacucgcucuuugggccuuguggcucucaggacuccugcccauacugucacuauguuccuuguuauacucaguugucuccuggaugcuuuccuguaucugagugcauucuucccauccucucguaccacagaucugccccauuccuuuugacccuucccuaucucuuccugcuucucccugagauuucaggugacaugggaagcaguucacaguacagucaucagugcugcuauaaacauggccacugcuaccucucuacagcaucuccugaguccagucuuuaugaagcuucacauuuaauccucaggaaaacccuuagaaaccauacacuaugucuuugcugauggaugaggaaacugguauaagccagguuaaagaauguaggacuuguguacuugaggaagucaggcucccucugcuugguauguguacagcauccugcuugcuugcuuucugcuuagguucuuggauuaccucucugaccucugcguauccaugaacaagucaaucccugugacacaggagcucaucuguaaagcugugcucaaucccaccaaugcugacauccugauugagaccaagugaguaccaucuggggacauacacuaaccaugagauacauuugauaugaaauggcuguauaugcucauggggaauaaaccuagcuccuccuccugugcagagcuggucucauguugguuuugguagcauuucaguuuuguuucacaggccuugcuuaaaagaacuguugagcuugugguuuagcuugcuuuugaugugaccuucuguacauaguaucuucugcauuguagugucuucuguacagaaggucacuuacucuguauacucuaaaauuguauaaacccaucagagagcauuugacacauagucuaaagaguugaugagccacugaaguucuaucauucauuaaaaaauaaaggaugcagggcuggagagauggcucagugguuaagagcacugacugcucuuccagagguccugaguuuaauucccagcaacccuaugguggcucacaaccaucuguuaugggaucugaugcccucuucuggugugucugaagauagcaacaauguacucguagacauaaaauaaaucuuuuaaaaaaguaaaugaugcuaacaaauacucaguguuaguauuaauucagugaugggcggaguuguaaguuaucauuguucaaaaguaugaugggcuggugagguggcucagagaauggaggcaucuguuguugagccugagagccucauucaguucccuggaaacucauggugagaggagagaacccacaaguuguccacugacauauacauauccaguguagcacacaacaaacaaaaauuggaaaaguauuuaaguagugcuuauuauaauuauauuauaauuauuauauauauaaguacuauacuauaguuaugguggauacuaaucauaauuacuauuauuacuauuuugguaauaguggauauuuacuuuuauuaaaagagcauuuuuuucuggugauuguacuagagcaguguagacuguauuaaaagaauuaagguguaaucaaguggugcaguuuuuuuuuccuuaguuguaacuuaauuuggggacuuguguuaaagcaaagugccucaaccuuggcaccgugacauuuuaaggcuagaugacuucauggcagaaaauguccugucacuguagauguuugcaaaaguaucccuagauuauggcuacacaaucuuaguagcaucuccuagcauugugacaaccaacauguuacagauacugccacaugucuacugggaggaaaaauugugcuaguugagaagucccaagaccacacagaucuuuguggcucugccacugggagaaagaaagaacaaaguggcuuucugugugucucugggcuggaagggaggcaagacuucaaaggauuucguaaaaacggaacucuuaucuccuauucuucuuucauaggcugguucuuucucguuuugaguuugaaggcguuuccacuggagagaaugcucuggaagccggggaggaugaggaagagguguggcuguucuggagggacagcaacaaagagauccguaguaagaguguccgggaauuggcgcaagaugcuaaagagggacagaaggaagacagggacauccucagcuacuacaggugagugggaggcuugacagccgcggcaagugggagcauaugguuuucuuguuggucacucuaaggcauuagugauucucaaucugugugggggugggggguggugguggugguggugucaaagaacccuuuccuggggucaccuaagacaaucaaaacacacacuguaauucauaacaguagcaaaauuauaguuaugaaguagcaacaaaaauaauuuuaugguuggggaucaccacgccaugaagaacuguauuaaagagauggagcauuagggagguugagaaccacuguucuaaguaauagaguggugcccugcaguaagauuguccaauggaaagucagaugugugcuuugugaagaucaaguagaagaugucauggacucauagucuaauguuaucucuguguguccaugucauaggaaggacaagagcaugcaccggccuuuguuacacuugacccauaaacagcacagccuguauauaacacagucagcagcaggcagcuauggcccaugcugcaucugguccaauccucaucucuuaacuagccuuucugcuuuggcugaauuuggcuuuguggccccgaguccuuauccuuaaaauagguguaauagugccagucuucccgaacauuugcagaaacagaaaaugucuccauauaugugcacacaccuguauucucauaauuuauuuaucgguguucauguaugcaaaccuaugguaaaaagcagggguuugcgcuaacccaaaucauguagcccuaggcuacaaacucugagauugcaacccagaacugugggaggcccaagcaugcuguucagaaggaucccgacuuuggagcauucuagauuuucagauuagcaaaacucaacugaugacguuuacaaagucuaguucccaaaauguuggucuggugcauuuccaaaacaggcaugcucagugugugcuuucgauucugcccuaaaaccacagaugcacucugccugucacccuccagcugcuaucugucauuccugggauguccaucuguuugccuguguacgccacuguauaucaccacugcccaccucucuugaccuccuuaguuccuagucuuggccccagcuccaagcaggggaaaggaaagaaaaggaagagaaguugacugauagauacuugugaaagaaaagggaagaaaccuuaguacuucugauauuuccuaacaagauaaacaaaauuuugcaguuaaaaugucuuuccuuacuccuauauucuacuuccuuguauuuauauacaugguagucuuuuuuucuuacuguauguuaugguucuagacuuuauuuuauuuucugcauugccugcaugcauguucguguaucaccgcacggaugcucacugccggguaggucagaagagggccuugcaugucuuggagcugaagguguggaugguugugagaagcugggcacugauuccaggucuucuguaggaacacggagugcuuuuuacugcagcuccaucucugcagcaccuccuuauuguguuguguuuacacuauaucacacgugcauguguguguaugcuuucucuugcacagaucuuauguaaaugguaccagacaccauucuaaaggucuccucaguauuguuucugaaauacauaugaaaauauaacuucagugucaauagagguagacuguuucuauaauuuugacugcugcaugccuuccaugugcuaauaugucacuuuuuuuuccauuuuuuauuagguauuuagcucauuuacauuuccaaugcuauaccaaaagucccccauacccacccacccccacuccccuacccacccacucccccuuuuuggcccuggcauuccccuguacuggggcauauaaaguuugcaaguccaaugggccucucuuugcagugauggccgacuaggccaucuuuugauacauaugcagcuagagacaagagcuccgggguacugguuaguucauauuguuguuccaccuauaggguugcaguucccuuuaguuccuugggugcuuucucuagcuccuccauugggagcccugugauccauccaauagcugacugugagcauccacuucuguguuugcuaggcgccggcauagucucacaagagacagcuauaucuggguccuuucagcaaaaucuugcuaguguaugaauaugucacuuucuguuggcauucuaucauaugucccaguugaguccuucaugagagggcacauccucacuuaauuuuguguacacaugagugaccacucccugugaagagauggauugauggaaacucggauuuuuaacuuuaguaagcaguacuacauugcaugauuccaucaacauuuuuaccauuagcagcuuugacuauauaagaggcuacagacauuguagaauuuuaauuauauguuauaugagccaguguuugccguuuccugcauggccuuuguugaacuauaugaaauacaggggugcagagagaaaguggggagcagaaagauaaucauuucaggcuuugucauuuuucuauuuuauaagguaaagauggugaauauaaucaugugacaugauugcuuuaauaucgcuagacagaugugugccuauggggugcugacccuuacucuggcauacuauaaacuuuucuuccaucuccuuagcucagaauccaaaauuauguguauuacaaucauuuaggaauguugguauagaagugugauggccauauaucacuucuauaaaacaugagugaguaugugaugucuugagugugagccuucuguugauuuuuuuucccccagauaucagcugaaccucuuugcaaggaugugucuggaccgccaguaccuggccaucaaugaaaucuccgggcagcuggauguugaucucauucuccgcugcaugucugacgagaaccuccccuacgaccucagggcauccuuuugccgccucaugcuucacaugcauguggaccgagauccccaagagcaggugacaccugugaaauaugcccgacuguggucagaaauucccucugagaucgccauugaugaguaagucuggguccaacucccugaagagcucuuaugucacuucaaaaccccaugauucuaauguucugugcagccgcagagaagccacauaggugaccuagugaaaucauaagagaaggaagaacuuuuguuuccuucaguauuuaaauagaauuguguagcuagcaaauaguguuuaauuccucaagaaaacaggaugccagggugcaguuuugcuaccucugguuuaucucuuuccuuuugcaaauaucuaaauuuguacuaugucccaagacuggggaauauuagugaagaaucuagaaaacuaccucuauuauaccggaggaaagacaggcaguaaacaugaugagguagauuuguaaguguacaugcuaaggaaggaagcagaagucugguccagguuaggggaugcggucuuugcaggcuaagcagccuaagaaggccuggaugcaaagagcuugacagucccuccacccugucucguccucucagcuaugacagcaguggaacauccaaagaugaaauuaaggagagguuugcacagacgauggaguuuguggaggaguaccuaagagaugugguuugucaaagauuccccuucucugauaaggagaaaaauaagcucacguuugagguaaggcauggugaaaugcucucucaaauuuuguuaucagugcucauauuucuguggaauaaguagaaaguauuuuaauucuuggcgauuguaucacaaugcuaucguuuugaaacacaaaaggaauuugggucagauuuguuucaacaaaauagaagauuuaccagacacuuagccucauagaaacacagaaggugaauuauguaaaguuggagagugucacagagcuucugaaaguauuaggagagaaaguucgugcuugggaugugucauagucucaucaucugaggaauauacauuuuuguuaguuuuacauuaaauaauuuccaagaccaccaucacucuuuaggcaagauauuuuggagacucgaagugccuuuaucuguguuccuacuuguuaugaugugguuuauucuugggaagucagaauaucaauugauucgacccauugcuuuaugaucuagucauccagauggaugggugggugugcaagcuuucauuucuuaguuuuccucauugugaaccgaaauacaacuuuaucagaaacagaaauccagauguaugccuucucugaccauaaagaaggacacaaucuauggugauuggcuagugaggaucaaguggaagaggagaacacaggucacugaguacuaauuucuucuucuuuuaaaugcaauagguugugaacuuagccaggaaucucauauacuuugguuucuacaacuuuucugaccuucuccgauuaaccaagauccucuuggcaaucuuagacuguguccaugugaccacuaucuuccccauuagcaagaugacaaaaggagaagagaauaaagguaacaaugaugaggagaagcugaagagugaguaucugaagugucugucugugcugacagaugucccccagcccaugcugccucauucaugccaugccuuaucaugugacaugcuguccuguccucguccguucucaccauugggagcauaccaauagacguaaagucucgaagaguuccgcuaagaccagugcccagcacugauggucguucucagcaauuuacucuucccuuugccucugucuagaguccuucuuugugucuuacugaagagugugaagguugucuugugcuuugaccauuugccccuccaaagcucaugcucugccaucuguguuccaugcuucugagacacuugaggaugauacuccuauaugaugaacuaaagugcaagcuuauaucuugauauuccuuuucgcuugugaauaggaaaauccuuguuuauauguuuauuucaagcuguauuaggggggucagaauaggcauaggauaaucaugaugugucauaugcuuagcugguuuucuguaaguaggaugaaaaaggcauuugacuugguucucccuauuugccaaguacggugugauaccauuuugcaugcauuauguauaccauggaguucugauauagagcucuuuucugugugaggacaccgagacucagaggugacauaaugcauucaaaaccaagcagcucugguuagaagcagcacuauucguguccugcuaacuuccauuccuauucugugcaccaucacaagcacaugucguuggugcugagucaaauuuggugaugaaaucaguaaagcagcaacaccccacuggagaugucaagaccaggauguucugcuaaucucagacgucuuaaauuugccaugcuuguuaaccuuucuggguuccuugggucaagagaauguaucuuaacagggauguguuaaauaguuugccuaaaaaaagcccauaccccuaaucagagccuucaggcuuucuccaaagaugucaugaccguggucugacuuggccuuuucuaggcaguaacgugaugaggucuauccauggcguuggggagcugaugacccagguggugcugcggggaggaggcuucuugcccaugacucccauggcugcggccccugaaggaaaugugaagcaggcagagccagagaaagaggacaucauggucauggacaccaaguugaagaucauugaaauacuccagguguggugcaaggaacaagaugcucgcguggucucuguuucauaucuccccucucugcucugauagaggcccaaggcauucugggaaaaauagcaaaaauguuagcucaucccuauguaucguuucagaauugcuccuuuuaauucuuuauugccaucuccuaccuuuccccaucauggcuuugucuagucugccaucucagaacucguucaguuaccuuagcuuuacgucagagcuguucacccuuucucugcccaagccuuugccuagagucacuccagggcucuauuagcauugcaaggccuuucuccuugguccccuccuccucuucuaucuuccccuccccccaucucuuccauuuucuaccuuuugcauccacucacguauucacccaugaauguuaguugauauuaacuccacaccaacucccuuuuagcacuugggagccagcaaggaacaaaauccauuaaaguucugguccuaaaaaguuucauuuugacaaggacaugggcuuaguuguuaaaacauaaagacaagccgacugggagcuggaacaaugacugaaugguuaaaacaacuuagaugcuuucccagaagacccggguuugauuuccagagcccauaugcuggcuuacaaccaucugugacugcaguuccagggaguuggguggcuuucuucaagccuccaugagcaccaagagugcaaguaguacacagacaaccaugcacacagaagacccauacaugcaucauacaaauuaauuaauuuucuuacuuuuaaagaagaagggucaacugauuuggaggacaccacaggcacagauaaugguuuguuuguuuguuuguuuguuuuguuuuguuuauguuguugugagagaagaccucuguaguaaagugguuuccucaaacauagaugcgcauggccauacauuggaagucuuaggauuuagcaagugcaaagagucugaaguggggacaaguuugggaacagccuguuuucaagaggacaaagggaaaugguaaaccagcuugaaucggucaauauacauugucaccucuuucucaauugaaccauuaagugacaguugagacaucauaccugccauguguauauucuuaaaacauagcuaaugcgaaucuuacuacugcgggacaucuuugggguugaaauucugugcaaggagcagaaagagagcauccuaagcugcugggaguugagagauguaauggggccaagagucuccaacugacuuuuccccuuccacacacaaggacuuggcucgcucuuagaauuauuagucuguccucucuaacaugauuguuuccaucugccaugccaauugcuauauuccuacaacugaaaaauguucaaacaaaaggaagccuuccuuccucacuacuaacugcucauugcccaucuucccaccuuucucuguaccuucccagccuccagccagccaucuggguguccuuuaaaucucucuaagcugacgcccaucaguaacuauuguaguugguuuugcauaauacugaauuugagguucugggaagauaccaaaccggaugugcaacagucacugggaauggggacuaagagcuuggagacaggucaaacaucugucuccaugugggaucggugacagccuguaauuggguaaggucacccagagggccaagcagaagcuaggagagaggaaggagggaugucaguaggaugccuacaugaugcagcuggcuaacuuuucuuuggggcucuagcuaucauccuuuguaaaugucugcaggaguagagggaggggggauauaggaaguuaacaaaacaagaacccagggggccucuaccuaaccagaggagauaaucaacuauaagugaggcuaauucuuagaaguaaaagcaaaaugucucacaguucauuuuaauucaaagcagccaucuucaucucuaguuaggcccaaaguuggcuuucagucuuugcugaaauauaguccuguuuuguaaagcauggaggcacgagugauguuuuauucuggguguuuaauucaggaugccaaagucuacaccagaagcuaaggugucaugggcacacaggaugugccccuuagcagucuguuaucauuaaaaugacuguugaaaccuaagacaaauauuugacucggugcuuaagguaauugaugcagcugauaccaggcccugccagacugcagcggcuuggcaaaguguuaaagaugguauguuaauguaaccaaaguguuuccaugucuccuugaaucuucaguuuauuuugaaugugagauuggauuauaggaucuccugccuccuguguauauuuaagcgagaguuugaugaaagcaauucccagucaucagaaacauccuccggaaacagcagccaggaagggccaaguaaugugccagguuagugacgccagcaugggauuucagccauagaguggcaccugggugcaaugccacuuggggcucaaagagagaagauuucaguauuuuaaagacucuuuaaucaagaguauauugaggaaacaaacacaaaaaacauugcuucuuggggguacaccucuagggacugaagacagcugagguuuauaauguuggaguuuccuaaaaagcaacucaaaaccaacacaaugccaaaaauauucucuaccagcaacuuuugugccguauuugauguucuacucagccauagauacuggagaagacuaagagaaagacagugguaguugugauucccagacagcacaaguauuuuuuagagugaggccaucacucuucuuuagccagaaaaaaugacagaugugagggucaucugggccagccuggcuccauggcucuguagguuaugacgggcagaucugagggucgcauggagcauugcuuuugaagcagauuaggcucagcucugcagaagcagguuuuccggccuuguccugucuaacuucauguacucucacuuuucaggugcucuugacuuugaacacauugaagaacaagcggaaggcaucuuuggaggaaggaaagugugcuuucaucguguccuugugugguaguucuagagugugccgggcagcucuucuguaauuugcccaggguuuuucuugagccuacuguugagccuucagggucagguucuguuuggaauuacuaagucacagaacuuagguggugcacugugcaugcauguguuuccugccuaggacagaaaagauuuacgguguguguguguguguuuccugccuagaacaaaaaagauuuaagguauccuaauauauagagagauuugcaagguuauuuuuauaugaugugggucaaaagaguagagaaaagggguucaaaucagauagagguuguuaaugucauugacuuccuccacugauagccaagcuaugcaacaacagcaaaaauaaauaacaaagaaaaccaaaagcagcaaaagauaaaacaaacaaacaaacaaacaauguauccuuuaaucauuccugaugagaaugccuccuaauaccacugaucuuaguuuuaacacaaaacauuauuaguauaaacucacacaucuguaauaaauauccuaagggcauagugauuauaaccagcauacuugguuugacuguuuauugcuucacaacacacaucuccaacagucuuaagaauuugagccccaaguauuucucccagcugucuggggugacuggauccccgccgagugggucuagucacuguugggucugccacacaacugucgugguacaguagcugggacugauacgcacuggauguuuugcuuauauuccuggugcugauaaacgcacauacguuaugcugagguuucagccuugcuccacacggucaguuuguguucccuuacagaacgaaggcugauucccagaacagauguugcaagaagacaagccaacagaaagcaaaggcuuucuagacugcagacuagagcuuuucaaaacuaguuuuauuuuauuaccagaugauuuaauaagugcuaagcuacagcauuuuaaacaaaaagcuuagaaggaguacauuuguuuuagauuuuggagcacagaugaagcccaguggaagaaagcucuaaguuaggucuccaaaucucaacauguuaguccuauuggcuuagggaguuauaacaucguacuuguccccucuucucacagaggagcugaggguaaaacacaauuggcuuauaaaaaaggagcugaugagcagcgaggcuccauuggauggaauagaguuugaauugucguucagcucugccgggcucaugugcaugauccugggacuguagcuuuacuuggucuccuuuucuccuucccuguguuccuguagugaggagaacacaccuuuggaccuggaugaccaugguggcagaaccuuccucaggguccugcuccacuugacaaugcaugacuacccaccccuggugucuggggcccugcagcuccucuuucggcacuucagccagaggcaggagguccuucaggccuucaaacagguacuuccuguggaccagcauggccauuguguaucaaaaagcuguugugugcaaugaaaggauuaugucucucucgugcucgcucucacucucuugcucucacucuguguguguuuguguguguguguuaagguucauguaacuaacauauuauguucauuaagguucaacugcugguuacuagccaagauguggacaacuacaaacagaucaagcaagacuuggaccaacuaagguccauuguggagaagucugagcucuggguguacaaaggccaaggucccgaugagccuauggacggagccuccggugaaaaugagcauaagaaaaccgagguaggcacagcccaaguuaggucuccugcuucuuagagcaagguagcauccuuuucuagucuuagauauaaacguagaugauaggaugguugcucucaagagaugcuugcuaaguagccagggugacugcuauucuccuagaaaguuagcuacaaaaucaaagcuuagauguauuucugggcaacuguggaccauguagaagaggcguaguugagugaaguagcacuggauuucccucgagagacucaguagggaauggccuccugugaccaccacaucuucuuccaaggagugaagaacuggugaacaucuugggcugccugacugucgaaagucaaugcacaauguauguacuuucuuaaagggugauguucacccaacuguagaccacaagaggcaccuacugcauguguucuuuuuggucccuaggaggggacgagcaagccacugaagcacgagagcaccagcagcuacaacuaccgaguggugaaagagguaagacauuccugccguuccucguccugaugacacuagucagcuuuagucagugaucgacgaguugaaggcacaaggaccugagcucuuuucuuuguguaaaauuugacuggggagaggagaagguagcucccugauguugaauacuuggguuccagccucaggucugaguuuaaaacccagcugugcuauguauuaucugaguaguguucucagucccucaccuuuuguagacauuaguuuuuuguuuuguuuuguuuuuuuuaaauaggaacgacauuauuuucagguuuugaaauggaucagaaauugauuuguacaaucacuggggguuuauauccaugcuuggcuuuagaaaucucugcauguaguaguuugggcuuggaagcuuuguggguuuugccccagcaaagcccuccuaaggucuucgaagcuguugccuagccagaucauuuaagugacccaugaacccaucucacuggcuguccuagucaggguuucuauuccugcacaaacaucauggcaaagaagcaaguuggggaggaaaggguuuauucagcuuauguuuccacauugcuguucaucacuuaaagaagucaggacuggaacuccagcaggucaggaagcaggagcugauguagaggccauggagggauguuucuuacuggcuuacuuccccuggcuugcucagcuugcuuucuuauaaaacccaggaccaccaacccagagaugguaccacccauaaggggcccuccucccuugaucacucauugagaaaaugccccaaggcuggaucucauggagucacuuccccaacugaagcuccuuucucugugauuacuccagccugugucaaguugacacacaaaaccagccaguacacuggccauugaaacauagauguguucagcaagacacuuuucuuacauagauuagauuuuguacaaucugcacagauacuauguacuggaggaaugccccuguccuaaguugugaauguauuaugaccugacccuucaggucucuccucacacugcaguuccugguuuuaugugguugauuucuucuuucuuagauuuugauucgacuuagcaagcucugcgugcaggagagcgcgucggugaggaagagccggaagcagcagcaacgacugcugaggaacaugggcgcacacgcuguggugcuggagcugcugcagauccccuacgagaaggugagggcgcgugcauccaggguggaccggagucccacucccaaagccuucacaauugggugaaguaggggagggccaaagaugcgcuugugaccuaaagcaaguccacgucauuuauaugagagagagcaccucuuccuaacaccucuaguguuugcguucuauaaagaaauaaagaucucguucuucugucacauccaagccuucuuagauggggacuucuagaucuacaccagagguuucauuuguguguuuuagcugguguuauucaccuuuguccaaaacacaacuaaaagucauuggaggcaugugggacuauguggaacuugcucuauuuuuugacaguguccuaucaucugaguauauauuuagaccaagaccaagccccgacccccccacccccaacaccaucuuuuuuuuucuuuucuuucuuuuuuucuuuuucuuuuucucuuucuuucuuucuuucuuuuuuuuuuuuuuuugguuguuguuguuugcuuccaagagauuguauuucagaagggcacugucuugauuagauuucuagugcugugauaaauaaauaccaugaucagaggcaucuuggggggaaggaaggguuuauuucaucuuacaacucucaggucacagccccucgcugaagaaaggcaagggaagaucucagugcaggaauggaugcaagaugaugaaggaaugcugcuuacuggcuugcuuccauggcuugcucagcuuggguuuuuaguacaacgcagguccgccugcacaaggacagcacugcccacaaugggcugagcucuccccagcagucacucaucaagaaaaugcccccccccccacccugcgccccagcccauaagccaggcuauggauacaguuccucagcucaguuucccucuuugcacaaagagcugcauuuuguugaaaagccaaucagcacaggcggaagccuauucggcaucuguggagacagacaggcucuuggggacacaugcaaaccuugcaauugcagugaggcuuugugguuuacgcacacggcauugggaagcugaggcccagggaagcuggccaugacucuggagugccuugcgcuccauuaccaucccaaaggcugacccauuggugaagcagcuccuggaggaacccaacugcugagggauuggaggcccacagcacuuugcugcaguccuuaugcugcuuaucuccugaguccugugcacaugcugaugagacagugacgccaucacaucuccuuugagugaggacacuguggccgggaaggcucaggguggcaaagcugugugcauauggccagcuuggcucccccguggagucugggucuccugcuuucccuucuagauagcacauccauagaagcugccuucucagucauggagagguuaugaaucaggugagcugugccuuucccuagccacagggaagcacaagccgauccuucugggaaaucagacuuggagguaaccuggaguuagcucaggugugugugccauccacacuuuuccaguguguaguguggggagaugguuuuugguggccauagcuuggcccuuggccuuaaugauagccauucauagagcaguguuaaaguagggacaaccagauugaucugcaguuggugccucuaaggcagaacucuggcucucuggcucuguguguguguguguguguguguguguaugugcauguuugcucacucacuaugaguggggcgcaaacaucccaguuuacgauaagagauucucaccaggagacaucuuguaacacaaugucucccaagccugccugcugugugaaaugcccuucaaaccccggaagcucuuuccccacuuugcagccaauuccuuuuuuuaguagaagucacgagaacuuuugcccaugaauuagaggugggcauagaacccacaaccacagcugguugcucccaguccuuguaucuccuguccugagagguuuuccugccuucucccagaguuauuuuuuaggacagaguugacaagauauggggcacuuccaacacugccugcuuuugcccagcaugucagcucagaauagcugcugcauuuccagauaguugcauaagaaccugcagggcuuaggguuuagcuucuugauucacuaauccuaaaaaguuuucugccuugcuuuguaaaugugaugaccucuguucaaaccagaauggagaacugacuuguccugagcagcgacugccuaagcaugccgcaaaguuccaggucacacagcuaggucauccauguccaugugagaucagaacaaaguauacaaaggucuccacuccuugcugucagucuccugccuggaggaggaagggauagauacucaaugcuuuaggaaauaaacgcaguagggugugaacgguggcuuccacuuuggagaguuucauucucccauuacugccuuaauuugcgauugagaacugagcagaaugaccguagguuuuauguuucauaacaaugguacuuaacucuuuacuagcgcuaaaauuuuuaauaugaaaucauggucuuaauuguggaagagucacaugaccaacaaugcagaccgcccagggcagacacugucccauuuugcagaaggagaagcuaaaucuuaguuuacagauaggacugggguuacagagaaggcaguagaucggacucagguaucugaauuuagaaucuacagucguuucuccucgucccuggcacaugcugcuggaacuuacggugcuucauaguggcuauagaacuaacaggagcagaugagcugaguauguaccagcaggagugaaaugcacccugcuccacugucaggacccauucucaaaaguaggaauuuggaaauuccagccaaugauauacaguggaauccuucucuuaacuuuaacucugcaaaaucaacuuuuucuuaugcaaaucuugguguuaauggccagugggaaagacaaggcaaggcaugagucuguuucuuucuggcuaauucucaggggcuuuggcaagcaccuuacucuaccaucaggacacugggcacacaccucuggaucccaccuuaguagaggguauuagcauggaguagaagcgucacaauaagcgcuuuuccuguuucuccucucacacaggccgaagacacaaagaugcaagagaucaugcggcuggcucaugaauuuuugcagaauuucugugcaggcaaccagcagaaucaagcuuugcugcauaaacacauaaaccuguuucucaacccaggggugagaugggaagcccuggcagaccugcacuggggggacugugggggaccaguuguccuuugauguuguguauucuugaccuuguuagaaugcagcauucacuccaaaggagaccauucugaccagcugucaggacauaaauacagcauauugugaaucuaggaugacauggguacaaaggagagaauucaggaggguaaaggagguacauuuccuaaaaccauccgucacugggucacaauuaccaauacaauagugauguuccucaguacuugccuaaguauguaauaugcccacaugaagcauuucuauauuacgcgcuugcuaagugcauauuucuugauauauucaguaaauauagcacauuuuguuuaauaugccuucacacgcacacauaucuuacauccugcacuuuuuuuugcauugaacaacacugaugccuuuguaaaucagaaauaaguguuuuuuuuuccuuucucacuaucuuugacgguucaauggccuucuguaaaauggcugcaaguugaaaaaaaaaaaacuuuacuacuaccuuaguagugaacaaguagucacuucccaguuuuugguuucauaaauaacacugcaaacgaugucuuucuccauguaaauacacacacucagcagaacugauuaccaagcuuucuuggccccgcuggcugccaaauaaugacacggagacuuacuauuucuaaaagcuuaggcacuauagcugggcagccucucaguuagcucauacaaauuaauuaacaugaauauccugauccacauccugccgcauggccggcuaucucucacacucuuggcuugucccaccucuuccucugggucaugcuggcaaaugcucccuugcccaauucuaaaccaaaguuucucucucggccagaaaguucuuagcuauuggccaguagcucuuuacuaaguccaguggagaguaaggaagguguagguuuauaaaauacugaggccagugaugaaccauaagaauaucgauaucaaaauccagccaguacucagcuuccugccggugugggaaaagacugagcaucucuggauaaaauguacaaagcaaaguuccuaggccaugaugugaguugucuucuuggcucuggcacaucacgguacuguauacgaaggaaacuaguuauacaggaaaauaucaauuaaucgaaccguauuaaaucaaucucuaugcccaagaugccaucguuaagagcgccaagagcaacuaagacacagagugagagaagacauuugcauuacauauguucagcaaagaguugauacucagcaucuuuauuacauuuuuuuaaagaaaggaggagagagguccaaaacaugaugggcacaggcaguuggugagacgaggucuccacaccaugaugagugaucacacaagcagaacuugacauguaagaguugacuaaaauaggaaagaugguguucaccgggaugcagaauagcuguguuaagcaggagagaugaaucaguggcuugaagcauugcucuugcaaaggacuagaguucauuuccuagcaccuacgugguugcucgcaacuacucuuaacgccagcuccagaggcucugacauccucuccugauuucugcauccaucagguacacacacgggguauaugcacgggguauaugcacguauaugcacguagaacacucauacccauagaucuagaacagccguacugcauuguaaaggauacagaacaccuuuucaaaagccguuugacagugucuuauaaaaaaccaggacuuugcuggcuaaugggaccguguaaagggagagugagaagcaugcucagauguagguaugauucuggguuuuaguaaggcaguuuaucucaucagccugcacuggccucuuugugacccuauccuucuguucacuccuugucuugugccagauccuggaggcagugacgaugcagcacaucuucaugaacaacuuccagcugugcagugagaucaacgagagagugguccagcacuuuguucacugcauagagacccacggucgaaacguccaguauaucaaguuucuccagacgauugucaaggcagaagggaaauucauuaaaaagugccaagacauggucauggcugaggugacaaccacauauuugcuucuaccuccaucugguguucuauagaaacuuaaguuagucuucucugugugaucuggcacccucuugaggagcaauauggaaggaaagguuguauuuguaugugugcguaguuucacaugcguggcuuaggcaagugucugaucugaugcucugucgcaguaaauguguuacucguaaggcaauuuggguuggacuuucccuccagaaaagaggaagaaugauagaccaaugucuaugugagaucaguaggccauagcagcguccccuuuaggaguuaggacguuuuuauuuaacuacucaccuaauuagcuagcuugagcaguuucaacuucauguuucaccaggagcaucuggucugcaggguggaggcccaaguuccacuugggucuuugcagaaguuggcucugugcugugacuguugucuuugauuaggaaggcccacccugcaaacacaaugguggcuuccagggccaguagaguuggcuccgccucggguacagaugcccgcugcaucacuuacaggcuggucugcauuggcucuucugucuugacaucucaagacuugagcauuucuguuacaugaguguuuucacugacuguguagauugaaugagguaaugacaacagcaauaaauagcuaacaucuacuugaagccuaugguagucugcacauuguucugagaaauuuguaauugaguguuuauucucaacccaacaacacuuuugagucagaggucacauuuuguccccauuuuuuacucagaaacagaggcagguaagacagcaaaguauuugucuugggaucuagacccuugauuggaauucaugaaaauuaauuguuaauaagcaaacagaccucugggggauguaccucaguacagcaugcauaaaugaacaagguccuaggcucacucacuaguagcguccuccuucccccaauccugcaguuccugaguugaggauauguuggcauugaguaaauaguauugacugaguuuauuuugacuucugcaccagcccuuuauaaaacuuuuguauuucauguugugcuaaaauugauguacauuaaaauaaauguauuagaggccacauccaaggaaacaaauuaugccuugauuuucuuuugcccuguuguuuucuucugucacauggcaggaccucacagccgagacuggucugaaacucaguguucagucaaggcuggccuugaacucaucauccuccugccucagccucccgggugcuaacauuauaggcacguaccaccacacccagcuaaaaugacuugacauuuugaugagggcagaaagaaaagcaucuuagguagauguggauaacuuaugaccaaagacauacgacacuggauggaagacuuccaucaggaugccuuuuaaaauauaccacgcucugcaaauauuuaagcuagaaaaacggccgccugauaguacacgcuagcagucccuauuuccuuuuaauggccuugugugcagacugguccuccccuagucgaucucuuagggucaccucggauauuucugugucuuuggcuucauaugaugcuuuuaagaaagugugguuggucaguccagaaacaagugggauggaucuagaugaguuuagugauaaggacacaaccuguguggggaaggaagucucucuuccucugcauguggaguuguguaaggcugccucacuccugcaggcuugcagcaacaaugaacacuuuucucuguguagcuugucaacucuggagaggacguccucguguucuacaaugacagagccucuuuccagacucugauccagaugaugcgguccgagcgugaccggauggaugagaacagcccucucauguaccacauccaucugguggagcucuuggccgugugcacagagggcaagaauguguacacggagaucaagugcaacuccuugcucccgcucgaugacaucguucguguggucacucaugaagacugcauccccgaggugaguagccuguggagcugcguggagacaugguggcuggccugggaagcccgcagauuucaggcccuucagcucauggugcagaaagacuucgugucacugcaacaguguuugccuccauauugauacugugugaaaagaacaggagucaggugagucucugcuuccuccccaaaucugggauaaaagccucaggguuggggaacaaauucaucucacagaggaugugcgccgaaggaacugccuagaagagaagcuaucaauggauugagauagcuucaccuguaaguuuaauucuuccaagcaagaacucauaguacagaaagaauguguaaucauuguacagaauuggggaacuguaagaaaugaaaaugaccugaaaucgcacuucccucagagaguaccugcaaagccagguaugguggcauaugucaauuauuucagcacucagaaggcagggguaggaggauugccaugaauuugaagcuagccuaggcuacauaguaaguaccaggccauacacaguaaaacucuauccccaacagacaaagaaguaaaucucuucacccauucuucccauuucucucugcauagcaacuauggcuuccaguaucccacuccaguguuccugugccccauucucagcauggucccuuuuaacucccuuggugccugcaguuacucuaggcuauggacucacaucuaaagagcugacucuuacaaaugagagaaagcauggcguuugucauucugggucuguauugccucacucaauuuaacauuuucugguucgcuccauuuaccugaaaauuucaugauuucauuuuucuuuguuguugacuagaaucccaucguguagauauauuccccauuuuuauuguccauccaucaguuuaaaggcauuuagguuguuucccugucuaguacugaccauagcagacauaucucuauaagucgucuugguaaugucuaauucauucuagaagacuugcuccccucaacaccccuccucccucuggagcgcucagugcuccacagcagugucaacacuugauauuaccaggucucucuugcuucauuugucucagugugcacaucucuagugcuugguuaauuuucuauuuacagagcucacaauucucucauuuacauuggacagaugaguagauggagccacagaguucuguagucaccgccaucaucuauguaccccccaaagcaaccccagaguagccucauuuccuucccguuccccgugacuagauaaucauggauuuuccucugccucuugugcucauucaguauaaacgaaaucacacaugcaugccuuguuuugacugggugauugcaaaauaguuucucacagcucgugccagcuuugcaggcauugguacuucacuauuaccaaguaauacuuccucauguccagauuccacacuacgucacuccagccaucacuggugcaguugugugcuuuuuccacagguuggccauuauaaagggugcugccagggagacuuaacugucauguuuuauguggacgugggucaugccuucccggcuucacucauugcaaacaucucccaggcuggaccauguaauaacgcugccuucuugccaacaggaacaguguagucaaacuugaaucuuuucauccaaccuuaccuugagaucauaaaaacagucucucccuaaagcuuuaugcuuugggguuuugaauuuuauaguugugaauuuggaaaaucaaaaagcuacagacacgagagccagcagggguaguggaauaagacugggcaccgaaccuuggagaggaagcgagagcucaugggcuccuuguggaagcgggguugucacaagagcuucuuucucccuucagguuaagaucgcuuacauuaacuuccugaaucacugcuauguggauacggagguggagaugaaggagauuuacacaagcaaccacauguggaaguuguuugagaauuuccucguggacaucugcagggugaggcgugugugugugugugucugugucugugucugugugugugaguaugauaggacugucugucaucccuguucagaaaugcuguaaaagccaguugugaauuuucuuccaugaacaguucugaguggaagggucuguucauacuugauacuuuuguuacuuuuuucuuuuuaguaauuucuuauuucaucuguaauauaagugauuuuuuuuuguaacucaagguauagaacuauucaauuuguuuaaaaauuuauucuccaaccuuagaaagggcuaaucuuauuccaagcagaacgauuaaauaguggacagguacuauacuauccaaagcaucucucauuccaaaacccguguggucaccuauuauacacugugacuuccuguuugucaccuauuauacacugugacuuccuguuccacacugaaaucuucaugaucaucuguuauacacuguggccuccauaucuuuacuucugucccgugaggaaugucauuuguugauauucuggaguaggcuugcauaccgaguugaguucccagucucugucucuuuucuaggccuguaacaacacaagcgacaggaagcacgcagacuccauucuggagaaguacgucacugaaaucgugaugagcaucgucaccaccuucuucagcucucccuucucagaccagagcaccacucugcaggugagaacggccucccgagggacaguuuucaugugggcaucugcagucuacauccaggcaugugcagggagcuggaaaugagccauucugcaaagccagaauggaagguggcucugucaggggcccuugggggcagaagggaaguugcccauaguaccuguagggauuggcucuuggaccuucucgguccucacauaccaaaauccaggggugcuuaaguccugaacaguaaaugguguuauaguugcauagaagcuacccacaugcucccucagacuuuaaaucgucucuaagcgacuuacagugagccaugccaugcagccgcugugagaguaguuggcccaccauauuauucaggggcaaggaaaacuguguaugaauuccauacagaccugaugauuuuucagauauuuucaguccuugauaaaucugcacauggagaacccaaggauacacgagaguggcgauccauucuugagaaguagagcccauuaacaacagccaggugcaucaucucuuuguacuuuuacaccaagugccaaccaggaaaucacagugauuaaugaggccagacacgcuucucuuguaguagaaggugacauucgagauggugaugccccaggagauagugaaacaguguugaaaaccauaagcuguaugccgugggucggcugauggcccaacagguggaggcacgugcucacaggccugacgaccugaguucaaucccuguaucuacuggguagcaagagacaaucagcuuguaaggauuguccucugaauuccaaaccugugcuguugaacauguguaccuggagacagacagacagacagacagacagacacacacacacacacacacacacagcuuuaaauggggcauacauuauggcuucucaccuugguugcuacuguuuccuucuguggacuaaauuuauccagcauauaagcaagaauugccagagaaguaaaucuucaaaugacaaauauuccaaaucucuccuaagguguaguuuauacccagaaaucaagguguaauucugaagacguagcugauagaucucugaaccuuucauugguaaugaacacgccuguguagccucucgugcuguuccuuuguaaggcgugucuucuccuuagcuacaucucaguucuuucucccucccgccuccuaugucagagcugagaccgaugaauuuggcguuagaugcacugcauuugagcugccagggaaaugcccaaguaucagcuuguaaaugugaauuccagggaggaagaggagaauucuggaagcuuuagagcaagacagauuggauucaaaucucuauucuguccuaucugagcucuguuaacacagagaggucacugaacuuccuguucccuccccuccccucccuuuucaugccuucucuuuuucuccuuucuauuuugaaacagggucucauguagccuaugguggcucagacucacuaugucaccaaggcuggccuugacuuccugauccuccugcuuugaccucccaacggugccaccacaccuggcucagaacuuaucguguaugucuggcaagaauauaauaucaacuuggugugcucuugugagaaugagauacaauauuuauuugaaacauucaguauaguaccuagcacacagcaggagguucaaauguggcagccucuaccggucugcagacuagugucucagacauugcugggccuuugaugcugguauuaacgaccagcaccuaguuaccaauuuuuugaguuaguacuugagcucugagacucagaaggauaaaauggcuaaagauuaaaaauaaagucuuagccggggcagggaagggacuucgcggggccuggagggaacaugaaugguucaagagaggagcugagaggccagaggaaggcgcaguuauggauaggauagggauaggauucauaaccaaguaggacugcaggacuauuucacauuacaguguggugccugcaacuggaggcauggggagaaaggugggcagagggaagacaggaagggaaaaaggagaaagaaaugaaaaggagccacugucccaaugucccuuccacagugccuuaccuaucaaagguuccaccacauuccagcagugcccccuuguggauaacuccugaaauuacauguauccuugagucccuguaucacucuuuacccaaucaaacaaugaauagacuauaggacuagcccuguccuuuuggcuaagaagucaagugagcugaugucaccaugcugccugucacauuuuucaguuaggaggcaacuacugagaacucauucggucaccuuuauaugcccagguaucagacaggaggaagcagauggcucauaaacacugguucgugugaauugacuaaccaaggaacacuucuccgugacuuagacuauaggggucucgucucaagcucagcauuuauaauaaugccccuuccuucuucacagggucauucuaaggcuaaaugagauacucgcgcaguucuuagcacaggggcaggccaggggcaaggacucggggcagguagcucuuucgauugggacccuuuauaaacucagagguuaagcagaagccacagccauaggaacugacucuagguuccuuggccaauuccucuggcucccuguccccuugaccucuaugaguacugaagcuugcugcugggugguugggagcgcagggcaggcuguucuuccggaagauuccagucccagcugaccugaauggggagaagagguugagucagcgcucugcuggccucucuuagcaguuuuggauaauuuuauccuugcccagccuuugucuuauacuagaacacaaagguaacuuccaugucacauaguuauuauccagguccaaaugagaucaugcaugacacaucuggcuuguaucacgcacccaacaaugggaagauacaugaaccgcauuuguaggggggaacugaaaauucuauuccucuguuucauuuucuuaaaacaggcucucuuucuccucuagcacuugccuugguucccucucaccauggaaaucccuuuagauuucucaccgccucuuucuuuacuccuuuccgaugcacuuuagugcagccgaaugaguuaucugccccaaacagaugacuggugcagcucaccauacaccuuugccuggcauguccaaagagaaaaaugucacaugaauagagauaagaaaucccuacuuuaaaaagcauucagaaagucaguaucuaauucacuagcuguaugcaugcucuuacuuuaaaaggagugcaaacuuaguucuucucaugaggccaaagagaggucuucucauagaaagcaauuggcuugugcccgugcucuggguuaaauggauauuuauugucacuacccauuacagcuggguugucuuuguaccaucaaagagacugucauaaauaaggauagaggugacgucccugcugacauccaucuggcauuccauuuuugugaauuaaaaauauagugucuacaggacagccagggcuauagagaaacccugucuugaaaaagccaaaaaaaaaaaaaaaaaauauauagugucuagggccagugaaauggcucaaguauaaaggcacuugcuagcaugccuaguaggccuguguuugaucccuggaacucccaugcuagaaggacagaacugacuccccaugacacacaugaaugcauacaguuaaacaauaaguaaauuaaauaagcaaacaaaguauuggacauacagaugcuagcucaggauggugguuugcaccuguagugcagcuguugggacgcugcagcagcagcagaaucaugaggucagagcuuuucuugggacauggugcuucaaggagaguuuggucuaagugacugugguacaucuaacaugcugggggccacucacaccagggugaaaucgcugaccuggguuaauucaucugguucguaguugcguggcuuuacugcuuuggagcguuugauuucccugcucacucuggugaucagaauucauuagauaauaucaaguuuaaaaugcaucuaaaauaaguaacaugaagucggugauacuauuuuauugcuuuaaaaugcuccugagcuucucucaccaucuaggcacuguguucuucagcuuucuguugauaugaugaaaaaaaaacagacuaauuuaguuacaaacaaaaaaagauuaauuuuuuuuuccccaaagcuuugcggugaggcagcauaucauggcaggagugucugaugggguagacauguucaaccaaucauaaaaagaaagcaacaauagcaaggaggagggcaaugucccacccccuguccuuuggaugcccgaaggaccucuuccuaggucccaccuccuuccuaugguaccagucugaagaccagucccuuuaauacauagcucuuuaggggauagucaacaucuacaccaaagcagacacauucuggaauccaguccuugacccuucuggaauccucccacuaagauguggaggguuccagacagccucuguuucuagccaggccaucuguguucugcagccuucuucaccucgccucucucucuuauagacccgccagccugucuuugugcaacuccugcaaggcguguuccgaguuuaccacugcaacuggcugaugccgagccaaaaagccucgguggagagcugcauccgggugcucucugacguagguaaggcagccaauccgucuggauguggcgggaugaaaaugaguggccugcuguuuaccgagccgagccgcagcucucccaaggaaggaagcugcaaagccagacccagagccgagcucuugacuccuuggccucugucuuugccaagccagcacagugagaaacaguaaauccuugaaaaacaagauuccguagaucaaagccagacggcucuuggcaagugacuauccaucaagacuaucaagacccugggaagucccucauucauagcacgaguuuguuuacuccagcagaugcauuuugcuacguggaaauuuucuuccugugaagcaccccuaagaucccaaagagcacccuuucccgcaaguggugcacuguuugcaucucucuaugaaguggcugcuucucuuuucccucuuugcuucccaacccccaagacucuuaucucaaggccagucuaaaaggcacuuguuuaucccuccccauccuugcguucugcaaugcuaguuauugaaccuuggccuaucccauauuaggcaagcacucuagcccugaacuacaccucagcucuuuccaaaggaaaaaaguuuaagugguacuaucacuguacauguuuugggguacagcauugucaggggaauuggcuuccuguugccauagaaaccagauuucuuucuucuacuagguuugaacuaguugguaaaucucuauauauuguuacuauccugcaacugcccguuauccagccuuugucuagccuucccuugccugagcacuuuuccucuuuuacgucuacaucuccuuaaaucagucuucugaccucuuccucucuauaccuuccaugaguucucuucacaggaauaagcuuucccacucagaugagaagucuugugacugaacuagagccccagauccuggcaagcaacaagcacacuucucagaaacgauguccuugggaaaggauaggauuuaugggaaagagagcuuucauagugaccagaagaugaacaucuccuccauguuauaacuuagggcaagcagaggcuguauuugugaggacuccuugccuugguuuuuuuaggcccugccuuauuccuguucuguuacagucucagcugacagguauuacaugagugugccugcguguggguguugauguguguguguguguguguguguugggagcgauuaggcugagagaaugccuggauggcccuaugcuuucuucagacucgacagcaauucauaaagaugaaauacgcuguucaggccaaaaugucuguguaaguccuuaacccacaaguuaauugguuuugauuuaaggaagcuguuggcuucaugggcagcuugacacuuggucagagaagcuacaaggcucaguagucucagcaggagugacauggagacagcgggaagccagcucagcgguagagagcucaccuagucuacacgaggccccgcaucagucccgggaaauucgaggaaacaaaaauagaggagagagccgaugcuugugugauaucuggagaagaggcagccuagucccuucccagacccaaucgugccucuugggaauggccuccugagucaaaguguaccuaaaauccuguguaucccuuucgguuuuagauaggucagucagggcacagacuuucuaacagauaagcgugaaccauguccccugcuuuuuuauauuguacauuucucccagggucucccacuuaauaaacuguuaggauauuauuggcuagcuacugauucuuuucgugugccuuauauguucccauuaagagaaaaaugguugcucucuagcccauccuucaaagcguuccagcucuuuucaacguuagauacaggcaguggggaacacucccucuguuuccaguguuuugaagcauccgugaagauaggaaaugguuccauugguuuggggaggguucccuacacagaaaccagaaguguucaccuuagguuccuuaacuuauacuuaguaauacuuucagacucgugggaaaguuacaaaacagauacaguagggcuccucuguaagucucaccuucuuccuccacucucagcaucgccguuauuagugcacauugucaaaagcugaagaaugacagugguacguuaccaccaacuaaacuccaggccugacucagacuucauaaugucuccaugaauguccuucuuccgcacugggcacaccuccacuccugucacacacuucauugucaugugcccagucuggucuggggcgguuuuucuguuuuuccuuguuacucaugaccucaccagccuuugcaaacaaguacuggccaaguguccucagguggcccugugcugguuuucagcgcuguuuccucaugggggagcguggcguuguccuuuguuagggagggaaagaggaggagccuccagugcagaugcuguuuugugucuuggucaguggaaguuugcuuucuguaggcuguucuguagaacaacaaaauugguuauuuugaggaaaacaguuucuuggccaaccaacuuauuuguccagauauuucuuaaaauguacaagcacccgggcauucguaagaagccagccauucauuuaaacugguguugagcuguuaacaugucuuccccaaguguuaaugcuuggaaccauuucagugucuguagguacaaguccccagaguuuacauuugugguuaaaaguugaguuuccucucucucuucaccagaccauacauacuugcccauuauaggcguagaaaaaucugucuagugggccaugaggauucuagccugcuucccagacuguuguagacucaugagucauccgucucuuuugcagccaagagccgggccauagccauuccuguugaccuggacagccaagucaacaaccucuuccugaagucccacaacauugugcagaaaacagcccugaacuggcgguuaucagcccgaaacgccgcucgcagagacucuguacuggcagcauccagagacuaccgaaauaucauugagagguuacagguaaagucugaggcuggaagaaguggacuuaaacuugagaaguguauuuucugaagccacaaaacauacaagcuccgcuacacagaagagguuuguggggccaggaguaccaggucuuuugguaaacaaaaacucccagaagggguuccacggcagacaguugaugcugagcauuagccauaauuauugucugaagucuauauagagugucccuggguggcauaggccuccucacacugugacagcugagucuauaaacauuucuagggaccacuuggaaacaccuuugucuuuaucacccuagcucuaaagaugucacuagacauccauucugcugcccucuguuggucuaugcagucucagagggacacuccauuucuuaggagggaaauucaaaccaccauucagugggaaggaugucgagcuacaacaaugugugaacuagagaaauggcugccauuggaaagcacaagcccuucaacagugccuggcauaccguauagugagcacucaagggcuucucuuacaaugccuaagguuacuguugugguuauaaaaguugcuaucauuaggaaaaguaacugagucacccuguggcuccauaauuuauguaauuuaugacaaauaaauguacugauugauuucucagcccugggcccuggugauacguagugagaaaagccccuuccucccccuuucauaaagccucgagcuuuggaagaggcauggccacggaucagcuaauuacacguguaaaccucaagugccuucaggaaagcuaaucuggacagggguuaggguagggacaagggaugccuaucuaagaacuagagugggaagcauccugcugaaggcuaccguugugaacagaugcaguccuuguggcuaggcagccagcagagcuacagggucaaggaaaggcccggagucuuuccuaugguagaagguguuucuaagcaaauguaacuguguagcuaaaggagggcuucccaaccuucugugcuucgggagaggugaggaauaacagacucgaugcuccaugaacaaacaguauuuucuugacuacacaggccacgucaguuaucugcaaacauagcagcaucuugccucagacauaauagguauccugagaaauggaacagaaugcauaggcaggucauacucgcugcaaagacuugucagggcuuuaaaagacccugauguugcaguaauguauuacccgagucccugucaucauucgauguccuugugcagcaaaaguuguaacaaggacaguuuccuggcagcucgucaccucuguaguaauccucaccugcucucucucucucucucucucucucucucucucaacauucaucuuccccaacucauugcuuugugugcucacucucucccucucucucccucucuccuucuggcucacucacuuucucucuuucucucgcucucacucucacaguugcuguugcuuucacagucacucucugaaugcugaaugucauacauuugaaaauacaguacaaacacguuucaacauaaaaaugaagacuucucaaaagaugcacagcuucaugcaguacguuaaugaauguuaaggaauugcuuccacccucacccccauaagugcuuucaguuguguuagagucaggaucaagaaggaguaaagagaaagggggcggaggagaggaagaagagugggccucaaaggcaugcuauuaggaaagcuggugggaccuuccucuucacucccaugaaagccguaccaaguaggaaaucugcauuaugcuucuuaggaucuuguugggaacucuuucccucaccaggagcaaucaccuaauucugcaucucuguguccuaaacauuauugcccuguuaccauuauacagagucccuuaaacacaagccaagucuaucuuuaacugguuuaaauugaguuucuauauacaagaucuuucagucccuuuucuuaacaccccccaagagggggggaaaaagagaaaaacauuaaaauggggcauucuucccauacaaaucgcacugugcuguguucuucuccagccuuagcauguugcuaguugaacgcugagucagcaagccuggggccaggcugcggcaucuuuugaagauggguccucgucuguuuccuaucauuugccuuuaaaugguguuuguuguguuggauugguggcucuuucaacuucucucuguuuuccuuuccuacagcuguguguuuugcauuugaagaccaucaugcuaucaggguacaugucuuuagcauguugauacagcauguucauucauuuguguucucauguuuauaugauuauucuguaaacugugcucauugcuaaggaucggacagcacuagcaacuauguagcagaauauuagacuccccuguaaccucgccacccagagaaaaccaguggugauguguuagugggauuugguaugcacuuuuaguuauggauauuguccuugaaaccgugucguaaaguccauacuauugcuugacugcucuaagcucauacugcagacaucuuuugacaccauuaaacuuguuuuugugugugcugugcuuaugacuacguagaauggcgacugauagcauaaacugucucagaugaagaggugcagaacagguugauguauuuguccuuuguuuucuggauugggaggcgaugcuuccgguaaccacuggacaguaucuaauaacuggaaauaaugggagacaaugcuaaagccgcacuaacacagccuagccuguaccacaggcucaggcagagauagguagaggcucauccuauuccagccagcuuccucccgagcugcugaccaaggcacacucucauuccaggacaucgugucugcccuagaggaccggcucaggccccuggugcaggcugagcugucugugcucguggauguucuacacagaccagaacugcucuuccccgagaacacggaugccaggaggaaaugugagaguggagguuucaucugcaaguaagcagccucccuucugacguggucaguagccaggaaccccugaugaccaggccgagccccuguuucugaaggaggagccgcuggccgguuucuaacuucaugggcuuaaguuagauacuagaguccuguuucugaccaucccaaaacaaacuugucuguuagauccuaguuacugacacuucccgcuccguuugaaccgcaugcccuuuuggguuuuuucucuacuuagcaaguugggagcaaacgccuaccaugugugguacaaacaaacaggaaacugucaugacccuccaggcccucuaacgucuuggaccugcaaugaucucacuaucuuugccuaacaugcuuuuagauucuuaguuuaugccaugugggccauaaacuauaaagaagucaccagucuuuugacauaauaaauaaauaaauaaauaaauaaauaaauaaauauucccauuugacuuuucacugagcugaguuguuuuucuguguggaaggugggcuuugcccuagaagcuccucugacgaggagacuauggauaccgaaagugucuuuccccagccaucauccucgugagugggguccuuaaaaauguccugcuggcauagcuuagcagcaauacccaguggauaacuaaccacacguaugagcagggcucugucugcuuucuccacucgguauaaccucccguuguuauguguccagcuccugccgugccagccugguaaucugcucccagccagcaggugucgugugugagacauggcugcugacuggcucuuaaguguguggaugcguugaaguguauuuaaaguaggaacccuucuuaaauguucauucuuuaacugacuaguuagaucagaauacuuguggcaugucuuuagcuggaggaugguuuuaagaugucacccccguuuucucuuauucaggcuaauaaaacauaccaagcaacugcuggaggagaaugaagagaaacuaugcauuaaagucuuacagacccucagggaaaugaugaccaaagacagaggcuauggagagaagguauugcauuuuauauucccguucaaauuaugcuguguauuaaaguuaagguuugagaguguguggaagccccuuaguuacuggcuggcaguuuaauuuuuuuuuuaaagcuguuucucuuguccuggaugaucacugaaucauaugagugccuuccugcaagucaaauauaaauauuauuaguugucucucauggacaccucaccacauaaccuaaugccaaggaaguaguucuaaguucuugccuagugaacuucccagugaggcauagcgucuuguguaucaguccggaucuguggacuuguguuccaccucagcacaccugugggcuggcuuaccgcucuccgauggggauuucacaauccuuccagcuccucacgaaacucccucgaguucuaacuagaaggaaggcuugguuucuuugcaugucaccacuucugauggagauugagaaauggacaauuccugugaccugguacuucuugguagaugagaaagcaggcauuuggcaugugucccaugugaggcacaguagggcaagaacaaucuuggugcucauucucuuacccagcaaggaaucuuaagcauaagucucaaugccaccaaccgucacuggguagguaauaacacacucacuaauugcuagccacuuuuaccaaugguuccuggucucgcuguccuuucagaauacccaguaacucauuggucagcccugggaagaaggcuugguaauuaaaccaccucucucccugucagaauagagggugauaaccaaauuauuauacguaugacagacugcugaacucucacccuucagccuaugcaaggucuuucacuagaagcuuaccugacaaaugaugcuccccaaauaagaacaagaaaacauggcagagugauggcccacgccuuuaaucucagcccucaguagacacaggcaggcagaucucuugacucagaggccagcacagccagugauacacagagaaaacauaucucaaaggaaaaaagaaaaaguaagggagagagagagagagagagagagagagagagagagagaaacagaaaagugaagucgucacugugccguagcccucugcugguuucccuuuugguaagaugcuuucccggcaugugcaaagcaggguuugacacccuacacugcaugauacuagauguaccucuuggugcaugccuguaaucauggcacuagggaaauggaggcagggugacccaaaguucaaggucauccuuggcugcauagaguuccaggccaagccuggaauacaggaaauccugucucacaccaacccaacagacgaaacuauauauaauuucauucugaauguuuauaguguguaaacuuaaaggggaaugcuuguucacuaaaucaggauuucguggacgaaaccugauaggcagaagcauauaaauauaaguaguagaugcaaagcgccuuaguccaggugagaaacgaugagaugacuugcccauauacacacaugggcaccuggguagguuuuaauugauaggagaagggaugggaagagagacaccaagggcaucuuugggguggagugggcagagaaagacugauggguaucagguagaagaugcuacaaaagaguaaaugcccagagguuaaaagaguuucuugggccucaguucacuuuccuuuguagccggugaagaaacuagacaugcccaagcccagaggcugacgucucuuuccagacugcuuggaaucauccccacuucaggaaauugggaacauuguaaacuagagugggaagaccacaaaaccaaggaagaugcucuaggaaccugcaauucauccuggaacuucuggcccuagugcuuuggcuauuugaaaaugcuacuuacccauuuauauuaauggaauuuugaaaugggcaggaggcaugaaaguguuuuugcuucccucugucugguuaauuacuuugucucacuaagguucuuugaugauauuucaacagguuaccuagcuguucuugguguagugaagaagcacgacagacacauaggcaggccaauauuuucaaggguagaaaaacucacagccagagcacuaaccuucucuuuucaaggaaaccaguuggcuuggguuuuuaucaaugagguugucccugccccugugcugaggacucuccuaggcuuucaucacacuuuuccuccugguugccccuuaugagggauguggucauggcuacuaccuuccuaaggguauuugcuacaguccuccuucccugcccuuucuugaguccucauagccacagaaucagaucuagacaaggcuucaggcuuugccucauuaaccccccccaccccaccccccuuggguagaagcaccugggcugggaugagcuaucugcccagggucacauggagaauccauguggucaaagcuagaagcccaguuucacuuuccugccucucuucugcugcaucuuuugguucaggccauuucuguauccuuugcccuaagcugcagucuccauagacaaagaggcuuuguguaccuuugcuccucucucccuuuccguucaacuucaggacuucaucaaggucacagaugagaaagaaguuugaaacaauuccuuauuauucuacucuaaaaguguugguguguucauguaggucuacuuuccuaaaggggagaaaagaccauugagaagaaugccuuggauuaccaaauagauucagauauaccagcaucucucuaaaguugccuuacacuuuuuaaucaccagauacagcauuugcuaaccucuuggguaacagucuccuaucuuaucuugggucagcccuggagauaaauaucaucaguguuauuuuuagacucgacguugaauacauagaaaaguucagaaucuugucuaggaucguacagcuaagaacaaggccccaugaaccuaaaucuacagucugacuccaguuaccuagaguuucgccaacauauccuaagcaugcagauuaacuacacauaagggcuuugaaguuuaccuauggucuuaacguuguuuucauuaugguauaugauuacuacauaaaacacaggagcauccuaugucucggaauaucuaggguucagcucagcucugauuugccauccaauuuaaagaagcuuucauuagguaggagguaaguuuauaaauucugguugccccaggaccaucagagacauaugguuuugaauagcuaucagaauagugacuagugaguguuuagcucacuauccacaaaauaugcuagucuaggaagugccaaaggcagggaguagaugaaucacaauugucgccacagugauguuacuauagugaaauaccugaagggccuauguuauaaaauugagguagcuuuaugguagaguguuggccuaucagacacaaucccuacuaccuaccuaccuuaauuaauuaauucaaaugaacaaaggaguuauacuuauaacuuacaguuugggagcccagaacucuuaagauugggcagccccauucauuuguucucugguuauggucuacuguugaguaguugaagugagaaaucacauucugaaacagaaagccaaagggggauugaggagucugccuugcuguuacagauaacuuuccagagaacuaaugcagggcgcagcuuguaacuaaugcccaucacccucugaaaacccaagaaucugaggaagaaaagcuaccuagagucugccaacaugggcuacagaaacccaaaccaaaagaaauaaaagaaaccaacccaaauaucagauuuuuaguuccauacaaggacagugcccugugugugaccuugggcccucccccuaggucuuaccaaggcaugucaccagugagguucaacgucccagugugugaacugucagaauacacucaaacccucuccagaccaugacaagcacucagggaauuuaggaaaacaaacaaacaaacaaaaaacgaauuucaccuguuuuaucccugaauucuaagaaccaaguacuaaacauaaaaauagagaagguaugaaaaauaauugcuaacaugaucuuggaauagguuuugguaugaagcuccucauauccuuguaucugcuucuucaaagaggucaaacuucagaaugauaccaggacucuaaacacacugccuaugaaaugcccacuacaguuugcuuucaauccauauuaaaagucacccauagcuaagaaaacaguuaacaucccucuagcuaagaauuguaaagauuguucugcaucucuaacucauagggaaaucuucugccccuugauccucuuugaaaauaacaagcggcacaguuaucuuaaugcguucuggccucucucgggucgguuuuuauuaggcugaccuagguuuauguucuuggucagagagcuuuggaggagaaucagaggccgggaacuaauggaaaaggauaugucggcaucuaacauuccacuccccauucucaauaagcccugcguuaguuccagagagagccaaccucgggcaacgccagagguuuuauuuauuaaaauugucaauuaucugcuaaucauggaagcuccuggauggguagagguuuggccuuucuggcaacuagcauuucugacaagacucuucacuucucagaggaaauguaacugaacuacacaucagcuagcuauucuuaacccagugugccugagauagcucucuugugaggguugguuuuguuugguuuuaaauucucauugaguugaugcuagugcacccauguuaguaauccaacuggggcaaaugucaacucuuguucaucaaugaucccagguuuugagauauguuagucucugccuccugaagguaaucccagaucugacugagcccagcugugguuugggcuccugacccuccauaaaugaguugaguacucuagucuccugucccuuccuaucuaauucugaaaagcauacccuagggacucagcucccgaucccacuccauucaaguuuucucguuuuauaagcagguaccaggcugucuugaugcuuggaugauggacuggugagcuuuguugcucagugugugacacauacuguggcacaugaagcauggcacauaugguauauucuauuccagagcagaugucauuccaagcuguggcaguguccucaguacguaaacuccuuccaauggccacugccuaucagcaaugacuaucagugacuaucacugacuaucagugucaugguugaacagagccauacaguugcaacuuucuaacauuuacacucuuguguuucccuuccuaacaaaucuuuuuuuuucuccccuccuuucuucuuuuccagcaaauuuccauugaugaaucggaaaaugccgagguccuaacuuuguugguuucuuuguuuuuaaugucccacgguggugucuccaugacccccuucuaguuaaccuuguaccguguucucuggucuaugcgucuagcgucugacucuguguagugugccuucuggggugagcagggccgguccugucuguauuagcaguucucuccagaguguuuaucauuuguccuugaauauuccaucauucuccagagaguuuguaagcuguaaugagguuucagucguucccucaucucaacugagucucugguuaacucuggucacuaacuuaugccugaagcggcugacguuaacauaaaggaauuuugcuugguguugaguaucugacccaaagagaaagaauagauugacauuguugagaaguuguuaaaacguagcaacaacccaucaagcccacuacucucuuguccguucucuguguugucgauccuuccguguuuggggucacagguauuuucacaaggcaaugucaaucgcaaagugcuagaugagaccuuccaccccugauauuaggaaaccccgacagccauggguugguucccuucuggaagaacugccuguagaugcaaaaaugaagauaucacccugugguuccuauacugaccugucacauuguaguuacaguaacguccuggaaacugacugauccaugaguagaucucacacuggagauuuguuuucugccucuuguuuguucugugcauuuuacuacagcccucaugauuuuaggcugugguagauacuugguaaggaguaccagcaaaaaaauugauuuuuuuuugggggggggaagaggauauucacacauguacacauuaaugguuuuauuggcugaugaguagagugcacugggauaggauuuuaucugauuuuuuuuuuuuuuuuggaaugaaacucccaggaugggcaugcuauccaguaucuuuucacuuuaguuuaauacacucauaguugaaaaaccuuaauaaauggcuuaauuauaccuaagaaaaguucagcugcaccacagauuugcaaccugaagcaacacacacgguuaugaauguggacuagcugucucaggaacggcauucagagagguaaauggccgcucuuugcccacacaacuauagaguuaggucuuacauguggcuaguuuaguuucauacaggucuauaaggugaauucuauauaaaaacauuugcccuuauuuuaaucagacacagcaggucuauacuuuaauuagauguguuuccuaggaugguagaagggugaagaaggggaggaccccugcagcuucauuaauuacuuuuagcacagucauuuucccuuauuucauauguagcuuucccauuuuugaauuauuucuaugcuagaauguccuggacugaacuuaguaugcugacacccuucaauacucuuguuucuuccuugaguuauaaaugccucccuauaaacuucucccccugggcuauugagguugaauuucuauuugcuuaaguacagauuaagucagggaaaggaaccccccccccuccacuguggucuguguagcauuauuaauacacuguuugcaccauaguaaaucaguugauguguuugcuugcucaggauacuacuugguucuccuggcugggaguuuauugcuugcuuauggaaagauuccacaguuggagcagguguguuuauaauuauacucuaggaaauagaauacugucuguuuauaaaagaagaauguucuggcaggcgcuuagauucuuugaaaauucccugaggaagcaacuguggcuccccucugcguaguuaccccuggcaaccgucagaacccagggacaccaacacccugucccuggucccucaggcuauuggcucuggcccucuucucagaggugacugauuggccuuuauuaucagcccauucuggaaacuaucacagcucccugugguacaauccccccccgccccccccccgcaaccuucuaccaguguguucuuggggaagcuguaguccacagcugugcuucuacagaaguuuaaugagagcuccugacagcaaaggaucuggguagggacgagccucacaccuaacacugaaggcuucugucccgagugaucauggugguggcaguggggcaaauaguaagcaugcauggucccuccaauuucucauugcggaagagccacugccuuuugaugacgauaaggacaguugaguaucucggggaauagauggcugcaaacaacuugggagagagggaaagaccuccugcaugaacaucaggacuuugggcaagacgcuaaaguaaggguagaggcacaaacuucucauaaagagcaugcauguacaggcucuucccagcugcccucuagaauaaaauuuuaauugacaccaggaacaggagggugucgguguuuguguuugcuucuuggcaagagaggcagucucuaucuuuaccccgacuugaucuuguucacuggagauaggagaaacaaacuagggguggaugcgggggugagggugggguggggauagaaaaacuaccugcacugugugugugaagcuucauggauugcuacauuugugugcuugggacuauacauccccccaaaaucuuggacugaugacaaaggccagucaguuaucagaagggccagggccacagaguauugguauccuaugguucugacaguugccagggguaacuauacagagggagccgcagauaaagaucaagauacagaaagcucccucacuggccauaaauggacaucagcugauguuaaagauccugauuucuaucacuggaagcaucuguuagguuccagguacuauguuaaggguuugauacaaugugccuccaaaaacauaguaucugccgugcuggagacucugcuagagaccauacaaauuaauggaaaaguuaccccagccugucaugcagcaugauagaaauacauggaauuguggggaaauguuaucuggggcuuucucgauaugucagaagggcaaguagucacuucagaggucaggcaagaaugcaguggggaaccucaaggcaggaccuacuuuucuaaacuaggaagugccaugccuuuuaagaacauacuugggguuuaggcagcaguaguggaugauggggugggccaucuagguuuccucauuuuuguccuugauacuaaguuguguguuuuaaaagugugugcuguaguucaacagacaugcccauuccucuucacuuaauaugacauccucacugaauuacugucacccuggugacagcaggcaacugcaacuuugcuuuccuguauugaaaaaaaaaaacaaaacaacacaacagauauccuugucacccagaguagcuguagccugauuuuauuuauugugaccuaaacuucucuccccuacaagcuagugaugccacagacaaaaaugucuguaauauucaggaugugaagggugggaguggggguaggggugcagacagccgcuuaggaauugcuaguuuucaccuucagggggcgcgcucaugacguccgacccgguggaggcguccuacuuucuuacauugcugcaaacugcugaguugggaaccugccaacccucaggcagccguuacauaagcccuuucuuuuuuuccuggaauuuaagcucacugcugaugugcgaccuucagcaguaauugccaauaagugcagcaggacuguuuacuguuagacacuggcaaccacagagcaagcucugcugucagcacacagaagccacugcggagucugcugagggccuuuucaaaucuuuggacucucuuuguuauuguuucugagauuauuccagaaugacugaaguuguguaguugcgucaugccaguuugcauuuuuuaacuaacggaccacacuacugaguucugaugaauccucucuguaagauaugcaucaaaguucauggguggagccauuuaauuuuuaacuuauccuuauuucuaaaagcaaaugcaguuaaaaugagaauuguauuuguagaugugaauauuuaaaauuguccauuuaaauucagaaaaaaaaaaaaccuuccaucuuugguuuggguuuuuuuuuuuaaagauuucuuuucucucaaugaagagguuucaaagucugauaaaagauggacccugacuugcuagcccauucacucuuguuuuguuuccuuuucccaggguuauaaguagauugagaagcaacggagugcugauuuagggaaccagaaaugauaaauuauuuuugauguacugauauaugagccuaucauacaugucuugacuuguguccaacuacugccaagaugguccauaaguggacauuauauugaagagaaaaugguggaugcucagaggccagagagggauuccgguuaagggcagaagaaagcaaagccuauucacagccauacugugugcugguccuauaauagacucauauaaaagggcuggauagagagagagagacggggucgggaggguugcugacucgaaagcaccaggaguaaccuaggacauauauagguaucuuuucuuuaagaaguucaaagagugauaacagaugugcaucccuccauaagaaauagggugccuuguuuauaugaagcaagcccacaggcaucuucuaugcacauaucacguuacuugguugacaucacaguuauaauaccuugauuauuggccucauccaacaaggacauugagggcucagaaacuugaguuacuguuuaaguuauucuuaaauguuuguuacucauuuggaucuuuguuucuacgaaauuauguuuugcugaacaucuuugagaguucuggggaaacuuuuaaucaaaggggcaauaugaugaagcagucuggggcaguacucaguuuucagauucauaacuagacguguucaucauccaccgaccagcugugauuagagaugucagcagcauguaugaugagggagaaauaagaccuagaauauauagaucuuaaaauguuauuacuuaaaauguucacuggaacaucaccauucaaguaaaguaaauaauaauaauaauaauaacaacaaacaacuacuacuucugaggaacuaaauuuauuuaucaaagccuacucuucacuuauauuggcaucauaucuucuauuuacauagcuauucuugggacaugcauacuuugcuuuuaugcuuaucagaauugcagcuuacuuccuuaaaagcagcuuauccccuaagaaaccgugacuuccuucacuggggaaggaagugcugauggagaugaagaagguguaggauguugcuugguguucuaauuauauccucauuuggccaggucucugccauguccaaaaucaaguagaacuuggccguuagaugcuuaaaaguaaaguuuacugucaguagaccuuucguuauuugauaugucagcuggacggaaucacgauaaugcuccaguuucugcggacacgugaggagguggaagcccaaagcgguacucuggugaccaaaaaggcuucccagagggccucgucacauggcgccagccagugcucucacuuguccaugguaauccaccaguaaaaacaugcuaaaacuuguccuucuaaauacuaauucaugaggccucaaagcagccucuaggguccaaaaaaggcuucauaggacuuucagggaaaaacuaaaaaaaaaaaaaaagcuaauuggcuuauauuucauuuuaacaaucagacuuuaaaccaagcacaguagucaucuagggaggaaauacagggugaaguucggugggagaaacauggaaaacaugggaucucacauuaagaaauaaagacugcacaucugauggcgucugcagaaucgaacgugcuucucugggcaaagagagcugaggcagaguggagaauuaaacaaaugaacagagcacgacacaccaguuccggcucugucuucuuccuuucccuuagcuuugguguuggcaagggacugacgauagcugcuuggguuccugcaggaaaucccugccuguaauccuucuguuguuauccuauagaaugcaccugacggacaugcccguggagccuggccaacacacaugguagaaggcaugacguucaucucugucucuggccgcucuagcacaugugagcacgugugggcaggugcucucacucagcucugaugggcccauuuuguaccgaggacagaaagcaacacuguucacaugaugggggguagggggguguuuucuucucuuuuguuuuuguuuuuagccuaaagcaggaggcagacagacaguaagaggaucauguuguuauguugaccguuuugacaguccacacaccucagcucugauuuuuuuuuuccuugcugugcuuugcacugacuuugucuccccggaugagguggcauuggauuccacgugacaggugcucuaucugggcccgacuaagcagcccccugaaaguuccuaucuacucuccguaaaacaguuugcucccauugcucuugcauuuuaccugcugggauguaaaagaaagacaauuuuuuaaauugcacgacaacagcuuuauuacgggaauuuuggccgcuguggugaucugauuacuaacgugguugccuugcgaggcccuggagcucagcacccaccccaggucucacagggucagucuucagggcuggcuugucacugcacagccaccuucuggcuuaaggagaggugcacagugcacagugucagagagcaagcaggggccaaggucguaugguuacagcaugagcccuggcuucauuccuuggcuccagccuguaccuugcaccacucagccaugcugccggagcgugacuuggguccagggcaucccacauaggaucugauagguaugucugacauugguucccugguucacgcacguguccuuuggccaggcucguggcacuaucuucauauggagcaggagacuuuucuagccacacccuuuuugaacuauccauuuauauacacacagagagagauagagacagaguuagaguuaguucauguguaucuuuugcgucuaucuuccuccauagggaagagauuuugaaauaguuugggguguuuacaugguauggcaggaauggccccaggaaauguaccugugacaccccuaggggaaccauaagguuaaagcuaucaugcucaaaaugcagaaaauccucuugucucagagguuguaaaagaggauaugacauucaggaagccucaagcaaagccauccacugcaggaugggacauggaguggcagggacaggagagaacguaaauccguaggcaguuuuggucccaggggaguggcagugaggagccuugccaagccugagcagugaugcucucugucccuuuggaccaucgcugugccucucgaaaguucuguuccugucacaguacaacgacccuucucauugcccagcaagacccccauaaccagcagcucuccuuggugcugaguuagcccuucaguuuccguaccgcuguaacgcacuaccuggcuaaagcagcuuaagguggacaagggucaucugggcgcacaguugacacccaccguugcucagaagauacugguucuagcuacgguagaugcucuccaggucucauuguaccacgaaucagaagcagcagcgaugagugcugguguuuagcugauucuuccucucccuauuuacucaguaugagaugguuccacucagaacuagggcaggucuucucagguaaaccugaaagugccuucccagacacccagaaguauaucuccugggcgaucugcagucuagucauuuugaugguaaaaaauuauaaucaucacagugauauuauucuguuuucuaacuuuaaaccuguaucuuugaucagucaucuuucccaccacauuccauuuacuuuaaacaucaagugauugguccugucaacagcccagucccauguaacgggugauucagugaaaucgccugucugugaccuuccucucuguguuuuuguccuucaguguuggucugcagacuucucuguggucuauaaaaugcaaaugccaugacuaacaugcuucguuuuacucccaacuagcugccacaggcaccggaagcugagaacuccacagagguguguugcccaccugcauuugcaaauauagcaaaucugggugcuucugaguugucccaguccagugugcgcauugucuugacgagccguccguucgggcguugggcaggggagggaagacuguagcaggcuggggacugaucugcugcugcuuuggggguagaaaguccucugacaguggagccagacuagguaaacuccagugagaggaugcaccauuggagggcuucacucuuaacccuuuucagucuggaccugagaaaaucuggaguguuaagaucauuucugcuguuguacggaacugacuucagauccugugcaaagaucacacacuuuugaaaaucuagacaagaaucucuaguuuucauagaaaccaccaagaaaguugcacaaggcaguguuuucugcuccauccuucacagucaccggcuacgcuggcuaaaugaaggaccagaaucgauucaagugaguaagaucagagaaacuguuagggcaggcguguuuccaggugugaaagcuugcugucagaaacugugguagauugcaggaguucaggcugaaaugaaagguacuuuguuggagagaaguugaucggaagugagaaaaaucaaacacaaacgauagagccccuggggugcaacggggauguuuucccggggucagccugucauauucuaaucagagcucaccacuagcaguuuugauuagaauccccaucuacugguggcuuagggagagcuguggucuccuguacgugucugauccaugcuguauguuucaauguccuuacgcaugugcuguucaguacugcauguaugaaaucauaaggagcugcccgguugagucuugcuuuacagccccuuuuggguuaauauaacagcauauccuauagaauuaccauucguuaucuuugaaaaaacaauuggcccaaaagcucacuugaaacaguguugugggagguaggaucgggaugacgguuaaguagaaucuaaaguauucauaccuugggagagaaaccacaaaacaagagaauucuuuuauguaaccuugacuguauaugagcucacaauguauuuuguuugugacugaugcugaagaugguaguguuuccuuagugccauacuuaaaauggaauuucugcaugcuuagcaggagcuugaaccaaguccaccccugaggcaacuggaagaccauaaaaggguauguagccuugagucucucggguugggagcugaugacuggaucuccccccccucagccacacaacuacgauuuaaagacagcuucugucgguguugcuauuguccaaacaugaaucggcuuaggaccgaucguccgcuguauagaggugaagcuaacuagcaguucuguuaucuaccugaacagaacucugcacaaccaagcugcaaacaauaaccaagugagcaccccacacccuccuucccugagaugguuuucuaaacaggugaugggagagcuuugugcuucuguagugacuagugauccuuccagcucgcucacaguaaacacaaaggcauagugucaacagagcggaauuacaccacccagcuaacugugagugcgcuaacuuccuccuuuucccuucagccaguuuuuuuuaccugugcaagugugugucccaacaaacacaugcaaauucucaucauuggauuguucguaggugcacagccuucauaguuggcuauuguuauuuaauguuacaucucagccuuuggugggcaaggaaagcuaagucuuugaacacuagcaggcacauaaagcucccccaaauuagggaaggguuugucauuuuuccuucuuugaaaaggaacaaaauaaauguauguuugcauagauucuuagaagaggaauaugccuaggacaagggauugauacuuucuuacaaugcuggcuauguauugucaaagaauuuucuagaauauauauacauacauauacacacauaugcaugaacuugcugaccagcauugguuuuccacauuauccauuucuagagaagcugggcaucucgguuuuaugagaacuuauucaguauuguguaagacauauauauauauauauauauauauauagagaacuuauucaguauuguguaagacauauauauauauauauauauauauauauauauauauauauauauauauauauauauuccucugugucauuuuugaacaaaguauaugcuaucccaauggcaaggcuuuuacucccaugccacaaguuaggaaaguugaaccucagaaguuuagcauauuacuuuguaaaggcugcuaugggguucuggucauuugugccaugaagaguuuauuucugagauaaauggcugagguaucuaugcccuguucacauccaaccccuccgcugucccucugccuuucagauuuuguucuguuuuccugccuugauagagaaguaaguuuugugauuucugcagcuaaggaauaguugacaggaaguuugcauuuaggccaaauuuggaacaugauaccccucuaacagacuguaacccccgcggcucacugacuaggggcauauuacauucacauccuuuccaggauuuuaccaacuagugaagaauuauucuauaucuuagaaguagauacccagcaaagcuacccagccauccuucaugcccuaagcuucucaagggacucagcaucaaacaacaacaacaacaacaacaacaacaacaaaucauugguauuagagucagauguaguucuccuuggcuagguauuagcugucuaauuuguauguuaugucacgucucuuugcccugguuucucccacucuacagugggaaugacacuagucucgauuccuuaguacaguaacacugagccaugcacuaauauaaauauaaaagcucuaagcccaguggccgaagcguuugagaguuucacauuguuuuuaaccuagcaguuugaagugcuugagugauuuuguagacagcaagguuaagaaaagggagaguuuuuuuuuuuuucuuuucuuuuuguuuguuuguuuuaauucaggugcuguuguaaguacuaagacgugagaggcucaaggucuaagaggugaucuugccuaaagcacaagcucuuuuagugguuggaacugaggaacccaaaaggccaccuccaucucuuuuggaagcaaugcauugacucuuggauaccuugcucaacacauagcuauauucccacucagcucauuagcagcucagcaggacaggagcucugggcugaugugugcccauugucauuaucuaacucgacacuuacuacaaaugaaacuuccucugaaguuuuguuuuccucaauccuagguaauacuuacuauguguagaauuucuuaccugaggacaaaugucugguauuugucuucaugcucuagaugccaugggggaagcgaggagggagaaaaaaaaaucuauacuccuacagcucagugccaaagcugcagugacaguaccgggggaucucugucuucuccuuugcagucgguugcuguagccugguacauggcaaacagcuuagcgcucgauguugaguaauuccaaccaagaugauuaggaaggcuuuucucuaaagauuuuaacguugccuaaauuaagacaguggcucagaaaaacacuagagauuuauauaacuuuugauaaugauaauucacaauccucuccuguccucuuuuauccagaauccugucuucuuucuguacagaagaacaaagcaacuuuaauacauuauuuaagaauaagccaaaacaauuccuacccccucuguucuuucuauauauuuacauuucucuaugugugcguguguaugcacacaaacacacacacaaauacacacacacucucacugauaugagauuaauauauaccacaaaucguauaauaagaauggggaaaguuuguggguggaauguguucuacagccucccccaauaaugagcacauuucaugauauuaugggggaaaauguaccauuugaugcaucuguugcuaugguaacugcuaggguuuuucugucgaggagaggcaggaugcaaaugugcagucccucuguaucacuugggcauccgggcugcauaaacacagacuuccugugcagagcccacauguucccuucuucuucaccuccugccugagugauggcaaacagaccccagugcugcugcucccaaccccaaaaucaagaguuggaaagaaaacaagccugggaggcgaaagccugaggccucugguccaaaguggaacugcuguguaaaggucaggcgugcacauuugcugacugccucccaucgcucuucuucugauuugaccgcccagcucagcugucuuccugacucuucucuugauggcaacauagaugggcugagagcucgguggcagaucggaggucucuucacagcugcgaggggaucuagucagaggcuucugagccuuugcauagguucagccuuuccccagacucuucucaucaaacugguagcauacuuuaugucaggcuccuuuuaaacagggguuauauuuaaucuuucauucagcucagagguaaccugucuuccccauuucuuucuucuuggauauuucuuucgaauuuauuuucucccagagucagcuuuuaagucccugguuucccagugacagcuuuggggaaugcugauuggcuugcccaagccccugggauagucaaggcugcaucuuucuaucaagaugggguuuucugagccgugaaacagcucggugccggaacuguuucucccuagcagggcauuucauuuugaagguacuuuaaacacugcaagugacuuccuugcuggaaaccgucuuggcauuauggacuuucuggugguccaggugggaaaugagucucauaagcagacaggagaaaaugcucucccauuugggggaagggggauagagaagggaaaauugagguuuuaggguccccccccauuuccugcacauucauguaaaaaucagcaccaggcuucuagcaccuuccccucuccugguuugcuucauccauguuugucccuguggguucuggcauaaauuaacaaaggagauaaauguggcagcauagcccuagugauugauagacuuuuccaguuggcaggauccaggcuucugccuuuucccuuucuuccuugacugccugcuucucucaggacaaccccccccaaucugccccccccccuccagcuuguuucacaacccuucccccagucccagaccuauucucagcacuucuuaacaaaucacuuuaaauucuacugacucaugcuucagucccaggucuccucggagcgcuugacuauuuuagagaccugcuaguucucagcaccucccucugccagacuccccacgccucucucucgcuacccuggaggaacuccaggccauacuacuuugccccuaggaaacagucccugggaaaugugcagucgcuggcccaggacucccuuaggauuggggugggaaagguguuagauagagcaagcucaccccccaaugcugcaugcauccuccuguggcagaagaaaucagauugcuucugucagaguucuaagaaagggccauuauguccauacuguuuuguuaaugauuauauuuuuuaagcuuuucauuaggagaaccuugaaauauguauuaaaggaauaggaagaguuuggggaacuaucuauaacucaacugcagcuaucagcuccugcucauucuuaccucuucugucucuuccuuauuucucuuucucuugugcuauuuuuaagcaaaucaugguggcgguucgugcauauugcuuacuuuugaucuguguaucucgcacuuauccagcuuucucaacguuccuaauucagccccuuaaaaaugucccucaugcuguggugaccccccaaccaucaaauuauuuucauugcuucauaaccauaaugucgcuacugccacaauuaugaaucauaagcaucugugcuuuccaauggucuuaggugaccccugugaaagggucauuugacccccaaaggggucaugacccacagguuuggaaccacugccuauuucccauaucauccuucucuguccucaccauguggccccaucagccuuuguaagaaaggcuugcugucaacugucauaucagcuuacacucuuacugugagaucuuauuacuucuugggccaggcaucgugucacacaucuuuaaccccagcacuugugaaguagacagaaggacccagaauucaagauaaucuuugacuacagagugagguuaaagccacccuucuguugcacacugccucacauacaguuccccuucuucacacccucaggaauaaaccuggugccuggguagcauuuuuuuuuaauauacugcuauguggaagcugaccuguaaaauuugcaguuugcccaaauuuuaucagcuuaacccaaagggcuuuucauuuguuuuuuguggcugcuaguugcccuucagaauuauuguucugucuuuaccauugugugaggggguacuucagaauuuaauaguguagauugauacuaauucuucaaucaaucaaucaaucaaucaauaaaucauguucuguucccugagaaaauauuggaaguugacuucaaaguuucuuaaaugcuuuuuauuaaucuuuuuuuuuccacugagugaaacucuguugaauauaccugaauauccuguguauguguguagguuuuuuucuucaauuuaaauauuaaucacucaauuaugcuuuaaauucgaaaucugauuucauuauccuguuuaaauuagggugaggcacuccgacaaauuuuggucaaccguuacuauggaaacaucagaccuucaggaagaagagagagccuuaccagcuuuggcaauggcccacuaucaccaggaggacccagcaagccugguggaggagguaggcuccgugcugugcuaaugagcaucuugugugaacugagcaugucacaaggagcugucugcuuuugcuugacaaguugaaacuuagauguauggaaguuuuuugguuuucuuuguuucugaauuuguuucucuuuguuguuguaacuucuuuuguguuugaugaaagaucggugugcuacaugaacauguuucccuauagcauagcauuucuaugcagguauguuuuccauacauccuuugccguucuuccccaagcugugacccucuugcugauacucagaugaugugggaagcuagauuucacugucuguuguccugugcucauuaggagcugugcuuacccauaagcugaugaggaugauggcagccaagauggugaaagcuagcauuuauuaugugccugcugaaugcucugagggcuuucccaaacacucugcaaguuaccccuuuacaggacaaauacuauuuuuuagcauaguuuaacagaaaaacaaaagucuauuucaaaccacacuuacacacaugugagcacacacaaaguucauaucacauauauauaugaacuuauauauauauauauauaucacauauauauauaucacauauauauauauauauauaucacauauauauauauauauaucacauauauauauauauauauauauauaugucacccagugcucaagacacaaaagugaguugucgagauauaauuuugggguugugguauuauggggcagauucagauccuuaggaagguccaugcaauacauaaaagacauauuguuuaggugaaagagauggcucuauaauuaaaagcacuucucacacagguagaggacccagauuuauuuaguuccuaacauucaugguagagcacagccaucuguaacuuuaguuccaggggauccaauacacucuucaaacaccuuaggacacaaggcauucuugugguguacuuaaguaguacagucagguuaaaacccucacacacauaaaagaaaacacaucuaauuuuuuuuuuaauaauccuaguacuuaauguucuuauccuaguaccuuguggguaggguguuuggcuuuccucugaugagaacuugaggucuguccgauucgaagggcuuugcagguuucagugaugaugcaguuccuggacacuccagagauggcacucaucuucucaaacccccaauagcccaugauucuugcaggaccauuucucaggccacagcucaugacuguuucucuguaucaucugagauggguuuuggacagauucuugagggaacuggaagguaucgcaauggggaaaagugucuguauaggcugccuuacagcuccggcagcugaugcaccgguauuaggacugcaggggaaguagcuccucugcugagcucuggacagaaagagugauagaugguauuuugcauacuggaguuaaucaguccgcuuuucuauguuuuauuguuucaguuauuacuaauaauaacugaagacauguucuuaaauaugaacuuuccaaaaauagccaucccacugagugccaugggcccuuucuucuucacugauugaucuugucuuuagagcugugaagagggggacuucguuuguucaccccuccccuucccccagcucuugacuucaugccaagcacugccuuaauacuuggugaauaaaugaaugaaugaaugaaugaaugaugucaaagaaggaguuuguuagaaagaaggccaguggugauuguuuucgguaaagcuuuuccaggaagagucuuaagagauguuuccuuuugauuugacucuuaaacaaauuaugccccaagucuucuuauuuuaagauaccauauuggcugaaugguuuggggucacuugaugaaaauguauccauuuuccuucauuuugccugccugaguucaguaccauguuugccacuuguaaauuuagguguccugagacagacaccuacuauuuagagcauuaaagguuggcacuuagugaaaaugcaaaucucucauagcuuucaaugucuuaauaagaguaauauucugccuuuccagggggagguccuggaucuaguuccacaagcaggggugagaugagccuggcugagguucagugucaccucgacaaggagggggccuccaaccuggucaucgaucucauaaugaaugcauccagugaccgaguauuccaugaaagcauucugcuggccaucgcacuucuggaaggaggcaacaccaccauccagguaggaugcugaugagacagcuggugccguacccuaguucugagggccaaguccccaggcugagccuuggucucaggagggagaccucauuuuucucaugcugugacuauucugucuuuucaaauauaguuccaaaguauacggucuguuugaacugcaguguagguaugcuguaacauguaucaaauggauggaugauuaaagguuuguuuauggucuuuauucaggaauauagaagcucuugucauuagacaagcagaaaaguguucagacuuguguuguuuagaagauguaaaauguuuuccuguccguaggcucuguaacuacgguuaacuauaaacucuaccuuuaaacugaaaguucaaugaaacaaaugacuaauagggaaaagagacuuaggcuagguuagucaaagauagauaaaugacguuucuguugacuguacaucuuuaaaugauauuuaaaauauuaauauguugccaggcgugguggcauaugccuuuaaucccagcacucgggaggcagaggcaggcagauuucugaguucgaggccagucuggucuacaaaaugaguuccaggacagccagggcuauacagagaaacccugucucgaaacaagcaaacaaacaaacaaacaaaauguguauauguguuauuaaaauaauauuuaaacaauauuaauuugggcaaauguccuugaauggaccauuaaaaaaagagagagagauuugcuuccuuuaugugcauuaugugccugugugaguuuauauacauaauaugcaugcagguaccaacagaggccagaagagggcaucagaucccuugaacuggaauuacucuuguaagccaccauuuuucaguuucaggaucuaaaccuggauccuguguuuaaaaaacaaagaaagaaagaaauaaacaacaacaacaaaacccucuucuuucuagcuccacagaguucauuuaaaggagcccaaaugugugugugcguauaugugugugguacaacuuuuacauacgaguggcuuuuucuuucauuuuucuguccuuuaaguuaggaucuuccuggguggugcaggcugacccugauuccuggauucagauaguucuuugcccucaucuuuccuagcagcaggauuacaggcacaauuaugauauuaugcuagacuagaaauggcauuuaaaaugauuguuuuuauuuuaaaaauuguguguuuaugagauaggucucuccauguaguaggcuuaccuggaauucacuguguagaccagacuccugaugauccuccugccucggccuccuuaguuuuaagcccuuuaaccauuuuuaacaucccauucugccugagucuuucuuucauugugagcguacugaaugaggccuuuuuuggaacuauguaccuaugaacacagacucacacucauuuugauccaaacuuuguucagguuaauucauauaauaaaagguuuuuccccucugucuauauucgaccugauacuuucuuggcuuuacauuuaaauucagaacauauacucuuagaguaucuuccuauaucagaaaagguuguuucucucuaaggauagauguguucugggccaagacacugacuuagcaaacacaggauggguuagacuuuagccucugcucacucuuccagccuggaacccugucccuugcauaacccacugcaggggcccuucuuucugcccuccaaucccuacuugacccaacacacacuucaaaguuuauuaugcacagagauuuguggcaaugaguuacucacccgugccaguggcaaagucuauugcuugucugaguagucacaugcacacaugaguucgugagucaugauauauugagacugcuguuaaguuuuaucugggugugagaauggcuggauucaugggcccuugcccuuguugggguacacuuccugcuagugcuauaugcacagugucaggucccuguguugccaugguagcaguggucuuagaucgccuguggucagaucaguugaucuaaauauccacuuggucaggcagauguucuaccagcugauccacaugcccagccaccuccucguguguguguguguguguguguguguguuuuauaaaagcuuuacuaauugaagaaaucuaagaauuucugagguuguuuucaaaaaaagaaaaaacuugaaugucuagcaaggacaagaagcuacauguaagaacagagucuauggcuucccagugaaaagggguugggcuggggaaaccacuuguugacaaagguaaugaggagauaucucuagauaauagucagacagacagucagacagauagacagaucaguauaaggagauaagaguuugugaagaguuuucuggugaccugugcuuucaaggagugggcauaggauuacaagguuaaaaacuaaacaugaggcccccaacaugggaagauugguuaacaaggcccagaggaaugugaacaggaucggguccgcgagacugaagagcacuguguaagagagcauagagagcccggaugagaauugagauuuaaaugagaagcaauguaccacacuaaggagacucaaaacuaucauuuagggcucuaacucugucaucagaggguacguaagagacagucaguaauucacaguuaaucuacuggcugggcguuaugguacacaccuuuaauaccagcacuuggaaggcagaggcagacagauuucuaugagaucaaggccucccugaucuacacagugaguucuaggaugguuagagcuaaauauagacagagacacuguuucaaaaacaagaacaacaaaaaaccaauuugggguaaccccaguccaugggaaguagaugaaggaggagggagcauucaguguaaaccgcuccaccauagcaaguuuaaaggccaugagccccggccucacuaaaaacaggcgcuaguaauauagcucuuaacucaugugcacaagggccuggguuccguccuccucacugaggaggaaaauaaaaagauacaaaugugcuaaguagcaaaucuguaguguuaacaaugcacagcucgaggauugauacagguaaugaaacugcagguuguaugagagcuauuaaaacagcuauuuuuucugcuguugccauggaaacaaaaauaaauguauguggaguauggguggauuggcuucacuguaguaaguuuuguccugucuauacaugcgucacaauaucauguugcauaccuuagguauacacaaugaaauuuauuucuugaaaagguuauauagcaaugauauggggaugagguaguaagccccaccuucugaugacuccgagaacaacaauacuagcuaaggaaaggaucuauagggggcacaggggagccaacugcaugcuagaaaaaccuucuuuaucuuuguguaggugacaguuaugugauuguguacaugguuacacacugagcucgagguguguuuuaacaagugauaaaggagggggggagggagagagggagggagggagggagagagagagagagagggagggagagagagagagagagagagagagagagagagagagagagagagagagaacgagccuagaccuuguugggacccugaugcaagagagaagagggauagacugcagugggugaaacugacacccucugcuggggccaagucuggacccugagacugagcuggcaaacugaguccagcugagaggagggcagacgucccugcugucucuggaggcuuucugucccaggaaugaauagaugcucugagccaccacgggugagggaauaaggaagcgugggguggcucacagggaugagacuggcucacugcugagguggaaucugggguucuggcaagacgcccuguuucucagagcauccguccugacagugauggagaggcagacagaagcuguuuuuccuugcagcucuuuaucuuauucaggaauuaugaauauuagcuccguguuuucacacacucaugacucaugugcuuugucggaagaugagaugcugcaaugaggucuggucagccacuccugauagaagcacuuucuuucucucccucuccagggaaccaggacaccaaugaguaacuggaucggguguggauaagcuguaggcuuuagccaguaugcguggacauagccuucagguucuagcuuaugcucccucugccucaccccuuucugagacgaccaggaccccagucugacccacuacaugguaucaggccuaugguuccagggacuguucuucuagcauggaguugccuugagagauuccugcuuugccccaagcuucuuuucucuggaggaaauaauuuagagcuaggguugugucugggaccagcugaggacaggaacccuaaagacccagggaaggugacucagaguuuggucuugcuggcgagaagccgguuuaaaguaguaaaugaccagcugggaggcaagucugcccucaguuagaaccgaaguggugguuauuaaugauugcugaaauaaacgcugugauccaugaaagacagggucauccuaacuggaacucacugcccauuaccacuuccuguucuguaugacgugcacguucucaugaaggacagcgugcuguggccagauggguuuccugcuuuguucuugccagugcagguugucagaaggacagcagagagauacaggcagggcuguguuuuaggcuuguguuuagagugccaucgaccuacucugauucguucacugucuuuauaucaaaaggaaagcagcuuucaaguccuguauugugugggguucaaaaucugucuuucaguucacguugcccugucuguugugucagcgagcagacagggacuucugaacccucgcagcuuuaaagcaagacuuuuguuuguuugaagucauauuagcuguuuaguuauuuccauggggaguccauuucugaagucaugaaaauaauuauuaaaaaauaguaaugauuggacaagugagccauaggaugacacccguguagcagguacucggcaaugaaaguaugcuaagccgguaagcagucaguagcuagguccaucucacacacacuaggcugaaugaaagaagucagugaguguacagacagcaacacacucuaaauuguaucuaucugguucuuuggaaagacaaauggugaugaagaccagaucggcccacagggucaggggucacaggaggauuuggucaaguguaggagcacaggggaguauuugggggcauagggguguugugugucuuccuuuccuggcagucacacaacuuuauaugugugugaaaaaucuauccaacugaauacccaaagagacaguuugguagcaugugucaauuguaaaaauuaggagaagugaaaaagauaggccuagugaaagggccacagccagcuagcauccagcuuggcuuccgaggcuuccucugcaggauucccuuucauucagugucucaucugagacuggcagcuccccugugagguguguacacgugaacucugugcuguaagaugaaacacacucaaggaagugaugggucggagcuacaguuaaacuucccaugcuguccaucuuuacugucuaucacggaguaaccucuucagaucccaggagucacuugauagcagucacaugcuucugugggcugaagcucagcgaagugacacuuucaccccauguggucuugacuggggcugaauucaucaggaaguugggacuagagucgucagcauggccacuuguuuggcugugaggguugguucucagcuugagcuggaggguacugguuuucgguauguggggcgcuucuuucuauaacaugguggcuggguucuuugagaagugcucgaagcaauagaaguugaagcuguccauuauuuucccccacuacgauuuauuuucauuuuuaauuauguguguaauuuuaugaaucuguguaugggcccguccauguuuaaccuguccauagguacaguaggaguccagaauagggcauugaauccuccagagcuguaguuacaggugcuuguaagauaccaaccaugggaccugggauugaaacucucaaccacugagccauggcucuagcucccauucccucuccuaccaacacccagcugugcauccuuuuaaagccugugcucagacuugagggugacaugccuacuacauucuagccaugaaccaacgugguugcauaaggccucagccugcuguugggagggaagccuguagaggaugagagagggcauugguagggcugucccuggcaucaguccauuuuccuucaguuauaauugacugugcaccccagcauaggccaguggaagccacaagcagggaaggacaacacucuaaucucuggaauugaguguaguuuuuccuuggaagugcaaucccuucuuuguagaaaguguugacacacaucuacucccuuuggauggagugugaaaacucagucuugucuugaggaucaggccacuggggaccucagcucuccagaaauccuggauuuaauuggccauacugucaaaagauuuugucagaaggaaaccagaaccaaugccacaggaacacuugcucggcccucuuguccugaaacccccaucacugaccucucagcaccuggaucccugaaaacugccagaagucaagguucaacuguccuaguguaguguaauagacuuggaggaacccugucccuaaggcuuucagaacuuucuuucucuuccaaggcuucucucauggugguaacucuccugccuggggccuucaaagcagcucuguuuacaggagcgugaagaugguugcacagcccuugagcuuucuggaugggugacacacuugucaggcagugggagaucaggcuuaucuugaagccugcuuccugcugcuuugucccugauccagugccagcccccagaagaaauauuuccuuucugcucgauguuuugucgcaagugggaaacuauaaaauaagcauuugcuuaugaauuaauuucuggcacacacagcacucaguaagccucauggugcugucuguauauccguccuucacgcccgugccaacuucuguguuccuuccuacuaagauguucccaccagcacccgggguguguguguggggggggggggggaguucccuucguguccucuuccccgcagaggacagggguuguccuuaccuggaauguggaggaagaaaaucugucuaugaacuuccaugacuuuaaaagguuaaaagcugauacagauguuuggagagggauguagcacucuguagcaaacuaaggggauaauuuuuuuuuccucuuggaauacuugccuccauuugcagaagcacagugauuuucauauaucaagugacugcccacggcuauuccucugccaaggucuggguuacagacacacccaaugaaaguuuucccucugcacguacacaguuagagguggaaaauaugaggugcucugaguccagaaaccaagcugugaguucagcugaaaagagagaguucccugauucauggggccuuuccccgaccacuuuugaagguuggguuaagaaaugagucccagccggucugggauaugacaucguacgcuaucuggaccuaucacugcagagcacagcgugggaggaacucauugcuuugacugucugcgacccccuuccucccucccccccccccccaucacagaaagauagaugcauguagaauagugugauuugaaucucugguaaugaacagaagggcagcuuguagggagauccgccucaguuugauagggcagucacccugaagaggaggaagagucugcugugugagggaguugcguaaauggguguuguuuuuggcaggggaguuagaaaugagucacuuucaagugguguuuucuaaccucagguuuuauccauguggaaagaagugagcuaaccccagagucagggacuguucucccgcaacauguagggacuuauaggugguuuuuggcauugagacugauaaaaacagccuggcaucuccauggggcauaucccaccccacucccagaacugugcaugccagucaacuagagggaucugaacagugaggccacuuacacuugcaaaaaaaauaccaccacaucuaggguccaccugugaguccugagaaucaguguauaaauaugcagagauuugggagagagccuugaaaggcgaccugucacacaaagggcucugaccuccugagugggacauuggaauccagcugugcccuugucagccuuuaguaacuuugaauuugaagguuucucuucccuaauggggguuggaaaacaaaguccauuguggaacucuccagaagauuaaacaaauagcaagaggggaaaagugcuugacccaagaaaugcccuuucuucaggccuccagccaaagugccuuaccuuucuuuaccuaguugcucaccuggugagcaagcugcugacaggugcugccucucagggccccugcugagucccagaaggugccuuguguggcguucaacuccuccaagcucuuaagacauucggauauuaguuucuauuguuucaggaaguugcuugucauuucaagacaggcuucauuuauuagccuugauuucugucaaacaugucugguuguuuguuuguuuguuucugugaagugguuuaucacccagagaggucuguaggcuguuuugcuuucucucacuaccuuacuuaaaccuuucugacuauauauuuaagauaauuuugaacauccagaaaguuaggaaauaugauugccuuugguguauaacuucuuaugcugguagccaugccaaaugagcagaagagagaugauauucuuuuccgcugguucagccuuuuucuuuucccucccuccagugccuuugacaugugagcguauuguccuccugucguucucuaggaaaucaggugucauugagcagaaguccuuuggauuauuggccuaaauccugcucucauagacagccauaauucaaaaagagcuacuguuggggcugaagagauggcucagugcaucagagugcuauuaggcaagcaugaguucucaugagcauguagucacacguguuccucucaccuaagcacugugaggggcggagucagugucucaguggcuugauggucaacaccaagcucuaggcuuaauggaaggcugucaaaggaacaaaguggagauggauagaaaaggaugccuaauguccuucuccagcuuccauaugugugugaaacacuccgcaguucccacgcucaagcacugaccugacuuacugacaaugugaacucucagagcucuauucugauuguuagugagucugccuaagugacaaccuuuggcaguguguaggucuaaaagcauucaauuuggcuguuaagccaagacacugcuuuaaaaaucgccaggcuuauucauccaagacugacaguuguguuauuaggaagaagcacagcucauggggauaguccuucuagagauaguagagaccugauauuguuccuuccugaaugguaaaaucccacgacagacagaagaagaauuuuacauauaucagcucuucuggccauccacaaagaaaauuaaaaggcgagaaaggauaaagagcaaaguccuguucuccucccuucccguaaaacccagaggcuugaauagaguucuaagaccagacaucugaaggaacacucaaauucugcagucucugcaugacuaaagagcagcaaauaaaaauacaagagaaugagcuagaagauagaucaacaguuaagaacacaggcugcucuuccagaggcugguuucguucccagcacccacauggcagcuuacaacuaccucuaacugguuccuggugaucugacacccucuucuggucucuguggucacagcacaccugugguccacagacauacaagcaggcaagacauccauuuacauaaaauaaaaauaaagcuaaagaagaugucagagaauacuucauuuauaaguugagccuguuuccuuucaucuccuagacacacaacaggucuagacuuucuuccuaguucuuccuccacuucuaggucaguacccaucugcacuuguccuugugacuucugaacaugcaguacaaacugacaccagauucuccuucuuacaguuugcuuugggauugguaaacagugggccaaggaccacaucuaaccagcugcucauguuuguauaaaguuuuauuggaacacagcuguccuccaguguccuucaugguugcuuccacucacaggggcagagcugagcagcuggaauaaagauggugacccuuugucauuccguuuuucauaaaaucauuugccaacccccaugcuuacuugauuguuauaacugaauaaucauaaaaagaaaagaggcauggauuuuauuuccuuguucugaguuugcccauaccccagagcuggcaguuauagguuuuagauaucugacauucaucagaugaauaguaucugaagucccaauauauuguagccacuuagcuaacaauaggcaaauucaggguaaugaguaucuucucugucuaugugucuguccauccauucauucuucccuccauccagccuaucuucugggguuggguuggguuuauuuuuagaacgcuauuuccuuccuucagauaauauccccuuucucuuuauuauaauucucuaccucugcuagcugccuuuuauccuagauccagaaggcauggcaaaacagucauccucagggaaguguccauguggcuuagagucuagauaccuuagcuuccagacuugugaucugugggccuucucugaccauucaaccuaagggcaucccauucuuaagguuagucacuuccuuguggccuuguggucugcuauuucugugcuucucacagaaguucucccggaggaaacgacagggauuccuaaaggcacauaguuaccuuuaagauaccugaacuguugggaccuuguuucccaucugucuccuccucccacauacuuccugcaugaucucauucauucccaaggcauccagccagcacuuaugccaacagcucccaaagauguagcucuuggccccaccucuuuaccaguuucuagaucucuguucaaaucucuuuagagcaucuuuaucuuacuuaacucuuaaguuaacaugaccccagucaggcugccaucuagucucuucucuuccaugccauuuguaugccaagagucacacaugagucaccaccuccaagcccccagccaccuucacuggcacccauaaaguuguuaauuguuuuucuuuguuacuguuggucacaaaucaauucugugccuguuugaucucccaguaguuuucggccaggauucaguuacaacuuccauucagccagggaauugcuagucaauaauauguauagagcagccuagcacggguuggaaugggacagagaaacaaguucucaucuuuggagcucauccucucggacaccuugcugugcacccuaccugccuugacggcaugaugccagaguuggaugcuuuccccauacagcagcaggacagcccuuccauagcuaccaugucuuucuuagcauuauugucagugacacuuccuaagagaagccuggucaucuuguccccugucuucaaagucucccuuagagaacagacucgauugacacucuggugaugucuuuggaugcccuguaaaauggggcacugccuagguuucugcccucuccuucccacauauuguccaucccuguaccugcaugcaaguaaacuggguuaggcaagaaugucuaacuguguaugugucagcugagcugaguaccuuccacauauggucucgcugaguuccuaggaaugacccacagagugggaucaugggcacugacucaucacauucagacugagcaugccucuucugcuagcauaugcagaagcguuuuuggagcacuggguggggcaagaagauuuggccuugguccccuugggucuucacccaacuccagucgaggugggaucauuccuuaaggcacugugaccagagguggagcucucccugccucugccucaggggauggaugaaaguuuucagaauagaagcaauuucagacagggcuugggaagccuuccaggcaaauggaaagugggcuugucccuuacagaacaaaacagguucaucugagcccaagagaaauaaauguacaaaagcaauggagaaauaucuuagggcuaaguuuuucauuuuuuuuucuucuuaauaauaacuucuuaauaacaaccuaauaauaacuaauaauaaauaaggaguaccagaagccagaaacucaacgugguguucuuucugccugagcuaauuuucacuuuguggcaguccuauguaaaaggugcuacuguggccccuuuauuugccgaagaggaaacgggaucccagaguugaaugcacuuagaaugccagagcaagcuggugguugcauagauguuguuuccugacacgucuuaguuuugguuucucugagacucuuccaucaacuuuccuaacauugacauggguccauucccccuuuagggaccuugcaucuuuuggugagacaaauggcaugugagccuucucacuggaggaugcucuggcauucuaguaccucagaagauagcuugagugguuaguuuuguuuuguuuugucaguaaacauggucauauaugacauaagaagaagccaugaaaggcuuuucccuucagccugggcauugcucgcuugccaaauaaaacuuguacacguuacagguuucaccuccagcaaguuucagguucccaggucaaugaaaauuagugacaggaagacuuuccugugaaacuguggcauggaaagcaguuggguuauaugagaugcccucaguuacggacgaggaacccaaggcuccaccuguccaguaaauccaguaucacucagucuccagcugucaggaccaagguuugaaugcaagucuuucucccuccccacucuuucaccuacauuccauaugacacagucuuugggucacacaggcaggaaguucgucagucaacuguucacccugaccauggccuuguuaguagugucugcuuuaucuuuggaggugagagaaggccauaguucuugauugaucugagcagcaagcacuugcugcuuuggcauaggcaaucaguuuuaaagguugacucaugaacccgcacagggaagcacauucaguuucauauuguuguauaagcuuuucuucaguuugcauuuguuuucucaucaugcguagcucugucuggccagaggcgaauauauccaccguaaaaaggcucguguucagucgcuacauuucucgggguuuucuggacuccucguggagcgggauugcugggauagaccagugaggggugucacaaacccccuucuacuguucccaguuuggcaugugugugugagauguaugccugccuuguauuuacaagaggaaguaucccauuuaauuuuauuuucacacuaaagccgaaguguuaagagaacauaguguuuuaacacucucuugguuaucagcugcagagcggagguugcauauugucacauacaguuuucugaguacauuucuacauuuguuaccuggcaacguugcugcgucggcacaugaagauguguugguuucugccaguuccccacucucuguacuguagacaggagaauagcugcuucccugcagggauggagaacaggggaaggcauggagcuaaugggcuuauagaaagacucccugcagucagugucacagccaaaccagaggcuguccagaggcguuuucuaccacugccuugaaucuugugcugcuuuccuccccgguuaggguuaggugagggguuugugauuaaucaccaugaauccuuguugcugaucuuugaucuuuuuaaacgaaaaacaaacaaccaccaucucguguccuagucguuauaugagucaucugaaccuuuuuaauauugugacaaagauaucuuuaauugcuuucauuugauccccagccuccugccugaucuaagugcucagguuuugacuaccucugacuucugauaaggaaggaaaucccacaguacaaugagagccgcugagcugauuauagcccaccggagugauuuugcuugcccaaaaugcugaacuuaccuagacuuggagcacuaaaguggcccaucuuugugcucuagggacaucacauccuacccuucauuugacugaugccuaccggucugaucuuugaaaacauuugaguugaaacccuuacauuauggguuuaaaagucuccguagucuacaccguacauccuaagauucaagaaaagcuuccugggaccagcaccuguacuguugucuugaagaacaauccacuagggaaguuuccaugguaacaguguuugaaacagucugacagcaucaacagguuaaguaagaagucuucuggcucaggggcgcauccuguaagcacagcuccuuagaaggaagccuaggagagacuaugacugagcccaggcaggacucagccacuggagggccuggccaaaacaggccaggcuuuagggccuguugguuuggcagagcaaagcuuguuggugucaucuuguuugugggaggccuuuguagccuccuggauucuuacuguccugccuguuaaggaaaagagagacagcugccugugucugaaagguaguuagaacccagcccuuagcuggaaaucuugaucucugcuacuagauguuggguuucaaaccugggacgaaugguugggguggcuauguaacaugucaaagcgggccuguccugucccucaauccuuaccuguuacagggcccucuuggcuggcacaccccacccccuagcuuaaauuucuccaguccaggggcugggccuuuuugguugccugcucuuggugucuguuugggucuuguggaugaugcacauggaucuccucucuucccccuccccccuuccucaaauagugccucuccgucuagucacaucuacucuggacucucccagaugugccugcauacucuaacucugggcucucucuccuuuuuaucuacaauaaaccuccuccuccaccauaccgaggggcacucaugcuugcuuucuuuucuauucuauuucuuuguucauucugucaucucccuguaaaacccacaggagccacucuccugaggcucugcugugggcguuuacccucaaguuuuucaguuuucaucaggaaagguccuaagaggaaaucucaagauuuuucacccguuuuuguuacuauuguguuguuuguugguuuuuuguuguuguuguuauucuugguuuuuuuuuuguuuguuuguuuguuuguuuuuuuuaaauauccagagauaacuugccccaaggauuccuagcuuuggccugaguuccuuuuaacucggaagucuguauccugcuguuuaaacauuaagaugguuccucacugccuuagagucggcaaccugcaggccaaggcgaacuuuaaagaaaaaccaggucaugccgcauguuuuuggugagcacaggaaucaacaaagcgcuguuacauaacuucuauuuauguccuccuugcucacuaucugcaggcaggcaagagucgcagagcugggauuuaaugagcucuggguuugcucaccuuccugagcugguaggaaccagcuuguucucaaaaugcgucaguaaagaaucaggcugugggugggcggccagggguaguaggugggccgcauuguugccaugguguuuuuuaauuccccuguuucucaaggauccugcucucuccuucccugacuccccacccccuucuuuucuuuucuuucuuuuuaauccaugcgcuuccuuguuucucacgcccacucgugauuucuuggagcugccucaggaaacaggaauauuuucccucccuuccacaaacacccccauuguguagccccagggccucagaagaguuuuuccuaaggugcuccuuucccacccuccccugucuauuuucccgugauuuuucguaaccacucccuccauugcccgggcuuagccucccuguggcgggauggaagcuuucugucuccugcuagauugcuccggaaccagguggauuccguugcuccuagcacagcaguuugccccggaggagagcgguuguuuguguuucccuacauccuggucucugcucuugcccuaaacugaaugacaucuguccccucuagccauauuauuaugaaauagagucacacuuuauaaaaggaaaacaagggaaguuugucccacaaugaugaccccuguuaccugaaaguuacagguuggauuaacacacauuuuaaaaaaaauagaaaaagucaugugcuagggaauuagcuaagugggacaguguguacuuggcacgggugaaacuggguuugauccuccaucugucucgagaacagugcaugugugugagagcucguguacacacacacacacacccucccucccugacucugauacauagcaaggaaggaaggaagggcugagagcccuguggcugccagggagagcucccugcucccugcaccucggcuucugagggaagccacccagguuucugugcugacuuuguguccacacucucagcagagcggaagcuuuuaacaaguacaaaagaauaaguugagaugaaaaacuccagcggggggggguggggguggguuggggguggggguggggggggggacaguuccagcaaaacaggcuuaagauuuuuaaaguuaaaaaaaaauuuaaaaagucaagcccaccccuucauugcuuacgaguugugcaauccuuacuggagguagcuguuugaauaaucaaaggccggcugacuucccuucauuaacuagagcggcagacaucugcauaaaacaucccagauuccagacugaguagguaauuuuuuuuucccucugaguaacuugagggacuuucccuuuggaaaccuuccaagagagugaacuucgugguugagacuuuuuucucuuucucccugguguuggauguagaacccagggcaagugcucuacugcugcgcuugugcugggcaagcccuaccuacagugguuuuuacugggcuaggcagcagcuugauccugaauaugaagcaauucagucaccucagacacaaaucuggagcccucaguucugagaacguucuugguguucacagcugaccgccgcucuauaucuuagcgccacuugccacuucagagccugcccacacuuagauuucucaagguccacuaagaucccuuggaaaaguagcccuccgcguuuuaccaguacccuacgcuugcauuuugagcuugcuucaucagcgugguucagacacucaagccugugguucuguaagccauguguauucuuccgcaacuguuccaaaaauccaagacuuuaaaauguguguguggggggggggggagggacuguaauugaaggaaggugugguggagucacccucagcagcugguguuugagaaauguggcuuuauuaauguucuugcaacaugaccccacagacugucgagccuggaguuuguagcuguggagccuggggagacagccagcuucuaagguggagggcccacaaaggauggcccuuccugcucccaaguuaaugaugcaggcagcugugucucugaggcccuauugguuaacaguuaacugggcagauuaaagauccccagccaggcugaaccugucccagaguuagaagcaaaagccugcuaagugccagcuccacaccucccuucagccgcccccaaggugggacacuuccccauuuagcgggacuuugagcuuucacauucccagaauuaagguuuuuggaacugugccucccuuaggguuguuauuuauucauuaagacaauaaauacuaggcacuggacaaaaugcuugugcggguuggggcagggacuucaaugguaugccauccagugggugagccggcuagggaaccugagcaaaacugggagagugagaccggaagcaaggaauugcuccuugaggaugggaagggcacucgcggaggagacauggaugcugagaccuuccagauggaaugggguuaagagcaaggguauccuggccccggagcgggguguguuggcauggcugaggaggccaguguggcagcaacggagugcagggcgggcagcagcaugaggugacugcucagcuuugguacuacgccugucaccaggugggaggcuggauuaggugauccucugauccucgugcucucugccaguccuuacucuguacuucuaaagggcaccaaguuggcucaggucagugaccugccuggaugcguacuacugcugccagggauggaauagguugagcuaccgaagaugaggaccguguaauuucaaccugaccaccuccgucggauuggugaucuguacaugucacugucagaugcuucccaagccacagggacauucaccaacauagugaaugggcgggcuggguugggggaugugauggucucacaggucugugucugagggugagaggagcuggagcggugguccagggaugacugcaagggacugcggguuucccaucagcucgacauugcuuugucuuuggcaugagagagggugauuauuuuucuuuggguuuuauggucuaguggacuugucccagucaaguguguugaaagcagggaugggugggaggggauagcauggaagcagggguugucacacguauuuccuacuuccucucaauaaaccucucagauaguucuuaauccuccuuuuuccuccugaagaugaggcgacuacagcagggguuuagcgagggaccugcccaaaggcauccaguucccagauuccccccgccccccccccccacacacacacacggccugccucccuaaggauagguuagcgagcuccuucucagucccagggcuccacacagacacagaaaaugugugaacaaaggauuauucuugguccugcucuaaauuccaaggcaaggucccugagaagcucggagcucugagucaggaagcuggucuaaguuaaugaaugguccccgcaaguacacagaacagaugcaugaccgcgagggucuguucuacagacugacuucuucuucuucaugccucuuuuguaauagcucagaucaucacacccgucaacguaggaaagaguagcgagccauggccagggccucgaccguggccuuccucuuuccagggugaagaccccuuacccaggccccuggagcugauguagacugcauugcuuucuguugagaugcgcuugcaugaauaagggcugugucauuucauccugcccaccuuuggcccuuugcucccuuuagccuucuacagguuucacugugggauaccuuuguggccucaggaugauaccuggugaagcucaucgcaaaaugggugugaagaguugggagaugcgggggcgcauuugcuuggguaaaacaauuaauguccuagcauguggcuuaucucucccccccacaacccccaccuccuuccuuucuuugcccagguuucacugaguagcucacaccuucaucucuuaagugauaggaccuacaggucucuuguaacacacucaguugagaacacauugcuguuuucuuccaagcgcuuugcagugucacggugcauguuggagguccgaggaggagaccuccaugaaccccccacugcagaucccacagugaaucugugggcaugccaaggcaagacuucagaauuucacccaaacugccaaaagggacccauugcgucaggaccccggaagguguuucuggacuggcugacgcauacauaccuccugcagccccggggccauauccgguuuguuggucauugccuucucuguuugagaagauagccaugaguugagacugugagccuuuaaauccuucucuguuugagaagauagccaugaguugagacugugagccuuuaaauccuucgaacagaagucuuccacagaucugagauuuacaguaaugagaaaggcacuguuacugacuuuuuuuuuaauuagguauuuuccucguuuacauuuucaaugcuaucccaaaggucccccaauccccuacccacccacucccccuuuuuggcccuggcguuccccuguacuggggcauauaaaguuugcaaguccaaugagccucucauugcagugauggccaacuaggccaucuuuugauacauaugcagcuagagacaagagcuccgggguacugguuaguucauauuguuguuccaccuauaggguugcaguucccauuagcuccuuggguaauuucucuagcuccuccauugggggccguaugacccauccaauagcugacugugaucauccacuucuguguuugcuaggccccggcauagucucacguuacugacuuuaaaacaaggcucagacucauucagagacaaaccagcauacuuucuuacgcaggugggaggugggcagagaggcuacuaacucaugaugcagcucuucgcccgcguugccuuguugucuuuauggagugugccucguuuucuauccagcgcucaucgucgugguuuguguuuuccuggaggguuuacuuuuuuucucuccaugucuuuggccagaaaccacacaagugcguuccccaaagauacugcccuuuaggcucuguaacaaguuccaguaguuaagucucgagaaagauucagccagaggcacgggguucuccaaugucuccugucucugaaauccuuuugagugaucuuaagucuuaguggagagugauugcugccgggauacuuauacagucagguacuuuggaaggcgccuuguuauuuauucagagaaacguucucacuauguagccccgggugaucucuuaauuuuguggggagguuuuuccugcuucagucuaccgaguacugagauugcaggauuccagugugugcuacuaggucugcccagccuaauuuuuuuuaaguauauuuuguuggcugagauguuauugaugaauauguaugaaacuauuccuauucugaucugcauggugaucugcaugcuaugcuguauagauggggcacaaguucccagcaagugccagcuccugugggcauugaaagacagaugaaggagaacacaguucagcuuccugccucagagaaagcaugcguuuuagaacagaguggacuuggcugcuugcuaaaagaugaauuauuuuacuuugaaaagcaucugugaaagucugcuuuguccuugacccugaaguccaggaaucuagugaauccaaguagggguauccuugucucugccccuucucucuggcaccaggaagucagugaugggccagaacauguccucuguccauucuugguuggcagaauaauugaaaauugguguacauuuuuaagccaucagaggaggcucuacaauucagaugaugcagaaccucguuucugaaaaaaggauguugagacauugaugguuuucuggguacccuuaguuuucuuauugacucuucccuucccauauggcaguuuauuucauaacucauuaaagccugaaaaagccacagcaaacuugauuaaaugagagcuacagguauuuagcugaaacccaccaaacuugccccccccccaaaaaaaaaaccuuuuuuggguuuuuguuuugcuuuuguuguuuugcuuuuguuuccuuccagacagucuuggcuguuguggcgcucucuauguagacaaggcuguccuagaacucauagguaaaugcccgaauuccccuccuuagggcugggaguaagaacuugugccaccauagucagcuuaaaacuugacuuuuuauaaugaguuuuaguaacuuuuaaauguucccuuuucuuauacguccauauuaucccaacgucaaguguugggaauagaggagaagaguucauauaaaaaacacauaaguggcuagagagauggcuuaaggguggucagaugacuagagagugauuaagagagcaaacuguucuugcagaggacccaagguuggaucccagcacccauguuaucucccaaccacccauaacuccagcucugaaaggcucaauaaucucuuuuagccuccgcaacugcucaugcacagauagcuguacacagaaacacacauacacacaauucuaaaucaaagcuuuuuuuaaaagagagcaagagagacagacacagaggaccaccuaggaaagcaggccugauaucaggcuuguauucuagcuuugaagauauuucacuucaugaauuggaagcuaaagggcuuucuaugucuacagaaaucagaauggcuucuauagcuaguaauagucuagaccaguuuuacuguuauuucuuacaucaugacaacuacaggggauuaccauuuacuauguuuuugcugucaauuuggaagcuaucuugagcuaccaauaccauauggaauugucacuggauguuacaugaguaggagauuuugauccuuacauaccacccacggacccaccuauccuauauccaagugucuuuccuucgacacaggcauuacuguuagauaauaauaccaucaugcauuuauaucaggcucaguaggagucagguuguuuuucacacuguuucauaacugcuacccugauggagcccuagccuuuuccaugugauguggaccaggcagguuguacaaucucauuuucucagauaaggaauccccaagacacaaaugaggaugaaacuacuaaagaccacaggauuggcuaaugaggagccagggccaagauguccauuucugaguuccaguucuccagggcuggugugucuaaucaaguauauuuuauugccuugugguuucugaucuuugacuugugaucauuacacuuggugccuaagaaaaagacucaaguccuacaguaguuauugugugguaguggcucuguugagagcuuaugagccccagcucuggcauacccucagauaccauaaagaaauuguuugggagucagagcuaacacauguauuaaguauccuugcuuccuguggaguugugauucuugguaccuuucacagugauucuuuaccaugauaguagucuguguuuguaucucugacagaguuggaguauaagucugggguggcuuauaaaaagcuguaagguauccagacucugacaaucucuuguucaacaaagacaaguuuaacaaagcaauggucaaaggcuagagugucagaagcaugccaggcuaaguaugggggcagcagccgcaagcacuaguuguaugacuuggcaacuuaugcaacuuguccaaagcucuguuucuuuguagagauaauaauggcaccugccuauggggcggcugaggguuaauagagauagugccauacuugggugaugccuggcaaauugggaccuuugcuguuaacugccauauaauuuucagaaagggucccuaggaaguggcaaauucucaguuaaucacaggugcauggagagcggccaaaggugucaccauugccuuuaccuugcuccacuggggaagacaggcagagucguuuggguuaagaugccccucaagucccagagcuaguguuaaaagaguaaagcaaagaguaaagguggccuguucaucagugcuuggaaacaccauuguuggcucacugcucagccacaucuuucaaauucccggacuuagcccaaggacuuaauucauuuugcagcagauaagugaagcacgccaacugaacgacgucauggcuguaucagucagggucaugucuugugaaaacagucaaauggaaaaaaaaaaucucacuuucuggauuuucucaggguccagaguuaaguguagaagguagcccagccacaaacguacaagugucuuucuuuggaaaaaaaagaucaaagucccaccaccacccuggcccuaggcugcucugccuguggccauuaccccauucuguaccugagauacccaccaauggguuccuccaaacugggugacccagugccugggcagguccaagcaggcagcucauuuuccagggagcaccaugcuagcagaguccaagagccugccuguccuuugcuuacugggcuccagauccucauuucagaugaggaaggucugugccugccacucacucguuguccuggcuguggauccagguuacaggaaagguaucugucucccgugaugauuuuuacccaagaccucaggcccgugguuuacuuaggguuguugccucuuauacuuaaaaauuuuuaaaaauaucuggcacacuacaguuaucuucccacuuucuguagguugcuuccucucucuguuggaucauaaccucagggcgccucuugucauagcauaagccgggcugcauuucuuugcaaugucucucucggguggagguagcagguggccaacagguuaauuaagcaacaauucauuuccaagauggacuagcagguaguuguauuauuuugauuugagaccuaucucacagguucgucagcacccaugacacucaguccaauaugggaaaacugaccacaaaacaaggauuauagaauaggauggaucaucaacuaggacuccgguuauaauuaaccacaagcugcuguggucauggagaacuggacugagcaaugucauaguuuuguuucuauuguugggaugaaugccaugacacaaggcaacucagaaaggaaaagguuuauuucauccuacucuuccaugucacaguccaucacggagggaaccugguggcagaaacugaagcggaagucaugauggacuguuccuuauuggcuugaucuguuuguuuuuuauacaccccaguaccaaugucccagaauggcacuacccacugugggcugggcccucuaauauccaucaucaaucaagaaaaugauuccccuuaggcaaccccaucugagauucccucuuaggugacucuagcuugggucaaguugacaaacuaaccaacacaagcaguaaggagagaggggucuucuugugcccuucacaaaauccuuuuccugugugagcucacuuucuucauuuguaaaacaugaagcgggguagcuaaaaggguauuuuguaaaucugugaauuaguuccaagagcuugugugguucuaaugccaccucaaagcgaucccgucugcccaagucucucuuauauaaggugucuguguaucgaaucguauuuggggaggguuauuaugcugggcaagacacuggauccugcugcuuucgcccagcuccagcuauaguaaguagccuaugaucuugcuucucuucuccuuuguucuguuuugaaccuuagcuuauaauggcugucgucaccccacccccuacccauacccuccaccacugcuuggagauggcugaggccggcagccacuuccucacccuaccccugaccccacuuccuucccucaagcaugucaugugcaaaccugccauaccucgugucucaacuuggugaacgucugcccccugaacaaaccccguuuccucuacuuuucuagccucuguucaugucugcccaccaaggcugucuuccuguugggcaagaguuuucuguggcacugccacaagccucugaccuccccugacccuagcacgcuugugugcaaugugcuggguuuaggaacaaugauaucuaucuuggcgaucucuucaggugcugaugagacaguauguauuaaaaggguuuuggcauccaucgugauuuggagauaacagaagggugaggacaggucaguaaggggcaggcagaugccaguucccucgggugaccagggauguucuagaaguggccucauacguauguuaccgaaguucccuaguauucuggaacccaaacaggcuugucucuucuauaauaugugcagauuugaagaguggaacuugauuagauuuuuuaauguuuuuauaccuguuguauggcuacaauaacagaugaccauacaccuagaugcuuuggguuaccaacuuaaguaucuaacaaguuaaacaugaaucuuuguagaguaaaauccaggugccagggaggcuguguucacaagcuggaggcuacagggucccuccacuuacuggccauucgcagguucuucuuaccugagcucccagccuccuccuuuaaucauagcagcaaggaacugacuucuccuaccuccuagcuaccuucuuccauguuaaaaggaccuugugauaucaacgggccccuguggugauccaaaguugugucaguguuaaagguuggagaguuagcagucaucccaucggcuacauuacuuucugguguaaggugcagugcgcauugucaggacccagggaugagcacgcgcauauuugagaaacccacuguuuacgacauccaugcaacugccgcucucaucacgaugguccuucaccccagaacauuaucuuaucccccuuuuuaacuguacuugccaucauuagccacggagacugccgccauugacauuucuauugccaucuguguuucuuaccgugagcuagcuuuauauugaaggguucgcucacacccagacgggugguacggaggaaaagagucaaaaaaaguaaaaucucccugugacaacucuuggccugggggaagagacaauucaccgaaauagguucagugaagaaagcaggcguagggccagguagugcugaggcuauaggggcuguguaccuguuuguccucaucuucagccccacaugaugugaaaaaacauacugcuucucucuucuuaguuaccucagaaagaaguuuggugaaugugaauaggccugugaagaggggaaagggcccagucucuuaaugucuagaucucaccauggaggaggcaagugaauggcucuagcagacuccagcagguugucccagagcccuguguggcuccaugucuuucuuguccacuuggcacaccuuguuguguuguugaaggcuucuuuacucgauucaucaucaaugcucaguccuacccucacgggagaugccuggccuccuuccagagacuggaugucuuccagcugucuuuguuuaauguggucuucugagaccugagccugugcuccauuaugccccuaaaucaccacaccugcaugugugugucccggacccaggcgaccuucuuccuaauuaguugcaguguccggggugugcuaaggauuuaacauguaaugucuuuuaggguccugggaaugaacgcucagcaggaacuugguuaagaugcugcacaaaggauuuccuccuggcaccuagugaggaagucagugcuguugaccuacuacgagggugacucuaagucaucucugggccuucagacucaccaggaaguauuaacacuguacuccuuuugcaguguggagaguaaggcaccagagauguguuuucuguggugacccuugaugguggagcuaaagccuggcaguggucaugggcugugcacuccaugugcagaggcagcccuuucuuucacuuggguacagagaagugggacugagaccugugccuugcagugccuucucucugaagagccucccuugagacaccccauuaccuucuccuuuugaugagaaaaugcagagcucaaaccaugaaggguggcagugggggaggggacacacggcgcagcucucccaucuucugcacucacuaccuccuuguucucuuccuaaaggaccuccugcuccagguccucaaggagcugaccaagguauaaauacugcaaaauaaacaagaguggccaguugcagacacauagacagaagucucugcccuucucucauuucagaagagcgucccuuacccaggaggugucagcuaacaucagcugggcuaccuuccccccacccccaaagcugagugagcccugugguuugcagcaggcuagcuagcugugugccaccucucccuguugggagagacagaugacaagcuccauuuauuuauauauuuacuuaagugggguacuuuguuuucucaaaugaccagauugucuccugaauacuucaauugcauggguuacccugagggucugccgucaagugaaccccacccccaccccacaauguccuuugaucaagcagucucuccugugacccugggugagagaagcuguucuguggccuuggggaauuaaggcucugcgguuugguuccccauucucucagggcucauuuuauuuguggauguguugacuuugaggggaaccguuaaauguugguuucugauauuuaagcaguuccuccagaauuuauuuauuuucaucaaguuugcugaauguaagaaggaucucauugagggggguagucaaaagaagauauaaaacauuagcuucuuaucaaucugcugucaaauggcuauggaaugccugcuauacgccgagccuggucacaacauaugacaguugcuggccugcauagagcuuacacuucuguacaagacaaugagcagcuccacaguaauuacugcagugagauuucacagcaucuugcuauugcgagaagaggacuggccauuugaaaagaagcaguugaccuggacguuguuucgggaugccuucauuaaggcagaaaguaaccugaguggggagacaaaaagaugaggagggucuagcuguggaaagauucaaguggcggcauugaguggcugccacagagcuguuugccagaagacucggauuuuuuuccuaggguuaaaagaaggagugaguaggugaucauuagggugagugcugaauuaccgugucuuuuucucaccacccugucaguucauggugaguggggauucaggucccuguguucguucuuuccugcaucucucguacuugacaaugugcccagcucaugacaggugcacaauagcaagugggugaguggauagaguaggaaaaaagagaaaaguaacugaaaggcaguaaagggcaguggugggugcuccagauguaagguuaguugaagagucauggucuuacaggacucagugaucacccagucaggaagacagagaugggccuagauucucaggagugacugcagggagcaagucagaaucagagagucugcaaaggaguagcagauccuguguugucaggaccagaaguuaaaauccaugaguuagaagaaaggacaugagcaagaaaauauaacauaggcgauuguuggacagaugcuggucaaagggguuugucaguggccagaagagccaggguaccagcaacugccuguucacagauggaagcagcagcucuguggggugggucacuaaguugggagaugcgcauauaagagcuagaggaauuaggggccacugcagaucggcaaggagguuauaguucuuuccagcuuuggaagccuagggcaucccuguaggaacuuccaucuugccagaaucagguaggagacugaaagaaagaucuccugagagcaggaauuauagugucugaagcuuugucucauuccuuuggaaaugaccguauuguauuuuuauguaaauaacucacaacagugugguucuugcaagggggugaaagcgaacagucguaaaugaaguagagacaccauauuguguuuucacaucaacaauauacacuauugcuugcaguggggccaaaaaacaaaugcacauccaagaggcaagcuaccugguaauuccgaacaucaucuacccacuccuuccuauggugcaaggccuuuuuuaaaaauaccuuugucuugaagcauuuaauauuguuccgccacugucacucucaucuaagcuccugucacaugauccacaccuuccugagcacuuuuggcucucgaaccucagccuggcuuguggacaggucaccuuuaccuaugagcaugcccuguggagcagacggcauauuuccaaucacuguucauagggaugugcacaggagcauagagaagacaaacaaccucauugcaguaaucacuacaaccauuuuuccauuuuugucaucuguggaguuaucaugcgcgcuguccauugaugugagaggagagcuucauccuagcuaagccgcacggaaggcagagcgagugcugccccaaguucagcuguuucuuugaaguucuccauguugaaaaguucaggccuuaaacucccaggcacuaauaagcagaaugguagaccauuugcaaagcuuaugaccugccuaggaucuccauuuaauuuggggaucuuaauuguguccgucucaugguguugagaaucucuucuccaugacagcacucguuuuucugccggcugacagaagauaagaaaucagagaaguucuucaagguuuuuuacgaucgaaugaagguggcccagcaggaaaucaaggcgacagugacagugaacaccagcgacuugggaaacaaaaagaaagaugaugaaguggacagggaugccccgucucggaagaaagguaauaugcucuggcccaucggacuggagcucacagaggagcccugugcuauauugcaugcuuuucauggcuuccagguuccaacaggccuucugagcagggccuuuagaagaaagcuaccauugugguuaugccauccucucaaguggccaggacaaagcccugccaccuaggaaggucuuccugcuuuaauaaauucauaaauauucuuaugcaugcacaguucuaauuaguauggguggcauuagcuacuuuucuuauuucuguggcaaaggaccugacacaaacaaccuaagacaaaccaggcuuaugcagagcaggcuucgagguuguaguugucacggagggaaggccuggcggcagggaugugaagcaacugaucacacugcauccccagucugcaagcagaguggauucucggcuccuucucauucaagucucagcaccagcugaggaaauggugccacucacauucgggguuauucuucauacaucaguuaaccucaucaagaaacucccucagagauaagcgcaacguuguguuucuguggcaacacuaaaucgcaucaaguuggcauucgaaauuaagauccaugaauuguuuggguuuuguuuuuguuuuacuguguuuuucugauuauuguuagagaacauugagaaaauauggacuuuuagaaaucuugucuguccgugucaggugacuuuaguuuccaaacugcaaacuuuuccucuauaaucucccuucaaaaccaaaagaaaaguacugguggugaaggggugaguuuaggagucacacagccuugagcaaauuaauuaaccacacugaacucaacuucccaagguuagugcuagauuugucaaucaaguaacuguugacauuuggaaaauguuccuugcagaggcuauaggauauugagcaauauuugugaccuuuagcuuguuagaugccacucacacacccauaugcccaaccgaaaaugucuccagguauuuccacuucgcugcuggggaaaguuagggagaaaaaaaaaaaaaaaaaccacuuucacuacugucugagaaccacuagucuagaagggaguauaaagagaaggagagaaaaauaaaccugccaagucccgcugaguacugaauaugaaccagguguacguuagccaucuuucuguugcaguaauaaauaccugagguauauaaaccaaggaccagggaauuucugucugaguucagacuaauugagguuucagucuaguugcuuugggacccaccuuggagcagcacauaccuacuagagcagagagcagaggguaaaacuguucaccucacggcagagaaucagaagaaaccagaacagacaaugucccacaaucccuuuagggaaacaccccuccuacuaacuuaugaccucccaccaagucccaccucuuaaagguucuauucauucccauaccacuaaaggcuggggcccaaaccuuucacauaugggccuuugaaagacguuccuaaauccaaauuguaagcagcuauuguucaaaguucuuuaccuaucugugucaauuuauguaaaccucaaguuaacccuguacuuagauaaaauggcuaucucuauuuuacagauaaggaaacugaggcacagauauaguaguaggccacugagccagccuuagagcccaugcugucgauaccccccagccccaccuaugaugccguaguuaucccauggggcuauucuucagaaaagauaagauaauacacacagagugcuuacucaugauaucuuggcacuuggcaaggggucaauuguuguccuuccaguaacaguaauugcuguugucauuagcauuacaucaagccucucaggagccuucuggaaaucacugaugugcucacauuuuauggaggaagaagcugaggcucggagccacagauuauggggucagcagagccugcacuaaggcguuuugcucuauagcauagcacagaccucagugaugugucaaaagcauuauggaauuagcaaggcugggcucuacauuccgccuaucaagagacugagagaggagaugguggcuuucuggauuguuuuuuccaaguguacagaucucucacaaaggcgggaaucugggcuucuggcugguauauaagauauagaaaauagaacuucugaggauguagcaguauuaacuaucacaaguuugccuuuuagccaaagagcccacaacacagauaacagaagagguccgggaucagcuccuggaagcaucugcugccaccaggaaagccuuuaccaccuuccggagggaggccgacccugaugaccauuaccagucuggggagggcacccaggcuacaaccgacaaagccaaggaugaccuagagaugagcgcugucaucaccaucaugcagccuauccugcgcuuccugcagcugcugugugaaaaccacaaccgagaucugcaggugagagacugggcuguggggucccugagaccucuaggagaggcgaggcuguggaaaccuggaaaugugcaagaggaguccuguguaggggaccuaaauauccucagguggggagccagaugaugggaacccagagaccuccaggagaggguucuggguuggggaaccugacacuggcaggugaaagccugggccuggaggacccugaggucuguaaguaauugacugaagcccaggaagccccagcauuuguaggugaggucccuggagaccucagcaccuagaggugggaguuugggguagguuggaccgugguguccuuucuacucaugguucagcuccugucacuuaggccagccucccugaauugaggauccaacauuacagacuuucugggugacuaguaauggaaauaugggugggugaucuaucccaucaugucuucaccauugucuccacaagaucaaacaaagauagucucauucauuagggacauuagcuccauauguagguuccuaugugcauaugucuuauagccuacugcccuuugccaccaauaacaauagauguucagguaauaauugaagagaugaauagacuguuaaauauauuaaguacaugagauuuacaaaaucaaauacauaaaucugaguauagcuguguauugcauaaagacauuguaguguuuggaaaaucauauauacaacaguguguucuacauguucuagaaguuuaguaagcuggacucgagucuagagcucgugauauuaaccagacucuaagacaaggacaaggcauuaccuugcuugaaguuuccuuguaacaaagacuguuuagaaagggcacagagggugugcuccagagauccaacucuuuguuccaaaucccugccccggagagacgugcuggaucauguggcccuugguguacuacugccuggcuuuccugucaauucuugaaccuuaggugccugccccuuuuugcuugagugguguuaggauggaaaggaaaaguauaucugcauggcucuuagaugggauaucucuuccaaagcuaaacaacucagcauugguaguucuaugagcuuaaauggggauaugagaggaguugauacacaccaaaucuagcaagaggaagguaccuccuuuaaauguuuacauugcugacuguaucuaccgagugacuaugguuggaucauuuaguguugccaaguuaaccuccaucauaaagaaaagacacuugaagaauaauacagaacaaugaaauggaacuaagagacaucuuuuaacauuaauccauccgauuguuuuuauuuuaucaaauuucucuaaagacccugaacuuugaaaaccaucuaauuucuagggucaucaacugacuaaauggagccagaccuuaaaaaugaaggaauucccccguaagacccaccauuggccaugcuuacccaucaugugccaagguaugauuggcagucagugguccaguucaggugucaguguucugagcuugaccuugucaccaucugaggcugagauccuggaugucccuuugguugaccauugcucaaacuugacugcuucaggcucauacaccuuaggcccagaucuacugaaugagacucggcucaggcugaacagggccuuucuuuucccaaagcuccagggucuggguauugucucauuggcuggcauuccugugucucaugauggugaugaugucaugugucccucuaucuuauaacagcaucauuggucagaagggagauugacuaagggaagaguaagugauguguaugaaucuaggcccaagcaguucauuuguggcaucuuugugacuugggggucccacugugcugcaaagcauagagauugguguucuguacuguuuguucuuccauguggugucacugaccaccaccaacuucaggcuccccaaaagaaauagguggcaucaauuccugucauguacacuggaaaacacauaagcaggacccagcacuaacggugaucagcccucacucaucccucagaucccaguguauggagcaggaggacugggaccaacgagagauugcaauacaacaugcuaagugcuguaaagguccaaacagcuaauacuugcugaguucccaucuaaccaaccaagguugccuucugguuucauggacuugcccugccuuucucuuccucuccccgccacuccccgaccccccaucuccauguuucuagaguaggaaaauagagcuaggcccuaacugcucgauuagcuaacugcacaaacuacaugauuucuugcuggaauucuucagaacuauagucuuagacuuuaucuuucauguaucucuccguccacuuuacacccuggggaucucuggagagugcagcuuuuaguaaggucuuuauacugcucuagggaaaauuggggcugggggugggggacucguguguguguguguguguguguguguguguguguguguacaguugugcagggugcaggauagacucacauauuuuaaaaagaccuagcaagguaacguuugaagguauaugaagauuuuccaauuaggugguucuaagcaacauuuuucuucaccauagaauccuuuguuugaagaccucuugugcagagaugggcucaagcugaguaccacagagcaaaacugcccuguugagaguggaaacuagagagucccagcgccuucuuccccuagcccucaucuguaggagcucuagagcauagggcucaguccugggaaccucaggugucuucagggaccugugguguucccggauccacuggugggggugggguagguuagaaccaucuacuuaaagcucucaagcuauguacgagagugcaguaaugaaacucaucuuucaguguggucauuuuaaaaaucaauuuuaaggcagaggcaugguucucuacaaaucaggggguaaccugccccacugacauuacauuugugagacacuaguucugaaaaugacaggaaguaauguguaccuacucagaauaccaccuuuuggcagguagugggauacuuuuguacuuaucagaugaguucuuaaaagaugcuucuaaccuacccgccucuaccaguggauccaggaaugacccucaauuuuucuuaugacugccaggcaggagugguuggcucccuggugcaaggaaacccagauuugcucagacagaggaagccccagccuucugaggcagcggucucugggcucgugccaguuucuugucauauuuauaaccuugacuuuccuguugguagauguucagugucgagaaagccacugaauuuggccuugccaagugggccaucacugccuuaagcaagcccugcuuagucagaaaccugaugaaggacugcccuuucaccagagugugugguuuugaguguuugcugagcuugagcuuccccguccccggguuaaaggcccaaggcuacaugagcacaggccugaaaccuuuuccuuccucacccaucuccaucccccacuucacccucccgaaaagaccggaguuucuucaugcugacgaggcaaugugcugugugcuaaagguggauugacaaagcuucccugggccccucggugagaaguaugugucugucuguguaaaagauaggaggaaauagagcugaguuuaggacaagggagauuccaacuagacacugcaaaaaccaugagagggggccuucccuggagaccacguaaacugauggccuucuuugucuucuuuucuccauuuguucaauugaauucagaugauugcaaucaguuuugauaaagcagcuagauagugccagcccuguguaagcugcccgagacacugagccggggauguucucagugguaccaagggaccucucccguguggaacccacacugcccaccugcauugaaaacagaaagacauccuauaaggcuccuguccauaacaugggggugcuccagaggcagacaggauuuccuggaugaagugacuuuacacuacauccugaaggaagaggagucagaggagaggccaggagagugugugagacagaggaaauccuaugugaagccccagaggcaaaaaaggaaagagugcuuaggcaauaaguaguugauugcugcugccagagagcacugcugggggagcagugacgucacgcagcagagaugaacgcacugggaacagugaugucacugugguaggccgcggaagggaugcugugaguuugccucuugagcauccagauccuuucaaugccuaggcugaggacccuguaacccuguguguugggggcccugccaggccuuuagacgggcugcaccuuccuuugguagucauaacaaggaauaaacugagugagacccuucuuugccuucccugaaaaaaaaaccuacucacuuaccuuaggaaagcccacaggguaggaccccugaguaaccugugccuccucugaacccuaccggaaccuggauccuuaugauugaguaaaguauuguuuuaguauuccccaguugguauuuggguuguuugcauuucuccgcugcuguaaacagugcuaucaugaguguccaguauauacuuuaugaacagaaguggaaucacaucaaagcucauguccacugugccuuucuguggauguuaucguuuuuacuuccuaauuucuacaguaaacacugcccacuuucuuuuuuuuuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggagggggauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccacuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuucgaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuucccacugcccacuuucuaacccugagauaaauaauauuguaguugauuugugucuuaugacuggacucucagacaaguuccucuuuauuagaauucgcagcuuugcaaggcuaccuagaugaugcuuucuuuaucuuguugaggaaggaucucgcuuuguuucucuuuaguagggaaaauggucaugagcuaccacuaaacugugugugugugugugugugugugugugugugugcgugcgugcgugcguguguguauauaguaagaaaguuuuuucagugacagugauguaaccaaggugcuaggcaggcugucuuccucugagcuaaccucccagcccuuaagccagccucuaacaucucucuuuguaguaucuauacuuagcaggagucuuguauucagcacacacaaccuccuaaccauccaauaagaacaccauaagcaaggauaagggaagaaguaagcagaggggagggaggguccauugguaaagugcuuguuaugcaacugaagcccagaguucagaucuagcacucauguaaaaagcugugcauagcagugcaugcauguaaacacacuacucaguggucccuagggcucacugugcagccagucuggcuaaguugaugaacccuagguucagugaaagacugugcucaauaaauagaauggagagcaauuaaggacaauaccuaacauugguaucuggccuccaugcagacagacacacacacacagucacauacaccugggagcauucaugcaugcaaacauauaaacacauccaccacauauacaucuguacccagauuaauuuuguuaaaggaauaaauggaaaaaugaaaauucauuccagaggaaccugaaauggauuuucaagagaauugcuccuucccugaaucucauauagauauacugaugaaaaagccagugguguagcuauagagcaagaccauugcuugacaaucccugggccaugaagacucuucuagcccauauugcaccugcuuucauagcagccuaucauaguccugauuccaggacaccagccuaccagagagagagaaucaaaguagcagcauggaugaccuuuuguuguuguuguucuuuguuuuucccuuuguucaugcagaauuuccuucguugccaaaauaauaagaccaacuacaauuuggugugugagacacugcaguuucuggacuguauuugugggagcacaaccggaggccuuggucuucuuggacuguacauaaaugaaaagaauguagcacuuaucaaccaaacccuggagagucugacggaguacugucaagggccuugccaugagaaccagguaauucuguuuauacucugggaugagagcaagacauacacauuuuugaaaagguuaacaaaggauauaaaaacccugccuguggcucuuagggagcuccuaagacaggagcuccuucuccagcaggggagacauuuccgugccacuucuucacaauccaggacuugaccuugacccagugaguacaagguugaccuugucuucuuggcucagucuuguuugaaucaaauguccaauuguaacugacuuuuagggguaaguaagaagguuggaaugaaagcaguaccugagaguugugacauauucuaaauacuagaaaaggucacaaagugauucccugaaacuccucaaaacccagcuaaguagaaaacaccugcuuccugugaaagugcguggacgcagaggagaacauuuuuaguugagauuuaacgccagggucuucugggaaaggaaagaccagcuagccuugcccaagcccacaagaagugucagaagagucacuguggaguagagccuauaucuuucuucuucuucuucuucuucuucuuaagcagaauccuugcucacacauggcuucuggaagguucuaguuuacacuucaaggcuagacugacuaugauuuuuagcuccagaugguaguuccuuccuggcuggagagcuggugggugaaggcuugaaauggucgguucuauacuccacgggcagggaaaguaugaggugcuaaguuaguuaggggaggugggaccuucacgccaaggagagcaguuuaaaguagacaacuuaccaucugugaaaacaguagucuuagugugaagacauuuuugguagauccacuuccuucuccuggaaggagaugguauaggucuagugauaagaaaaaacagaaauacaccaauucuggacauauguaggugaguuuucuuacuaccucaaguuuauuuucaugcuacaccaagaccuauugaaaggaaccaacuaggcuggcuuguucugcagucaaggaaccuaacuggaggaugcuguuccauuuugauaccauacagacugagccaaaagcuugcucuccaagcuuaagccuuaagcagaaguaccaaauucacaagaugagugauguagagagaacggaacacaauuuuaaaggggagagggggcucagauccugguaucagucacacaccaaauuuuccuauaagaacaaagucgacugcacggcacuauuuggauuagacucagccaauuuaucaguuaggguguauggggacuuuccuacuguuuacuguuaauucugaaacuagagaucuucaucugucuuuuauuuuuaccacuuucucacggaaaauugcacucuccccaaaugacauuacugggaguggugagcauuguguugaaauagcaguuuagccuguuagccuuugacgucugauuuauggccagcauuuguguaaaugcccgugugugugcuugucuauauagaacugcaucgccacccacgaguccaauggcaucgauaucaucacagcccucauccucaaugauaucaacccucugggaaagaagcggauggaccugguguuagaacugaaggcaagugggaacgaagagcuagaggaggcagccuuuggcaaaagucaauguaugcuuuaccuggcaugugacacagaugguauugugaaacugaauaccaaagacauucugauuaacuggucaaaugacccacauuguccauucugaccgaaaaugcagaacuuaccucuuuccaaagaagggccuugggaguaccagcuuuucaggucaccuagagugaagagcuguccccaaagcugagaaacaaauucagaaagaaugaaaagccucaauuaugaaaucuguugggaguuagaaggagaaagaaaggccauuucucuaugguuucugaucuuacugccuuuggggauaggggccagcagaaaaacaguacaagcaagcccuuccaguaucucaaaaaauauauauauauauauauaucuauuuuuacuuaguuaagggacaccuuuuucuguucugucauuggcugugcagaaggguggcuaauacuguuagcuuaaaauaagaaugugccuccaguccucugaugaguucuucaaauugucacaagugggagaucacagcugccaagccaggagcaacccuagcauuugaugccccgugaaaacagcuuuauggaguuaaauaauggcuuuaaggcacuuauucuuugggguuuacuagcugacagacaaucucugaaggucugugugcugcuaccucaaugucuugcccuuguucuaggguguguguguggggggggguauuccagaaauugucaaggauuaaaaaaaaaauccaauuuaaaaauugaucuugcaacccacccuggugugggaugcuguuuggaaacguguuagcaucgcugagcacauuuccucuucugcuguucccacguuagggcauguugagaucuguguucucucuuauacccagaggcaucaguaaggacuuuaucaugacugggaaauagccuugaauuacuaaggucagcugaaaaguauuuauugcaugaaaggcgacagaagacaaggccuuuggaagauauuaacacagacuucuccaggaacuacaugguuaauuuuauuuugccuuuaguauuuagaacugagaguccaaacucaugguugauuugaacauaugguuuaaguggaauuuuuuagcacuuuuuuuccuucugauaaauacuuuauacuugacuugaauaucauucaagcucucguauggcuaccauuuaucagaaaguacauggugaguaucugaaauagaggagacacgccuguguuacugguugacauuucagugccuuuuccaauaaauuuagccaucugaggauugugcuagaaagaccgagagcacaguaaauggacugagcuucuacgggaggaaaacuggucucaacuuccaaccccuagaaagaaaacccuaacuuuugaggccuauauacagagaaguauauaaauuguagaccugggaccucaaaugauaucaagccacaaaacuccagguguggacacauggacauuauuaacauaauaggaaauuaugccucaguggaugugaaguguuccuuggggccacuuguguuaacuaauggcauacguagucaagcuaucagaggcaugaaaguugaugcauuuuaggacagggagaaauaacauuuauugacugucaucucuguccaacaauauugaguaacaaaauacuuagggaaaaaagauuguaucuauacuauauguguacacacacaccuuuugcuuucuucuuacuccccagaguguugauacagcauuugugcccauacuaggucuuacaaauaauauaaagaugaaguagacaaagaaaaaauacauagauuauauaugcaaauguuauuccaugaaauuacagugagaagaccacacccaccugcacccuuguguaaguugccuauuucugcuacagcugcuggggugcuuacuagcuaacaaaccauuuuugaaggcagugucugaaaugugcuccugaacaaucucucacccucuucugaggucccagggguugugaaaguuugcaaaaauguagugcauguccugacagauacaggccucuuagacucaacucagccucuguccguaugcuucuaagcuucccaggagcauagccccugacuggugaagguccucugcagugcucacccgugcagcugggcacauagguccaggcagcugcccaggcugcuccuccauauuucuucccuugguucucuccguuuagaacaaugcuucgaagcugcuacuggccaucauggaaagcagacacgauagugaaaaugcagagaggauccuguacaacaugaggcccaaggagcuggugaguugcugcccaucccuugacaggagcaccacggaacucaaagugaaauuugggacagaauaaugaaccugcuucuuugagcuucugaaaacauucuccaaaacagaaccaucaaggcugauuuaauccagccccaugacuacauagagaaauauggcaguggacaugggauguuucacauugaccuaucagcacagaccacguaugaaagcuucccuccccuuugcucgcucauggagaccagugugcagugagugagugugcagugagugaguguacagugugcagugggugugcaaugugcagugagugagugugcaauaugcagugagugagugugcagugagugaguguauagugugcagugggugugcaaugugcagugagugagugugcagugagugaguguacagugugcagugggugugcaaugugcagugagugagugugcagugagugaguguacagucugcagugagugaaugugcagugagugagugugcaaugugcagugagugagugugcagugagugaguguauaguguacagugggugugcaaugugcagugagugugcagugugcaggucuggugcucguucuuuugacugugucagcucacacagcucuuggagcucucugagcugugcagcuuuccagaucuguaaaagagaaaguaagauuccuuacguugaaggguuauuuuaaagucuagaacacaagagucacaucagacuuuuagcauggugccuggcauauagccucaugugaauugagguccauuuuccucucuguuuucaugauugggaagcguucuaccacugagccacauucccagcacuugauuuugggcaguuuugcuuucuucuugcaaggaagcaggguuaggaauaauaggguaagacauggucccauguaguucaggcugaucucagauucacugugcagcucaggcuauccuugaacucuggauucuuuaccuccaacucccugggaggugggguuaugggugugccauuccccccauucccugacagccuugauuguuugaacggugacuugcuguaccccagcuuaugaucccuuuaacuucaugcgccgggaugacuggugugggucaccacacauacauagccuacuaccacaucuuuuaaagccuuacagguucgcauauguucuugguggaguugccugaacaacaggagagucuauuuugaauguugguguuugcuuuuuguuuccuugaaacaugaccugguuuauuuucgaagggugacauuuaugauagacugugacuccccaugcugggaguugaugguuugagcugugaaaggagcaguguucaaggaugggugauaugagcugagucuauuuggacuuugccccaugcaaauaaacuguaaccgacagacuuaaaugagggcauuaaagcauuucugccuccuggugaccuggaugugcacuagaggccagaccaaagucccuuuauguauccuuuaaauaaaaguucacagcagccugguucuuugaucccugaggucagggagugaguucuccgcagagacaggauucucugagaguuuacauaacagcuuauguaacuggggggguaacuggguagccaagggucauuauuuaguaggaucagaauggcccuugcauaggucccauuucauaucauaugaauuaagaauaugcccugucucuucaagacugucauggguagagcaaaugccacgaccccuugcuauggcuccaccaacuccaggguugccccaguugguuagagcacauuauucuggaucacagaaaggaucaagucuucuuguagcaaccagggcucuaaggagacaaacaggaaggaagcuugaaaaugcagaacauauccgugugugcacauguaugcaugcauacaugcaccuauguauguucucugcauauauaguauacugggcuugguuuuaaaacugcuuggaaaacaaacuuagagagugagggucucauccagcagcuggccgacugugagugcagaauauguggcugcccacaugcuuccucuuggauaaugagaaggucccagauaacggccaauggcaaugaaaacagugccccaggcugaaguaccuucugaaucauccaaggaaaugauuaauucuuaauauaacugaacauauuuacucuuaguguuugaauuauuaaauucugaaugacauguuuauuuaggaaagcuugacagagcagcgugccgagugccacggggcgggauuuagauguaagcagccccagcugcuucccccggggaaccaacgugagugagaaccgucagcagauagugcagugcucucagaagugugcuaggagguugugcggaacccuagagucagccaggcagcugugaaggguaguggcuaaguucaaauccuaguucacuaaccaugaccuuagcaaugauguuuugugccuucauuucuacaucuaugaaggaagaguagggacuucugagaccucacagaauguuugcuagcauuacauuuuaacagaaaguaguugcgcuacugucucaaaagccaauggauuucuuacuagucugcacucccccucaccaacuccccaaaguagcagugggauaaggaaauuuugggggugggugacauuuugccauuuucaaggggcuggguaguacuggaggugguagugugugucuccaugcauguucauggugguagugguggacauauagagaucacaaacaggcugucucucuccaccguagguuccaggauucaaccugaggccuucagcuugcauggcaaagcccuuuuagccaaucaucucaacaauccguuguuccccuacuagaauuuuuuuuccaccaucaacuuccagagcagaagguuauaagccagccauugaauguauugguccaagcagagugaaccaacuucucugugggugaggguggugcuugcaccugggaucguuauaacugaggagucugggcugcauccaagccugauggagugggcuguaguccuuggggagcaguguuuguucuaggaguggagacagcugucuaagcuauagaugccaguccugcaggggucagcccugagucacgagaugucuucucuuguuccuacccaaagguggaagugaucaagaaggccuacaugcaaggugaaguggaauuugaggauggggagaacggugaggauggagcugccucacccaggaacgugggccacaacaucuacauccucgcucaccagguacagccuucucucucuugcccuucuacacaucaccagcaugcuaagcuagaggcacccugagacugacucuuccuggaaagcuuucuucuagcacugguuguacccaugugaccauggcuugcagcuguguuugcccaccugccuuaaggggcugaauucccggacacugccauuuuccuaguaugguaggccggggacuuggaaauccccaugcucuguacauaugucuucucuuaaggaugguugucuagagcggcugaaaaggggucuugggcaucuuauaaauacuaaugagucucuccuaacaaccuaaagaaauaaacuugagccuccuugauuaucacauuuggggaucugugggaaccuguccuuacaguuuccuuuuguuugccuuucugggugauacuuucuucccugacaccaacaugccauauuucauaaucaccucccaagugucuggguuuuugcaguugcuucuuuggguauacuagugucuucagguguuggguggggaugggaaagcugaagcccaguggagauuaaccucuccuuuccuuagccucuuuuaaacuuagguacaggaccugggcauaauacaaagaaggcaagaggccuggaguuacuaggucucugucucugcauguguacugaaugauuucagacacuccccugucccacauugccuccauacucagcaucuagcauccgaaaggguuucucaauagccccagaauggaggcuuaauggggugcacagaaaacuucaugucccuccugccuagcuuaagaaaucagagaaaagggguauucugcaugggcauggacuguccauucuuuuaugccagacucccaaaauagccucugcaaagcagagcuuuacagagggagcaagccucucuuuagguaccuuggccuuuggcuuacugcuggucauuuugcaauuuuuuuucuaaacuccgaaaagcuggguauagcucagcugauacagugcucaccuaccauccaaaaagcccugguugcagugguguacaucaauaaaaccagaauucuggaggaagaagcaggagaauggaaagguuaaggucauccucagcuacaucacaaggucaaggccagcccgagauacaugagaaagaaagaaaccuggaguuuaaaguagcucuuguaauccuugacucccaguuucucucugcuuguggucuaguuggcucggcauaacaaagaacuucaaaccaugcugaaaccuggaggccagguggauggggaugaagcucuggaguucuacgcgaagcacacagcacaaauugagguaugaaccagucaagccaugagcagggaguacucacuagcaaggccuggaccugcaguagaugguacccuauaccaggguuggcauguucucacugcucugagcaauaaaaguguugaagugcuuccuguuuucuagcuccucccacuagguacuagauuuccaguguugaucaaaacuaucaugauuaacuaucugcuuaacaugcagaggggggacacacugaucagauccauauagauuugauuauauuuucuggccaguugcuaaagcaaguagguagggcugaagagacagcucaguugauaaagcauuugccauauaaccacaaggacccaauuccauguccagaacccacauaaaauauccagguguauuaucaugcacuguggucucagugcgucugggaaggcagagguaggcagauaucuggguuugcuuggccuacuuagagacagguccgucaauuuuggagggagaacugccuccaaaaagggacaggguggagaaagugccugaugauugauaggcaccaaggguuggcucugaccucucucuauguauguacaccaguacccacccgcacauaggaacauacaugcacaugaagucuagcagagggaccuguagauuauaggaggucuguucagaaggaauggaauccagagacagagugaaagaacacaggacugaaccgagcagcucccagagggaggagcuuuccuggucccuacaaggaacgaacgacgagguaaggggcacucaggagaaggcaugcugacuggaagggagugaaucagugugaaaaaugugcacgucaagagaggaaaucacguacacacuguccuggaaagacgucugcacuucauucucagagcaguggaauugccagcauuucucccacagaaaccccaccauccucuaugcauccuaacaggacaaaacacucagugaccagcuccacggcauaacaucaucucuaccuggagagugcagaagcagcucuuccauaacgcucagugaggaugcugacuucucucacucucaggcucacagcuagaguaugaaucccaggcugucccaccccugaucuuuuaugucaccugcauugucuuuuagaaucugaaaagaaacaugucugacuccagggucuagauagucaggauauuguaccuuguuuugcuaauggauuuaucaucauugucuguagagggauucuguagaccuaagggacugguugggugcaaugacaccuucaggauggaggcucuugggagucucuucuuaccugcugucucagcucuccaggccacccugaugaaaugcuucguuugaccaacucagucagccaggccaaauguauagucuggaauuauugauucuggccagaagcuuagccagaaggccagcuagcucugucuucuucauccuucaggagauaagcauggcaguggagaacguuaaagaugaauagaaucaggagguauuguucaacucucuggcccaguugagagaagacugaagccugaccgagagaaaaggcaugaacaaagugucuuacuacuagggauagagaaggaaugcuauucuguccuccugauucccacccaccgcuaaaucuacccaaauaaggaaauuuuaaaaacuguucuagccucagaauccaguccuugccuugccaggacccucccuuugauucccccgagggcuauguaugcagaucugagguacugugcagauccgagguacuguggcguagcugcuugggcuuugcuaacagacucuggacucuucacucuucagccauggaaugcaauucuugccagaagucucccucuuccuucccuuuuccucaugaagccagcugcauaccucuucugugcuuggguccuaaugcuagucugugaagcagguagccacuucauaacaaacauauggaauaggcccuugagccugugucccaggcagguucuagggauuaaccacacgcuacacuuccaguuaaaccagguuggcuuugaaccaaaaccauucuaacagcagagugauucugagccccccacaccccaaaaccugagcucuagauagauucagaaggcccugguauaaagaccauuuuccucuguacuuaaugcagucagagcugugagaaccugucugaccuccauaagaguuucccacuccaacugggccugagucaucuuucuugccccaucagggaacaaagguauugagagagggagcaagcucuuccugucaagggcgucagcccugggcuucaccugaccuccucagcuucuggagaagaaugcagaaaggccaagaggccaugucucugguguacugcugccugugaccuuuuagaacucucugcccuugaaacugugacuuaauacuguguccuaaaauuggaaacaggcuacucuggagauggagcccaucuaaggaggaaauggaacaaaccugcagccacccaccccugcugcagcacaaagccaguuuaaggaacacugauguccucccagaggcagugggcauauugguucagaugucaugcauucuagacauuaugacaagauguaagaagucauugcaacugugguagaaaagcaaaggucugcucuaaaagaucuuauucagaguuaacccaguuuugcuaucugagaaagaauagugggugaggcguauacuaugacccagcauugcccuaucuagcaugauagccaucaagcugugccuguuaaaucaaaauuagaugcaagcaauuauucuguugcucauuugcgguaacugcaugugccucgugcuugguggccucugugacuaguggcuguccucguggacacaccaagaacugcccuaucauuauagaaaguuccauuguacaguaccagccucugcugaauguucugaagcacaguauaaauuguuccagaugaaagcugaucauaucuaaaggaaaaugagaaauggguuucccaucuguucauuuugaucaacuaguuuuuacacucugcaguguuggugucuauugcugcugaguuuuagcuuggcugagcuugucagcuugugaaauugagcugguugucuuuaagcuuaucaguuguuuguugacaagcacuucagcaauguguagucaugguuguacauuguuuaucuacagucucaagacagcaucauuuuaaaguaccuugggaguauguagaguuguaacuauaauacuuuuuuuaauucuagugauuauuuuuuuauuaaugauuauuuuuuuaaaagaaauuccaugcuacagucauaagauuaaaaccaguauuuaaaaguggaggagcaagccaggcguggugacucauggcuuuaaucccagcacucaggaggcagaggcagguggauuucugaauucgaggccagccuggucuacagagugaguuccgggacagccaggguuacacagagaaacccugucucgaaaaacaaaccaaaacaaaaaaaaccaaaaaacaaaaacaaaaaaaaagugaaggaggauuaagauguuaaggggggagguugaucauauuuucauauuuaaaugaauggagcaugagguuaagcaaauucauacagacuuuacaaaacuuuuauguugggagugugcaugcacaaaugcacacaguuaagggcucucaaaucagacagauucauauuauccugagccuugaaaucagaguucacugccaauagcaaagaaaaagaguguguguaaaagacuuugagaauagccgcuuacccuccauguuaacccuagauugucagacuggaccggacaauggaacagaucgucuucccugugcccagcaucugugaauuccugacuaaggaaucgaaacuucgaauauauuacaccacagagcgggaugagcaagguagcaagaucaaugacuucuuccugcgcuccgaggaccucuuuaacgagaugaacuggcagaagaaacuucgaggugagucacagcgcguuggacacgcucugggaauguacagcucugaggcuucacaccugcccaggggagugcgugcaccuccaaggacaagcgagucaggaacgguugguguuggugugccccuuugaaugcagagaacuuugguaucuuaauauccagguucaaucuaagggcccuaaauggacuacauucacacagcauuugauucgauuggccuaggagcuucguggauggcuuagcgugccuguaauuuagguguuucccuauggaaacuaauuagacagagaaaagcccaggccuuuuccugcccuggaugguucccucgggcugagagggcagacuggcacaccuguuccugagacucucucucuucccucugauggaguagcucagggucagaacucccagucauuuuauaggcaguacaguuguuugccaucuaagauacagcguggcucaccagcaggucccaugacaaagccagccaagucaaaugaagauuacuugucuaaggcacauuuauagcgcuucccccagagggcuucuggacucccaguuuucauuagcguuuuuaaugugauccuucagcaccagcaguguacuuggcagcagcuguugugaccaacuuuaaaggaccgugcuuuauuugugugugaguugggagccaggauuuuuuuuuuuuuuucaauuuuaaagccaggcucuaguugagaucuuugagacuuucugcagggugcggccaggguaagagagagcaguuuccgggaccgcuuggggcagagccaggccugccauccucaccaggcuuaccuucugccuuccuccuugcuucccuugcucuccugcaaugagaggagucgcagguccucagcaccgaggagggggagaagugcucucuauuuuaccuccaccauccacugcuucuguggacacaggcaggcagcguacccaucuccagacccucugggagccgguggguaggcaagauucauuuucucccagagaggcugccucauuguuccaagauuuuuaguaaauuauagcuaaugccuucucugguuucaaucuuccuggcuuuugaaaaauaguguuuguuuuagggaaguuuaaagacaacaauacuugucaucuaaaaauuuuuaauugccuucaaagcuauagacuaagagaaaaauggaaaaacaauaagugaauuaaacaaagcaagucuuuagaaggggagagauguacucauuagacgccgaauuaaaauagaacucacugcuuuucccgagcaaguuacuucugccgagugugcacuuuucugucguguuggcaaagcuggcuuaccuuuggcugaagucaugaagguugugaugggugugaugggaagucgguaggcaguucucccucagugucugucugucugucuacugaugugaguguuuuguaguguuaagaaaucaguauggggcuggagagaugggucagcaguucagagcccugggcaacucuugcugaagaacugcguucacuuccuggcaucugccuggccacucacaaccaucugcaacuccacuucccagggaucugacacacccuuuuggccucugugaguaccaggcaucaugugauacacaugcauccaugcaagcuagacgcccaugcauauaaaauaaagaucaagacauuugcuuuuuagaagaaauugguucugcaaacguuuuaauucuaaagcaguuuaacacccaguuugguuugcuccacagaagcccuuuccugcuuucuucuugaaagauacacacacacacccuucugugcauacacaugcuuuucucaggccaucccuuuucugacacuugaagaucacacaucuggugaagagaagacucuaggccguggaacccagaugacagagcaagaggaagcuaagagagaguuggucaugcuggccauuucuugcuuggaauuuucccucgugcuuaguacauuagagguagcauuugcuuguguggaguccuaagucauccagaaaaaccuaguuucuugaaaacaaaccaggaaccacugugacggagacaugcccuggaugcaguuauuuaaacagcuuugucugucucgggugccagcguucuuccauucuacuggugugugacaaguauaucacuccaacuaaauuacaauccuuaggaaaagacagcaugcugcaagguacggugggggacuuggcaacaugcauauuucuuccugugggaacuaacgcucuguaagaagacaggcagcauaaguagauuuuuaaauggcuacaauaugaagcugauuaugaccaggguuauaaucaagcaaugacagguuacagaaguauggggaaagacuugaaagaaggggaugaauggugguaacaugcagcaggauuuggauuggcacagccuagaagauuaggggauggggagguauguucuauugccugcugcuucgauaucaaacuccuaugcuuacaaggacaugaauguacuaucugauuguccuggaagucaggugagguucucacugaguuuaaaaaaaaaaaauccagaucuggauagggugaaucuucugccuccuccuuucacuagaaagacuuugucagucccuuuugucauguaacauaacacauucgcaagcugaagacugagguuucagacauugugagcaucaauguauguuaauugcuuuaaucauucacaaaacacaauggcuuaaaacaacaaauacucauuuucuuauaguuuccuguggucaggaguggcuuagcuggauaauuauaucucagagucuuucauuagguccccacugagauaauguccagugcuguugucaucuaagcacuugccuggcccugaugaguccacuucuuugugcucucuaauagcucuguaaucagggcauuccuuucuucugcacauagacauuuccagugaauuuggggaaucuucauggcguggcaguugcuuucuuugagugaaugauugaagagcaagagugaggagaaagccacagagcuuuugugaccugcucuuagaaaccucaugccugccugcauguaaaguauccucuucauaucagaagcauagcauagguacagccauacucaggacaauguaauuagcugccccucuuaagguauuccgucaaggaaagacuuacauugaagacuggggcaugugcuaucucccagcagagggagaacauggaaagcacagugcguuugugggaacuaccacaagguuagguuguagaagcagcuuauguggagaagggagaugguuuggaggaggaugggacuuagcccaauguaucauaggaaguguaaagauacuguggaucguuagccauaacuguauaccuggauuaauaacuguuugagcuauagaacugauuauuuauuuguuuagauucaaaaugagagcguaaugaauauuagcuuugagaaauuagacuuauuugugagcuauauacccuaguuaaagaucauuuaugaucgcuguacugaggggauauguucucaugcaaggaaugcuggcuuccaaggaccaccacagauuucugcuagcuuuuuguauuucuggacuucuuaugagcuuuugaugcauacgugaguguggagaggguacugucagaguuccugaagcugucucucagccuuaggagagacaaucaccaacguucagccauucagcucuccugaccuuuucagguguuuuuuuuguuacguguaucacaaguguccacuucgguccccaaagaagugccaauggcugcuacagccagacgagaugaauucucaucuccaguuagcuucagcaggcuugggaugcaucucaguuagacagugcuggccuagcauaugugaagcccuggguuugauccucagcaccauauaaaguaggcacaguagcacacagcugccaucccuguacucagcaaaagagguggaggaugagaaauuggaggucauccuaaccuguaugguugguuugagucuaccugacccuacuugggaccuugacucaaaaaaggauuucauuuuugucucacgacuauuuuacaaaauauuacauugcuaccuggcaguugacuggauuuagucagcuccuccauugaauggugacauuagccaucugucuuagucccuuuuacuaacuccagaugaccacuaauugggaaaacaagaucgugaauauuuccuccaaugccugggcauugguuucucuuauuuuuugaagaugaagaauuucaaacuagaugauugcucauagcucuguaacucaucaguuuugaaacauugcccgugaccaaguuccaacaugguuaucucaguuacucaauuaccagggaccucuaauugugccguaacucucugggauggauguuuccaaaggcuuggcugcuguccuaaaguuuuacgaagaagauuucacugguggggaggggggacgaaauagaguuccugucucacauauccugugcugugcucuggaguagagggaaugauauccaacgagacugucuuguggaagcuguccccugcauggccacgucaggauaaacuuagagcgcuguguccuaucuuuucucuccuggagcuuuuggauguaaacuccacugcuaacccuaucugguuuccccaguuccuugguuuugagaucaacuauaccauuugagggaaauggcaagugaguugauggugaaagggggguaacugucccgcacaagggaauugaugggguguuuaagugaagaaaaugguaccaggcccagacagaggcucagcuucaccaacucugaauguucugucucucugacauuucuaaaaggcuaauugaauucuugggcaucucaucugguacuggagaucugggggagacccagaaguucaguauuugaacucuggcuaacccucagauuccacaacugguggaguugacaggguacgaaggacuuuucgauggcccagccuuugcccuucucuucucccuuguaccccaaugaagcuucuguucaugaguucuccaaugaccugaugucaugugacugugugccagcucugaaacaaauucuuguucuuacuguugggaucaagacugggaacaagaguggacuuguagggaucuagcagaaguaagggccauggcaagcucuagcccucugacaugcagcagucaacaaccucacuggcuucaucuguuuccacagcccagccugucuuguacuggugugcccgaaacaugucuuucuggagcagcaucuccuucaaccuggccguccugaugaaccugcugguggcguuuuucuauccauuuaaaggaguaaggggagguaaccauaccuuucuuucuuuaaguguucugccuuaucuuuuugagacaccgucuugcuagaaguacaagcuggccuggaaccuaggcuccuccucuccugccguggccuucuggugauaggcugucauccugcuuuuucuguuuuucuaugguuucuauugcugucauaaaacaccauuaccaaaagcaguuuggggaagagaagaacuucuacaucacaauccgucauugaaggaaauaagggcagaaguccugaggcaggagucaaagugcuguucacaggcuugguccucauagcuagcucagccuacauuuugauuuugcuaacagagaauugcaaaaaaucacagacaugcacuacauuuugauauguucguuucuuaaauaaauuaaauacuaaguaaucccauuggcauccaggucuaaaauaaaauguuauuaaaaucuuauuuuaaaaaaaauucugaagccugagaauccaaauuuugaguacccaggacuacuugcccaggggucagaucaaccucagggaucaaucaucaaucaagaaaaugcaacacggucuugcccacaagccaauuagauggggacacuuuguuaacuuauguaccuucuucccaaaugauucuagcuugugucauauugacauacaacuaacccgcauacgggcguauucuaccauagcugguuaaauauauuuaaucucaaagaaauagcugaugacuuccggaaggcugugucugggucuuaaauccugucacugaaaucuuuagugccauuuaggaucccaguuauccauuugcagauaagaugaaaugcuagcuuuuacccaagaucuaguuuuaaaguaaacuuaaaauuguuagaaagaggaggaagagcuauugagacugucagaaauugucuuaagccccauguccuacauacagagaaagcaugcauccaagaagucaggagaaacaucucaccaagcuaguuaggugcauagcugaucucauagcauagauauaaacagucaggcuacuguauguuuucccauacugugcuucagaaaugauuuucaacuaaagacuaagaagccucuggaauguuuuuucccuuuugcaggucagagguaaggcaagucuugcgacuguagccaguacuccuugaguguuuagucuguggagaguugccugcgaccauacguggauuucccccacccauccucuccuuccagacgcccacaugaaccuucaacauauuuugaugaaaaaaaggcaaagauuaggacaacacuuaucuacuggggaccaucaacuugauagcuggcauuugagagccauuggcacugugguguucugguggcagacaugaaaggcuccucuucuguuagcuauucauguccucucucucuccucaccauguuagggacgcaauggaagcccucaugagugcuaggcaggugcuccagcaugggaucuuguucccagucccauguagcccaguuuccgggaagguugguuuuuagcuaaguuuuucuuuggagcuuuuuggcccaccaguucaccuuuagauagaacaaccugccuccuguaugacacuuaaugggauaaagaagccccagagucagacccuggaaaacacugagaauauuugaacugaauaauacagucauagaucuaagcagcacauguguaauaaaaguauacuuaaggacuuuaaagugauaacauguuguauaaugccacacacccuuucaaggacuuaacuuuucuguuuggacuuaacuuacauugaaggcacuuuuugaacggccacuucuucaccaaagcaccaucuaaacacagacccaggguguguguggggggagguauguauguauguauguauguauguauguauguauuuucuuuagaugccacuuuagguaacaugaggguuaauauuugaaaagauuugaucagaacaaagggcuacaguuuuucucuggggaguuagcuccuuuaacaaagauucuaaucaguggaggugagaguagucagggagucagcacaaaccucuauuggugacuacccguucuccuuccagcucaaggacacaagaaauuacuguguuccucucagccgauuauccagucauuucuuuggcugagcucuccucugcccuccacuccucugaagauauuucauauagacauuaaugauucaccccaacuguuuucuucgcuauucguuugcaccagcauccagaccaguguuuggggacagugaguugacacccuucaccuucaguauuagucuucauacuguauaauucuagcuauggguuugcuggccacuggucaugugacuccgugcaggccucuuugguuacuccuugauguuuccuguauuauaagaugcugacagugaagaagauguugaggcuuugauguggcuucagaaaugccuagaaggcacugacaaaauagcuuuagaagccuaucucuuaccagucaaaucugagaccccuugaacgaggugauggcugagaucuuuccagcucuauggugauacacuuuggauauggcgcccaccuuuauuagccugaaagucacaggguuuccuuaucagacuguggaucaugggcuucagaacuucauagcaauggacuuucuggaaagcagugucagagcuccugggaaugaaaagaggcugaucugacccaugaauccccuuuuacugaagcgcauuuguaacauguguucuggaaauuuucugugcuuagcaccaacuguuuucaggaaaaugguuguuuucauacugcucagaaaauauaucugguuaauuggucugcaaaugccagugugagaucaguauguguuagacucuguaggugcagcuuaguaguaggaugcuugccaagcgugaccaagaccaggauuugagcuccagcacuuccaaaauaaaauuuucuguguauguuugcaucacaguaucuuucuaaaaacaggauugcuaaaaaguaccucuuagauguuauaacaaucuaauuuuguacagugcugugguucuguggcuuacaugaccuuugcagccaagagcagcaguggccuuaaaagcuccuuuucaaaagcaucgucccagcccacugagccaccugucagaagcacagcccuggugcagagucagauacugcucgaucugugagcaugccacaauggcucaaauaaagacaguauggcuccuuaaacuuucuuauuauugaaacguuuuaacuuacucaugaguggaaggaacagcaugacaaacugccauguacaucagcccagcuugaacaauuaacauuuugcuaaacuuguuuccucuagccccccacuguaauuuugaaacauuuuagagaaguuuagacauuuuguuguuuugaccauaaauauuucagugugccucuaacuuauaagcauauuuuaaaauauauauaaccaucaggccauuaucauauguaacaaaacuaacaguaaaucuuguaauaguccaaauucacauuucuccagcugucuccaagauuucuuucuagaccuagucuccuggagucuagcacuaguuuucaggaccgaguuaauagcaucaaaagagcagguucuuaccuuggccucaggccuugggugcaaguguuguaccagccauauuuaugguuaagacauugagaaucuuuuaaaagccaggcuuuguggaaugggcuuucuuuuuuuuuuuuuucuuuuuuguuaaauuccagcacauagaaggcaaagucaggcagcucucugugaguucaaccccaaauaguucuaagacagccagagcuacauaguguggccauguaguguggcuacauaguguauccagaaaaaagaaaucuauuuaaaaauuuucaacauuuaugagcuaaaagguaagccagagaauggaggaagacaucuccaaagacuaucucaauauaucaggauguaaaugcagauuaaaaacacauaaaacacuguaauagaaaaacuaccacauuaaaagaauggacaaaguauuugcucauaugauuaacagaagaucuaaggaugacaaguggguaugugagaagauagccaauaucuagaguuaucaguaaaauacaaauuagaacagugauguauuucuauagaccugcuaaaauggcugaaucacaagacuguuaauaucaauggcuaaugaaaggcaaaaaaaaaaaaagugugguugcuuugguuggaaaguaguauggcaguaucucacaaaauuguacauucuguguaagagccagcagucuacuucucuuguguuucugcaaaagaaaugauagcaucauuuccacuccaagauuugcacuugaauggucuaguagcaacauucccaguaccucugggaugaccacagacaucaauccaccuagugaaugaauaaauagauuauaaauugcuguacauacauagugcggacuauuacucagcagcaaaaacaaugaagugggaguagccaccaugauucuuuaagcacuuguuagucacacccaagccuaccucccaauacaguuauuucuccauuuucaugagaacugcaagcguauaguaacaggaagcacacuggugguauccgggaguggggugaggcaacacaugaacugcagagaccucuaggcagccugucagggugcucguguuugucagggugagcacauucuaggucuugauuguggcaacaacauccugugauggucauauaacaaaaaacugucaaaauucuugauccaugcgcacagugaguuacugcuuuuauuuuaacauuagcugaagacuguuaacauuaaaggcauguacuuccagccguuuccuaggucacuucggauaaaaugcauaaagacuggauugcuuuuaaaguagagguacugcaccaaccuagguugcuagagugggcugagugaacgguaauuaaugagaacaggagagacagcaggaugugugacaguuguuacaugugcacaaaaugcuaauuugccccaagaagccacguuuuuagcuuuuaucaaccuuauguaccuuugugcccauuucuuuuauuuucugugcaugagguauacguggucacaugugugugagcacacguguuuaugcuuguguguggagguucaauauuaacaaugcguguguugccugaccauucuccacuuuguauauagaggcagggucucucacuugagcccaagcuagucuaccuagcuagcuugcucaggggauugccugucuccaccuccuacucaggaacauuacaggagagccaccacacccauccaacauuuacacagacaguggagagagaccugaacugccacuuugugcccauuuuaaccagcuuuucuuccuuaaggauguugaaagugaagggggaaaagauaaaggcaaguggcuggcucuagggggacaguuguugaagagaaaaugccucagguggcugucacuuagcuggagaaagagcagccaccugcauagguaccuccucuugagcugggcuacacuccuggcuauucuaaagaagaaaaucuccuuuauauaaguguccugaaucauguagcccugcuuguuuacauccgagggagacucggaaugugacagcauuugcaauagggguguuuuauuuuuuuuaaugaguguuuuacagaacuguauuuuuagccacguuggcucauguuauguaaccaagacaucucgugggacacucuaaauagaaccugaaauagcaagagaugacaaaaacugguagaagcucguuaucuacuggguuaaucuaacaguagaugaugcucaaaagccggaagucgccuucccccuucccuugugaaaaucaaauugagccauggaaccugcaguuugaauucacaggucuuaaauauaaguaagcuuaggcuuccaguuccuccuuccccuaaagugaauucugaccugagaaugaguuuuauuuauugagugagaaucugguguguccucugugccacauacuuuccucaagagucuagauagaagacagacaaguaaaaugaugguuagcaaaaagcagcauuugagguuggggaaauauuucagacaguaaaagcacuggccacucuuccagagaaccuggguucaauucccagcaccuucauggcaacuuacaaccgucuguaacuccaguuccaggggaucuggugcccucauacagacauacauguaggcaaaacaugaguggacaucaaaauaaaucuuaaaaaaagaaggaagggaggaaagaaagaaaauaguaguauuugagccaagaguguaguucuguggguagagcacuucccuagcauaccgggcccuauaggaauaaccaggaaguaugguggcauagcguaggaggaaacacuuugcaaguucuuuguaaguaggaaugacuuaccagaaauaguaauggcucggcuaaacccaaaauacacaggaaggccagagaauugggggggggggggugcauaagaaacaugaaugacugggaaucuaaugagguaaaaaaaucagaacaucguuuagagaagugacugaagaaaaugucauuagaccugucuuacucugucaccuagaugucaugaaaacacaaauuccaaagacgucuguauugucuuuccaggaacacuagagccacacuggucaggccuucuguggacagccaugcucaucucucuggccauugucauugcucugcccaagccccacggcauccgggccuuaauugcuucuacaauccuacgacugauauuuucaguuggguugcagcccacacuguuucugcugggagcuuucaauguaaguaugaaucgcuuuguaguacaguucucauauaugaguaaguaggaaugcuuuccauuuugucccuagcaucuugacuuugguuuucaaucuagaaaaaaaaugcuaucagucuccaucuuccuuugaccucuucagggugaauugagucucccggggcaucauuugggccucaacaugaccuuuccuugggaguaucccucucaagagcuagacagggacaguagcagccaucgaaguucaaguuaguuuggucagucugaccaaagguuuguuuagaccauagguuuuuagccagcaaaucaaacgaucaaauauuaacauagcacuugguucucaaagggcucacauagaaaagaggggagagguuagagggacuguucacaaacagacagagcaaguggugagggaaggagaaaaugacaggugacuauuuagaugucaguggagugcugucacuauaguugaagggauguccaggguccuuaggagauaguuauggcugagggaaggcuauagguggcaugggacuccugcaucuugggaaucucagaauaccuuccuuuggcuuugguuucuauucuaaucauguaagaaagcugacgugaauguacaaaaauggaagugucauagaaaagugcgggcaauacagaaucgugucagguaucccgaucgcuaaagcgucagggauucuggccagauaagcacagagaaagaaaggcagcggguuugaaauuguguuuuguugauuugguuucgguuugguuuggauucuugaaauauucuugcuguagagcccagcucagccuugaacucucugugucccaaacugaucuuacauugacuauguagcccaugcugaccuccaauucaugaucuuccugccucagccuuccagagugauaaaauuacaagcaucugccaccacaccuuaugaaacuguacaugaaagaauagaaaaggugaggccaggaagugcaagacucaggaaagcauuuugcuugucuuaggcuucauaggccuaaguggagcaauagaccagagagccguguuagggaggggacuaauccuggaacacugaacucugggguaaguucauugaaugucuuccuccagguucacauguguuuccagaacaucauuccauggugguaaauguugggugaggaauuaaaauagagggucaauggcaaaaauccauuaaaaguguuguaacugcaauaaagacuuaaagaauaagcccaagacucugagaaagggaaccuucguggccauguuucccacaugccuguagcuuugcugacgagucagugagacugaugcgggggguacucuaugcgccuugguaaaugcuugcaguguuuugagccaagauuaucuuuucaaagacauccuagaaaauucauucauccauguuauguagacuggggugggagguacuguagucagagaggcccuuggggcucugccagugcuuuugaucaggugugguaaggcugagucauaguguagacauaagaaacaagcugcaggugucucaguggugaaggaaagaacaccaugggguaggcaaaaaggcagagcaaacaaugaggaggucuuuuucuucaagcaaagaaguauugucuuaacuggguggacaaugaaaggaauaaauuuauuuuguguauuaguugccuuucuguugcugugacaaaaugccaagacaaaggcaauuuauaaagcauuuaauuggacuuucagggggcugaagucaauuaaugggggaaccaaaggcuuggcagcaggaauaucugagaguucauaucuugaacaagcaggaggcagagagagcaaacugugaauggcucuugucuuuugaaaccucagcuccucuccccacccccagcccaccaccaugugacgaacuucuuccaacaaggucacacuuccugaucuuucccaauuagucuaccaacuggggucaaguauagaaacacacgaaccuggggugugggggcuauuuucauucaagccaccugggucuggaggcugggguucacguguguacuuguguuugugccaguguguaugcaggccaaaugucaacuuuagugucuuuacucaggagccauccaccuucuuauuugagacaggucucucacuggcuuaaggcuugcugaguuggcuagguucaaaagcaccaaggcuucccugucacugccuccccacugccuccccuguauggagauagcaagcauacaccaccacacaaggauuuuuuuuuuuuuuuaacauggguucuggugaucaaacucaggcuuacaugggaagcauguuuacaacugagccaucucccuaguguaaaaaauauaaauuuaacacuaaguuuccaaucauggguggcuggggcaauacuauggccuccgucuaaaaugaaaugaugcaacaaugcauucacauuguucacuuauaaugccugagguggcacgacaugccauuacuauuagcucugacaauugucaaagcaugggcacaauggcaaagagagagagagagaguucuagagacgguggcauagguuuugugugcucugagaaguuguuucagagggaacacaggauaaucagaugacagacaggacagauggauggaaagaaaagguauuaauuaguuccucagaaugugugacuauuuguuucuuuuuguucuguccuuugaucauuccacagacaacacaucuuugacaaagaccauuuucaaggaagacucaaguuagacaauugcuauuuuuaauacauuagcugaggaggccaggacagcuaucauaaauagucacuuagaguuuuguuuuguuuuagcaagauauacuauuugguguguaugggauaaguaagaguggcugaacaaacaggugaaggcuaggggaagaggcuagggugcuauccaaaggaugacucacugagguuaggguuaggacaggcucaccagucuccugcuagaggaagccagauggaugugcucagaacauaagacaugguauauacugacagcaucccuuagagguagggcaggaagcuagaucaaaagcuggucaaacagucaguguggaauaggggcaauagacugagucuacaaacaggagauacuugcuggagcggcagugaauguuaaagaggagaucaaguaggcugaaguggacuguuggccuguucagauuuuuagaacuuggguguguaggagguucuguggugucaacuggacuaugaucaucucucguuucuccaaaccccucucucuaaaccuccauccagagucagucaugcucugcuacccuguaaggaaaucucacccacagggucagaacucaggggaaaccuggccgauuguauguugagggugcuugagaaagcuggagguucucuguccguguugguguccucccuuaucugauugucaaggaguuggcuuacacuggccugcagcuuagcuggcaggaugucugugugccuggugccaagggaacuagagaagcagaagaugguuuccccaagugcauucagaguguucuuucuagcuuuucugucagccuguuaauggagauggauuuccaggcaugggguauauguucacauacaaauguauuaucuaguagguaagucagggacccuucaauagugggugucaggaaacccacgcuagaugaagcagaguggaaaugcauugguucauuuugacauagaaagcaagaaccuggcuucagguauagcugaauaugggggcuuaggcaguggcaucggggcccaauucuuuugucccuuaguuuggcucugugucuacugaauguuugugauuuuaugacccacggugggguaagaagaggacaguagcccuaaacucauauucccuucagguucaagguaaguagaaaaaaaacaaaauugucuuuugcuauaaucccaggggagaaaaaaaugccuccuggguuuuauuggcucauuuggucacaugacaauccuugaacaauuauuauauccagaagaauauaauguugugauuggccagaugaagcuccuucccgaccucgggaacugguucuugaaaagggguggaucccccaugggaaggucagaaaucguucccugaaagaaguacaggacaaagagcucauccuggcaaaacccuguuuuuguuucuuaagaaaauguucaucuuacuugugacugcagaagccaagaaaguugagccguguccacuucucacuaagcucagccccuguagugucuggaauggagccagcuuagauaacgagcuuuaagcaugcugaucgcagaguucacagagacgggugacuucuguaucugacugacucauacaagaauguuagaaaugguucauuucgaaaaccaucauuucaguauguguuaauuuuguuuuugccguacacaagugcugcuugauugcuggugcacuugaaaugauuugacuacuguguaauuuguauuaugccugaaaagcaaaguacuggaaugacuuggagucccaggacaguucugagagagcuuggugggcacucggugcuaaggcuccucucagguucucacgccuaguugagcauggucucugccaucugacucuucccaccaccgucuguucucaggucugcaauaaaaucaucuuccugaugagcuuugugggcaacugugggaccuucaccagaggcuaccgggccaugguucuggauguggaguuccucuaucauuugcuguaucuacucaucugugccaugggccucuucguacaugaguucuucuauagcuugcuggugaguaccagggguucacauguggagaacugugucaucucuuaucacagaccccccaccuucuaaucacagcuacugggccugguucuauaauaucaagcuccaacugcauccgaucuugggaggaucugagaggaaaaugacauaggaaacagggcagcuccagggaaccuggcagugcaggaucucaucauguccuguauguggcacaucuguaguuuccacucauggaggaggugccucugcaguucagauguuuccuauauauguguccauuucucucacuugggaagcacuugccaagaggcauauguuugacacagucaccuacaguccucugcaaucuguuucucaaggcaaacaugucaggaccaaaguaagagcaacuugcaaagcccaggacccaggacagugagcuugcuaaguaaaagugauuuuguucccauagagccaaguuguuaagaccuugacaguuggugaguugguucugucccuuucuugggagcagauuaaguuauaaaccaaauaaugauuuucugugccaaagucaaaagaaaccuagaucuauaaaauuggggauaagaaauuucagugcaccuacauaacauggcaagaagcauaaacuuuuauggugcaaacacaagaaauauaaaaauaugaagaucaaaaaaaauauccaagggcuaaaaauaagagaggggggguagggaaauggaaggaaaggaaaggaaaggaaaggaaugaaaggauuuagacaauagggauugugaaacguccuuaaggaaaacccauguaugguuucuaagcugcuuuugucugucucaguuuccuuccuuccuuccuuccuuccuuccaaguugagaagaagguuuuccucgcagggauacuguauggaucacauguaacuguucaugucagcauccuaagcaagcauugccaugggacagcucccuagucuuaucuuuaucauccucuguucucgaugccacaaaaaaaaaaaaaaaaaaaaaaaaaaaaaauagauaaagaauucaccaggauuagcucauuccauuagugagagauguuggcgggcuaagcggaaugguuuauuuucucuaguuucagaaucuggcuggcuguacuuugagcuuuuaagcaaagggguggcaggauguacuugugagcgcuauuauguggccuauuuuggucauucugcaucagaaaucuuuagagccauccuggagucuguucuggaacuguucugugucgugcaugagcaucccuggacagaguuuagcccgugagucaaggagacccacauccaccagugcagcacacuccaguccucccuggggagaguggcagagggcagggauugucucuugggucccugguuguuguuuauucguuuguuuuguuuuguuuugagguaggaucucucccuuugugcccuuugaucuguacccucucccccugcuggguguggcuuuccuugcugcucuccuuccuguugaucuugcuuccuuucuucuucauuuccagucugcugcuuugguuuuuuguuuuuuuuuuuuuuuuuuuuuuuuuugaguuauuuuuuggagguagccagggccuuuccuaaaugcaagggacagugugaggugagacccacaccccuuaccucacagccuuaccaucaacgagacagaggcaaaaaaacggucacagcuaaaucucugcaagugcgugcuucucccacacucucacccuccauuugagggagaugaugucuuuaggucgcagcugaggaccgugacacauggugcccugaaucacacagucacucgaucuuccagacccaaaugucauuccucccaaccaugggcaggccauaccucugugagcacagcgucccaugcugcagcucacacccgugcuuccagagcccucccgucacggaagcacagugcugucagucuagaugagggugaaagccacucucgugugcauccaggggucuccugagccuugacuugccugugggauccuguucuuguccaaagaaguacugaauguaucugaugagaacucaaaacccaauauucccacaaagaaagaaagccucccauguuuaaaacaaaccugaguuuucagagagagaaagagaaacagagagagagagagacugacuuccuacagagaaaucuagaggaguccccugggugaucagagcucccuuggcuuuagcugucuaggaggaaggaaccguaaucccuuggccuaagguacuguggccccccaggaagcgucuggaccuggccucaagccugcaucccaguuguguucuuaagaaaauauuaacagcggagaugaaaauguacaaaguuccuaaacagcagcugacaggaugagggccccagauggucacugagcgcggagacagguucaucccugagugccgagccaaggcaagcucauuagaacgcccacacucucugagucuaaccugucgccugagaaagguuaaacagcacacucauuccuggucugguggccauagggacacagcgggucuaaauugcuaguaauugcaaauauaaacugagacagcacacuugauggcuauaggcaguacucaucuauuauaacaggaauuacagauuucuguuucuggaaauuagucagaaagcccuaaguagacagauguguauacgagcauauccagagguguucaucacagaagcacugauaagacaauugaaaacauguugacuagucacaaacaugauacuggcuauguuaaguguauguguuucuaaauaacacuaggagaucauuuugacaugacaugaaaugugccugaauauuguccaggaguggcuauaagucaguauuaugguauuuauuaauaauaucuauacauuccauuuuuaaaaggaauaauacguggaugucuauagaugauggaauggaauuauuagguuuuuuccuugguauucuaucuuuuccaaggucaauuuuuacuuagaaaauauauaauauauuuauauauauuauaaguaaaaauacagaauauaugcuauauuuuauuguuucaauuuuaaaauuauuuucuaaaaaccauaagagggucuuuccugguuugaucuguuaauuccgugccuccugcccacagaagacaaguacccuuuguucgcugugugauuugcucuuaguacuucagacugaguugcuaggaaauauuuaaccaauguuaaagcaacacagccuuuuacuuucuuuuguggauuaaaugccacauccuugcuuccuuugaaagauccuacuuugcccaguacccucuaggaaacuaguuucaggauacagauuggaauuaagcagggagaaaagcuaauuggccagaaaauggccccaaauauacaguacuaaacuggaagacauugaagagaccagcucugugcacucauuuuacagaugaggagauggagguccacagaggcucauucggcaucucgcuguaauucaaaagugaaguggagagcccaccugcuuuccccauaaccaucuucacugugcaguuagcuaaagccacaaugaagaccaagccuuucagagcugccuagacaugggaacagaggcaacguuaauuaaaacacaaacaaacaaacaacacuagccuucagccaugucuggcagcaugugccuauaacacuagaugauuaagaagcugaagcugaggcaggagaguuaaaaguuugcugccagugugggcaacauaaagagaccgccaucuuaaaaauaauacucaaaguuucuaaguccaagacuuaccccagagcuuuccccuagucgcuccccagccaaaccguugccuguacuucauggaaaucuaucuaccugccauccucuaaugcccaugugcaccuucaaggauccugccuuucucaugaagcccacuuccugcaggcuggggguuaggacugaccuacgaacccaggucuuuaggggucauuccucuacuaggggaagaggauaaaggguaaggcuuccugguaugucuccacuauggccauccuucaaccacacuguguggcuuugcuccagugucuucaucaggaaguuggugauuaugaguuacuguacuugcacaguauauauguaugccugugugccgagcacuguauauauaaugcucgauuagucuuucuauuaacucuccgucuuggggucugcauauguggaaacugaggcuagggacuagggacagaacaaagcccaagaucccacuggcuaucaguaacugagcugagauaucagcaguccagagaucuugcagcuuguacuagcuaagugguucucaacccuccuaaugcugagacccuuuaauacagguuguggugaccccuccagcuauaaaauuauuuuuguugcuaucucauaacugaaauuuugcuacuguugugaaucauaauguaaauauuauuggagauagaagcuugccaaagggucaugagaacccuuugaaaaccauuacaacuagcuuguaacaugccugccuuucacaacuagauaauggccuuccuggaggcagacagauaccagaguuccuggcccuuuggagaagcucagaaauuagaugcuaaauggauggguuccaagacccucaguacuuucuuccgccucgcucucugaaacuccuauuucuauuucuggaaccucuaaccuguuuugugugugguuugaaguugguacugauugccacccccucuucuguguuuauuuuuccuccucuuuaccauccuaguucucacugugaagacgggcaacauguuacguguuaaaauuauagaaugauucugaguuuccaagagaguaaaugaugcugauauaaaccaaaucccuuaacgacucuucuaucgucuuguuuuuugaagcuuuuugauuuaguguacagagaggagacuuugcuuaaugucauuaaaagugucacccgcaauggacgguccaucaucuugacagcgguccuggcucugauccugguuuaccuguucucaauugugggcuaucuguucuucaaggaugacuuuaucuuggaaguagauagguugcccaaugaaacagcuguuccagguggguuugggguccucuugucuuuuucaacgugaacaugauuauaaccagacuagaguaaauacaugaccuuagcaggcaacugugucucuaacaccagaauacaaaguaugaacacaagucauugucauguuauucaaaggguaaugcugaauacuguguugugagggccagugaccaccccaugcacugaauucauucauuaaagccacauguguucacacacacucugauccaaacucccaagaggccgagguugguguacaagccagccugggccacauauaguaagguuccgucucagaaauacucagaaaaaggcuaacuuacuaaugccauauuuucaaccagcacaacuuuuucacaaagcaauuugacuguauaaagugaaaguauucccccugacuuagugaaccuacuucugguaacuucuggggaaaaccugcugaguguguguaaaagcaggcaugucuaggaaaauguucacugcaauuugaaguugggagcaauccaaauauaacagggcacugcacuggacuguaacccacaucugugggguggaguaccccacacagagagugcauccuuauaagccuuuauggacaaacacugauaacaugagaaaauacagaauaauaguaguaaaaucauacuuuaaauuaagacuuacauaacuauauuguuuuguguuuggaguuuugugagacagagcaucuuauagcucaggcugaaacucaccagguagccaaagaagacuuugagcuccucuucuuccugccuuuaucacccaaguacuaggauuacauucauacauauaccacacuugacuaucuguauauuuaauguagaaagacaagcaccccacgcuguuugagguggcuauccuugaaacuuuauuuuuaaaaaaaagugugaauuuuacagugagcuccuguauauaacaaaacuggaaguaauuuccuguugguaaaugauaaacagcgaccaauuguuuuggucauuuuuggaugaugccaaagcauucuuucccagaagagcugucaguccuuaaugaaaaguaccugguuacaaguagucaggcugccugaauccuggggacaaacuagaccuucuaugccacaccaagcuuggccgccuucucccgcaacugugcaucuugauguaaaaguucauucaaccuucaguugacaccaaguggcacuaccuucuuauucuaaacugagccagcuugggccuugggauuccauucaugcccaaguuccagaucuugauggaaucuguacacccaguaguauuugucuucgaguuugagcuguuugucuuuaaagucggagaggugcuauuuaagugugauacuguuaguaagccuacagaacuugacauuucuggcuuuuuucccauccagcucaccaaauaagaguguaaauugcaucugugcuuugaauuuauaugcaguauuggaggguguuauuuauguaaaggguuguuuaaucagccgugaacuagggacuucaaacauuuuaaccauaugcugccagauuguucuucacaaaacucccuucucuaucccagaaacuggcgagaguuuggccaacgauuuccuguacucugaugugugcaggguagagacgggggagaacugcaccucuccugcacccaaagaagguaggaccacauggccaccagccccaggugacuaucagcaccuucagugaaguacgugaggcaggugguauuggaagcagauuaaagaaagcggaacuacugcuuaggagcgaggcuaacaacaaaagggagaaguuaguugggguugcaggggaugaacagaaaggaagccacguaugaugaagcaagcuacugacuugaggcagccaauauuugagugcccucuguggacagggagacagccugggaggggagggugguggaguaaacgagaguucacauaaccaaaugcugcuucaguaagggugccauucagaagacaggcagccagcagaguauugcgguaaaggugcugcaaugcaacccaaggacucucaggcuaaggaggggaggaaggcauucauugguaaaaguccuucagagagagaacaggcaugugcaaggagagcagcaagagaugguuccagaaaaggaccggucucuauggaucugugucaggcuaagcaggugaaaguuacagagccccagaagcugcuggacugcaccucagugggagagcacuugcuuagucugugugagguccugccaggaguacaaaauaaauagauaagagagaucuuuagcaacccagugagaagguagcaagacaggcugcaaagugggauaaacagccucuaaugggaagccaaagaccuguuucuguccucugagcaugcccaguuggguacuuggcagaaaccucaccugagaagcaagaugccuuguucccagccuaggccaaagacuauucuguuuguagguaggacuauacuguaacauggucaaacaauaggagauaucugaagcuccauagaggaaggacaguacuggcuuagcuugagaaguuugcaggguuuaaagugggaacagcccuguuugacuccugacagcacauaucugacucguaacggcuuaauuuuauucccugggcugccagcuggagagauggcauuugggaagcaucacaggggaaucgcagugucucuuuccccccuccugucuuaacuguguuguuacuugcccugcucacagagcugcucccugccgaagaaacggaacaggauaaggaacacacgugugagacccugcucaugugcaucgucacuguucugagucacgggcugcggagugggggagggguaggagacgugcucaggaagccauccaaagagguaaacggaucacaagggaaaaagagggggcacaggggcuuguggggacaggcagcgggggcgcucgguggugaugcugaguguaaacugucaggucuggaacaugagcugggaguaugacaagccauugugcagaacccagccagagccccuucccacaagaccccacuaaggcauguugaggccccagggcaacuccuuagacagagguuuguuuaauauuaggucuggccaacauacugacagaaucuuccuaguuguguuccccacagcuguugaagcacucccaguauagagucagggauuaaaaggagacuugguugggaguuuuaaaguuugaugcucaguguaagucccgucaaaguggacaucuguccagcuggagcuggacucugaccucugaagaguaaagggcagugugggccccgccugagagcaccaucucucaucuccaggagccucuguuugcugcaagggugaucuacgaccuccucuucuucuucauggucaucaucaucguccugaaccugauuuucggggucaucauugacaccuuugcugaccugaggagugagaagcaaaagaaggaggagaucuuaaaaaccacgugcuucaucugcggugagugucugucccacucgggcaggcaggccacuggccagcauggcugagcacauggccacguggcaauggaguggguacauaacagacacuggacugaggcagucacauugugcagucccaucccugcccucucuuggcaaacaacaggcuucuauguggccuuuuuuuuuuuccuccccugggaaguaucucgaaagccaauaaacucugugcaguaguuacugguuugccuuucggaauuaaguucugaagaguagaaaugucaccacacguguaagaaaaaaaauguaucucgcgucuuccuggucuggucauccugaaaguccccugguccaguccuaaguaaacuaggaaggaaagcuguuauccagcaacagccugagaaugucuucuccacuggcaggaccaggcugcaauggaaaaauuccauuagagcuggacacagcagcacccaucuguaaucagaacacuugggaagcugaggcaggacgauugcugugagaucaaugccaacuuggaccugagcuaccuaguaaaaaccuuucucaaagacaagagaaagaggagggcuggagagauagcacggaggcuaagugcaugcucugcuccugcacauaacccagauucaacucccagugcccaugucaggcaauagcucacaucacccuggaacucaagucuccauaggcaccugaacucauauacacauauaugcaggcaacacuaauggacucgguagauuguauuuauauacauaugcauauacucaccaugaguuugagggggcacacggauaguauaauuguauuuuaauccaagcacucaggaagcagaggcagauagaucucugacuuugaggccaacuuggucuacauagcuaguuccaggacagccaaggguacauggugagacccuaucucaagaaauagguagauagauagauagauagauagauagauagauagauagacagacagacagacagacagacagacagacaaauagauaaauuuuuuguuuuauuuuuuaaaagauagaagucucuuacagucaggugaaaguuaaaggcuuggacucgguacaucagccccugcuucuggaccagccucagcugcugacuggccaugcaccugcgcucagucauuuauauucacugagccaucuucuccaccuguaacgugggugguguccccgugcacuucucugcaucccugugagaauuaggaguggggacuuggauaagcuccugacauagcccucccacccccaaccccuucaugcugcaggcuaaguaggaacugcugcaggaaacaagugcucacacaugcaauuucagcacucaggaggcggcugggccaggaggacuauggguuugaggccagccuuugcuacaugacacccugucucaaaaaccaaaauaaaaauaguuucaugagguaccaaaaaagucucuaaaaguauuacuauuggaaaauauauguaaaugcagacuaaucauguuggaaucuggaagcugaguaaucauaucaggauuauucagaauaugguuacuaaauuuaugaauuccuucccaauauggauacuaaaaaauggaaacuuucuuuuaaacaucuaaauucuuuaauuuuuagccucuuuaagaccuaguuuuuaagcuuuuuauuuugcuguaauuuuagugacagaaaagucauagaacuaguacaaagaguuucucccagcuccuaagauuccccuaauuuuaauuuuaauacuggcuucccuuuccuuuacuuucuguacacacacacaugcacacccacucacuuuuucugaacugauucagugucaguggcugacaugaugcccuuuugaucuuuagcauuucaguauguauuugcugcuggcaagaacauugucuuacaugauugcaguauaguuacugggaaauuuaagacaaaacuaucugucuaucuaauuuaaaaaacucacccuucauucuacuagugccuuuagacagucccaagccaugugacauccuacauuugggcucuuaacuccaugggcuuuuuuuuuuuuuuuuuaaauuuaaagauuuguuuauuuguguauaggagugcuugauccacauguuugucuguacaccagaaagggcaucagauucuauuacagaugguugugagcuaccacaugguugcugagaauucaacucaugaccucuggagaaacagccaguguucuucaccacugagccaucucuucagccccuccacagacauuugugaagaacauaaggcacuuguuuuguaggaaauccuuugauuugaguuucucugaaggucccuuauaguagagcuaagcuuaugcauuuguauacgaauauugaagacacauuuucucaccuucucagucugccacaccagggaaacauuaagucauagcuuaaaguauacagcugccgauacucacuuuguucucuuggauaaggacauauuugguauguuucucacaauaaagucacuguauggcaggacacuuggaaaccuuguaaguaaccuugguauuccucacuuugcccauucagccccagacauaguauccccuagugauucugccuuggaaauuauuucccauauuuauuuauucaggucauuaaguuuggcauaacaucuuaccuuaauuuugaguuaguguaggcuggccuugaacuugugcuccuccugccucagccucccaacuauggugaugugccauuguaucagguucugccuugaugcucauuuccccuuggguuuggccagugagaacccuucaggcugccuuuuguguuuugucgugucauaauuuuuuuuguacuguauauuuuucuggcaacuuaagaauuuccagucucaaaccuuugccuucucugauccagccauacaaucagccauuucuucaguuguucauagugaaauaggcauuuaguagccaacaucuaaguguucaucccuuuugaugaccacuguuccagguuuaggcuguagaucuaugggcugguguguauguaugccuuugugugugcauagaaagacauggagacggauccaccuacaucuguuccucuaguuucauauagauaacaaaaagauggcuaccucuaauccuaccucagcauuacagugucuauaucaucuuccuuacucuguauauuugugcucccuucuuuuaaugugaggaauccaaacccuacuaauggccugaaauauauuuccuuuuucaauucuaauuucauaauggcuagcccaggccuucacaaaauacaguuaucaaccagcaucugaaauugguuuaaaguucuuuuugucauguccacacuuuggcauuuaccugggacaagggagcuuagaaucacugauguccuccggggccugagccuauccucaugcuuccuccccuagaagcuggaaggcagguuucccgugcacccgugaggcagccaaggcaccuggccuucauuaggaagcugcaggguuuucagacccuaggaucugcacacgguauugccuaucuguaaauccagcacuugggaguuugaagcagaaguaccaggaguucaaaguuagccccuggcuacauagugaguuuaaggccagccugggcuacaugagacccuguuuuaaaacaaaacauaaacaucaaauaaacccugguaagucagacucccugccugugcccuccuaccaugaugaaaguggguuugaaggccaaaagacuccaacucugccugcagauuaaucaagacaacaagcuaugcugacuuugcuguaccgugguggcucauggggaaucugggguguucugucucucauuuaggcuuggaaagggacaaguuugacaauaagacugucaccuuugaagagcacaucaaggaagagcacaacauguggcacuaucugugcuucaucgugcuggugaaagugaaggacuccacagaguacaccgggccugagaguuacguggcagagaugaucaggguaagaaggggccccaaagcaaggcagccccggcagccucggcucugccuuccugguucaauguuucuggcaccuguagaggagccacauaccaaaaaccuauggacugagaccucaguacucugugcaccucuguucccugagguucagcuggcaccaacucugcccgccugcucucaaggaggggaggcugagacuuggggaaaauggacucagggcugucuaacaacugccuuaucucaucucaaacuccaccucccagcuuagugucugucucagucuaccucuccuugguauuccacauuguuuuuguuuguuuuaacaucuccagucucacuaagauugguccuucacauacccgaugauuaauacguauaguuuucagcacgacguguuucucugggcucagccuucugggagcucugcugccuauauggaagggaucacaugagggagucuaagcuccaggguaaccuuccugcugaugggaaguguauauuucugugucccagcaaggcagagaguuagcugcuguagguuuucuagauaacucuucucucacagggcuuugaggaaucacaagacgugugcuaugagaguucccggccagcugcccuuuauaacacgugcuuuccaaaucucuuagaaugugcaggggcagggagguguggaaaagcaaagaagcauggacugucaaagcagggugaugaaccugggcucacucagcagcgggccauugguucuuggaaaggcuccacgacuguugcccuccugccaguggccaggaacgcaugcgcuccaucugaccaugaguuucccuaaccaagcucugcugugguuucuguguguaagacuuucaggccuagaaacauguucgugucacgucugucccaguaagcagcagcacccacgcuagcaagggguagugaacuguacugcgugcagugccacagucgugugguacuacuuccugcaccccccaguccuaccagcuagaaggcuuccuggagggggaacuaccauaugugucuugacauccuuaggguuuguaucaguugcucgguucauggcugugaccagauaccagaugagaagcggcuucagggaggcgugaaggcaggagugagaggcaucugcucacaccgcccacaguguugagugcugcuucucggcugcucucucauuugucuucagccugggaccccagcccauggaacagugccacccacauuucggauggguguucccaccucagcuaaccaagucuaggcccucccucccaguggcaugucuccuaagugaccuuagauccucucaaggcgaacggccguuuguauuaaccaccgcaaguuacacguuucccaaauuugaaugcacuuagaacucuucuuaguauuauccugacucagcacucacuucaaggauucccuggggugccaacgauacaagucugcgaaucacccuuugaguaguaagaaucuaacagaaaaggcaaaacacucugacuuaaucaguuaccauccaagggcugggagacaaggcucagugggcaaaaugcucgcugggcugaguuucugaguccagguugagaucccuggugacuauggaaaagccaaaccuggugucacaagucuauaaauccagacagacagaucccugaagcucacuagccagccagucuagguaaccagcgaggcuuccagaaguagggccuaguuggaggaaguaggucauugggaguguagaaugcuggcaagaugguucagugaagaaaggcacaugcugccaagcaugaugacgugaguuuaauuccucagaccaacaugauggaaagaaaacugauucauaugccaugugcauacacaagauaacuaauuaaauauaacaaauauauauaaaguaauaaagucaauguaauagguaaauaacuuauuuacauauaauacuuauuacuuacauuuacaauauaaacauaacaauuaaaaucaauaaagaugauaaauaaaugaauuuuuuaaaguaggauaugagguuaagaagaacacuugcuacccuuaccuguaacuccaguaccaggggauuuaauguccacuucuggccuccacgggcaccaguugggugcucauacagacaugcaggcaaaacauucauacacauagaaaggaagaaaaagaaaacuuuuuuuagagggcagaaagcaauagaaggugcuugaugucagccucuggucuguacgugcacacaggggugagucacccacacacgcaugcacacacagcaacgaggcugguuaugugacugcugaggaaaaauacuaccgacccucacuguacauagcucucaccacguauaaagcucuuccauaucuggcauucuguuuggucacuauaacuacuugcuugcaacaggaauggucugggguaagggaagagauuagcagagcaugcuucuggaaaggaucuggagggagggaacguaaggggagaggaaccagagaggagcagcgagcaaaagaugccaucaagagcaaguguccugucaugagagggaagggaaggggagaggagccugugggggggaacagcaagcaaagaacacgccaucaagagcaaggguugugcaguucuuccuuuagucacuguaacaaaugcccaacacaaacaaccaaagaaggaaagggcuauuugggcucaauuuuagacacuuuggucccugguuagcgguugucuugugucugaguuguggugaagcagagcacuaugggagaaggguguggagaaccgucacucacuucuuggaggcagaggccagaaagagauaucauccuuuaaaggcagauucugggccaggaagguggcucagugaguggggugcuuacugugcaaccaugagaauguuaaguucagaucccagcacccacaucaaaagccaggcuugguggcacuugccugugaccccccccccccacacacacacacacacugaugggagggagcacagagacaggcauauccuggagcuugcuagcuugguggacuaaacaagugaugagcagugagagacccuggcucagaaaacgauguggaaagcaauggaggggaagaccuguuuucauuuccuuucugcuuuugugauaaaacacugaccaagagaaaaggaccauuugguucaugcuuucagaucaccgcccgucauuggggaauuaagggcaggaacuugaaagagaaaccauggaggaaugcugcuugcuguauuccucacaggcucauacuuaacuggcucucuuacagcccaggacuaccagcccagaggauggugcugcccacagugggcugggaccuccuacauaaauuaguaauaaaaagaaaugccucauagacaugcccauaggcaaacuggaccugagcaguuccucaauugagacuuccuucucaggugacucuaggcugugccaaaguugacaaagcucugacaacuucagccuccauguguacaugcccacgaauaggaggacacauauuggggcaacacagagaaagaagggugguggggagagggagaagaaaaacagacaaaccaaaacauacagugaaauucccaaugaucuacuuccuccaaguaggcccuucuucuggaaguuucuauaaccuucaaauaacgccaucaaaguuauuaacugaucuuuggauuaauucauugauuaaggcaacacucauuguacagccaccucucaaugauaugauauugcaguugaaggccaagccuuuaccucggaagccuuugggugauacuucaggaauauuaugacagggauagaugcagaugaaagcaacgcuggggucggugccugcccacacuuagcuuuagguuuuaggcaggguuucagaauccguuucuguagcacuuuuaugggagacgguuggcagggugcuggugagaccuggucagaugggagcagacuucuaaaugggggaagguaagcagagagugucagagccaguucccaucggggcaugacacccuaauaaacaucaguccucugagccuauuccuccagugguugacacuggcaaauaaguccauguuucauuagcccgcacaaugccacgaacccagccauagggaaguguggugagcuggacuuuucugcucucuaaagcgucuggcugugucauaucuucaaaucuuuccagggcugauugugaagcucuguuaaucaccuuacauuaugcucauagaaaagucuggugcccuuuggagcuuccgucucagucauggagacuuacugaagucuugugagcagucacuugacugggauuaagagcagagugacgccuugccugccacacagccugaucagaguccucugcauucaaugcucugagaaccugagcauucauucugcuuccugucuguaccauguuugauuggcuaagaugucuugucagaaagcaugaaaaucuagagcauuaaaggguucuuaacucugaaugucagcagugcuggagagcgggauguuuugugcuauacaagaggcacagaagaguauuagagccacuggccaaaaggcagagccuuuugccugugaucuuuuuaguggugauucaacuuggugccacaugaaucccugacagaaacuuagccauagcaguagaggaccugagugugguucagccucaccacucagggcugucaggcuccuaggcacacucagcugcacugcuguaggucacaugccuguguuguaacaaccaugagcucaugcuauguggcagcuguuacugucaggaagagaccucccaaaccucuccuacucacugauucugggcaggaaacuaggcuguguggcaagacaagccuuggagacugcugucacugcagguaaaggacagaaaggggacagccaucagggauggaagcuaaaggccagcagugcucaccccuccuagacacuucaugucuuugacaaaggcucuuuaguggcaugcgacccugaggaaggacagcauucgccugaugcucuccuuagucugucaguuaagauuccggagcgucugcaucuguucagucacugcugcaggccaugcaggagaccaagugggaagccuccgguggcuacucagaagguaaaagagcuuucuggacagcaccuuucaggcagaggcaucaggccuagaauaugggccuccacucccaaagcuagcgucugacuggugguuuaggaagagagccuacuggccauggauggggaugauggggaguugccuaaguucugagcauaagaccccuuugccugcauucacaucccaaaggcauauguccuuuaugguaauggccaaccuguauaaaaaaacgugacagccagguaugugguggcucagaccuguaaugcaagcccucaggauguggagacaagauugcaggaguuugaggacaggcucaauagguuagccguaucaccuucccuaguucagucaagaaauggcccacagucaagguaacaagguucuuccucuccaucgaggacaguugugcuuuucugcuaucccuagggggaaacaaaggaaacuaucuuguaguugagaaauucccagccauuugcccacaaguuaaauuucacuuaaguacaacaugaccugcauccucaucucucuccuuuuggucaucccuugucuuguuucaucaguugauuuucccacagagcccauuccuacccaaagacaggguguggggacagaagauccuggucugagugccagcucugcucuuucauaggcauguaauccccagcaagucauaggacaucgguaacccauugaccaucugggacuuauacaaauucagguucaugcuaccucacacacccaucugggacuagacagauaagacccagaguguggcaggaggguguggagggcaacagcuggugggcaagccuaagcacagcagccagcagacggaaggccacauggugacagaagagccaaagggagcuuccuuguagucccaucccugugggagguaccuuggcugccagcuaauggucaccggucaccaagccaucuugauuuuaauagcuuccuauguggaaaaaaaacaaaacaaaacaguaucuuccccuuucucuaguaucagugguguuucugucaauucagagaaauggucuuagaguugugggguuacucucgguucacuaguagaccugaccuucgguugcaaccccaaugguaaguagugcugugacucagaagucuggagaaacuugcuuucuucuguucccugcccccuauaauacauaugcagcuuaauauauagaaaugaugucaucuuugucauaggcaagcuaugacugcugugaccucauauagccccuggcagcauagaaauagauagauagauagauagauagauagauagauagauagauagauagauagauagauagauagggcugccuuuucucauaggaacuccagucaugguaguagccuaaggaguuuuguuaaucuggaucuccauauguguuuccacaguuauaugcaugcccuuuuauauaauuucuacaccaguggcuuuguucugugcccaccaaacugaggauuugugcuuguguaagguuaaggugauacuauuggguaggaauucacuaugaauuuucugcccaggaggauguaaauacuacauaaguggggacauuagagguaagagacaaaauauaugauucccagaaagauacaguugcccuuuuuucugcuguauucaagggagaagacugaauucuugaauguuagaagcacaaaaaaaaaaaaaaaaaaaaaaaaaaaaacauuaaaaggaaagguguuuuguuuaaaaaaugaaugaugaauuucuuuuccuaacuaaacacagauucacuuauguaucuugaaauuccaccucauaaucuuagauaccccccccccagaaguguuucugagugaacuucauagacaguagggugacuggauagaauauccugggcuauucugagugccucuccuccaugguagcaugugauagacagguuauuucuauccugccgaugaaaugagccauuucaaaccagauuagaucauguacgcaggguuauggggaagcugcucucaggugaguucaccggccccaagagggggagggggagggagggagagggagggagagagggagagggagaaggagagagagagagagagagagagagagagagagagagagagagagagagagagagagagagaacacgagaacaaaauaucuggauuauauaggaagaaccucugggggaaaggcagcucagcuggaaaauucaagguugccagcugggugugccaaauuaggacugaaggaugcugggagaaccugaaggccagaucugcuuugauauguaaaauacuuguccuggugcgguaagccaaacauuggggucaccuaggacccagcaguggcuaaggagaauguguuuccccaggugaccugaacagcggcuagaguacacuggcaacagcagggcugauuggauagcgguugccuguccuagguuaucauuaaucacccuccggugcagcaucucgcccauccuauaccuagcagaauauaaacacuucaccaaugagaacucagccggguaaagcagccucugcagggucacacagcuggaccagagcugcugggccccaguucagccucaaguggccccacccacacaucuagguucccuugcaagugggggggggcagucugugcaccugcacacagcccuggggucaggagccugcagccuuugucaucuggcugcuucaucucccuagugguguggaauuaaucacuuuuuaaaaaggcagaaaaggccccauggggggggggggguaggaaggagagccggaaagaggaucuccuggguaaugcuggcuggcuaaugcauaaaucagcaggccuugagcuuugugguuagaugggguuuaaugcucaaagcugugcauagccagccuggcucccaggugaccaccucaagugcuagagaguguccauaugacagaaguagggcagggaguguacagcucugguaaagaauuuaucugacauauaugauaaacaccucuaccaccacuuacacuugagacaccgaagcauaguccuugguggccagaucugguugggggagagaggagucuaagagcaagaagggagaggagccaucagaaccaccaggcggaccagcuuccacacccaggugacucaggcccugcgcuucacccagugacaaucagacaggagaaugucugcucugacaacccuuaagccccacgcugacuggcugacucuuucucaccgcugugaacucuuuguuaauccucucucagguaguggagagugucugcccagcaggggagggacucuugcuuugcauucuugguagaggcuuuccuuaagagccuaaugcagucuguaucagaagcuaggugagaaucuuuuuuuuuuuuucuuccugaaaaggucuggucaaggaauguuccaagcaaauaaauuguguuaacaaaguauacaguacaaaaggucucugagggaccacggugagaaaacugggaagcgagaggagcgcuggccucagccuguuugucuguagucgauaagaagacacaggaaguaaacagaaagcuacucuuagcaagguuaagagaucagaauggggaguaagugcccgccucugcgugggugucacucccuucugucuuaaagcagaacuggcccaaguugugcacuuugcuugaccugaaggagugccugcacucuggagucugcagacaggcagugucuccaguggugucuccagugcagggacagugcuucuuucugccaaggguaguccaaggacuggcagggagacucuucguggauaauaccuagauaaaucaagguucuggguggcuguggagcaagggcugcccagcauagggaaaugcaucucaaaugucacagccacaggggagacuccaggagggaaaugagaaugagagcccaugugagguauauaacugagagacacagccuggcaggauaugcagccagcuccacccugaccugucuuaccugaguuuugacagacuccgcuuugucccggcauuggaaaugugacagugacaucccauugcuccauucaagcauacaguuuggacuuugauucuggaaaucaagggaggaugcuaggaggaagggagugucucgauaaauuccuggggcagcgauaucaguguuucgguccucagugccauagcaacaacuuugugccuaaccugggaggccauaugcauuggugaaaagcccugagcuccuauacgggaggagacagccugugcugcccucuaaauaccauucccagaaugcccccuggagcgagguuacaccacguccaaguucaagaauaucagggugaaagagaaguggagagggauuuggccacugccuucucaggggcuggaaacugugugucagcaccauucagugcaccucccagccagccagccagccagccaggcucugaccccacccgcugggcuugagcuuggguuccuguccguggcagcugcacaaaacauuugcugagcuuauguuuccccaccuaacuucauaacauguucuguccucugguguagaggggguggggccaccccccucccuuccugugcacuucauggacaccuuucuggugcugggauguacucggcaucaggccugcauuucugcauacagcucuagcaugcucugcaucuuccccagucuguauguuacagccuuucugacagaaaguagagcccuaaaggaucugagaugcugaaggggaacauggggaguggagccaccugacuggucuuccaggccgcagagcgucagggucacaccaacaaagguuggauagagccacggagagaguguucaccacccaagagagcacaugcuuauaugcguauaguaaauauuuacuuacacaucacccaacaagacaaagcuaauaaacaaaaagaaaaaauauauacccagccccccucccauuuuuuuucauccaucacacaguccacugggcugccacccauucaggcaacaucuguaacuccuuugcccuaacuccugcauucauuccugaugguuccaaauaccaacuuugucugauauaaccacuuaguaguaucauguugcuaccacaguauacagccauauauacacauacuauauauauauauauauauauuugauaaacagguauaagagauauaaaacucaaccuguaaaauacucugaaauggacugucuuuaucaagugcacacaauggaaauuaaaaaccugucuuuuuauagugaaugccugcagggaacauggggaagggaaaagacuuggguaccaccuuucaaaguggcaucaggggagacucgggcuugugaauauuuagagaguaggauaggugauuuggagaggaugggggagccugcaugugauaugcauucuucagagguggcaccaucccugcacaccacucucaggucaguagguacagaccagcucuucaguuccuugagaacugugggcaggaagacugguaguguguuccuagccugcccucagaauagcuacaaagcaaugauccugaacaaagcuuaucuugaguuuucuguucugucaacccagcugaaagagcucagaaagcacaccauggcacaugagacagcuauuagcucuguguguguguguguguguacuuguauguggguucacguguguugagacacggucuguguaguccuagcuggccuugaacucauaaauaucuuccugucucugccucccaagugcauaugccaccacaccuagcucugugucugugucuguucaaaggugaaugaacggaaggacuuucugcugguugggggaaaagauuuuagaaccuugguuaucagauuaggcaucaaagcaaagaagaaagcacuggauucagucaaccaugucaacguuaaaaacuuacagacucuagaaagaaucaaaacugcugaaaauugucacggucuccaucuccaacuccaggaauguucuggucagcccuuagcuggugaaaacugcaagggaagccgccuuagcagcaggucagaagccagcuuggaugcuggauuccagaaaagugugacuuuugccagauugucucuuauuaacagucucaaagggggccaguccugccuugccuggcacaggcugcuggccuaccuccuucuccucccugaccucugguuugcucaacguggcagccucgggugcccaggacccaggcaagucacucccagugcugaacucugccuucucacagucgcuaugggugcccagggaacacuccaccuguggccccagacugacuugaaagggugauucugcagcuggccguggaugggaauuucaucagaacugggugcgguucucucugcuggcacgagcuggucuuuguugugcuguaucauccaagaacaacuauuaacuaagucuaggaacgguaacaggucaucacagcccagcuggagauuauauaaugugccuguuucagucaugucauuccgagcacacaaacggccagacucccaccucaacuuguaagcagcauggacaaaccucuggucaaagagaaaaacagaggcuccaaaaccuuaucgcacaaaaagaaaguaauuuagguaggagucuugauaucuagauuacagcauugccuccaugugagcuaugugaccuugagcaaaugacuuuuuauugauuuauaaugcuuuuauacaauuaccauccauuuuaggggacacauucacagcuacuugauccuuauugucaccaagugcaauagcuaguaagcucuugagagagagagagacagagacagggagagagacagagaggcagagacagagagacagagagaagaaaggaaauccugagcuaaaugagcugacucacucuguccuguguggauagagaaagucacaccucuaacucugccuagcuuuugauccaggccuuugcucuuucuacugucacaaaucugugguagacguguauagaaguggugaaaaagcaacaucugugguuuagguugacuggauucucauugguagcuucuuugagguagcaaugaaauuccagguagaagauaucucucucgcucucucgcucucucucucucucucucucguuaaauuuuucucaacaauuuuagguuuauagagaaauggagcaggaagcacauuuucccauguaucgagucucaccuccucccuuuccugucuuuccuuccuucuuccuucucugcaguuaacccaauuaaaagugugcauuccugaggauauagcuauaacuauguacagagagaucagcagcagcacacacacagauccugugacgcuguugugaaagucauaguuuguguugggaggacugcucuugcuguuugagacgcauccaguguuuucugacaggcaugugguuuggaauuacggaaucacacaggcuagcuucacugcccuaaaaccucuggaccucgugugccucucccucagagccuguggcauccacugaguuuaccaaguuggaauauacuuuccagggggguuuaauguauaaaugugaaagucauggagcauaaagaacaaaugcacuuuaaagaauacuuuacuuucuucuucagcguaaaugacccagccuugcucaccaaagagacaauugauuccaagucugcuggguacccuacauguccucuuugucaaaauaaguguuauguuccgucucccuccgcccucuaagcauucugcggaguugaagacugaacuccaguguguuucuggccucucgguuucuagugagccaaaagacacagaguugcagcuaccaucugagcugaagauagucuugacuucuagaaucuuccgaaagggauuacuugggggcaaagcaagaguuccauuuucuagaucuugccuucucuuccaugacccaucuguuuuacccuucacccaacucccaaguccucauguucucaugagacuuucuauagaagaacaaaggguuugguaaguaaccugcucuaccacaugccugucagaaaacacuggaugcgucucaaacagcaagagcaguccucccaacacaaacuaugacuuucacaacagcgucacaggaucuguggucugcugcugcugcucucucuguacacagcuauagcuauauccucaggaaugcacacuuucaauuggguuaacugcagagagggaagggcucccucucaggaggccauggguucucuggagucuuucucagaacagcuccuccacuugaaccugggaagaaaaaaacaccugccucucagcauuggcaaccccugccucugcucucccucucccuggcucugcucccagccccccucccagccuuccccuccacacauacacacauacacacacucucccucuuuccagucaaggauguguugaaguggcuggucagugccacccccgugucuaaaacuugaguguuugccuuuguagggacuuuuccaaccuuaccuagaaaagaacuaaccagaacuucagcacuugugguuagccugcuuccggcuguggcuucaguuagucugugugcucugacagaggaaguauuugcaacgaugggaagugcaugacuggauugugggaggacccgggcagacggugccucauagcauuggcaugugagaugccagcagcaagcugacugaggaaggcgaagagggauagcagacccagaguggcagaugccaugugauacccacccccccacacacacacacacacaaccacacacauuccccacaguguaaacucacuuagaaacaggaugucauggucaaggauggcuuuuccaaaaaugcaagccaguggcacgcuuuugauccugaguagacuuuagggcaagagucugcaaauauggcuagaugcaugggugacagaacuuguggauaacaagcuaguaauggcauuaaaagcccaaggcuucacauacacacacacacacacacaccuucacugcauugcaguauucugaacauuuucuuuucagauugauuccccauguagauuggaacccucuugaugaagaaccccagccagcaggagcuuauccaucuuauugagccacaugcaaaaaccagcuggaaauggagagaagaguuuggcuagaauuacuaauuaauuuuaacuacuucguaauuggagauuugaccuaacaggcaggugauucauuaaaauacuggcgauaccaaaguucucacauuuaaggaucuguuauuucagcacagagcuuagauucugucccaggaagcuugucuucuaugcauuaggauuuuaaugggguuccuccuaucccaguuucacauuuugaacuuacagaggcagugaaggggucauagcccagaaagccucuuuccuaccuuuucauggaagaacuccgaagaaauagagaaugaaggauuaucccaggguuagaacacauggccuuugauuguuguggaugcuacuuguuugaaaguuugguccacagcacucuuucaguuugcuaugguuuaaagauccauugugucuguggauguuuauggacuccuugaacauugccuucauaucccagagucacagguaccccuguauagagcagggggaaaaaacuagaaagagugaaguugagucaaggacucuuguguggaagaaguguguguguuuuacauguguucaaagaccuuccuggagucacugcucgaacuggggguugggguguguggggcggguggaugucacacgugcuacagaagaaguagaaauuuauuauagcacaaucucauuguaaucugucauuguucagucauguguuaccauucccuaaauucaaagcugugugcacauccauauauggaucuucuggagucuuuuaaagauucacugacauggacucuuuggaaaucugucuucucuuuuuuguaaaacguuugcuaagcagaugagaacauagggcguuagagagccugacuuagaggaguuuacuaccagcuuggccuuggggccucuauuugcagagcaguaacaaucacaaaugagccuagggcugcucacuaugcaugccccacaccuaguaagguggacuuucuucucucacaucaucauucuuuuuucuuuccuucauucccugacucacacuuaguuccugucuccuuauucccgaugcuuccuugggccacuguacagcuacgguccaagcuaccuugucugacuguaauaguccucucuucugcucaugugacucagugcagccucuucuuucuuaccuaacaccuacuuuccucauuuccuggcaggcaccuggaaauggaagacccgcuuccuaauuagguguccaaggcaaacauaccuacuuuuaaagaggucccaggacccagaugcaaugaacauuaucuguguggccacugcaccaugcuuggcgccacacauuuuuccuacaguuuauguugauuuuguuauacuuuuagagugcuuuccugcuuacacacacgagcccaaaugacucuuaagauguccacccauauacucugcuauaaugauauagaauuuguaaauacaaauuaauuccuaagaucuuauuugaaaaugggcuugauaaugacaguaagauuugggaucuuuguucuccuucucugggaucauucuacaaaauuuaauaaagugaggcuggauaucuggggcuuuugauggguaaguuggccucuaagaucccucaaucgauuuggguacaugacuuugucagccaguccccagcaucugaucccuucacagaagcugguuuacccugaugagagaaagcucacuacccagcagccacaugcuucugucuucugaaauacaacauucuuuucucccucagcauuucaucccgugaacuaagaugguuuuaugugucugagugacugacacaggccuguagagucucagcagcagcaggucacugaagcugcucuguagauaacagauuacaggcagagaaacacuucagcguuuuagcuaguagcuuugaaucagaguauuuuaugggcugaucuuuugccugucgcucuguugagaaauuuacuaaaaugaaugugggguaguauaaauguuuaucaggggauauagcaggguagacagugccauguuuuucuuucagcagaaaagaaacauuguaagcagcucauguuuaacuauuuaagcucaugugaguagagucgagucugugaaggaucccuccaugcucccacaaacacugacugucagcuuuggucuagucacuccauagagcuggguccagccccucaccuuaaacaguagugagcgccuaggaauuccuucguggacuccccugauguuuuacauugugauuugagcuggggauguaacucaauugguagaaugcuugcccagagccaccgaaguggacauggcaguacauagcuauaauucagcugucaagagauagaggcuggagcaucaagaguucaaggucaacuuagacacagugaguuugaggccagcuugggauacaugagaucaugacucccuucccccaccaacauacacacacacacacacacacacacacacacacaaagaugugcaagaacauggguugccuucuuuauuuugaaccaggucuaugaauggcuucuccugaaagaucaccuuaacugaucucaacugauauaucauauuuagacuuaggucucucaagauauggacaccacuaguucacaaugcaaacccagugagccaccagcacuuguaaauaauggcuuuuuuuuuuuuaagcacacagcugcaucuuuccuuuuccaucaugcucauagauaucuugaagagggcauaugguucauaaagacaaaaguagucugugucagaaaagacuggcucccagagaaaugcugggaacccauaguagaucauuguuccugccuacagggguguucugaaaagugugcaguguguauugauaagaucaaagugguccaggugagaagacagcggcuaggcccagagugaaucaguuccccuggaucucugugcauuccugccccgaguaugaggcaugcuguucaggagggaggcaucaugggaagaaggaagugaggugagagaaggaaaagucccacucugcuaaccaaaggugagaaagaccguucacacguacaggcugagacaccaagaggauggagcuggguggggcauguggcugaacugcccagccuuguacagugagcagcaucugucgccuacugaaggcuggaaggaacguggugguaccuuccagaaguucacaaacuggaaauggauucaggagcccauugccucgucuucaguccauuaacaaucccuuuacccaaggaaauucacacauggccuuuaaaaugccagaacaggaaggaacuuaaugcagguuccccccagccccauguagcuccuuuuaaauacagugcagugugagguacuuacaguggucaaagccucagagaaaagaugguaacaucaggggcacauaaagggcgcgggguuucaguuaggaagaaggaguguaggaagccugguguaggcuaugcagcagugugaauguauucggugcuccuggguugugacuuaaaaauuacuguuucuucugcguguucuuaugccccauucugaaacaaaguuugucagucauguagcuuggcaaagcuaagagccguaguacuacagacagaagcuaaagaggcaguguccacugcucagcuaggagcuuaaacuagaagccuacuuuccccuuacauucaauuguacagcaguuuccucuuccgggaauuaagagcuccaccguguugacugcagcuucucuaggcuagggagacggcucagucaguaaagugcuggccacaagagcccgagggccuggguuuggcuccccagaacccacggaagaagucagaccagguguccguauaccugugcucccaaagaagcggggaucucugggguuugcuggccagggagucuagccaaguuggggagcucacaugaauaagaguccuuuucucaaaauaauuaaguggggucaagcauaguaaucuacaccuuuaaucucaauguuuguaagucagagucagacagagaccucugugaguucaaagccagccugaucuacacacuuuugggccagucaguaguaccuaaugaguacuguuuccaaaccaaaccaaaacauaaacgaacaaacaacauauggagaguuaacaaggaagacucugaugccagccaugggaggaugacgggaaaagauaacucuuuuccguuuccacccucagaagugccucccucuguuucucuuugugaauucuaggaaagaaaccuugauugguuccccagaaugagagccaugucccuggucagcagcgauucugaaggggaacagaacgagcugaggaaccugcaggagaagcuggagucuaccaugaagcuggucaccaaucuuucuggccagcugucagaacuaaaggaccagguaaagggccaaacccccucacccaccccccaccccauccucacugcggucucccaucccaacucuggcagcacucacgcugcgguaaugaagcaucucaccuccauggaggggacugggggucagaagacagacuccccccucagagucacugcuuuggcugcccucacccuuggcauggauaugucacuguuucugcacuacuuaggcuguggucucaauauguaaacuauagugaaacacugagcaacaaaaccauuacgcugcauagagcugcacccuuugagaccugacucaccgaugggagagugugugcuuaguucugcuuuagcuucucagcccugugacuucucagguguucacccgcauuuuaaaacuccaccacuugagagaaacugcagguuugggggagcuuuucuaguccucucagaaacacagcccccugcccuacuaccucuugagggaaguugaaaagagauggcagauucacacuaaaccuagcuuauuguccuccacccacagaccuuugaugccuugagagcacagcagucaccagauaguuguauagugauaggggccacuuugggucaaggacuugaaccagggauggggagcagcuccccagagauagccacauacuaacagguacagcucagcaucauaugguucugaaggcguuuuaaugggcaccauagacacugcaguaggcacuggacaagccuguccuggagguaaguagcaagguguacccacaggugacuuacaacuuuuaagcauuucacaacuagagaagagcuggccugcaauaaacacuucucagaggcaguugaaagagcauuuuuaauaauucugcuuucaauuauauuucuuuuccugcugaauuuugcucaucugugcccuaagauaucauucggccucaaguucuuuccuuucaaauacacuaagauacaaauaagaaaagaccaaugagaaaaggucuuaccgaugagagccaucugcagcccagagcuuggcaaccaccugagaugagcaauagccuaaaugagaaaacugaggaagaucuagcuagauugcuuuccuuauuaacugcccguucugcugugagacauuuaagggguguuucacaggcccaagcugauucaggaacgcaucaaugacugagucugcaucugucccuccagcccccaagagaggcuggugaacuucacagcccagcuagcucuucucuccugucugagguagcuguggcaucaagaaucucaguccaauuagauguuuuaaauuagguacagagaacaauucuuggacucugauccaagacacuuaaacacaggcgcuacccgugaccuuggugccauuuuuuuucagaccguucaccuacacuucuugcccaggguaucagaacugcuacugcucaggccuccuaacuccuagggauggugucuccaacccucaucugagcuccucaugacuguuuaucgugauccuugcaaguucagaagcgacgugcucuauugauaugaacaauugggggggggggcgcaccaguuugccggagaguuucuuaaaguacaccggaaacaaaaguacuaaguuuuugaguguucugugguggucaaaucaaggcagcccuucccuucagguucuguugaaaaucccugucccacgaugugcugaguagucugucucccaguggcucacacacagugauucagaagcugccuggagacccacuucacugaccugggugugaguuggccugaggagguacagcagggauggcaggaguagggagaugccucgggaacucaugggccauccuaccaggacccugguuuucuggaugaggaugucaaggagcagagcaggcuccuaggaaacgcaucccacugcacggcacagcaggagggaguaaagcccucaucccccagugcuggccugcuuugaugucuuuaguagguguguucuguuuuguauucaguuugccuucugugguaaauuuaaauuuucuuuugcuuucuuuucuguuuuccuuucucuuuuucucucucucucccuuccuuccuuccucccuuccuuccucccuuccuucccuaaaagaagaagaaacuaacuauuucaugggacagaggaugccuccacugucauaugcaaacaaaaaagaugugcacaucuuuuguaaauuugggccuggguagagcuauuucucccgaccuaacccuagacuaaaagucaugaaaucaccuuagauccugggcgguuucaacuguuccguccccagcccuucuuacaucguuuuccguuuucagcuuggcaguuggaaaagcucuuuagagaaaagccucugagggauucugaaaaugaacuuuuuuuuuucuuucuuggaaaguguucuaggcuacgaagaagcauggaacagcaauagcacguuuugaaauucucuuuuuuaccaggauugaacugcugaaguuucagcaugcuaagaaauacagggagaaaaaaacaacaaaacaaaacaacccacaguugcuuuggggucaggacaggguuguuucauucaaaaggagguagaaauugcuuccuuaaugggucaccuuaacaaaccuuugcaacaucuccgaacuaacuugacuagguuugaauguuauuaaguuugguguuaagagaauucuaaacguugugaagcuguuguggaucagaacucaugguggcauguuacagaucugguuuuggucauugcaaggauuccugcccacaaaaggcaucaaaauggauuaaaaccuaaaagccccacaaaugguucaagaacaagaaccucugucacagacauuuuuuuacuacagccaugaaagaccgucauucacugggaaauccgcaaaaaaauugcuucaucccuuagcuaucccguagauguccugacccagaaggcagcaauggagcgacagucauuuaaguaugaaugacuuuggguuucacuccuugcuguauuugaggucucuggguguuguuuuucuaaacuaccaacuaggggagguguccuugcgaggacauuagugaaaacgugauucauggugucagguguucauucugcugagacguuugcuauucaaagaacuaaaugaugcaucucaucuccaaguuuccccucccaagagauucugaauacuaaaugugguucucuuacaucuuuauuccaaggaggaagacuaauguaagaacuucauaaauuuuuuugcauguuucuuucauaaugcaaaagagcaaacacuaagcaaagguuaauuuucuugaaaaugugacuggcuuccuaaaggacagugccccuuaccuguuaugcuaggaauguaagaagugccugaacaucucaauuauauuagcauguugccuuuuuucaugaaagagagccaagacagacaucugccuucuaggacuccauguuuagcaagaaacauagagaaggagugaguaggacuccaucaaacacagaggaggcuggcccagcaguggcuucaagugagaacgguguagcuucugaaucacccaggagguggcuucugggcugacagagaacuacaauaggggccuuccuggcaaggaagcagcaugaacaaaugcaugaccgagcauggcacgcucaaggaauggcuacauacccagguuaaccugacuccucacuuccaccaacacgggagccacguguuugccaagcacagcacuagauggcagggacacaagggcagagagggccuagcaucugccuucuagaucuagcugucuccccaccaggacuuacaaagggaagugaugaguuucucacagugagcuuaagggagagacugcagccauugccccaagaccuucucaagguaguuugugugugguucagagucugagaaauagaguuuguuggugagguaguaguuaacacauagggggaggggggaggaccuguaagggucugagcaauacuaauauaauauacaauaguauuuaauauuuagcagaugcuauguuuggggcuuguuucagguuuuuugguuuuuugguuuuggcuauuaucuuguuuuuacuucuaagcaucuuuuaaaucugacugacuguacagaaccauaggacagaauucugguuacuagauuuugcuggcuguuuggcaucucaguaaccaggauguuuguccauauguaaccagcagcuuuucggagaguuauuaaggucaguugugagccagacugcagaggguggggggugagccucagcccugugcaaacuuauacucacgucaugaucacccacgcugggucuaguguucuaaugcaaggucuuugugacuuugcuucugucugacuuacauuuacaucuauauuuauauugacaagaggcaaaaggcagcacagagauguucaaggcgguuucuguguuuguauagcuauagcagagcacuuuuucagcugccugucuucagcugaguucuaaaaccuuugaguguucuccagugaggauguucuacauggcucaguuacuuaaguguaaauaugauggggacuuuuaucaguggucaguuuugcucuggauauccauuaauuaggacagauuauuuccugacaaggugauggaaacacauagugagugaggccuugcaguaagauagccaguaagcuguaucauggaaagucuggaacaggcaggaacgguaggaaagcuaagcuaaguguccaauaccacugaccuugguuccuuucaagucagauuuagaccuuagcuguuuuauggcuuuuguuguuuuuguuuuucccccucuuuaacucccuuguaguuguuucugauagccaauucuuccaguggaaggguuauggcuuccuccugucuaugaggccaaggcuaaugcagaucacacaaucaaauagugugcuacuguauucucagccggagagaaucuucuccaagaccugucugcauggaagagaaaggaaacacagaaauguaugaaaacaugcuccaaauguacacacccaguucuuccaaaacaagccagcaacaucuucaacacccaggacuucacuagaaauacauauuccuaggcccccacagcagaccugauaaaucaaauucucuuugucgauauuuuaaugugcugggugguuaugguguugaagcauuuaugaacuagucuauggaaacgaucaaagucagguagaucuguauuggguacuugacaugacuaggcauuaagacuucaccacuaaccuauagcacuauggaccuuacuggcuuaugagagagggaagaugauuugccaacaggcuuuaaugaaacaaguagaaaagaagaccaggaccaugagggagggagccauugauggcucuaagugaagccaaagacucacuuguuuuuuuguuuuguuuuguuuuuauuuuuuaauuagguauuuuccucauuuacauuuccaaugcuaucccaaaagucccccauacccuccccccaaaaccccuaccuacccacucccacuuuuuggcccuggcguuccccuguacuggggcauauaaaguuugcguguccaauggcccucucuuugcagugauggccgacuaggccaucuuuugauacauaugcagcuagagucaagagcuccgggguacugguuacgucauaauguuguuccaccuauaggguugcagaucccuuuagcuccuuggcuacuuucucuagcuccuccauugggggcccugugauccauccauuagcugacugugagcauccacuucuguguuugcuaggccccggccuagucucacaagagagagcuacaucuggguccucacuuguuaaaaagcagaaagcuuuacagguugugaguuuaagacaaagauagagugagggacuuacugagcagagaagaggccaguguauaaaaaagauucucucugguaccagcaguuacugaaguauuucugagaaaguuguaugggccaguuuugagcugcauggccuuagcaguuccauauggauguuuuaggaaaguacccuuucuuaaagggugaguaugccaagauuuucuaaacccauuuaaauacucgagauuaucaagauaugaguggauuccccacaagacugccugucuagacagcaguuuaugugagcaaccuauccaaacuaccugagcugcccuaucugaacugucaaccauucagaugagcauggaacugacauguuaauguaacaaugagugcauccaugcgccaugugaacaucuccuuccucagaugaaccugggaauguaaacuuugaaggcuggcuagaauaucuucauucaguuccuaacaaaaaccuuuauuuaaaacuuccaaguagagguguucaaucuuuguacaucuuuuugucuaaauuauaauaaagaaaguguuuccauuugagcauaaaaauaguaucucuugguuuaaacaguaaagugcucugcucugagaaagcaaaauauaaccacuuuaaaccugagccagaguaacugagcuagguaugaaccagcaaucagugcaggcaggaacugaaacccaggcacccuggcuuugacucugggcucucccauuuucauacgucccaucucauuucgauagguccucagcuuucuacccuccagacggaaauuacauucauuacuuggacuaaugcacaaagugacagaaguuaaauaacauuuuacauugacuuaaauggcugucugaguuuaaagucuuuagguuuuuacuguucuacccuaaaccuuaugcuauuggcacauaacuucaucuaauguauucauauagucucuuaucuuaguuaacuuaugagccucaaguucagaaguaguccugagaaugcugagaaaagucuauugcagagaacugagucguaaaauacccaggagagagcuagagacccaaagugagaacucagcccagcagccagaagaaaaccaaccucuugcucugggcugagaguguacuuucuucaugggaacccacacugagaaauguucucaccucaugugacccaaaaucaagucccuguucacagcacugguggccagagcacuguuuauauagccguuuaguuacccugcaccuugcaggggugaggaccugucugucaucuuuccuagaagaagcagguaacuuuuuuucuaaccucgcagaaucacugagcagaggaaacccaagaccccuugaagagugugggcacaaagucucagacccagggauucuaaaaacacugcuuuuugcagauaaugugacauaacauaacauaaucauagcgagcugccauuuuccaaugagucuugacaucacuuggaaauggcguuuggaacugaucuagaagcuaugcuucaccugucuuuuguuucucuaugaaacaagcagcaagcaguacuugugaaugucacccugcugugcucgcuucggcagcacauauacuaaaacugaaugucacccugcaugaugaggccacagaauuccccaucugcggaggaagaugcccuuguggaagggguguguguguguguguguguguaugugugugugugugugacaguacacuauuuguagaaaguggguuucaguauaacccauaaccacagagguaaaccuaugguucagugugugaccugacgcacaggaagugucugaguguaaugaugaaacuuuuuaacuuuccagaugacagaacagaggaagcagaaacaaagaaucggccuucuaggacauccuccucacaugaaugucaacccacagcagccggccuaggcaaaugaggcagagggacucugcucagcccucuguauaucacugucaggguggguacggcucauugguucugauuugcccacuaaggguacaugugcgcuuaguacauuuguaaauacucaguuuuguauuguauguauaugauugcuauucucagagguuuggacuuucguauuguaauuagcucuguuggcauggugacuugucacuccugccaaaaauauuaaaaaugccuuuuuuggaaggacuacagaaaguaccugauuugcacuugaaccagauuauagauuuaaaaguauaugacauguauuuuguauuuaaaacuagaauagccaguauuuauguuuuuuauaaaacugugcaauacaaauuaugcaaucaccauaacuuuguaacuccugaguguccuaagggaguacacaucuuugaagcugauuuguugauacucguguaauaaaugguuaaauaucaaaugcugcugcugcugccaaaauuauauuaauagcgaguuucuggccccugggcaauuuuguaccuuguaauuauccuauggugaugcuguuucucguugcuaauggcauuagugccccuguauccuagugauaacuccaggucugugaaccauucaaacagcauucauuuugagaaaagcaacuuuaguuucaaggauaauuuuaagcuucaaaauuaaucauuuaaaguguuucuuuaagagagccauguuagaggcucacacuuuagcuugaaaggaguugaugaauuaauuuuuuaaagggaacuuuuuacaugacguuuggaauaacagcauauugcugaccagucagugucaucucccgggugaauuuugaugucacguuauagucaaaugaguuagcugaugguuucuagauuuucuuccucugaaccaugaugcaguagguaagaaguuauuaugcguauauacauauauacauucauauacgacaaaguaggagcuguccccuuaggaugcauagcugccccuaggguacguagcugaacacugacaauggcguucuucugaaagagccacguuuggguuuuauuucuuugucacaugauuucuuuucuggaugggugcaaaguaucacaggaaguguuuucucucugucgccuuguuuuguaccugggucucgcuuuacuagaccgucucugcacaaaaguuuaaaaacugaaccguaugcagaguuccgaagcaagucaaguuuguaaaugcauaccuaaaaauauuuaauaaacgaugcagaauccuaugcagug

SEQ ID NO: 3273 - RNA, 2315 nt, Mus musculus
uaaagggauugugggacauugucuguucugguuucuucugauucucugccgugaggugaacaguuuuacccucugcucucugcucuaguagguaugugcugcuccaaggugggucccaaagcaacuagacugaaaccucaauuagucugaacucagacagaaauucccugguccuugguuuauauaccucagguauuuauuacugcaacagaaagauggcuaacguacaccugguucauauucaguacucagcgggacuuggcagguuuauuuuucucuccuucucuuuauacucccuucuagacuagugguucucagacaguagugaaagugguuuuuuuuuuuuuuuuucucccuaacuuuccccagcagcgaaguggaaauaccuggagacauuuucgguugggcauaugggugugugaguggcaucuaacaagcuaaaggucacaaauauugcucaauauccuauagccucugcaaggaacauuuuccaaaugucaacaguuacuugauugacaaaucuagcacuaaccuugggaaguugaguucagugugguuaauuaauuugcucaaggcugugugacuccuaaacucaccccuucaccaccaguacuuuucuuuugguuuugaagggagauuauagaggaaaaguuugcaguuuggaaacuaaagucaccugacacggacagacaagauuucuaaaaguccauauuuucucaauguucucuaacaauaaucagaaaaacacaguaaaacaaaaacaaaacccaaacaauucauggaucuuaauuucgaaugccaacuugaugcgauuuaguguugccacagaaacacaacguugcgcuuaucucugagggaguuucuugaugagguuaacugauguaugaagaauaaccccgaaugugaguggcaccauuuccucagcuggugcugagacuugaaugagaaggagccgagaauccacucugcuugcagacuggggaugcagugugaucaguugcuucacaucccugccgccaggccuucccuccgugacaacuacaaccucgaagccugcucugcauaagccugguuugucuuagguuguuugugucagguccuuugccacagaaauaagaaaaguagcuaaugccacccauacuaauuagaacugugcaugcauaagaauauuuaugaauuuauuaaagcaggaagaccuuccuagguggcagggcuuuguccuggccacuugagaggauggcauaaccacaaugguagcuuucuucuaaaggcccugcucagaaggccuguuggaaccuggaagccaugaaaagcaugcaauauagcacagggcuccucugugagcuccaguccgaugggccagagcauauuaccuuucuuccgagacggggcaucccuguccacuucaucaucuuucuuuuuguuucccaagucgcugguguucacugucacugucgccuugauuuccugcugggccaccuucauucgaucguaaaaaaccuugaagaacuucucugauuucuuaucuucugucagccggcagaaaaacgagugcugucauggagaagagauucucaacaccaugagacggacacaauuaagauccccaaauuaaauggagauccuaggcaggucauaagcuuugcaaauggucuaccauucugcuuauuagugccugggaguuuaaggccugaacuuuucaacauggagaacuucaaagaaacagcugaacuuggggcagcacucgcucugccuuccgugcggcuuagcuaggaugaagcucuccucucacaucaauggacagcgcgcaugauaacuccacagaugacaaaaauggaaaaaugguuguagugauuacugcaaugagguuguuugucuucucuaugcuccugugcacaucccuaugaacagugauuggaaauaugccgucugcuccacagggcaugcucauagguaaaggugaccuguccacaagccaggcugagguucgagagccaaaagugcucaggaagguguggaucaugugacaggagcuuagaugagagugacaguggcggaacaauauuaaaugcuucaagacaaagguauuuuuaaaaaaggccuugcaccauaggaaggaguggguagaugauguucggaauuaccagguagcuugccucuuggaugugcauuuguuuuuuggccccacugcaagcaauaguguauauuguugaugugaaaacacaauauggugucucuacuucauuuacgacuguucgcuuucacccccuugcaagaaccacacuguugugaguuauuuacauaaaaauacaaua

SEQ ID NO: 3274 - RNA, 6654 nt, Mus musculus
cuuagacagagguuuguuuaauauuaggucuggccaacauacugacagaaucuuccuaguuguguuccccacagcuguugaagcacucccaguauagagucagggauuaaaaggagacuugguugggaguuuuaaaguuugaugcucaguguaagucccgucaaaguggacaucuguccagcuggagcuggacucugaccucugaagaguaaagggcagugugggccccgccugagagcaccaucucucaucuccaggagccucuguuugcugcaagggugaucuacgaccuccucuucuucuucauggucaucaucaucguccugaaccugauuuucggggucaucauugacaccuuugcugaccugaggagugagaagcaaaagaaggaggagaucuuaaaaaccacgugcuucaucugcggugagugucugucccacucgggcaggcaggccacuggccagcauggcugagcacauggccacguggcaauggaguggguacauaacagacacuggacugaggcagucacauugugcagucccaucccugcccucucuuggcaaacaacaggcuucuauguggccuuuuuuuuuuuccuccccugggaaguaucucgaaagccaauaaacucugugcaguaguuacugguuugccuuucggaauuaaguucugaagaguagaaaugucaccacacguguaagaaaaaaaauguaucucgcgucuuccuggucuggucauccugaaaguccccugguccaguccuaaguaaacuaggaaggaaagcuguuauccagcaacagccugagaaugucuucuccacuggcaggaccaggcugcaauggaaaaauuccauuagagcuggacacagcagcacccaucuguaaucagaacacuugggaagcugaggcaggacgauugcugugagaucaaugccaacuuggaccugagcuaccuaguaaaaaccuuucucaaagacaagagaaagaggagggcuggagagauagcacggaggcuaagugcaugcucugcuccugcacauaacccagauucaacucccagugcccaugucaggcaauagcucacaucacccuggaacucaagucuccauaggcaccugaacucauauacacauauaugcaggcaacacuaauggacucgguagauuguauuuauauacauaugcauauacucaccaugaguuugagggggcacacggauaguauaauuguauuuuaauccaagcacucaggaagcagaggcagauagaucucugacuuugaggccaacuuggucuacauagcuaguuccaggacagccaaggguacauggugagacccuaucucaagaaauagguagauagauagauagauagauagauagauagauagauagacagacagacagacagacagacagacagacaaauagauaaauuuuuuguuuuauuuuuuaaaagauagaagucucuuacagucaggugaaaguuaaaggcuuggacucgguacaucagccccugcuucuggaccagccucagcugcugacuggccaugcaccugcgcucagucauuuauauucacugagccaucuucuccaccuguaacgugggugguguccccgugcacuucucugcaucccugugagaauuaggaguggggacuuggauaagcuccugacauagcccucccacccccaaccccuucaugcugcaggcuaaguaggaacugcugcaggaaacaagugcucacacaugcaauuucagcacucaggaggcggcugggccaggaggacuauggguuugaggccagccuuugcuacaugacacccugucucaaaaaccaaaauaaaaauaguuucaugagguaccaaaaaagucucuaaaaguauuacuauuggaaaauauauguaaaugcagacuaaucauguuggaaucuggaagcugaguaaucauaucaggauuauucagaauaugguuacuaaauuuaugaauuccuucccaauauggauacuaaaaaauggaaacuuucuuuuaaacaucuaaauucuuuaauuuuuagccucuuuaagaccuaguuuuuaagcuuuuuauuuugcuguaauuuuagugacagaaaagucauagaacuaguacaaagaguuucucccagcuccuaagauuccccuaauuuuaauuuuaauacuggcuucccuuuccuuuacuuucuguacacacacacaugcacacccacucacuuuuucugaacugauucagugucaguggcugacaugaugcccuuuugaucuuuagcauuucaguauguauuugcugcuggcaagaacauugucuuacaugauugcaguauaguuacugggaaauuuaagacaaaacuaucugucuaucuaauuuaaaaaacucacccuucauucuacuagugccuuuagacagucccaagccaugugacauccuacauuugggcucuuaacuccaugggcuuuuuuuuuuuuuuuuuaaauuuaaagauuuguuuauuuguguauaggagugcuugauccacauguuugucuguacaccagaaagggcaucagauucuauuacagaugguugugagcuaccacaugguugcugagaauucaacucaugaccucuggagaaacagccaguguucuucaccacugagccaucucuucagccccuccacagacauuugugaagaacauaaggcacuuguuuuguaggaaauccuuugauuugaguuucucugaaggucccuuauaguagagcuaagcuuaugcauuuguauacgaauauugaagacacauuuucucaccuucucagucugccacaccagggaaacauuaagucauagcuuaaaguauacagcugccgauacucacuuuguucucuuggauaaggacauauuugguauguuucucacaauaaagucacuguauggcaggacacuuggaaaccuuguaaguaaccuugguauuccucacuuugcccauucagccccagacauaguauccccuagugauucugccuuggaaauuauuucccauauuuauuuauucaggucauuaaguuuggcauaacaucuuaccuuaauuuugaguuaguguaggcuggccuugaacuugugcuccuccugccucagccucccaacuauggugaugugccauuguaucagguucugccuugaugcucauuuccccuuggguuuggccagugagaacccuucaggcugccuuuuguguuuugucgugucauaauuuuuuuuguacuguauauuuuucuggcaacuuaagaauuuccagucucaaaccuuugccuucucugauccagccauacaaucagccauuucuucaguuguucauagugaaauaggcauuuaguagccaacaucuaaguguucaucccuuuugaugaccacuguuccagguuuaggcuguagaucuaugggcugguguguauguaugccuuugugugugcauagaaagacauggagacggauccaccuacaucuguuccucuaguuucauauagauaacaaaaagauggcuaccucuaauccuaccucagcauuacagugucuauaucaucuuccuuacucuguauauuugugcucccuucuuuuaaugugaggaauccaaacccuacuaauggccugaaauauauuuccuuuuucaauucuaauuucauaauggcuagcccaggccuucacaaaauacaguuaucaaccagcaucugaaauugguuuaaaguucuuuuugucauguccacacuuuggcauuuaccugggacaagggagcuuagaaucacugauguccuccggggccugagccuauccucaugcuuccuccccuagaagcuggaaggcagguuucccgugcacccgugaggcagccaaggcaccuggccuucauuaggaagcugcaggguuuucagacccuaggaucugcacacgguauugccuaucuguaaauccagcacuugggaguuugaagcagaaguaccaggaguucaaaguuagccccuggcuacauagugaguuuaaggccagccugggcuacaugagacccuguuuuaaaacaaaacauaaacaucaaauaaacccugguaagucagacucccugccugugcccuccuaccaugaugaaaguggguuugaaggccaaaagacuccaacucugccugcagauuaaucaagacaacaagcuaugcugacuuugcuguaccgugguggcucauggggaaucugggguguucugucucucauuuaggcuuggaaagggacaaguuugacaauaagacugucaccuuugaagagcacaucaaggaagagcacaacauguggcacuaucugugcuucaucgugcuggugaaagugaaggacuccacagaguacaccgggccugagaguuacguggcagagaugaucaggguaagaaggggccccaaagcaaggcagccccggcagccucggcucugccuuccugguucaauguuucuggcaccuguagaggagccacauaccaaaaaccuauggacugagaccucaguacucugugcaccucuguucccugagguucagcuggcaccaacucugcccgccugcucucaaggaggggaggcugagacuuggggaaaauggacucagggcugucuaacaacugccuuaucucaucucaaacuccaccucccagcuuagugucugucucagucuaccucuccuugguauuccacauuguuuuuguuuguuuuaacaucuccagucucacuaagauugguccuucacauacccgaugauuaauacguauaguuuucagcacgacguguuucucugggcucagccuucugggagcucugcugccuauauggaagggaucacaugagggagucuaagcuccaggguaaccuuccugcugaugggaaguguauauuucugugucccagcaaggcagagaguuagcugcuguagguuuucuagauaacucuucucucacagggcuuugaggaaucacaagacgugugcuaugagaguucccggccagcugcccuuuauaacacgugcuuuccaaaucucuuagaaugugcaggggcagggagguguggaaaagcaaagaagcauggacugucaaagcagggugaugaaccugggcucacucagcagcgggccauugguucuuggaaaggcuccacgacuguugcccuccugccaguggccaggaacgcaugcgcuccaucugaccaugaguuucccuaaccaagcucugcugugguuucuguguguaagacuuucaggccuagaaacauguucgugucacgucugucccaguaagcagcagcacccacgcuagcaagggguagugaacuguacugcgugcagugccacagucgugugguacuacuuccugcaccccccaguccuaccagcuagaaggcuuccuggagggggaacuaccauaugugucuugacauccuuaggguuuguaucaguugcucgguucauggcugugaccagauaccagaugagaagcggcuucagggaggcgugaaggcaggagugagaggcaucugcucacaccgcccacaguguugagugcugcuucucggcugcucucucauuugucuucagccugggaccccagcccauggaacagugccacccacauuucggauggguguucccaccucagcuaaccaagucuaggcccucccucccaguggcaugucuccuaagugaccuuagauccucucaaggcgaacggccguuuguauuaaccaccgcaaguuacacguuucccaaauuugaaugcacuuagaacucuucuuaguauuauccugacucagcacucacuucaaggauucccuggggugccaacgauacaagucugcgaaucacccuuugaguaguaagaaucuaacagaaaaggcaaaacacucugacuuaaucaguuaccauccaagggcugggagacaaggcucagugggcaaaaugcucgcugggcugaguuucugaguccagguugagaucccuggugacuauggaaaagccaaaccuggugucacaagucuauaaauccagacagacagaucccugaagcucacuagccagccagucuagguaaccagcgaggcuuccagaaguagggccuaguuggaggaaguaggucauugggaguguagaaugcuggcaagaugguucagugaagaaaggcacaugcugccaagcaugaugacgugaguuuaauuccucagaccaacaugauggaaagaaaacugauucauaugccaugugcauacacaagauaacuaauuaaauauaacaaauauauauaaaguaauaaagucaauguaauagguaaauaacuuauuuacauauaauacuuauuacuuacauuuacaauauaaacauaacaauuaaaaucaauaaagaugauaaauaaaugaauuuuuuaaaguaggauaugagguuaagaagaacacuugcuacccuuaccuguaacuccaguaccaggggauuuaauguccacuucuggccuccacgggcaccaguugggugcucauacagacaugcaggcaaaacauucauacacauagaaaggaagaaaaagaaaacuuuuuuuagagggcagaaagcaauagaaggugcuugaugucagccucuggucugu

SEQ ID NO: 3275 - RNA, 2223 nt, Mus musculus
cuuuuuuuuuuuaacaaugauaaaauuuguuuuauggaaguauuuaaaaauaaaauauuaucaucauaguaaagacaaaaagauccuaaaggugauaaaguuccuuuuuaaaggguauuggggagggggaaguugggcaaagucaguccaggcugaaggcagauugccucagugugagaacugccugcggucugcuggcuucuuacugauguguuuaaagaucuuggacuucuccacuuucuuuguuuucugguagccgaauccgccaccaccgccucucuucuuaagcuugccaucauggcugcucacauucagaucaacaaaaggagggaccuuaaaaccaaaagacagagcaaccugaggcagauuuaaguuguucacguugaagaucugcuugagagagugagagucauaugcucguauguaggauuuguaugcuuccugggcagacuuguggagaaaguaguucuuuucgaucaguuuuuccggcugagacuggauaucagaaacuuuagaccaggagaagucaaacugauucaauggaaccuugaacuguuucaaguaacgaaggaaacccaacucuucagggcgcaggaugagcagggcgugcccucuuccauucaggccccuggcuguucuaccaacacgaugaauguauuccuuggggucaucgggagggucguacugaacaauccaguccacuucagggauguccagcccucuggcugccacaucaguacacagcaguauuccugaauccgaguugcagaacuggaaaaacgugguuguuugcuuauuuugcuuuugcuuuccauggauggccaagacgggaaggucaauguaguucaacagcucauagugguauuucacagacauacaagaugaaaagaagaccaucacuuucuucuuccgguucuucuuaaggaaugugaaaagcagaaggaaccucuucucagagggacaaacaacauagcccugcucaaggccauccacuguggcaaccucuuugucgucaucaacacccacguacaaaggcuccuuuuucagagaaauucuugccaagucuucaacuuuucgaguuuguguggcagaaaagagcaugguuugccuacgugcuggcaaaaguuuaauaauuugcuuuaauucuucuucaaacccaacauccaagauacggucagccucaucaauaaccagacacugcagguucuuguacauaaacccuggcguguucugcaugugguccaggagccggccgggcguggccacgaugauguugaucccauugaggagcuucugcacuuucagcagaccuguugcugccgcccaugaucagcccauacgugugaacguggugcgucaucagcuccuugagaacaccaaaggucugcauggccaguucucugguaggagagagaaucaggacuccuguuccauuccugggcaugaacuucaacuugacaaugagcucgaucacagggauaaggaaagcgaggguuuugccacugccgguuuuugcagccgccagaaggucccugccuuccagaaguggccugauacuuuuaugcuggaucuccgucaugugcuugaagcccauuucuucuauggccuucaggguguucucauugacgagauuagacaaggaagcaaaugaaguguccucaaaagcaccugucaguccuaguggcaggcugggcaccucgcugucaucugccuuuuucacaucaucuucugguuccucacaagccucagcacuuucuucaguuuucgcuuuuuuuguaucaggcccggcaucauuugccauuuuccucuuuuucuucuuuuucuuuuuuacuucugaaucaggaggugguguuggugcugcuucuccguuggcuaaaguugugaguuucuggggugacuuuuuaacuuugccauuuuccaaggucuccucaggcaugccuccacuuugugcuucugcugaguccacaggcacagaacguuucagggccuuuuucgcuuuuccaccuuuuccuguuucuuuaggcacaucuccauuuugagguugggacaggcuugugucugaugcuucuugcagcuucagguuucgcugccgcagcuuggcauuccgcuucucgaucuuccugcgcaggaguuucaucuguaacugcgacaucuugccgggccgcccagcugucugcacugagacaaaugcacgugcgcaguugcaagucggaaguguaccgc

SEQ ID NO: 3276 - RNA, 2223 nt, Mus musculus
gcgguacacuuccgacuugcaacugcgcacgugcauuugucucagugcagacagcugggcggcccggcaagaugucgcaguuacagaugaaacuccugcgcaggaagaucgagaagcggaaugccaagcugcggcagcgaaaccugaagcugcaagaagcaucagacacaagccugucccaaccucaaaauggagaugugccuaaagaaacaggaaaagguggaaaagcgaaaaaggcccugaaacguucugugccuguggacucagcagaagcacaaaguggaggcaugccugaggagaccuuggaaaauggcaaaguuaaaaagucaccccagaaacucacaacuuuagccaacggagaagcagcaccaacaccaccuccugauucagaaguaaaaaagaaaaagaagaaaaagaggaaaauggcaaaugaugccgggccugauacaaaaaaagcgaaaacugaagaaagugcugaggcuugugaggaaccagaagaugaugugaaaaaggcagaugacagcgaggugcccagccugccacuaggacugacaggugcuuuugaggacacuucauuugcuuccuugucuaaucucgucaaugagaacacccugaaggccauagaagaaaugggcuucaagcacaugacggagauccagcauaaaaguaucaggccacuucuggaaggcagggaccuucuggcggcugcaaaaaccggcaguggcaaaacccucgcuuuccuuaucccugugaucgagcucauugucaaguugaaguucaugcccaggaauggaacaggaguccugauucucucuccuaccagagaacuggccaugcagaccuuugguguucucaaggagcugaugacgcaccacguucacacguaugggcugaucaugggcggcagcaacaggucugcugaaagugcagaagcuccucaaugggaucaacaucaucguggccacgcccggccggcuccuggaccacaugcagaacacgccaggguuuauguacaagaaccugcagugucugguuauugaugaggcugaccguaucuuggauguuggguuugaagaagaauuaaagcaaauuauuaaacuuuugccagcacguaggcaaaccaugcucuuuucugccacacaaacucgaaaaguugaagacuuggcaagaauuucucugaaaaaggagccuuuguacguggguguugaugacgacaaagagguugccacaguggauggccuugagcagggcuauguuguuugucccucugagaagagguuccuucugcuuuucacauuccuuaagaagaaccggaagaagaaagugauggucuucuuuucaucuuguaugucugugaaauaccacuaugagcuguugaacuacauugaccuucccgucuuggccauccauggaaagcaaaagcaaaauaagcaaacaaccacguuuuuccaguucugcaacucggauucaggaauacugcuguguacugauguggcagccagagggcuggacaucccugaaguggacuggauuguucaguacgacccucccgaugaccccaaggaauacauucaucguguugguagaacagccaggggccugaauggaagagggcacgcccugcucauccugcgcccugaagaguuggguuuccuucguuacuugaaacaguucaagguuccauugaaucaguuugacuucuccuggucuaaaguuucugauauccagucucagccggaaaaacugaucgaaaagaacuacuuucuccacaagucugcccaggaagcauacaaauccuacauacgagcauaugacucucacucucucaagcagaucuucaacgugaacaacuuaaaucugccucagguugcucugucuuuugguuuuaaggucccuccuuuuguugaucugaaugugagcagccaugauggcaagcuuaagaagagaggcggugguggcggauucggcuaccagaaaacaaagaaaguggagaaguccaagaucuuuaaacacaucaguaagaagccagcagaccgcaggcaguucucacacugaggcaaucugccuucagccuggacugacuuugcccaacuucccccuccccaauacccuuuaaaaaggaacuuuaucaccuuuaggaucuuuuugucuuuacuaugaugauaauauuuuauuuuuaaauacuuccauaaaacaaauuuuaucauuguuaaaaaaaaaaag

SEQ ID NO: 3277 - RNA, 6301 nt, Mus musculus
cucauucacuuggcucgcacggcgcagacagcgcagcgagcacacaccgccagucugugugcagagcgggagccagaagccguggggacacccggccaugcacgcccccaacugaagcgacaccucaaagccgcugcuccuggcaucccagcgcauugcaaggaagcucaggcuagcucauaggaacauaccucuugagacccucggauccucccuuccagggcagcccuuucucagacucuacuaagugcagacaggagcgcacaguggccccugcucgccgcaucauggaacggauccccagcgcgcaaccaccuccuaccugccugcccaaagcuccagggcuggagcacggagaccugucaggguaagugugugcugugaucccuucaagucuccacuccuaaccuuguguuccgcgacacucucaacuuggggcaucucugagaguauagggggcuucuuucacgucuagggcuccugcagcuaguacgcacucgggagucacggcuuuuucugaccucucucccugcaggauggauuuugcccacauguaccaaguguacaaguccaggcggggaauaaaacggagcgaagacagcaagguaggugcaucccugggaaccucauuccuuagccccucgugugcgcugaguuuccaagaaaaguuugcuuguuucaagguuggcugggggguucaagaugagaugagcucauugccacaaaugagugacuugggaaagaaggggcagagaaggugaaucugggugcgucucugcgcccucgcagaauuuuuccccccugcuaccgguugggaaggaagggaggaagcuucguucccuuccccgggcacccauugcuuccauguauuccaugcaggaaacuuacaaacugccgcaccggcugauugagaaaaagagacgugaccggauuaacgagugcauugcccagcugaaggaucuccuacccgaacaucucaaacuuacuguaagugagaagcuggcugcgcuccaacccaguucuucugcccagagggcggaugguggggugggggugucucucgccgccugcaggcgucacggggaacugcaugcuagacgggcggaucaaagcuucugguuuggagggaacccauccccagacccagaacuuccuaagcagaggcagaaccagaaccaucuggggccucuuuaaguuggcuucaacacuaacacagcuuccuuuugguaguuuuuuuuucucucucucaccaccuuguagucucccugacuuaaagaagcaaaccacgaaauuaaaaacuuaagccuuguccgcuuuucauuuacaauaggaccuacuuuauuuaaugugugccuuuuuuuuuuuucgucauaaucuuuacugguagccaaaagcuuuuuagcuuuuccuucgggaaaaguauuuggaaaggaagacaaaaagccagcaugacuggaaguucugaacaagugucaggggggaaagaaagaaagaaagaaacgcaacacauugggaaagccacuugguugccagacacaguagacaucccucccuggguugacaccacagcagauaaauguuauccccggaguccccuaaguuaaggucagggcagcugcuggagaaauauaucugucagcucacucccuagacuguaacaacuaccaaaaugccuccaaagauagacaacacgugucuggcuuuuuuuuuuuuuuaagcuuuugaucaucuauguguauauguuaaaacaucugcaaacuuuaaauuuaguggagcaggaaagacucuuccuaucuuuguuguuguugacacccaauucuccuaacagauagugucagaagggacuccacugaccucacgggugacagacucuccguuuuuuucuucuucuucagacuuugggucacuuggaaaaagcagugguucuggagcuuacguugaagcacgugaaagcauugacaaaucuaauugaucagcagcagcagaaaaucauugcccugcagagcgguuuacaagcuggugaguccccggccugauuagugucuccugagagcucagugccaaucuagccccugggagcucgcucuggcuucugacucuucuguuaccauucauuuuucacagucacugggcaggggugggggggggggagaugcucuucugauucuuuccuaaaaggucauauuuugccauacggaaugcugcugugcgccaccugaaaugaguccauguuagcccagugaugaaauguuucggugacauuuugagagugucuagguuaugggagacuuccccaucccccuuuaaaaugccaaggcaccuauaauuugcauuguggguguuuuuacaguuggucugaugagcccucauucaugggcgaacagaacacgggucugcccccaguguuuuccuguuucuuugcuuccuucucuuuggauguggggugcagucuuggcaggaugacagcagguuuucuuuuuucuuuuuuuuuuuuuuccucuugccugccuuccauugugguucccugaauagccaccagguaucuuggcaaauugcacaauccaacgaaaccacugcuuucaucauucauuuauccugaguuucagagaaucgggguacagaccagggggaauccuaauauguaccccaauaggcguucuucaguccuguccaaggcuagaaugagaaucacagaaaccaaaccaagccaguaugucugccaguuuucuuucuaaaaauagaaaguugaucaggacugaucucggggugugugugugugugugugugugugagcuacaguauauggagaagacuuacaaauaaagagccuaguuaaacugcacggaggaaaugcaacuauuugaugaauagguuagguuucugugugugcagcaguuguuggaguuguugguuuuaguuuuguggugguuuugguuguucugguuuugguuuuccuaaagcucagaaguaaccugccagccucacccucccaggcggggggauuacagugggagcuguaacaguuucuugggcaugguggugcaugccuguaguccuguccuugagaggcagauggagccccuuaaauucauagccagccaguuuugcauagggaauuccaagccuuuuaagacuaaauagggagauccuagauccuaucucguacaaaaaaagggguggggggcaagggagacaauguuuuguuuaggcgguauuuguuuuauauaguuucuuuuuaugagucucuggacuucugcuuccaugaaacuguugcuauacuaacuuauugaggaugggugugguagugcagaccuguaggcccagcagucugaaaguuaagauaggcucauaugcguucaaggccagcuuggguugcugaguaacucagugucacucuagacuagaaugagacugcuuuauuuaaaaaaaaaaaaaaagaugugacuguugaacuuuuaaacacaguagcauguucauuuuugugacacaagaaaaaucgguagcuacuacaugaaguuuaucaagaguagaaguaaguugguuuauuucucugggacacucuacagacauuaugaauccuaguucggaaaguggaguauauguaaccuuagcgauacucuguuguaauuaguauuaaaacccaaguauuaauaaggaaaaaaaaacccuguaacuaaguggucggaauuuguuuauuuuauucuuuauacuucucagcauaauucucuaggcauagacuuuuggagucugaaaugcaaauugcccgacaauuucaaaagagacaagaagagagccucagacuuaccuaccacccaaccuucuaaaauccuccuuucugggucuuuuucuucaggugauuugucgggaagaaaucucgaggcagggcaagaaauguucugcucagguuuccagacuugugcccgugagguacuucaguaccuggcgaagcaugagaacacucgggaccugaaaucuucccagcucgucacucaucuccaucguguggucucggagcugcugcaggguggugcuuccaggaaaccauuggacucggcucccaaagccguggacuugaaagagaagcccagcuuccuagccaagggaucagaaggcccugggaaaaacugugugccagucauccagcggacuuuugcucccucggguggggagcagagcggcagugacacggacacagacaguggcuauggaggugaauuggagaagggggacuugcgcagugagcagccguacuucaaaagcgaccauggacgcagguucgccgugggagaacgugucagcacaauuaagcaagaauccgaagagccccccaccaaaaagagccgaaugcagcucucagaagaggaaggccacuucgcgggcagugaucugauggguuccccauuucuugggccacacccacaucagccuccuuuuugccuucccuucuaucucaucccaccaucggccacugccuaccugccuaugcuggagaaaugcugguaccccaccucugugccaguguuauacccaggccucaacaccucagcugcagcccucuccagcuucaugaacccagacaagauaccgacucccuugcuucugccccagagacucccuucuccuuuggcacauucgucccucgacucuucggccuugcuccaggcuuugaagcagaucccuccuuuaaacuuagaaaccaaagacuaaacucuggagggaucuccugcugccuugcuuucuuuccucccuaauuccaaaaaccacaaagguuucccugagugcagagagaucagcccacccugcagacccacagagaagauucagagugugugugagagugagugagugugcgugcgugcgugcuuguauguauguuuguauauguaggacaauaaguuccuucugacacaagggagacacgagaaggauagccugacaucagaugacagacuggaggacuguagcacaucucugggcguuucccuacccagagaagagccccccccuuugauacaaaucgguuggauuuucauaugcuucaaaggcuugaucugugagucacucuccaguuugggacaugggucugucuguggcuuugagaaaagguacuuucaaaagagggcuuuccagagcacagcucacagccagcuguuaggaccccacccuucucccuuuauuguggaggugacucacagcagacugacaguggucaggcugagcuuucugcuaagguggugaggucgccaacacuggcaugucucgguagugguuugggcaaauuucugcaggucccuuccccccaaccccgucucugaugaauaaagaccaugaguggaguuccuuaacucaggcuuuugugaguaguuuacuaaggaacugaaaaugguccccuuuguccaagcugagcugcuagggaaucaaggugaacuagacccguccucaggccucuggcaccuguuucuagcucucacuucuacggcaugcuguccaaggaaccaaaggaggcucucggagaugcccccaaacgucccaaaguacacagagcuaaguaaucaauugcuacacuuauugcacagcuagacacggauuucaaguguauccuaaagcuuugaaccaagcuuagcuucucaaaggccuagcagagcuuuggcaccccaagauccuuucuguaggcuauuuccucuugcccagcaguggauggagcguccuugcuaaaaaggguuccaucuccuuuaaggacguuuuauuuuugauccagaguccuuguuuccuugacuugcuccaccagcccugcaccagcuuuccaaaugcacucugcuuguguugaaauucucccauuuuuauuugggcauaaaaguuguugccuuuauuuguaaagcuguuauaaauauauauuauauaaauauaugacaaaggaaaauguuucagaugucuauuuguauaauuacuugaucuacacagugaggaaaaaaaugaauguauuucuguuuuugaagagaauaauuuuuuucucuagggagaggcgagguuacaguguuuauauuuuggaaccuuccugaaggugugaaauuguaaauauuuuuaucuaaguaaauguuaagcaguuguuuuaaaaauacuuaauaaaauaagcuuuuuuccuguggaagagaaauggucuccuugguuuuaaaaauaacuuagugucacgguacuuucucuguccucucaacugaggacagugacuaguuaaucuugacauaauugcauuuggcuugucaugugccuggcauuaaaaacaauauugaguucacauaauagg

SEQ ID NO: 3278 - RNA, 606 nt, Mus musculus
uggacuggugacaguccuaagucauagcugugucuaauguuauuacuucucccaaacagucgcacugcuugucugaauuaguuuuucuuccaacugaagucucuacgaacccagcgaagugcgcugauguggucauggcaaauuaacaccaaugcagcaccggcuuuuuggcuucaugucaagaaugguaaauuaaacauauuaaaaacaaggcaggcagccuugcccagugauuaaccauggcaacugucaggaauuaggcugaagucugaguguaggagagaagggacgcuucuguaugucaauaagaaugugaaacauccuguguguaggccaaagugaaagcauacuaaugggagugacaguaaugagauuauauguauuauaagcacugacaauuaugcucucauuacuaaaauacacaaagggaaaugaacacaauuauguugcagacacuaugggauggugagcuuauuaugccacuuccacugugucuauaaaaguauugcugcuuaguuuuaugcauuauggguguaaaauuaaaaaaaacauaucuaccugauauuuguggaaacuaauauuggaagaaguuagccuagcaacagu

SEQ ID NO: 3279 - RNA, 77642 nt, Mus musculus
uacgguguagcgcggggaauuucgaguagaggagcugcguggcgggccgguagcuggcggucucaucaggugcggccauggagguccuggccgagccgcgauggccuccgggguuggcggugaugaaggugagugucgggggaaggccggggcgcggacgucgucggugcgaacaggcaccccgguccgcgcgccgccgccucggcccuaaccuggccucgcgacgccgguccucaguuuccaacccccgagacgguccgggaacgcgccgcggcccugcgcagucagccuuaggucgccgcccuaacgaaccggauguuuuggguuucugucacuaucaccgcgucuccccguaaaguagugucaacgauggugacaucacauccuacgaggacuccuguguuaacagugacaccacucgugauuuguguggacguugcaucggaugacauuuuauaaucaagcaguauagcagaggguccgcuuaucaugguuuuccauuucuggcugugguccagaaguccuccacguucuuaacacacugcauccggcuucccugccuaaugugcccuccaugacucaauaaugacgcaucucucuuuauuuaacuuuuauuuauuuuauuaauuuaggagacgaggucauacccuguagccccuggcucacaucuuuuuaaaagagagaccaggaccuagacccagcgcuuagccuuuccuuuuaaggaauuauugcauacugaauuaucucccuuaaauaacauuuaguaggauguguuguuuguuuguuugauuguuuuugagacaggguuucuuuguguagccuugcucuuguaggaccaggcuggccuugaacucagcgagaucugcuugucugccucugccucccaagugcugggauuaaagaugugugccaccucugcccauccgguggauguuuuuuguuuugauguuuguuuucuaccaagauuggguagcccuccugccucugucugcugagugcagcaggcuuacguuguaucuguuauaaccuagacgguuucccuaugacaguugguuauucuuugcuuuuauaauuguuguuuuuugagacagggguuuuuuuggauauccuuggcugucccguaacuagcucuguccucugagugcaggcuuuuuccuucuguucuuacaaacaaugcaucuauuacaaccugaacauuucccuuccacaacugauuauuguuuguuuuauuuuguguguguguguuguuuuuugagacaggccuccuuuguugaaucccugccuaucccagaacuagcucuguagaccaggcuagccuagaacucacagaccucaaugccucugccuuccaagugcugggauuaaaggcaugugccaccacugcccagcacaagcagguuuuuauagcuauguaauguuucauauggacuguaaaugacaacuuuuugguuuguguuuggcuuuaugacgggcuccuuauguaguagugcagguaggcuugaagcuuggauacuccugcuccugccacugaaguguuaagauuaaaaguagguacucccuugguuguauuugcuuauauuuacauuaauuauucuaaagaauuauuuauuuuauuuuucgcauugagugcuuuaccuacuuguauguauaugcacugcauacaugccuggugcccauggaggucagagacgacguccucucgccuggagcuggaguccuggauggcugggagccgugugugggcacggggaauccagcacagguccccuuaacugcugagccaucucuucagccuccacaguguuuuaaguaacagauucauacaguucaagaaauacauaaaauaaaaacgaucuccuuuccgccaugucccucauugcccaguccccucaucuuaguaacucugaugaucacuuugucgcauccuuucagaaguuucuuuauauauggaauauagucuacuuuguuggugucgguggggugguuuuuuuuuuuuuuuuuuuuuuuuuuuuuuuuuuuuuuuaaagagcagcgucucacucuguagcucuggcugcccugaaacuauguagaucagguuggucuugaacucacagagauccuucugccucugccuccuaagugcagagaagccugugucacuaucuuuggccuacucuacauguuaaaucaucucucugugugugucaggaugcuagccagggucacuuccaugccagacaaggacacugccaccucccuagcuccccacacuuccauuucuugagaauaaagcaccccacugucauugcuaucagucccuuucuuaaacaaauuaaaggauuuuaaguugcaagaaccaaucugguucugcugagcuuguuguccaaguggacacuggcuuucgaaggcuuucucauuggcugcacugugccuauagaaaguaccagacuaccaugaggaggguggguaugucagccuuggcuugaaacaggcccaguauugugugcuuaccugggauguuagucuccucauugcgaaauagagauuuuaaucggauaguuuaguauuuaucuauuuuauuuauuuuuguuugagauaaggucucauuauauagccacaucucgauuugcacucaauccuaccucagcguccgaaugcugguaucacaggugcaucgaccgaccccacuagagacucuuuaagucuuuggcuuuauuagucuuuuguccuggcugguuuugucucaacuugacacaggcuagagucaucagagagaaaggugguugaaaucuuccaccgaguggugacucugugccagaggaugggucugaaagaagagcagggaugaaggagaagagcagggaugcaggagcccuuugugaagggcuaacaguguggcccaggagccugcagcuccaccuguccacaaagcaaguaggauaaccugaaacuuaauauucagggggaagcuuuucucagucaugauccuuuguuauuugucuauagucagauuuugaauauguaucacucacaaauaaguguuauguaauucauuuuggggacuagagggaaaauuguuugccaggcauugagugugcuguugauguccugcugauacacaugugcuuuugcauugcagacaauagaugacuugcugcgcugugggauuugcuuugaguauuucaacauugcagugauaaucccccagugcucucacaacuguaaguacccuuuguuuuucuuaguaaaagcacaacguaguuuuccuugauggugaaggaaauacuguucacauagucauuuuccauuuuucguuccuuugccgugcacuuucaaggucuaugccgucaccuuuuccugaauauggcaauuguguuucuuacaagguucuuagauuuucugcuacgucccccuuggauauuuuuacaugucuuuugcagaguuuaugguaguaaagauuuugguaaaguauaugcauauuugcugaacacuuuaauauauuaagcuucaggauauuuuuagcaggaugacagacaaaugguucagccacuuaguguggaauuguaaauuuuaaacuucaaaauauuaggaaugcagauacuuuuaacaugggauuauauccuaguaaaccuaucagcaguagaaaauauuaauaagguaaacauuuguguuuuuuaugauuauucuauauaaaauuuuuaaauauauuuuuaugugcauugcuaguaagguaaacauuuguuaauccacuuaaccuguuuccuguuguagcacaguacaggcacaauacacucacccuucugaccagcuugcuuucggggaguugugccuacuccuucuacccagcauucaaaaguguuauagugcauauugcuaguaaaagguugugguggggaucgggacagaggaauuaaaaugcaaaauacaguuucuauugagugaauaccauuuuuccauucugguauagcuggaaaacagucagucaaaccaucauaacuaggaccaucuggauucccucacaguucuccuauuuaagaguauuaaagaucauuuuaucacuuagcagccauguacuaccgaaaacaacuaugcaauagaauugcuucuuuauaagaaauauuuuaaaugcuuauugaauaugcugguucaucuguuuacuuauuuguugagggacaagucuugaccacagccucauacauucuuaggcaaguacucugccagucuccuaaguauuuaauaacuuaugguuguacaggcgaguuagccugccaauuaggccaucuaguguauugaauauuuaguuaugguauuuuuuuguccuuuguuuucaaguuuauuuaucuuggaaacuuaaaaaucaguucaguuuggcuuaaaguugguuuuauuggaaggcauccuugacagacaguucugugaagucauacuaagaugaugcaaauguccgcuuugcagauacacccacgcuucgcucuugagagccacuuagcaaguggaugaguuuguagucauugccuaggauuucucuaaauguaaaugucugucgaguaguuuguacuucagaagauaguucugggaauuaaugugcaaccuugacaaggcugugggaggugguuuaguggguaaaguguugaguuaugaucccuacuacccacuuaaaagccaagggugaugcuagacaccuauaaccuuagaacuugcggacaagacagaugaaucuggggcucuaauuagccuaacuggaaaaacaacagugaauuucaggaccuugucucaaaaaauaagauggagggugauugaggaagacacacagcguugucuccauguguauauacccaggcaagugcuucuacauauaacacacauaccaaaaccaaacaacccccccauuucuuggcccaguaugagcagauugcuacuuuuguugugauaaaacaccaugauccagucaacauauggaaggguuugagguuuaccaccucaaauaagagauaagauaagaguccaucaccaucacagaggggaagugugucugcagacaagaauggcagauggggguuacagagguaugcaguacuccaguccuggacauugugggauacaggcccuuaguuggauggauggggcuuguuaacagcuaaaacuaauuaugaaauuuuuauugaaucaguaugauuucaagugaugcauuuuuaaaaaugacccaauccacugaauuaauaguagagucugggaacuaaauuaaaagcaauagcugucccuguaggugccugagcccagcagguauauuuaggaaugugugacuuaaaauauugcuugggagacuucuuacuguaugccuuaguuacauuucucucgcugugcuaagucaccauggcauggcaaccuauagaagaaugaguuuauuuguggguuauaguuucagaagguuagagucuguaagaaucauggugggaaacauggcaguaggcaggcaggcaggcaggcaggcaggcaggcauggugcuggagcaguagcugaaacagcacaucuagagaugcagcuaugagguagagguaacugggaguggcaugagucuuugacacuucagaguucaccucuagugauacaccuccuccaacaaguaauacuaacuaaucauacuuauauuaauuaaauauuaacuauauuauauuaauccauaccuucuaauccuugccaaacaguuucaccaaguggagaccaaguauucaaauauaugagccuauggggccauuuuuauucaaaucaccacauuccacucucuauccccauagguuugugauuguauaauaaugcaaaaugcauuuaguccagcuuuaaaaguccccauaguuuuucacaaucucaacauaguuuaaaaguucaaagucucuugaaacucaaggcaauauuuuaauugucaccaucuguaagcacaaaaaucaaaaaguggauuacauaauugcaacauagaguggcauagaauagaccauaauggaggaagaggcuuauagugaggaaauacuggaccaauacaagacugaaacccagcaggacaaacuccaaauucuguaaguccauguccaauggcagaggguugagaugguucuucgcuuccagccuugcugacugcagcacucuuugcucucgggcuaguccacucccuguguacagcuagugcaacuuggcagauauccuauggcucuaacaucucuaacauccugggaucuccagcaggauccaggcuucacuuucacagcuuuaugaaguagccuuucagacuaaaugcugggacucuccugccacaugccuggccucuguaaccacggacauuaccgcuuugcaucuuuguucccugaaguaacaacucugggaguucuuaaauaugaauaaaugccuaagccaauagcuuuuuuuuuuuguuccccaacuagcucauaacugaauuacccauuuauucuauucuaagucccaccauaugguugguugguuaucucuccucaguuucacgcaaccaucaccuucaguguucacagcgaaucucacaugcauuacuauuucccagaauaucaucuuucucugcgggaugacccaccuucuaauccugccuuagcucauuggucauaggcuuuuuauugacaggucuguaaagaugcucuacaggcuucagugacugucguuagcccuggagggagauuccacaaccacuuagcuugugcauccuucugacuugagagcaagaaucccauggacaacucugccaaguuuuuuguucacucaggauagagccuggcccccuccuugaauuauauuucuagaagcuuuccuuuguuuuuagcagcagaaaauuccucaggcauugccuuuugacaagguggaagcuuggcuagagggggucuugcucuggugcaccccuuccacuauuccauuguauaacagagcuuucuuuaaucuucauaucucuucagcauaggccuuggcucugacauuaaauuuucuccuuuuugccgggcgugguggcgcacgccuuuaaucccagcacucaggaggcagaggcagguggauuucugaguucgaggacagccagggcuauacagagaaacccugucuuggaaaaacaaaaacaaaaaauuuuuuuuuucuccuuuucaaacuacauuuuguacuuuuugcuuuuuuucauuguagacccaagagugauuucuaagaacuacuugacagagucaguauuugacugucuuaaaaucucccuuaccaaggaaauuaauccauuauuuucaauuuugccucaggcaacauuuuaagacagguguggaaaguagcuauauucuuugcuaacauaccacaagaauguugcaaauaauccuuuaugaaaucuuuugagcugggccuccacaguccacauugcucucagcacuacugucuucuaagcuuuuacuaggauggcccauuaagcccuacuucaacugcuuucccaguccacagucccaaagcauucucuguuucuccaaaaaccagcauggucaggccugucagagugcuaucccacuccuaauaccaacguucagauuugccccacagcuguuagucacuucagguguucucuuuggugguggcuacaggacagguuucuuuucuggcuccugaggugcuuucugcuguggucucuccucccugaguggguuuucugucuggguuuucugggggaggguagcaguuuagccuaugaucuugcuuuuuccauggaucuagggcaaguuguuggguuuucagguugcucagcaacugaauggccacuuccaucugaauggcaacuuccagcuucucugcaaugcccagaagagcucaaccuguuuucucucuuguucuuggccauagucuaucccuuuauuccuuggaguacuguuguuggaacuggcagugcuucuuuaugaauacuuacaccaucaaaaccauauugguuuugcuuccucaacuaaaaggcucccuuaguucagcuuugcguaaaggagccaccagcaaagugucaauuuauuacacccgagaguuuucauuguaugcugccccgggugugaauaauuuaguauuuacuuauuuccugcuuaacuuuauaauauaguugccccauucuuuguuggcuauuugagauuaaacaaaacaaaacaacaacaacaaaacaaacccuuagccccguguauuguuugguaccugccacccaagugcuuguuaaguaugggguugugggccucacaguuuuaggguguagaaaucuucacuuaauaaccuggauauguguugugucuguauaucccauuuucaaguuuucuguuuucaagugggaaauacuagcuaucgggcauguguauaaaauaagcccagggcuucaguguguccuuguggucacaaagugggcaaagagggagugcugugugcuuacagagcugugggagcuuagagagucacuguacuagaggcacuuucuuucuuuaacagugcuuuuuagauauacauguaaacacuuguggagcaagaggacacuagaaacuuggaaugaaaucacuuucuagucggaaggcaacauuguaaaagucagauuccugcauuacugaauaacguaacuuccuauguuacauuuugugucuuuuugcagauuguucacucuguauaagaaaguuuuuauccuauaaaacucagugcccaacuuguugcgugguaaguuuuuaauuuuuuuuuauaaauuuuguugauuagggcaaauuuuuuugcuuuauguguccacaaaaaugcacagggugauugauauguagucagugaauuaagccauuugaacauuuccaggaaacauuucuuaaguaugcacaagagacauggguuuuauucccuuucucaucaagaauuuugauacccuaauguauuuuuaggaaguaaaaggcucuaauucuguuugauuccuacaguuugugcuuuugugccuccuaacuuuuuauaauuuuucacuuuguaugcaaacuagugcugggagucuucguuugggaaggguugguggauauauuuguaggaggcgagagauucauggcagcugggcucccccaggccucccuggucucuuacugcccucccagagcagcccuuucagaacaaacaugagcgaguguguuguccauaucugagacuuuuccuugaggugagaauagauagagagggagauaaaauggaaaauuaaacucauaucuggguaaagaaagaagagacacaggucucuugaaaaggaagcugcagggagcuggaggugugaccacucuggccagcaagcacaucgugucaggaugucacugaauuugucuaaaccguuucccugugucagaaacagagcagcugccuccagacuuggaggucucugucacugccugcugucuuuguaaagguagacuuguaccguggcguucauuccaggugacaccacugcugcgguaauggauauuucucugguguucuugaguuucuuaguuuuaacccucugaacacuuaaugcuucucuccuagaguuauugcauagaagagcuucucucuuuuguuucuaaguaauuagggaaagcuagaguuuuggcauuuuaaggaaaaaaauccuugcucauacuggguuuugucuuaguuggucagagugaauagcagauaguuuuaacaugcuuuugagggcuguugccaggcuuccgguuagcagguccugauucacuggcuaaaguuauguuaguaugagaugaauccacuuuauuuugaaguuuuccuggaauacuagugggacagagagccccaggagggcaggucagacauuuucaaaaacaagauugugacaaguuaaugacugcuuuugaccuuuuccaucuguuguuuuccuuuucuaggcaguaacggagccagaccugagaaauaaucgccucuuagaugaacugguaaaaagcaugaauuuugcacgguaugauucaguuuggugacuaaccacucacugccugugcucuuuaugugugccuccuccccaugcccuuuccguuagggagugcaggguuacauccuggagccaaagaagggaaguggugauagccaccgcacaggggaaggucuaauaagggugauagccaccgcacagggggaaggucuaauaagggugauagccaccgcacaggggaaggucuaauaaguagucacaagguuuucucuaccagaaacuuucccguuuugaagaauuaagaguuaaaguguagauaucuuggcacuuuauuuauaguugguguuguguugcuucugggauguuagccucuaagacguuuuaguggacagcucuagagaauauguguuuuuaugcagguguguauauuaacccuuuguucacauauuuaauugguucuauuuguuauauuuuaaccuauuaauucuuaaucagauuuacucagcauguguaauaugguauauugugugagacaugcaacugcuucucuauaaagcugucguacauagcuguguucuuuaacugucaaaugcaugaagguuuggauaugaguuugguuucccaaagggauauagaaaggcauguucuaccaaauauaccuuguauuuguuuuaauuauguuguuagugcacauguccaugcaugagaccucuuuacuuguuggaaaauucauggagauaccugaccuugucucuaaaaaugucuucagacuucuaguagaauugcacauuuuuaauagguuuguaucauaaagaugauuauguuuaaugcucugugaacucuaauaugccauugcagcaacuggcugguuagcuaauuucuuugugaggccauguaauaguacacuuuucuagaauaagaaacuauguguuucucugauucuccuauugaagucauugcuuucuguauuguauacuguaaaaacucaugucaugucuauuagguuuuuucccuagguaugugugaauguuauauguguacuuguuaaugaugauauaugugcauguguguagguacacuugcaugugugugugagggugucaaagccagagaucaguauuggauggaugucuuccugugaucauuccucgaguuuuggggggguguuucucacuaacuucgaguuuguguagcugaugagccaguaagcuuucgggucugccugucccugccuggcuagugcugaggcugcaggauuacacugccagccccagcucguuaugggaggucugggucuggaacuugaguucucauacucccaccaaagucacuuaaugauagccaucuccuggacuuuuuguuuucuuugauuuguuuuacuuuugaagguuuaucuuauguggcuguauuugaguucgucauucuccuugggcuaccuucuuggcauuaucauucuuagcaucguccuugagcaggugccuguuuuguuucuuagauggucaucacguguggugcugugguaccucaucugcaaaauuaguagggaugaaacagaaguuaauugauaucaugauuuguuugaacucugguaagauugaugagggaagaagaauaaucuuaugacuaaaauguaagauauuuauauugcuuguugauuuuauuucuugucuuucucauuugcccuuaccauuuuauaugccauuuggauuuuuaaaaauuuaauauucuaaauugaauaauaaguuaugggaaauaauuuuaagagguuucagauacaaggaugacguucuuuuacauuuucuuuugaccuuugguguucauuuuucaaagaacacccuuuuucuugccuuguuuuaaaguaauguucuuagcccgauguaguggcucaccuucauccuggcauucgggaagugcugcuguuaagagacacagcaagagugagagcaggcacagagcagaagaguaccagcagucuccuuuggaugugucaaggguuagcuugcucuuaaggggcucaaggauaaaugggagauaggcuguugacaggaaucugaagucugggagaaaggcuuggaaaaacaugaaaacagaugacaucuaaaaccaagaaauauuuugcaauucauauaaccuagaauaaauuagacagagaugcuaauuuccaagcagauguuuacauuuaaauggaguuagucauuuuuccuuaauuuccaucacccuuaugaauucguaugaaagugaucuggcaccguagaaccaaacagcacucaucacaggcacucagauucucguggacagauaaggacuuuuagagcuggaagacuaggaucagcaucuuauuguacagauggguaaauaaagucccaggaaguuucacuggucugcuucaagucaucuaguuuagaaaggcaaacaaauuagaucucagacagccaagagagccccaaacugcucaccucauggcucuagcgcugaauaaacaacuaugacucagcauauuaaguuaacuuaaguuccaggucuuguucucugccauguugauugcaucuggcuccagacuuugugcuugcuguucuuuguaggugaagcaguaucuucccagguggccaccugguuuagacucacuuucucugaccucuguucccauagguuaccucuagugaggcuuuaugaccagcuggaaagauggaaagaacgcuucccucaucuuccccugcuuggcugcauucuacuuuauucuauguauuuuuuccugggguagggcuggcacucuuacccuuccacgugcuagggaaucucucuaccacugaguuggguuuguuuguuuguuuucuuagccauuaggcuccauuguauuagcauuuuucacauaaauuguauaaacguguucauuuuuuccuuauucuguaacuuucgugaguauagguuuuauuuucuauugugauucucuggcaagaguacacgguacuggaauaagugaauugauuucaauuuuagcccugagaauaguuuguuguggucuugcuacuacugucuuccauagucuucuuggcaugccuugaaauaagaaagccaccugaaguaaaacucacccagauuguggaauaaaggcaagaaaaugaccacuagcaugcugaaaguaccagugcuggcucaucuuugccugaauacugucuccucuccuuugcuacugugauaggaaagcuuuucucagaaucuucuuuguacuaaauccaggggcuggagggauaagagacuacugaacccagugguguguguguguguguaugugugugugugcguguguguguguguaaacauauauaugauuuauauaaaauuuuuuuuauuuguuuccuaagaccaagauccuuucuuucaaccuucuuccuguuuuuccccucccuccaacuuccuucucuugcucacucccucacucccucuuuccuccuuccccucccuccuuucccuaccuuuuucuugauuguguuagauacagcaucauuaugugauugaaauuacacuggaauuagaaucuucugcuucauccugcugagugcugagguuaucagcaugugcugccauccuuagcuuaguuuuccuuuauuuuuuuaucuuuuucuuuuuuuuuuaaguugugaaaaaauuuaaauauacaugaaaguagggaagguaauauagugaaccagccuucuuacuuaccguguaccuaacuuuuccuaugaaaaugaaaucuuuuccucuuuuuauaaucuuuguagucuuuguuccuggcucuuguucuuggucuuaccuuugcauugacucaggacgucuucugcaguuuuaggagagagaugguggugguuggcaucugugcuuuguucagucuuggggggagguagcucauuuguuaucacugaugguugauaagaguugugagcuuuuauuguuguugcuuuguuuuuaaguagcauuuuaucagauuggugaguucuaggccugccagggcuuuauaugagacccuguacagggggaaaaaaaaauacaaaaagaaaggaaaggaaggaaggaaagaggcagcacauugacaaacccagagcagcaggaaagaaaaacuauacuuuuugaaaguaaaugcguuuuguucugacacgcaguuaccugaccggcucuuugcuuuuguucuguuaaggguuggugcaguguauuacuagauucuguguuaguuuuccucacuuuuucugaccucuguccccacagguuaccuaccucuagugaggcuuuaugacucaugugcauacacgagcuuuagguguacagauggaaacacauaugcacacgugcacauuugugugaacacacucugugcacagagcgguccccuuuccuaaggugcgaccucugacaucucaccucaggcaggccacauggucuccgugaagguauccauuuuggcugggcuaagcugagcaucuuucuagcacugccucuggcaucuguuuaccaaugucuguuuccugccaggcuuguggcguuugguccuugcauacccuggagacgauugcagaugggugaggguuuccuucuccuggcucccuccuacaugccuagcacaccgucccucucguucucaucaucucugcccagaauugugcucucuucucccuggucagggagguaacuucugcuucgaugucaguucaacguacaaauccgagaaggugcucccaggugaaggucuugggucaggguugcaucacuucauuugucucucuucucccagggaucauacuuuuggguugcuugugucguagugcuaacuguugcuuuaugucuuucuccagcuuuuacuuagccauuguagaguaagugucauaucagcaccuagaacccaguauacucuuuaaguucuagucacugccuuuuaauaaugauuuccugcauuuuaaaagaaacguuuuaguuugauugugauugugacauaaguucuguguuucagaggaaccaaguauuaauuagggagacucaguguauuaugcauaacuuggcaucuuauuuacccauuuguuuguuuuguguguuucaaggacucaccuguugcaguuugcuuuagagucaccacccauaucuccugugucuuccaccucaaagaagguuguuguuaaagugcauaaugcugacgccgcccaacacccugucaaacaggcgaacagguuaauggauaaguuccugauuagagaaacuggugacuguguauuugaguuguugggaaaagaaaaugagaggaaauucagcccucaaaaagagcuaagcaccucugcugagauuaaagagacaagucuccuaggaaagccgguacuggggcucucggaugcuaaugguccugugacucccucuacauccacuaugaaacuggauacuaaagguaggcagcacuuuuauaugugcacuuuuauacuuaaggaagucucacuuguguggugugagauuaauaggcagcacuuuugagggggagaaagacuggacuggguuucaccucaccaugucucaggcauugaugcaguccgugguuagggcuuauuuuauugguauaggacauguacuucagugagccugacuuauuuccuggcucucccagaaugucucuguagccaguuuguuaucucacucuuccuacaguauacucaggcugacagaauagcugaaaacugaccggaugugcuaccuggucaguaaauaccgauugccuggaaccugcccuccuccucuguuuauauacuagcucugguguuuccaugcugcaguggugcagaguggccuaauggugacagagccaggauuaugguaugaagggucaucuggaaaacucacagccagucuuuaggaccuuaucuuuuacuaagaauguguguuguuuagcaaacccauacaacccacaguugaaggccaguaguguuuacuagaaaauugaaauuagcuuauuaguacuuguauuuuuaagguuuuuucuauuuuaguuuuugauuaugcguaucaacaucucagccuggagaucacuccgucugugguuuuuguuguuauauuuuuauuucauauggacauguuuucagcucuuguagaauuuuuuucuuuuuuauccaaaugaaaucuuagaauggaccauaacauguaaaauagauacacuucucugugcuacuaaaagaaggaguagggagucuggggacucuggugccacaagccuuccuucuuuggaaacugcauuuugugggcaccuccacauucacugcaacuccacaaagcugcagcuuuaguaaggaggaccuggcccgggagccaggaggucaguaguucagccagauuguaaggagccagcgaagccuugguuucacucccagguggaacuuguuuacagaguugcugaggcugugcuuguccuguguuagauguccugugugagauguccugugugagauguccugcggccuggggagacucagcgcugugguuuccuaguacccuguuuccagcuggcuaacucccaaaccuaagugcagccucuaggcccaggguucugaucaugggacuucccgcaaagcagcuaguuacuaguaacccguuugccuguucuccuggcucuuuuaaagagcauaucagcugggauucugucuuuaaauuacugaaagaugucaguguaauuuuugccuguucuauggcuaauaaugucuccccccucucuuuuaaaugcagugucuuguccuguuuguggggucagcauuccagaaaaucauaucaauaagcauuuagacaguuguuuaucacgugaagagaagaaggagagccugcgaaggugagcacagccucugaccugccuuugcacgaugcuucucugccugauagaugucaaucaaaaccaggacucccguuguccuggugacuagaacuucuguuuccuuccguguuugauuuucccuuuagugcugguuaccucuccauccucuuguuuuccuucuucagcucacacucugccauauuucaggagcagauuagcgcuugcucucugauacauuaugauuuagagaaacuagugacuuagaauucacuuaucuuuuaaacuuucuuuuuagaauuuucaguuggucaugcagaggccuugcccaaagagagcaaggacagcuugaauuugaagaauguaaaaucuuucauuaguucuuaggauguuuuaauauuuuuauauacaucuuuaaacaauuaaaauguaguauuuuaaguauuaauuuaaauaaaauuuacuguauauuauuuauccaucugucuguauguauguggugcugagaauugaauccuagugcgcuuuuucaaaaacuuuuuuugaauaggauguucaauagcauaaugaugcccugcaaaaaugaugcagaagaauauuuuagcugagguuagugagaugugccagccaguccaagcauucaggaggcuaagacaggagacuccgagacuacuaaaaaguaggccagcccagguugcucagugucauccagcccagagcuucugauuucccccuucugugccggagaguauguaugggauauguaugggagaguauguaugggauauguaugggagaguauguaugggauauauaugggauauguaugggauauguaugggagaguauguaugggauauguaugggagaguauguaugggauauguaugggagaguauguaugggauauguaugggagaguauguaugggauauguaugggagaguauguaugggauauauaugggauauguaugggauauguaugggagaguauguaugggauauguaugggagaguauguaugggauauguaugggagaguauguaugggauauguaugggagaguauguaugggauauauaugggauauguaugggauauguaugggagaguauguaugggauauguaugggagaguauguaugggauauguaugggagaguauguaugggauauauaugggauauguaugggagaguauguaugggauauguaugggauauguaugggagaguaugugugggauauaaugaccuucucuccaaaacacccagaaaugacaguacuaguaaguugugaggaugggguuuguaccucaacuacugugcugcuuugugucauuuguguaccacggucaccaaaucugaaauaguccacuuaguauucaaggagugauguuuuaauugaagguaaauugcagggcuuugggaaucaguggcugguggagacgauagagaagcagggucguguuugagucuggguagauguagcuggaggaagcaugagcagcaaggucaaggggagauuuuauuuuuaaaaacaggguauaggccucagucuaccugcacugucaggugguaaacaggacaguggugagcacagggaaugaaguggggugaaguuggagacaaucugugagaguccagagagagugggaaagagaagggggcuagagacuucagugauagcuggaaaggggugaagagggugauuggcucuuauguucaucuguuuugaggaauauucucccaaaagcauucucuuagaaggcaagaucaucuuauuguuuuaauuauuaaaacugaaaaggugccacuuaauguuucuaagucaguuuggagugaaugcagguucccuggggcaggcugugacuuacaaaggcugaaguguggcagugugcugcuaacucacagcacaagcuggccuuaacuccaagccugccuagcacugugcucacaaggacugccuucuuagacccacaguuuguugaugggaaucguauuuagaugguuauguugcuaguuagggggcggggauuugggauaauacaaggagauaucccaagaugacuuucuaagccauuaaucgguaucuugugaccugcuuuuuuuccuuguguuucaccccagaaaaugaguuugaaguaguuucugaguauuuucucccugaagagaauuuguacuuaugaucuuguuuggauuguucucuuuccagaaggcucuguuguauucuucuaaugcuucuagcucuguccaauuguguuccaaauguggcugcacagagagccuugccaguuggucuccaaugcaacuuagaacuagccuguaccaugucacucaguagacugcugagagauccuacacuugagauagcugcugguguugguuuuguuuuccaauuccuaaauuggcuuuacuccaaguuuuucuguuuauuuuuuguccucagaaguauuucuuacaaaauuguucagacauacuuagggaaacauggaccugaaucuguuuaguuacauccuggccuuggguuuggucacauaacggucucuaugcuucacagucuuuccuuuauaacacugaaggacacugcugaguguggcugaucacccugaccccauccuguguggagcugucacuugguucagagcagaacucuuuucuauugauguccugguucugagaccccugacuuacaauauuuagcuucaccuacucagcauggaaaagaucagugcaugucaugcuuggggagauguuucucuggcuucagagucucaaguucuugauagagauggucgacgucugauggugcuuuccuugugaaugcugccggacaccacagauguuuauuagcauuucauaguugugaauguaguagucuguccuggaugaauguuuuacuuagagacuuaaugaaucaccccuuccuuuguacuugucauaaacacuguaaagugaguuaguuguugcuaccuacucugauuuuauuuuaccauaauuucaucaaucuuguggaguccaguuggaugccauuauaagaacaaucuuggaaaaagacucuugaaguugcagucauuuuacaauuaaguaguuauuucuggcuuucaggcuuuacugauugggaauaaaagacauaauuuagucagggaauaauccucaugugaguagaacuauuguaucuauacuugacuguaauagugcucccaguaugaccuuuggaccacugcagcaucagauuuaccuugggaaacuggaaaguaaagacuuucaguuuccaccuucaggccugcaccauguagcuggaugcuguugguaguucugagguuccccugaaauuugagaagcacagccuuuuaugaacugucuuugcuuauuucuuuuuaaaucuuuuuuauuuuaaacccucuuagucuuaagaucuuacuaauuugcuguuguaauuuugaaaugauugcaauugugaagaccacuuugaaaacugcuuauuaugcaucuaauuacccuuagagcugaaccucuagucagaauacaccacaccuuugugugggugugaguaugcaugcucaugguuugggguacauguguauguuagcaugugugugaaugccagaggucaacccuggguaucacacucaggagucuguucuaccucguucuuugaggcagagucucucacuugggccugccuggccuuggucauuaguuaggcaagcuagcuagcaagcucuaaggaugccucuguuucuaucuccccaacuuuuuauauggauguuagagaccaaacucaugcauaugaaacaaguguuagagaccaaacucaugcauaugaaacucaugcauaugaaacaaguacuccauugacuuagcuguuuucccauccuuuuaucuuaaugucucaacuauucuucuagucagucagguauugggaaggaaacuuacuguuuuaucugagaaugcuugauaauucacaguaauccuaagaucuuuuuuguuuguuugucauaguucugcucacaaaaggaagccguugcccaaaacuguauauaacuugcucucugaucgugauuuaaagaaaaagcugaaacaguauggcuuaucuguucaaggaaacaaacagcagcuuauuaaaaggcaucaggaguuugugcacauguauaaugcccagugcgaugcuuugcauccuaaaucagguaaaguaauaccccugugcucaucucugcauaaaguaaguauguagcucagagauuauaaaccacagaaagaauuuuaguaaguacuuuuuugguaguagguaagauaagcaaaugaauuuuaagagcuaccuguagaacacugugcuaaggcagucuuccucucaggcugucucacugccccaggucccuucucugagaaucacugcuggcaauuuugagucucuuuccagagacugcaaggugguaaagagugauguagcgucuuacacuccuccuccuuuaaucugagugacugugagcgaaucacaucucuguccuucaguuuucucaccuguagcuugaggauuauaauccuccaugcuguauucuuucgaggugacagaacacaccgagcacaguaccuuacaagucguuagagcucaguggaugcuucuacugugauuauuauacauaaacagacauccuuagucgguacugaugcauacaaaugucaggauccuccccauaguucucagucagccauccauacauuuuggaguucuuuauagguaagaacauuuagaauugcuuuauguuuauaaacaagaagaaugauauaaaaacagaaaaguacauggugugguaaauuuucauaaagugaaaaugccuccugagaauacugugacuauccccaaauccuucuccucccaagccacuggcuguccugaacuuuguagaccaggcuagccucggacucacagacauccaccugccucugccuuuucagugcugggacuaaagguuugugucaccaguaccagccagcagccugucuacuacuuuacccaugcuagagcuccuuuucuuuuuaaauugcacauuuuuuauauuuuucuguucuguguuuuaugaauuaggauaaauucacugagcaguagccaugccaaagccugaauguuauacuauuguaagauuuucuccaccaaacaaagccuauuauuuuuaaauucauccucacugaaauagucagaauugcagaaugcaguccgauucuuugcuagagcaugacacagaugaccucuaguguaguucuaguccuuagagaacucuguugcccucggaaacucuugagugcagucuucauuguucacauuucagcauucuggucuuccucuuuccaaccacagcggccuaccaagcugcccuaagaguauucuaggacucuagccugcagccguucacucuucuacaguucuucuccaugcuacuuccaaaggccuaugaacaacauggccagcuuuacaacaaugacuucauuguucuauccuaaguuuuguuuuuuugcuuuugguuucuugagucaggguuucucuguguagcccuggaugaacucucucuguggaacaggcuugccuugaacuccagagagucaccugccucugccucucacaagcugggguuaaaggcauguaccaccagacccaucuuguuuuuucacuaacuuuuuuguaucuguuacuuuucucauugguaugaucaaauagcuaagaagcaacuuaaagaaaagguuuauuucaacucauucacaugguugggaaggcaugaugaagacugugaugcugaguguguagcugggucuccuaccaucucagugugccaggaagcagaaaaaugggagugcuggcauucuguagaaacagccugcaauugauguccugugucugagccucucaguguuuuucaacuuucuuggaagccacccuuggccuuuugcaauccaucaaaaaguuuagcuguguucuuacucaguuguggggucacugcagucucucuccugggaauugcuuuuugugaccuggugcucaugguccaucccaaccuugccaccuguuuugggauuuuagggcaugcacuugcuguuuaauuuuaacuuugauggauucaaacaaaauuauaguugcauagauugucuagcuuuuccuugucauuauagugagugugaugcugcuguuagcucucuacgucccaagcagaauuagaagucuuucugaagauagcuuaagccuuuagcuuguacccaaucuuaaucuuaauauauaauauaauauaauauaauauaauauaauauaauauauauuacuacuguagagugugccagaaugguacuaguguuaaugcauuggauagaauguaaauacuucugcuuuuguguuaugccaugacucagaaggcucacaaggagaugaacauuucuuguucacagaagauauugucuacauuguuucuaucaguuuuuccauauuaaggaggcagauacagcucagugcuuggagaagaaaaucuuuuaagugaagaaguugcuugaauuuugaaguaggcuugaguacgauuauuugcagugguacagaggagauugaaguggguguagaggagaaguacuccuaucucccccauguaucuauccuccaguauaagcaauuaucaaacaauccuaguuuuuucugugucucuuuuaaagccucucuauagaauauauugaauuaaaucccagacuuaauaacuuuuuacauauaaagaugaaugucaguucuucuguaccucauguacuuuaauagacugacuuuugauacagaaaggcagcauuugcaaagcugcaccauugguguuuaaagaaaggcauuuaaugugugacaggacauuuucuugaucuccugcucugagcgguuggaaacugccuucagauacugguuuuggaggcaagggcgugucccuugguauuugcaaaucuuuuccucuccuugcuaaguuuuacuacauuuaauauauuacaguuagaguggauauccucuuaaaaacuuaacucauaguaguaaauuaauucucauauuucauuaaaauuacaguuuauauauuaagagaagguaaaaauuacauguuauacaguuuuauuuugaugcauagaagaguuauauguuaaaacgccacacucuucauuuaauguacuacuuugauauguugcuaaacuuacuauuuucauuacuguucuaauaaaacacuaagaccuaggcaacuuauaaaaggaagcacuuaauagaagguuugcuuacaguuucagagagugaguccaugaccuucaugccaggaggcaggguggcuggcagacaggcccaacaugggagcaguagcugagagcucacacugauaugcaaauuuuaggcagagagagagagagaacagaggagagagagauauauagauacugggccuaagugggcuuuugaaacaucaaaguccagcuccaguaaucaccuucuccaacaaugccauacccccuaauccuuccaaacauuucuacuaacuggagacauagcauucaaauuuaugagccuguggaggccauucccuuccaaaccacuacacuuacuuuugaaaauuugcaaaaaugaagacaggaaucugcaugucucuaccaccugucuugcuguacuguuaagaaccugauauagguauagaauaaugaucagacagugugauaguuuuuuucuuccuccuuauuuuaauagcugcugaaaucguccaagaaauugaaagcauggagaagaccaggaugcgccuugaagcaaguaaacucaaugaaaauguacguugagucucuuucuguguuuauguaggagugcagaaggaaaaguugaacuuuuaaaauuaagagccagccuuuguaaauucuuccugguagaaaauguacuggaacacagugcuguuuagaguaucaggauuuccuuacagcucaugcuuuuggacaguguuuguguuuaauagacuuauagcagaaaguauagccccaaguagaguuuugccuauacacuggagucauauaggaaaagccaacguugauucugcuuccuguucugccaugagguaaaggcuugcaccuccauuuacuccugccacugugcugcucugcccuggugccuggggccaaacagcuauggucugaacccugaaaccagcaucuuacuaggacacauugaaagaaaaggaaaaguaagaauauucugagauuucaaaaucuuuauaaauaucuuguacaaucauaaacauuaagaguucugaguuuacucugcuauucuugaugacuuuuguagcucuuaggagagaccauaggaccaggauuugaaauguagcuuucauccuauagcugacugugagcauccacuccuguguuugcuaggcccuggcauagccucacacaagacagauauaucaggguccuuucagcaaaaucuugcuggcauaugcaauagugucuggguuuggugguuguuuaugggauggauccccagauggggaagucucuggaugguccauccuuuugucuuagcuccaaacuuugucucuguaacuccuuccauggguguuuuguucccuauuuuaaggaggaaugaaguauccacacuuuggucuucguucuucuugauuuucuuguguuuugcaaauuguaucuugaguuuuuuaaguuucugggcuaauauccacuuaucagugagugcauaucaagugacuucuuuugugauuggguuaccucacuaaggaugauauccuccauauacauccauuugcccaagaauuucauaaauucauuguuuuuaauagcugaguaguacuccacuguguaaauguaccaauggaggagcuagagaaaguacccaaggagcugaaggugucugcaacccuauagguggaacaacaauaugaacuaaccaguacccucagagcccgugucucuagcugcauauguaucagaagauggccuagucggccaucauugggaagagaggccccuuggucuugcaaacuuuauaugcuucaguacaggggaaugccagggccaagaagugggaguggguggguaggggagcagggccggggaaggguauagggaacuuucgggauagcauuugaaauguaaauaaagaaaauaucuaauuuuaaaaaaauaaaagaaauguaguuuucaaaguuaccuuucccaagcuucaaugaaucaugggccaacuuuuaauaaucuguuuuaaagaaaauagguaguuauauagcuauaacacaauugucuaccaucuaggaaauuuaacauauucuuaagauuauauuuuugcugggugaugguggcgcacgccuuuaaucccagcacuugggaggcagaggcaggcgaauuucuaaguucgaggccagccugaucuacaaaguaaguucugggacagccagggcuauacagagaaauccugucucgaaaaagccaaaaaauaaaaaaaaaagauuuuauuuuuauggacaccuguuugcauggagaggccagacaagagugauauuagauuuccuggaacuggaguuagaagcauuugugaguuguccgauaagagugcugagaacucugcacaggucuuccgaaaguagcaaaugcuuuuaacuucugagcuaucucuuuagccuauuagugucaucgucgucuucuucgucuuuguggucaccaucaucaucaucuccuuuuccuugucuuccuucucuucuuucuuccuuuccuucuuccuucuuuuuccuccuccuuccaucuucuuuuauauauauauuuuuugagauagggucucacuagcuuuguguggccuggaacucacuauauagaucaggcuggcuucaaacucagcagagaucuacuaguuacuguacccaaauaacuacucaaauggucuaggcgguggcagugcacuccucgcuaccccgcaccccccuuuauauuuaauaugccuaaacaguucaauggcugggcuacauccagacuuccaauggcuaauacacccccucugauauuccugaguuauuacuuacuaaaaccuauauuccaucuuggcugccccagacccagaccugcagccuucucaggcuguguucucugucuggcaugcuucagccucagacgugguggcuucuauuccuuuccuggcauggcagcucucuccuuccugcuccucccucagucucuugucugggaauccucaagucuugccucugucucccugcucagcuggccacuggcaacuuuauuuaccaaucaaaaccaacuuggggcaggcucugucgacaucuuguguagacaugcagauucuccugcaguuuuggggaccaaauuaacauaauacaugcagcauuagaccaaauccacaacaaccucugccucccaaauacugcaauuaaagguguguaccaacacucccagcuaauuuaauacuuuuuuuuaguuuuauuuuuaaaauuuccuuuuauuuuuuuuuauauuuuaaucaauucuuuuuccuucuccaacuccucccuacuucauagcucacccaauuugcuguucuuucuuucuccaacaacaaagaugcaagaaacacaacaaaaaacucagaaaaacuaaaagaaauagaauaagacaaaaaaaaauagaacaaaguacacaaacaaaaacaaaacccccauggacuguauuuuguauuggccaucuacucauaggcaugagaccugccuggagcgggggcaucagugacacuccauuggagaaaacugcaucgcuucuugacgagggguggggcuuuaugcucacuucccuuucuccacgcugagauuuugucugguuugaacuugugcaggucuugugcaugcuaucacagucucuaguuuauagauguaucaguccuguuguaucuugaagacacuguuucuaggagucauccacuuccucugccucuuaaaaucuuuccacuuccuuuucuacauagaccccggaacuccgaggggagauauuugauaaagauggcccaugaaggguuaagaguuccaaagucucucacucucugaccauuguccaguugggaaucucuuuguuaauuaguaucuacuacaagaaggaucuuuucugauggauguugaaugaugcucugauauauggguauaucaguaugucauuaggaaucauuuuauugcuguguuccacuaauagaauaauaguaggguuuccccuaggcccauagucuaugagucugagguucuugaccacuuuagcagggucagguaugagugccaacuaauggagugggccuuaaaauucauuuuaaaaagugguugcuuacuccugugacauuugugcuauuauuguaccaguguaucuugcaggcaagucucuguuguagguugcaggguuuguaauugggugauauugauaauuacuuuucugguaauguucgagaauacuuuccaguaccauaaacacuagucaguagucagggguuuagcuuugagcuggacaccagcucaauuucuauuuguuugauauaagguguaucuucaauaauagggccuaaccauuaggcuauagugaauaaccaauaacuuugacaauagcuuguaauauuuggaagugucuuugagauccccuuggaaaaguucaacaaaauguaacaaccauucaugucacuggugguuucauuugguagcauaagauguuuaauugaggcauugucuuuuucauuaucaggugacuccauuuaaguuuauuucaugugguaugaaauacuuuuugugaaugugugaguguguguguguguguguguguguguguguguguguguguguguguauuuggaagcuucuauacuauuggguuuccauauggcuuuauaaagaccucuaguguuaggugucucucuauauucccuccuuuauucugcccuccaguucuccuuuccauuugauccuccuacuuuccucuuuaugucuuuaguaauacucuauucuguuuccuuucccuuggaagaucacccccacuccuuggucucuugcuagcuaucuaaccuuuguuguuuggauugaaauauguauaucuaaacuuaaaagcugacauuugcauauaagagaaaacauucaauauuggaucuagguuuccucacucaugaugauugcuucuagcuccaucuguuuaccugcaaaugucauuauuucacuuaucuuaacagcugaaaacuccauuuauugguugguagauaucuaggcugucuggaaauaugguuauuaugacuagagugcuaauaaacauggaugaacaagugucucuguaguagcauguugagucuuuuggauauauauucaagacagagagagcgagucuuguaaacugguuuucaucuuuuugaggcgucuugacacugauuuccauagugagucuaccugugugcacucccaccagcagugaaaaguguucuucuucccugcguucucaccauuuguuugauugauuuuggccauucugacuggggcgagaugaaaugucaaaguaguuuuaauuuucuugguggcuuaggauauugaagauauuaaaaaugcugagguuuuugaagauuuuaaaaauguuuuuuagccauuuguguuucauuuuuggaagaugguuuaauucuguaccccauuuuaaaauuguguuuucuugauguucagguuuuuuuuaguucuuuauauauuauagauucuaacccucuaucagauuucauauucugaagaugaccacuuugcucgaaugauggugucuuguuauacuaaagcuuuuaacuucauaacaaaugaagucccauuuguuaauuguuggucuuagugccuauguuguugauguccagaucagaaauugcucuccugugcauaugaguucaagcucauucccuacuuucugaucuauaagaucccuauaucuugucuuacaaugaggcucuugauacauuuggaauugaguuuugugcagggugauggauguggaucuguuuuuauucuacccgcagcuauccaguuugaccagcauuauuuguuggagaugcucucuuuccuccagugugcauuuuuaguuucuuaauaaaaaauuagguguuuauagguauguggaauugucccaaggucuucgguucuguucuauugaucaauacaucucuuuaugucaaugccauguguuuuaaauuacugaugcucucuauaauacaguuugaaaucuggacuggugauacuuccagcaguucuuuuauuguucaggauuguuuuggcuaucuuggauuuuguuucuaauguaauauucuuaauauagaaacauacuuuaacugauaaaauggacuucaagaauuagaaaagagauucaugugagcuucagagcagaaagaagaaaugacauggacaccugaaaaaucagacugccuaagaaauuugucuucuuguuuucuuguauuuuuuguuucuaggaaacauaaacaacgggucucuuuguggugcuuucauacauuuacaucauugaacuuugcccauguucccccaucaccccauccuuuguagauggcuguuuuccucuaccaaaauuccccauuaguauuuuacuugaagagccuuaccugcacagaaagguagacaaaaugguacuacccauuacugucaaagauuuauuaccugaugcaaucucccgccaccuuuuuaucuccuguguuuugauuuuuggcauuuucauuuuuauuuuuuucucaacuauuugaaguuggauacauaugcuuuacaaauuuuauugggauguuucuauuuaugggaagaaacaaaacuuuaaaucucuucacaaaugagucucaacuuggcuuaaaauacauaacuaugccaagcuacuuauuauaacaugaacauuuguuaaguuauauaaacaacgagggcuguguagauggcuaagcagguaaggucacuugguguauaagcaugagaacuugaguucaaaucucagcacucaugugaaaaaucucgcauggcuaucuacaugccuguaacuccagugcuguggggggugggggggacgacagaaggauuccugaggcuuucugcucaccagcugagcuucagguuuagugagagacccucucucaagaaaauaaggcagagaguggacagcagaacacucgguguucucaggucuucucaugugcacaagcgugcacaucauaccuacaugcauguaauaccacacacacacucaggcacauauccuaacuuauauaaacaaucucucagauuucaccguaauauuguuaaaguagaaaacaguauuuaaccacggugggauuuccuuccuggaugccacugguuuugagucaaagguugcccccuuccuuuuuuuaauuagaauccguugaugagaaagaagugcugaguaagaguguacuguugaucauacggucugaggcaggggacaaacaugcggguuacacacaaaggcaauggcuuccucuguuugaaaaaaacacaguugagauuuuugaaacuugugcauugauuucuguuuuugucauuuuggauggauggaauucugaauauucuucuuuuuuguaggucaugguuuuuacaaagaaccaaacagagaaggaaauugaggaaguucacagugaauaucguaaguugugaaacauguguuuauuguaaggaacuuaaguugcuauuuuacaucuuuaguaauuaaaaaaauggugguuuuuauuguucagauaaucuuguuagugcugcuucagagacugcguuuuaguggggugucuauguggugccugccuuuuaagaucugugacuaacguucagcuuugagcucaucaucaccaagaacuuggcaaguacgaguuaguucucagaaagcacuaugugagaagauggugcaggcaggcauagaagcauguggacugcaccgugucccggccugcagagacagcucuucuguacggagggacagcacuucugugccccaggccugcagggacagcucuuccauggcuaaaagauuugugucaaaaauggguuuccuucucucguuagcaucuucgcaugcguuaucauucccucucccugaagugggcugucugugugaaucuuugccaggugacugacaccuuacugcuuuuguuaacuggguaguuguuauuucuuuacuuaguugaugguuucauuuuuuauuucuuagguuuuuuuccugagacugagacagagucuauuuguauggcccuggcuguuccugaacuugcuacauagaccuggcuggcuuagaacagagaucugccugccucuuuaauuuuaauuuaauuuaauuuuugcaguguuacggauugaauuuaaggucuugcauguaguaggcuagcauuccuggaagaguuacaucucuaaccucaaauuuaaugaggacugaaauugcuuauugcucuggguccuggcuaauucucuuucucguuuuuccaaccuucuucucucucccucccauucccccucucucuuucucugucuauuuucguuuauugagaauggguccaguguuacuuggcaggucaguaauguagccaaaacaaaacaagacaaaaaaaaccagaaacaaagcaaaccauaaaauuuucucccucuccaaaauguaaaaauaaauguacaagucuacucuauagauggaguaacaaauuugacuuacuuuccucuauuuaaaaaaaaugaaucugaugaaauaauaaguuaacauuuguuuuagaugcuggcaaacagguagcacagggcugugugagcgaaaacaagaugagaagcaccauagucugcuggcaguuaucagguaauacugauaguauuaauagugggagccuguuacuaacuaccagggacugagacagacaucauaguucuuggaagcuaagguggucaggaucguuggcuuucugaguacuggaugacaagcaugccuugacaugcccaucuaggcuucacuauuuaauuuugucauuucuuggugccauaugauggaaucuuaugauauagcugucugcaucacuguaucuuuuauuuauuuuuuaaaaauaaauuagcuuaaucuuuugcuccuuaaaauaauaaauaaauaaaauaaaauaaaauaaaauaaaauaaaaagguguguuuuccuggcaguggaaguacaugcuuuuaaucccagcucuucagaggcagaggcagguagaucucugaguucaaggccagccuagucuacagaguguguuucaggacagccaggacuacacagagaaacccugucuuggaaaaaaaaaaaaagaaaaaagguguguucauuucuuuguuguugaaguuuucagaauuuuuguuauucuuuuuguugcaacuauuuuuuaccaaaugcaugcuuuguaaauauuuuacuuuaguagaggauauauaugcaugauguuuaauugugaaauuaugucaccuauuacucuauuuucaacagcguguaaauguugaucgacacuuugauucaguaguguaguguguguacuagccagggcaguaagacaauagaggaguaauacaucgauucaaaagggaaacaauaagacuuguaagucagagauggcagauuucuuuuacagugguaugagccauaaaagagaagcuguaacuucagaugacaagaguuuaagacauuugcucuugaaaagaacuaaaaacgaaacaaaacaaaaaaacccaaccacugauuaagauaaagucucuguaaaucuuaguuaggucugacagaguauaaugcauuauauaaaaaacucuaaugugguaaaugccacauuaagaaaauggguaugagugugaaaagacaauaaagaagaugcucagaugcuacaagaauuacauaaaaagauaguuucauuagucugaaaagauguaguuuuauuaaucacuaaucuauugugaaacacaaauuaauacuuuaacagugaaauuguguauucacugaagggacgcuggucaggaagagcaaguaucuagaaacaugucccgugugcaguagaacaaacuggucauguccgugugcagugaagcaaauuggucaugucuguccgugugcgguagaacaaacuggucggggaagacagggagcuuccggcuggcucucauccucaugauaagaguuagaagcacuguggccugagaaaagccaggcuaagcaguaagaugaguauaguccacuccuuacauucuagaaagacuaaagauguagggucagaaagcuugcuggcgcuaccagggacuacacguuggguaacagaacuguggcagugcaaaaagaauucuuagguggguuuugucuuccaguucaagacaguguacauagcuacuaaauuccgcaugucauacaugagaagucugguuuuuaauuaaugagaagcauauucuaaguuuugcaaauaacuuuaaaaaguuuuucguaucuauuuugugaaugugugugcauggggugaccauaugccacaaaaugcaucugcugucagaggaggagucuguucucccuccuaccacauggcccgcccacccgcacgcccgcagggauuggauucaggugucaggcuuguuggcaggugucuuuaccugcugaggcaucucuucuguaaacaucuuuaaugucaagcugauuuucauguuggugucuacguuugaccuuuuccauggcuuguuuugguugauggauaggagagauaccuggcuucaccagaaagguaaccgggaaaaugaagcauuuuauaaauucuugggaaaggauacauauuaugcuaaaacuugaucaacauuauuucagaaaaguaaagcaaaauuugaaaucauaucgaugaaauuuuuuuuccacaccacacuacauuaaaauucacuggucugcucuguucuuucaacagaucuuucauaugugugugcuuugaaauauuguuaguuauuugcuauauauuggcuuauuguguuuagaauauuugcaaauugccuucuuuaauaucaccaccuguuucaucagaagagguagugauaaggaaaccauaacacucacagugucacauucuccuccuuacugagaagacuugauucucucuuugacaggaaguagugacguuuauuuccuuggcguucuuguccugucauucccuucugagaauaugugaaccaguuauccaaguguaauggccaugcuuuuuugugcuuucacuucaagauguuaaccugagccagauaugauugcagucaggaaguugaggcaggggguuggaugcuugaugguagccugaucuauauuccaggaccugccuccaaaagagaaaaggacuccugugcuggcuaguuuuaugucuacuugauacaagccaaagucaucugagagaagggaaucucauuuaagaaagugccuucauaaauguggcaguagacaagucagagaccccuccacggccugugucagcucuugccuccagguuucugcccugcuugaguuccuggccugacuuuguucagugaugacuagugauaacggagcuguaagccaaauaaacccuuuccuccucuagaauggcauuggucgugauguuuuauugcaucaauggaaugcuaacuguaccccauuaaauaaauggcuaacuuagcucacagagucucagugcuuugauaauuuucaccauggaagauuuuagaaaggcaugucauauacucaagagccaacaucuaauuaaauuaauuacuuuucuuacuauuccaccaaagaaauguguguaggcugccugccacauauuuauuuauguauaaagagaguugcuggggaucacacauacuaaccauggccugcuaaguaaccaucaugcagcccaccaucaagauacuuuuagucaaguugauuuuauguuuuuuucuaagugguacuguaugcaugcugagagaaacagcauuacuuucuugacauauaccagggcgguagacaucucuccaccauggugucacaccauucauauauuaugucauuguaaugagaaagaauggguggggcuaaagugauggcccaguugguaaaagcauuauucaugcagaaaacccagguuugguucccagcacccacaugaagacuaacaacugucuguaacuucacuuuuucagaggaucuaaauccucuccuggccuccauaggaucugcacauauguaaugcacagacauaaauggagccaaaacaccuauacauguaaaauauggaccagauaacaucuuagugugguugugacaauaaguguuaccucauaguccuugaaggaaaaauuucaggcauccucaguuguacuguacucugaaauacccuguguuagaauguagaugauggaaagaaagauguccggagugucuuggucuagacuugaggcggacggagcacuuggacauaagggauuggaaacguaguuagaugaauagaugaaucgugaauugugccccacaguucauugcugcuguugcugggaagcuggguaaaaggcagugaugaguggcuuggggauagcaaaccucugcagugguaucauggagaggaggugucagaagugagaccacucaaaguacauagcuuuuuggggaaguguuacugugucugggagaggagaaaagugaauuuggggucaggggagauuuuuuuuuuuuaaguuggcugcauaaguugaguacuuaucuuagugacuuuuaggcuuuuggaauguaacccuuagccagaaaugcuucauauaacacuacuaagugcaugcacauaucauggcaacaacuuucacaaagcuauauuucccuuuaccguuuuuggugcauguugacacacuccauucuggucucuguuucauuaagaaaugaaaagccaaucccugaucuacuaagccccccccccccccaaccugugauacugauuuaaaaaagauucuguaucuggucuuagugauggaggugggagcguaggcuagggguuggcuuuuaauucuaacauaguuaguguuguuucuugguaauggcuaggaagguagagcauguguacacagacaaggaguccagggcuuggaggaagauccaagcuuauuucucuuaaaauuaauccguauguuuuuugguccuaagaggguccauaaagaggcugugcugggguuuaaaugaagagcagaagaugagccacagucauuuugagucgguagacauggacuuguucaucaguuucuacaacuaaucaaaccacuuaauuguuuuuuuuuuuaucuguucuuaucauuguuuuucuuuuuuuuuuuuuuuuuuuucuuuccauuuuuuauuagguauuuagcucauuuacauuuccaaugcuauaccaaaagucccccccauacccacccacccccacuccccuacccgcccacucccccuuuuuggcccuggcguuccccuguucuggggcauauaaaguuuguguguccaaugggccucucuuuccagugauggccgacuaggucaucuuuugauacauaugcagcuagagucaagagcuccgggguacugguuaguucauaauguugauccaccuauaggguugcagaucccuuuagcuccuuggguacuuucucuagcuccuccauugggagcccugugauccguccauuagcugacugugggcauccacuucuguguuugcuaggccccggcauagucucacaagagacagcuacaucuggguccuuucgauaaaaucuugcuaguguaugcaauggugucagcguuuggaugcugauuaugggguggaucccuggauaaggcagucucuacaugguccacccuuuaaucucagcuccaaacuuugucucuguaacuccuuccaaggguguuuuguucccacuucuaaggaggggcauagugucuacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaugcugcuaugaacauaguggagcauguguccuucuuaccaguuggggcaucuucuggauauaugcccaagagagguauugcuggauccuccgguaguacuauguccaauuuucugaggaaccgccagacggauuuccagagugguuguacaagccugcaaucccaccaacaauggaggaguguuccucuuucuccacauccacgccagcaucugcugucaccugaauuuuugaucuuagacauucugacuggugugagguggaaucuuaggguuguuuugauuugcauuucccugaugauuaaggauguugaacauuuuuucaggugcuucucugccauucuguauuccucaggugagaauucuuuguucaguucugagccccauuuuuuaaugggguuguuugauuuucugaaguccaccuucuugaguucuuuauauauguuggauauuaguccccuaucugauuuaggauagguaaagauccuuucccaaucuguugguggucucuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguucuuugauccauuuagauuugaccuuaguacaaggagauaaguauggaucgauucgcauucuucuacaugauaacaaccaguugugccagcaccauuuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaccacaauugcucuguaguaaagcuuuagguccggcauggugauuccaccagagguucuuuuauccuugagaagaguuuuugcuauccuagguuuuuuguuauuccagaugaauuugcaaauugcuccuucuaauucauugaagaauugaguuggaauuuugauggggauugcauugaaucuguagauugcuuuuggcaagauagccauuuuuacaauauugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcauccaacgagaugaucaugugguuuuugucuuugaguuuguuuauauaguggauuacauugauggauuuucguauauuaaaccaucccugcauuccuggaauaaaaccuacuuggucaggauggaugauugcuuuaaugugaucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguacuuucuacuucuaucuugugaaaaaguuugugcagaacuggaauuagaucuucuuugaaggucugauagaacucugcacuaaacccgucugguccugggcuuuuuuuggcugggagacuauuuauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucucugugcccucuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuucuucauggaggcacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaguguuggcuuucuguuauuuuuuuuguuauugaagaucagccuuagugcauggugaucugauaggauacaugggacaauuucaauauuuuugaaucuguugaggccuguuuuguggccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggcgcauagauauucagaauugagaguuccucuuggaggauuuuaccuuugaugagaacaaagugccccuccuugucuuuuuugaugacuuuggguuggaagucaaucuuaucagauauuaggauggcuacuccagcuuguuucuucauaccauuugcuuggaaaauuguuuuccagccuuuuauucugagguagugucuaucuuuuucucugagaugugucuccuguaaacagcaaaauguugggucuuguuuguguagccaguuuguuagucuaugucuuuuuauuggggaguugagaccauugauguuaagagauauuaaggaaaaguaauuguugcuuccuguuauuuuuguuguuaaaguuggcauucuguucuuguggcugucuucuuuuagguuuguugagggauuaccuucuuguuuuuucuagggcauuguucccguucuuguauugguuuuuuucuguuauuacccuuugaagggcuggauucguggagagauaaugugagaauuugguuuugucguggaauacuuugguuucuccaucuaugguaauugagaguuuggcaggguauaguagccugggcuggaauuuguguucuuuuagugucuguauaacaucuguccaggcucuucuggcuuucauagucucuggugaaaaaucugguguaauucugauaggcuugccuuuguauguuacuugaccuuuuucccuuaccgcuuuuaguauucuaucuuuauuuagugcauuuguuguucugauuauuaugugucgggaggaauuucuuuucugguccagucuauuuggaguucuguaggcuucuuguauguucauagguaucucuuucuuuauauuugggaaguuuucuucaauaauuuuguugaagauguuugcuggcccuuuaaguugaaaaucuucauucucauccacuccuauuauccguagguuuggucuucucauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucuccaguguugccucacuuugaguuuucuuuauuguuucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguuuucggguguguuggggugcccuggacugggcgaagugggaguacuggguucugaugauggugaguggucuugguuccuguuaguaggauuccuccguuuaccuuucgccaucugguaaucucuggaguuaguaguuauaguugacucuguuuagagauuguucuucuggugauucuguuaccgucucucagcagaccugggagacagauucucuccucugaguuucagugcucagagcacucucugcuggcaagcucucuuacagggaaggugugcagauaucuuguuuuuggaccuccuccuggucgaagaagaaggcccaaaacagggccucucucagaagcuguguugcuuuggcaguucccagaagcugucagcuucuguggugcagacucucaccugugcagacuaaaauccuaaguuccagggaguccuggaaccaagauggugaccgcugcuccugaggccgaggccgucucccgagccaggcggacaccuguccucugguccggaugguggccgguuaucugcggcccgcccaggcugcugccucagcggcucugugcuuccgcccgucccagaagcuguccgguucucuggugcacccucuaaccuguucagacuaauuuccuaggucccgcggagucccggaacccagauggcgaccgcugcugcugaggcugaggucgccucccaagccaggcggacaccuguccucugguccggaugguggccgguugucugcggcccgcccaggcugcugccucagcggcucugugcuucugcccgucccagaagcugucagguucucuggcgcacccucuaaccuguucagacuaauuuccuaaguucugcugagucccggaaccaagauggcgacugcugcugcugaggcugaggccgccucccaagccaggcggacaccuguccucugguccggaugguggccgguuaucugcggcccgcccaggcugcugccucagcggcucugugcuuccgcccgucccagaagcuguccgguucucuggugcacccucuaaccuguucagacuaauuuccuaggucccgcggagucccggaacccagauggcgaccgcugcugcugaggcugaggucgccucccaagccaggcggacaccuguccucugguccggaugguggccgguuaucugcggcccgcccaggcugcugccucagcggcucugugcuuccgcccgucccagaagcuguccaguucucuggugcacccucuaaccuguucagacuaauuuccuaggucccgcggagucccggaacccagauggcgaccgcugcugcugaggcugaggucgccucccaagccaggcggacaccuguccucugguccggauccacuuaauuguuuuaaaggguuauuugcuucaugugugugagugcuuugccugcaugcauguuugugugccacaugcaugccugauacccacauaggucagaaagaaggguugcugcccuagaauggccuaguaauggguggcugugaaccaccagauagguucugguaaccaaacuuccucuggaagagcagccaguucuguuaacugcugagccauuuugcagccccagauccucuuaaaaauuuuaagaggaaaauucaagacauauaacgcaaacucauauuuuagauucaagaguguuccuugccaaauagcagauccccuaagauaaguggagugaugagugggaacaauuuuauuagucauaaucuguuggcaucauuuauuuucucugcagcaaucuugaacuucuugaacaagagccagagugguggcuguugguuuuuguuuccagccuugccauggguuaacuagauucaagcaagaaaaugacacuuuauaaaucugagcuuuuaguacucuaggguaaagucauuaagcccuuauaaguguuaguuuaauuucuucagggauuuuugaacaaaccuuaagucacaaagucacaauccuacuguuuccugguggcuuagaaaaagaaagaaagaaaauggcuguggugguuucuguugucaucgugauaaaauuuaaaaucaccccuuagaugggccuuugggaaugccccugaggcuaucuuuauuguguugagaagaccugcccauggugaguggcacuugguuggaauacuagauuuaaauuuuuaauacagguguauuuauuguuauguguaugaguucuuccugcaucugugucugugcacucuguuuguaguaccuucagaggccagccaugggcaucagaucccuuggaacuggaguuacagacagucauuagucaucaagucggugguaauugaagccaaguccuuuagaagagcagcuagcucuuaacucugagccaucucuccagccccauggauccuagauuuuauaagugcuucaaagggagcugaacagcaacacuguauucaguguucauuuguuucccucuugugaaugagaugugaccagcugcuucaggcuccugcaccugggcugcccuaaauaaaccuuucucccggaguugcuuuuguccauaucuuaucacagcaacaggaaagaaaccaagauguuaagccuauacuuggcuuaaacuccccaugccuaacagcagcuccagaaggaugaugguaguguuguguuccugcauucugggagcuggggaaguagaugagaugauuuucuuuacaugcauggaauuaaauaggucaugaaagaaauuauuguguccuucugugcauacucuuaccugcuucuaaagaguuucaacucccgaagugguaguucaaaccguuuguagcuccaguuccaggagaucugacacccucuuccgaccuccuuggguauacuugugaacauaaaaacauaccaacaaacacuuauauaagcuuaaaauaaggguaaauauuuuaaaaauuacaaaaauaaaaauagaauuuuaaaaucuaacugaagauugggaagaugguuuugagguauaccaaagagaaucaguggagcagaccaacuuguggaugaagaauauaagaaaaaauuucacauggaggcaaaauggcuucuuccauacugggguaggauaucaauugagcugauugucuggcgagggaauuuugcauuccuauagagaauuguuuucuaggccuguuuuuacgcauaauuugcagaagguauucaguggcuagaauccuggaaggguagcuccgggccuuagaaccucacuucaggccacuccuuggcccuuugaauugugcuaaauguagaagaaaccagccuuaaccaguguauugucagcuaugugggaaauuguuagaauuuuguuugugccauuauaguauuuucuaaacugggagggcauugcagacaguguuauuuugaaucaugguuucugguaagguaccaguccagaugcugugaacacgguucaucucacaaguggccuagccuuugugcucuauaccgaggugucucggggugugugcuuaaucuccauaauggugaucuugaagucaggguuaugaaauuauguuuugaaguguuaacgugguaguaaagauugcuguuacguaucuuaagacaggagacauuggugagcugcgagugucaaauguuaaaagcauucugcuggggaacagaaguguuaggaaaacauuauaaaccuacuuacuacagccucggcuuuugugucaguuacuguaauccacuuagucuuaguagucuuguggaucuugaacauuagaaaaccaucuuuugaauguauuuuagaagugucaaucaccaguguguggcacaugccacauuugggaagcagaggcaggagcauuaugacuuugauguucuuugugguuacaaagugagucccugccucacuagaacaaaguaagaugggaaagaugggacagagugaggaaaugguuaucagucuguguuucaugcacugugcaaagccccauccauaaaaggguuuggggaagaaaaaaccaggaguagcaguugauaucauucauucauguuugcuuugggggaagagaaggaugcgggagacuuuucagcugccccuaaguaagcccucugugguccucugcauggcacgcugcauccagugccggugacugugaaugguguugcugaguagcugugcaccugauacucagugugucaugugcagaugcuucacucacuuacagugcuuuugaauuuagguaaaaagcaccagaaugcauuccagcuucugguggaucaggccaaaaaaggguauaagaaaacuggcagaguuucacaagcugcagcgaugagaacagaugaaccugcagagacacugccgucgaugagaacagaugaaccugcagagacacugccgucgaugagaacagaugaaccugcagagacacugccguugaugagagcagaugaaccugcagaaacacugccgucugaguguaucgguaagacuuacuacaagagugguggguuucuuuuauauucacuuacucacuguguguauaugugugcauacacucguguacaugugaggaaguuguagaguaacuugugggaguugccucuguccuuucaccagguggguuucaaugaccaaacccaggaugucaggcuugguguccgugauuuaccacucagccauccucaguuuuuuguuuuuuguuuuuuguuuuuuuuuauuauaaaaaacauaaaaccaaugucauuuacugaaguuaaucaguauuuaauggaguauuuuauuuuauuuuuuagauaagauuaauguagcaauuauugacucuaaaguagcuuauugcuugcuuuagaaacaagggaagaguguccugaagagaugaccccugaggucugcuuaccuuguacacgugaagcaccccaaucauagagaugcucuguggaagaucuuaaggcaaccuaccuaggaagagauuuuuuuuuuuaaagaauuauuuauguaugugaguacaccguagcugucuucagacacaccagaagagggcaucggaucccauuccaggugguugugagccacuaugugguugcugggaauugaacucaggaccuuuggaagagcagucagugcucuuaaccgcugagccaucucuccagcccugagaauuauuuuucuugcugcacucugauguuuacuuuggauggaguguugugaugaagagucgaagcuauguaguugggaugaagagucgaagcaauguaguugggaugcauuacuuaguuuuggucuaacuuuaaauuugagauuaauguuguauuucuguugcuaaugcuuugguccaugagcaaaacagaaucacaauggggaaauucuuuacuacuuuucuuaguugugacaaaugcacauaacauauuuuuacuaguucuuaggugcauaauucauggcuguuaaaugcuuucauaauacuguuuagccaucugucuaugcuccaaaacuuuucagcauccccaguacaaacuguacacagugcagcauaacacucccuguucucccacaucucccucaugaucucuguuguaucugucuauggauuuguuugcucuggguaccuaaugcaagugaaauuagguaguaucugucuuccuauauuggcuuauuuuucuaggcauguuuuaauugucuuguguaguggcagauauucaaauuucuuuuguuuuauggcuuuaauaguauuccuuaguaugugcaugcugugguucaucuauuuauugauuauuuauuuugccuuauugaguugugaauacuguuuuuguauguguuaguucccagauaucuguucaagacucugcuuucaguuuguuuuauuauacgucuguuguuucuguugcugugauaaaaagcucugaccccccccccaaaaacaaacaaacaaacaaacaaacacuuuggggagaaaugaguuuaucuggcuuacaugccaggucucuuacugagggaugucagggccaggaacuugaagacaggucugcuugcucucccauacagcaugacuucuaaccaagagauuuacuucacaggcaaagaaguacagcaggaaccaugcaaaauacuguuugcucccagccucucaggccaguuuauacuuauccugcuuucuuauacaguucagggcugccugccuagggaugcuacuacucacagugagcuagguccuuuuacauuaauuaacaaucgaggcaaucccccgcagacaugcucacaggccaaccuaaucuagggaguuccucaguugagacuuucuuucauaugguucuagguuguguccaacugauaguucaagcuaaccagacagugucuaaaugggcuuugugguucaaaugguaguuccaggguuaaccuuuugaggaaccaacacauugugcugcacagcagaugcaucauuucuccacagccuggcagcacuugcuaguuuuguuuguuguggaaaucaccuucuagguauguguuuccuuguuguggagaccaucuauauuagucaggguucuuuagagaaauaaaacguacagaauacacacacacacacacacacacacacacacacacagagggggggggggggagacugauucaugggaguaggguauuuaguggcuucaggcugugguuuagcgaguccaaaauaucugucuccugauugaaaggccaaguuguucaguccagcuagucuagcuggcuuucagccuauguuggaagugcaaagaaguaguuccuaaugccaguuaauacccucagcaacaggguagauggaguugccagagagagugagggcaagcagggaaaaagcagaaacuucccuucucucucucuuuuauaacucagcuuaucaucaaaaaguguagcucagacuuagggugagucuuguuaccucaaaugagccugucaagaaaaucucucacaggugugcccagcuacuuggguuuaguugauugcgaauauagucaaguugauaaccaagguagccaucacacauuuuacaaagugggaaguggcaugccaucaugauuggauuuuuauuuuuuuaggaaguuucagcaucuguucauguacuuacuggccaucuguuuuggaauuuauucagguccuuugccuacuuauuaauuggguguuuggguuuguuugaguuuuagggauuucuuacuguggauaucaauucuuccuucuauauauaugauuugcaaauauuuguagacacuuuuuguauugucuuuuguuuucuugauaguacuuuucaugcacaaaacuguuuuaacuuuuuaguauguccaguuuuuuuuuucauuuguuguuuauacuuuugguguuauauacaugaagucuugccaaaugcacuguuguacaaauuguaccauucucaugauuucuuccuaguauuuuguaguaucccccuguaaugagcaagaggcaugcacacucaagggggaccugccucucucaggggaagucuguugucugaguuucacauuugggcuguuuggagccuguauuucaagguuuaaggguaaacgggaaagauaccugacuuuuagugcucacaaaccauuaaaugauacucauuuugauggaguuuuaccuuuuauaaacuaauguaagaggggaagaagagaagaguguagucauugugcaaaaguaaauguuuaaguugaaucccuauuucccauguacuggcugacauugugucaacuugauacaagcuagagucaucagaggaggagccucuguugaggaaaugccuccaugagauccagcuaaaaggaauuuucuuaauuagugcucaaugggggaggauccagcccguuuagggugccuucccuggguuggugguccuggguucuacaagaaagcaggcugaguaagccacuaagcagcaccccuccauggccuuggcaucagcucuugccuccaggauccugucuuguuugaguuccuguacuaacuucagucccgucaaugauaaacagugcuguaaguguaagcccaaauaaacccucuuuuccugaacuugcuuuuuggucauggaauuucaucauaguaguagaaacccuaacuaaaauuaucugccagcccgacuguauucucuccaacuacugguugaaugaauggucuugguggugaguggaguuccucuccaugugguauguucauaauaggaaguucugaaccuucuggcaagucacugguuaaugccuugcucucccuuaugaacagcagagguuguggcucugcuguggucacgaugguuuauugguacagguaacauuaguuugcacuggugaugcgugccgugcuggacuucuguauaauaaacauugagggucauuucugaaaaucuugaaugcaugaacuugagaagcuauuuuuguuuuaaaaaaauuuguccaauucaauauauuuucucuacuaauaaaaucuucacaguugcuuuuauucauuuaauuauuuauucauuaugugaauugucaggagagaguaaagcccugucauauuggcacacacuguaaaagggagagucauaggcaacagacaaucuggcacggcugguauuuuuugugccuuuauuuucagauauuuggcuaugccuauauuuuauaaccuuucaaaccacccugagguaucucugcaucuuuauuuauaaauuuugaaagcagaauuugaagaguaugaccaggaaugugucagaucaaauggcaagauuucugugucugauugguuuuccuuaaugaauagauuuuauuuaaaaguguucaaaaaaguauccauaguuggucaguaucgugucaugugacaaauugugugauuuuguuguuaaaucuguuguuaauuugucaauuauuccuuaguaagaugcuaauagaaaauucuauuagaaugacaagguagucccaccuccguuuuaaaggaaacuuuacuucuaaaugaguuaauccugaaaaauacaguaagauuucuuguguuauuucuugugcggggcagugguagugcaugccuuuaauccuaguacuugggagguggagacagguggaucucugugaguuugaggcugucuaaucuaccgagagaguuccaggacagccagggcuacauggaggaaaccauguauugaaugccccuauccccaaaguaucauuucuuauuuuauaguuuuagagucaauguuuucuucuuaacuuccauuuuuaaaguagaaauagcaacauuaaguguuaaagagauauaaaaguuuauauaaaguguacauuaagauccucuuuaauuuuuaaaaauuuuauuuuuccuuguuagcacaagaagauaaugugagcuucucagauacugucucaguaacaaaccacuuuccucagccccagcuggacucgccaggcccgucggagccugagaggccggaugauucuucuaguuguacugauauucuuuucuccucggacucagacucaugcaauagguaagacauguguacaaguugguucucuuaaauaccugcuuccuauguuuguuucauagucacuuuucuguuuuugugacaaaauaaacuuugaggagaaaggauuuauuuuggcucacaggucugggguucugauccucauaagaaaaucaagauuuuuuuguuuuucuguuuguuucuuuguuuguuuguuuaacuugauggagccgauugguucuaugacuaguuuggagaagaagaaggguaagugcuggugcuggguucacuuucucaguucccuggcaucuacaccccagcuccagggaaugguccugcccaccuuugugguauguguucccaucucagugaacccaaucaagaugaaccucuuaggugugccuggaggcuugucuccuagcuagucccagauucuguacaggugacagucaacacuaaccaucuagggcggugcuucucacucuuccuaaugcugugacccucuaauacaguuccuccugcgguacugaccuccagccagaacauuaugugguugcugcugcguagcuguaaccacgcacagccaugagaaccgcugaucuagaggauaaaucauaguccgggucaggucacuuucucuucuguuuaucugcagagucggcuucauagagauggcaaacugggauguggguggguaauguggggaucuuaaacugacuuucuuuucucccccuugaguuguuagaacaaaccugauaggcagugggguuuucuuguuuaguugguuuuuguuuuauuuuguuuuuuggguuaagaaaacuacuucugcuacacuaucaauacuggauccuacuaucaauacuggauccucaccaagacuccugggaggugacuuagugauuaagagcacuaacucuuggagaggaccugaauuugauugccagcacucacaucaggcagcucacaacuagcuguuauucuaguuugggaguaucugaugcucucuggccuccacaggcacuugugugcgugugguacacauaacucauuagucagacauguacaauacauccaugcaugcaugcauacuacaucuuuaauaaaagaaaagucuuaaagagaagaugucugagaacgacuuuggaugagcuccuagaaacugcguacaggcagggacuguugagaaugcuguagucugcugguggugccucagcaugacugugugggaagacgcaaacuuagaguuguuuagcaaacgugaagagguggggauggaauauuuuagggacacuuaaaccacuuucuguuauauuuuuauauauguacaaaaaugguauuaaaacccuauguugaggcuccagagaugggccggucaauguuuaagagcccuggcuaggcaaucguuguauuggaauuugcucuguagaaccugacugccugccaaacugaaaauucuauaaacaucucuaacucuggcucaaaggaucuggcaucucuuccgaacuccacagcaaccagggguacacaugcaaacaaaaauaaguaaauaaaacugaucuuuaaaaaacaacccuuagcugggcuaugguggcacugccuuuaaucccagcacuggagaggcaaagguaggaggaucuuugugaguuugaggacaccccggucuauacagccaguuccaagacagccagggcugcauagagaaaucugucucaaaaacaacaacaaaauaauaauaauaauaauaauaauaauaauaaaaaagaaaaccuaaccuuuuauuuacuuaaguuuaaaaacauucucuggguguguauauauuauguuuucuaagugggagggaaguauuguagcuaaauugacccccccccccccccccgcuugcuugucacacaguauguuuugucuugccaucugcauuguugucuuggacuuugaaaugcaacauuugaaugugaauaagguuccuaacucaguucagacaguuuucaucauuuaauuggaaaacaugaagugauuuauaauguaggaugaugguggccuggcagaaagcugucacagaguuagugccagugucauuuagugacuccaaaacuuaaauaguccaagagaugaccauuugacuaguguaauuaucaccguagaauucgggaaaaugauccagaguaagaaaggccagucaaaacuaaauuucauagcuaaaucaaagucuauuaaagauaugugauuuuuauuuauuuguauuuuauauuuuauauucaggcaacagagguaugggagaugggauacuguagugccuuuguugagaucuucugcaauccuaaaauugugucaaccuuuuagcuuuguagaguuggcaaguaaaccgaauguucaucuacaacuuaguguuauaaaauaaaucuagaauuucauucacuuuuuauauugaaguauuuguaucuuuaucuuuugcauuuuaaucagaaaguuuuacuuuaugaccaucuuguuauuuuauauguauguguguguguauguguaaugaauaugaaucuuuaggucauuauuuucaaaaaguuuuuuauguuuguuugcuugguuuggcuuuuugagacaguguuucucuauguaacccuggcuguucuagaacuuguucuguacaccaggcuguccuugaacucagagauccaccuccccaugccucccaaaugcaguaauuaaaggcaugugccacuaccacuuggcugaaaaguuaauuuuuuaacuuaaaggauauacuaucuuuuguaugauuggaaaaauaugaauaaggucuccagauuuuguuacuguagcaguauuuaacuucuugauuuugauaguuaugugcuaugguuauuguauggacugauuuuuuuuuagauuuauuuauuauguauacaguauucuguauacauguaugccuauaugccagaagagggcaucagauccuaguguagaugguugugagccaccaugugguugcuaggaauugaacucaggaccucuaggacagucaaugagugcccuuagccgcugagccaucucuccagccccuggacuuauuuauaagaaaggcacacugacagauuauagaacauuugcagcaaugccccaaauuaaaaaaaauuuuuaaaaauuauauaucauuuaugucuauugugaaaaauagaaaaauuaaaggaauaaugguucauaauuuaacuagguugaaauaacacuagcgcauuaauaaucagccuuccacagauagacaaauguguaggucgauggguucuuuauuuuuuucuacaguaggaccaugguauuuuaaaguuuucuuguugugggucuacugugaguaaaaacgugugaauugucuuucugccuugcagccuugcugucuuacaguacagagcugaccauguugaaugaagagguuagguguuuuguuuuguuuuguuucgugcuagaacaguauucaagcuuauauaaaauggaagauugacaccuaaaaauagucguaagauucacuauguguauccaguccaaauagguuuuaugaucaaguggucuuuauugcuagcguaacuuauaaguacagauuuuagaacuuacuuuauuaauacuauauugaccuucuuuugccagcuugaaaauagaagauaaacagauuaauaagaauuucagauuguuguacaguuccuugcuagaugauuuccgggaguucacgagucuuguccaaauuucuuuaaauuaacuuauuguucucuuuaaucaagaaaagaaugcuuuuauucacugauucuuggcaaacuauggacacugcauuuuuauugaaggcuaaauuagaagcaaagauucuguugauuaugauuagagaagagagacacuagcuucauaaaggaaugauuugugaauugugucaugcuuuuucuuggaagaaucuuuagaucauuauuuugaaaaaaaauuuuuaauuugaaagagauggugaucuuuuggcauggauggagaaguacaaauaaggucucuggauucuauuacuguagcaauauuuaauuuuuugauuuauuguauggcuucauuuaagaaagccauacggaggaaguaaauaccacuggcaacagugugcuuucuaugguaggguguuguguauauauguagcuacacggauagcugugauagacuguuaucaacuggaaggucuuggggcuuguagguuugaaaucauuaaaaauguaagucuuuuuaaaaagucauccauaaugaaagaauuuugguuguuaugcuauaagugaaaugucugauuuuucuacaucuaggacauguuuuaaaaaggaagauuuaugcuuuaaaaauuaacuuuaaaaauaguauccaugaguuugcauagaguguuaaauauuguuuccauuuaauuuggucaaccuauggucagagccugcugugcgagacuaacuaucugagccccaugagcaguugugaauuuuuagcuuauaaagauuagcuaggucgggugugguggcgcacgccuuuaaucucagcacuuggaaggcagaggcagguagauuucugaguucgaggccagucuggucuacaaagugaguuccaggacagccagggcuauacagagaaacccugucuggggugggggugggggugggggggaagauuagcuaauaccaugauucuguggucagucacauuuguagccuguccuaacucagguaggugagucuucccacagaugcugaggguaggccucugaaaaaugagucaaugugugaacgaauaacauuguaaccuuucuaaaucuccccccccaaauagugaagacuuuuuugguguuaaguuaggcacagcauguguaguuccccccccccccauccgccauuaauuaauuaauuuauucacuugacauccugauuguagccucuucuccucccagucccacccuaucaccucuuucccucauggcccccucuggguaccaacagguccuggcacaucaaguccuaucagaauuaaacuaauccucuucuagugaggcaaggcagcccagcuaggggaaagugaucuaaaggcaggcaacagaguccaagucagacagccccagcuccaauuguuaggggaccacaugaagaccaagcugcacaucugcuaccuauguuuagauggucuaaguccaguccaugcaugcucuggugguucagucucugagagaccuuaugggcccagguuaguuaucucuguaggucuucuagugguaucuuuggccccucuguucucucaauccuucuacucuuucaugagacucccugaauucucccuaguguuuggcucuaggucucagcaucuguuuucaucagcugccggaugaugacaguugagcuaggcgccuuuaauguguguuucuaggucaggguuaccucacucaggaugacauggucuaguucuauccauuaggcauagcaucuuuaugaaugaaauuccucucaagaauaggcaaagguuuuaggcccuuaccaaauaguacuuagccauuggccuguguuuucuaguuucauagaauuuuucuccauuugucaaucauuucugaaagagcgaucuagaaaauugaaagccagaggaaaaaacaacgcccccccccaaccuuauuacuaccuuuuuagaaaacguuaaauucuaaccucucuuaacuucugagagaaauggaaaauaaugaagauagcuuaagggaaaaauggcaugagucauucaucuuaguuggcuauggauaaggucaggugaacacauugcuuagugaggggaccaggaagcacuuucuaaguagccaguguacucucuuacagcuagaaggguacagaugggucguggucugacaauauaagguguagcuuuucuuggguguugcaguguuugucagggcaaggacuggguaucccuaaugguugggguuugggaauccaggagagcaugaguuugagaugaaaggucagagaacuggagugucccuucauguuucagagcugaugggucucucaggaaguucuuggacucaggagcuuuuguguuucugggagagccuccugaguaguucuguuacucaagacuacagaguagugaagccuuguuagggaggcagugagcuaugugagcuucaggagaugcuacuacucuaguacugguggugauguaagguauauaaucuuagcgacuuggagaugcagaaaugaaauagccaggagucuuguuagucaggaaguaaguggcaaggucagguuugacccuacuguuugacuguagagcccucaaccaacccagcuuuuuuccucugaagagaaguaugaaguguguacuuagccaugagggagcagacccgacaggaggguuuguaugagaagacauauuugacuuuccucugaagggaaugggaggugaggcaggaaaagauguaugucaucaaaccagugcuggccucaccacucaucaaccauaggugacauguguguguguguguguguguguguguauguguguccaucuguccuucucccccacuugcugcaguuggaagagcuggccccagggucaugagaacugaugagauggccuugauaagggaacacuuguaggugagagcucugaggaugaaagcaagggagagccgggcccugccacuuaucugccauugucugacugagguuucaucggucgaaaacgcuuggcuaaguucucaugcagggccagggaacucaugucaucuaacuuggagcuguucccuacugcuuccagcccucguguugggcagacugucuugcaacaguaaggcuaagccuggcacacugaaggaauggggacaggguaugaaggagaucugccuaggcuagguacugauauuaacuaaagguaggaauaggguuuggcuuugguacauuuuaugagaacagaugggauuuuucaaaccuuagucuuugccuacaagaagggaaugcugaguguguaucucuagagcucuuuggacucugcagcuaucgccaugcacaguugccuuugccuccuagaaggggagcuuagcuaugccugugggcuguuguaguccaggcugcccuuuaauucauggucaucuucuuauuucagucucuugagugcuaggauuacagaugggcgccaucaucuccuagucaaccuuuugaacucuugauuccaucugcugagagacaugggcauuauuaccaucacuaauguccuguguaugagacuuuguguagcuagaauuugaacuuuuagaguaagauagaaucuauuagaagaguuaauuuauucagagacuccguugacaacuugcuaugggccuaacacacuauuugugcauaguaaguaugggucaagguuuacaagaacagacauucagacuaagaaaaagauaguuggguaaauacaauaaaugugauugguguuuucauaugcaagauauaggauggugggggaagggcagcugaucuaucuacuguggggacaucagauuacuggaauaccaaaggaugagaaaagcuuuacuaagcaaagcagaacuuuggaggcaagaaguggagaaaagcaucauuuccagugauauggggaagcacguagcguguguggugcaguuagcagugcuggccccauaggcaggcaccuguauaccgagucugaugcccucccaccagguaaaccgaacuguucaaaguggauugcugcuuaucgaauacuuuccaaacuugggauauucuuguccaaagauaugucugugugugcuguuugauucauaaaaaugguucaauuuuuaaauguuggcagaauuaauuauucauugagaaaaaugaagaacaaaaaggaguagcgagugugcuuuuaagaacacugagaaaaguuguagaggcugcaggaacucguaguuccuucugacuguuagacaggcaguaacuguuugaaucaauauaagcaggucuccuaggugguggccaguuaacagcugacucuaguuuacuuuuuaaaaaaucacaaucccuuaauccauguacuaguguaaaaaaauggauggggcaaaaaugauccgucauuuaccaccuuuugcuguuggaauuuuguguuuuuaacugguugcuugggauucguuguuccagucacugccacacuacuugucuuuuaucagaagagcagguauuacaaggucuuagagacagugagagucugaggaaagggugagcuaagauagaacacaaguguuucaaaguagaaaguuugcugagaagucguaaacacaguaucugcuucuguggaugaaggauggagaucugggagcugaugccaccucucuagagggagacuuaagccucucguucacuccaucccaggcauucucccauuucaacgugaggguuuccaucagccuguauuuuagaccaccacugccuucguggucuaagaacugaauguucaaguuaggugaagaacagccauguggguggguucuacuugccugcagucuuggaagucuugcaggcugguuuuaacucuuaccuuagcuuaauaacuagauagcauuccauuaucucuuccuggaaugguugucuggguuccucaucaguaggcaaggcagaauuaauuuguaugacgucucuguccuuuuccccucucacccagauccauucuggaacauggguacauaguaaaccgcugauucugcuugcuuuuauugauuuuaccaaguaagcauaacacgucgcucuguaucucaggaauucagccauuacaggugauugcuuuuguuugcagaggguuuuuuuaaaaauugauucugcaaaagccaauuauagaagacuuaaagaugacauuuuaugcuuuucuugcugugcucaguauauuuuaaaagcaucuuguguaaccuauuauuggggguguggguuauacugcacauaaaauacuaaaauguaucaagaauuuagaagcucagagaaaauaugguuugggagggauaguuauuucacacauuuaugguuuagugauaauacuucauuucuuuuuuuaacaaguuuuuauuagauauuuucuucauuuacauuucaaaugcuauucugaaagcccccuaugccucccacccucaccccugcuucuuaaaggagcagauucucagagaagguaagugagugacugugcuccagucaugucagugagauuuaaaaugugugcccuccuuggacagaucauagccuggagucauucugcucgugcugauacagugcagggcacuggguauccuccauugguacuguuggaaagagaacaggauggacuuaagugcagcugcuguagcugaacagaacacgugcagucucagugccaucuuuguacuggaccucuccacucccauugucagaggcuugucauccaguuaggcuacagugauaggaaaugcucauccuuggaauuuugguuauucuaugauucccuggcggugggggugcagggugcugggcacagucaccucacauugugaucucccugucuuuugguuugucuaugagauuuucauuccuccgauaguucaaaauaaaacaaacugaagugacaccuugugcuuuuguuucuuugcccauuuaacuagagagauuugguaccuauuugaaauagucaauaucuggguaauuuaagaugauuucuguggugauuugaauaggaauggcccuuauagacucagguguuugaauacuuggcccacagggagcggcacuauuaggagguauagccuuguuggaguaggugugccaaccuuguuggcagaaaugugucacacuaggggguggucuuugaggucuccuaugcucaagcucugcccagugugggaaucugaccccuucuauagaauucucagcucuuucuccagcaccauguuugccuggaugcugucaugcuuuccaccauaaugauaaugaaccaugaaacuguaagccagccccaguuaaauguuuuccuuuauaagacuugccuugaucguggcgacagcagugaaacccuaagaaaucuuuuauauuagguaguugauauuucagagauacugcuuuuguuuaaguuucaagcuaagcauaagcauaaauauuuaauuguauuucaaacuugaauuuuuacagagagccaaaaaucuccaauauuuagaaacaacuuacucuguucugguuuccuuaaaaagaaagagcacacucaucacauucauaagaguuacuggcccaaaaggagugcuucucuccuuaauucagaguuuccaacucuuuccuucaguagacuuagaaaauaguaguauuuugguagugugccaauuuaaaaaaaaaaaaagugaugcuggagccugaagguaccuaccaugcuaugggcuucagcuaccuacaguugggugcugugaguuaguuccugguauaccagcaaucccuguggguuagggagagcacacugcuuaggagcugugcuguuaccugcuucccuaguauaccauugaguaguggccagggagagugucugucgacacguagacuccuacugccuuagguaggaggacagcagcaacauuugaugucuccccaguuucugagaaggguccauugaaagagguggaugugacuuaaucccacaagccccagcaauaguaaagcucuuaguucuucaguucuccaaguccucagaaagcaccaaggccagaugaauaaaguuugaggguguugaaguggaacugaacaaacaguugagauauuagaacuagcaaguucauggguuuccccaguccaucacuucuguguaacagcaaagaaagcacagugaaagauguaguguuuuuuaaagaauaaucaguucauguauuagacauaugguuuucuucuaacauugagacugccaacucuccccugguuagaaaccuugcuuuaggauccaggggcaggcaugcuccacguggcugagaagcaugagauagagaucacauugcuugcauguagaaagggguggggcacagauuagggaucggaagaggggagcagacugacuguugcucgaaugaaauuugaguuugcuuggccaaccucccuagguuaguuggucauuauggugguuugaauaagaauggccccuauagauucauguguuugcuuggccauagggaguggcacuauuaggagguguggccuguaugccacucuggagguggggcuuuggggucucauaaauguucaaguuccucccaguuugcagcacagccaccuucugcugucuguggauuaaguuguagaacuuuugucucuuccagcaccuuguccuacugcaagcugccaugccucccugacuguaagccagcccuaauuaaauguuuccuuauaagagcugccuuggucauggugucucuucacagcaauggaaacccacacugugucuauucaugcauugggacuaauuuuuaagugaaccucauugcuguuguuuuauaagcuuggauaaacacauucuuuuuauuaccugucaucugaggccuugucaucuuaguuuucuagcucuggagcccacuaagcucuucuuagcugaucuuuaugaaguucgcaguugguuaucuaguaaaacuuuauugauagaaauguagggaaguaugaauaguaccaccuuacagaugaagaguauuugaguuccuacuuccucuggcugaagcaacauggcuggugaaaacaaaaugagcuugguauuccugccccccccccccuuuuuucuuucugauccucuguccaucuugcagaugguaagaaacguagaacaggucugcauuaaagcuaguauguaagguaauuguuacagugguugcuaauaguaguuacucagaaaaaaauggugcccuuuaucaucacugaguuaaaaaaaauccauaagugcuauuuuacugccacugcuaauaauuauuaauaguaauacuccacuaccagaguauuuugcauguagacgauuggcucauccuaaagaacagauuacuagaaaucacucuuugaggaaggauuccugcuggugggcagcauuuacugaaagaccauugucuggcagguuucguacccuuucauugaauacuugauuugcaguaaaggagguuguuuucuuuuuaguggugcauauucuuaaccacauucaaauuauugccacagugaagacacuuggaggcagguaacuauuagauaauagaaaauuccacuuguaaguaaucuuuaauccacaggauuuuuuauagcagauauuuguguuuuuuccuacugguacccuuuguaccgggcaagcuagauaauuaggcucugaugaguuugcaccuggugucauagaaacagugggaaucaaagguuaaagugguguauguagugaucaaguguccugggcaaauugaaacggugcugcgacaguguuuuggaaaguccaggcucaaagcugguuuaugaaaauaggcaacauugacugaacacucacuacgugccaaccucgguccuuaccaucuagugugcuguauugaucaucuuuaaaagaucccugcaaaauauguguccugacucuauagauacaggcuuugagguuuagaaggauuucagaaguugccugagguugcacauucagugacaggaacaggggucccaucuuagcaaugcugacaguaagucuaugcaugugcgccccaucccccagauaacuuuacaucacagcuuugcaggauauuugacaucuuuucaacuguggaaaucuacuguuauaugaaauuguaugcuauagaggaaauaugcaaauagcuuucucuuuaaaaguaauguucagagagcaaugaugaaauucucagcuauuccaagguacauguacauauaaauguauuagcuuauuuuucucuaguuuaagcugagauuaaggucaaaagguaugaaaaauugagccuacuaaaaucuugcagaacccagcuugggaauuuagaauuuaaaauucauauaauauucgaugaggcuuucucacguaugaucuauauaaugcgcaugauagcuggacagaugaugacaucggagggcacaaucugaauacucuuccguaguuagguuguaacuuucaugugcaagaccucuuguuuuuucagcuucccaaauuacaaucuuguagcaguggcagaccuagcuggugagagcuaggagagaugaugaaguuuaugcagaaguuccuuguuuuagauguaaacguuauguucauguaggauugcacgugcucucaccucaggcuuaucagagucagugauuacauuucuccugaagaaguauuuuagauauuuuaggggaauauucuaucuuuagggcauauuaaaaagacuaaguaaguucaaaaauaugaauugcuucuguguacaggaaagaaaucuuugagugauaauuuuaguaacacugaaauuuguucccuuuguaaaauccuaauuaugaacugucugcuuaguuucugacacuuggcuuucgaggacaugguaaguacauuccuuuagacagguuuguacaguuuucucuguauugccguguguuccugccaacucuuaguagucauugaugacagaagugaaguaguagauguagcacccagacacuuccuagcuggugaacuugauacuuuguaggcuuuguaucagucagauuuugauuuuggcaucauuucaugagugccuaagauguaguguuaacaaaguaaugggaauuaggacagugggagcugcuagcauggcugagcaccaguauuaaaggcaggggaaacaacgagguguccuuugugaacugccaucuguuuuccacugaggcaucauugcagaagccucucgaguguaugcuaugugcucugcacauauuaaauuuccuuuaacaaaccagugaccauccugcuuacuuaccuggaaccacagaugcuuuguaaccuuuuuuuuuuuuaaugucuuuuaaaguguuuuuuguggaagaguuauuggacaagaaguagacuuuacucuuuccuuugacuaugugacucaagacagaaauacagucaagugaucucccaaacucccagaacuacugccacagacuuuguccaggagugcugaggagaacuggaaaagguuaacuggcugcagguuuccuacaguuagaacaguuacugcauaauaaggaggagccagaguugagauuuuaugcuagaaagguuuaaacugugucugugagaauggcaguggcggugggcaugagccagcgaggagccgugugggucugucucgagaguaaugaaguuagugaaaucagcuagaugaccuggagggcuuucugcuuugccuccucuucuaauaaaagcuccauuucaguaguuguuuaauaggaaagguuucccuuguuggaugaaacuuacugcugaaguguuccuuguccuagaggacacuuagcuuuugaagggggugcauuucucagugggaaaaaauaguagacacuuggguacuauggcaggcugugucacagguucccagcacagggaccaaaaggaaaaauugcaguucauauguagauaagacagaauugacugcagacaagacaguauccuacauaugugugugcugucauuuuaaaaauugugugugugcagugcugugagaauaaacacaacuaaaguauugcgaagucacaucuguuccucaucauuauggauauuuuucaagccacaaacaccugaaguugcuauuaccagugagccucuuguucucagaugcucaggaaagguacuagaagguugggggcauacgugcagugugacugaacguccuagacccugcaugaggcucuugagaauguagaggacuuggggcaccacaugggaugagggagacauuuggugcagagcuguguuugauggucuccggggccucuuugaucuaagcaucagagagaaaugcugcuucuguguggcuugucaguaauggcugcaagugcuucauuggcacuuuaaauaaauuuaauauaugugaguacacuguagcugucuucaugcacaccagaagagggcaucagaucccauuacagaugguugugagucaccacgugguugcuggaaauugaacugaggaccucuggaagaguagccagugcucuuaacaacugagucauuucuccagccccucguugacacuuuaagccuucauaauuuaaagcuuuuguuguuuauuaguguaucauuggagaauuauuagcauuuaauauuuuuaaccuuguuguuucucacccuagccuuccucauucugcuaagcgacuuuuguuuuugaaugucccguuugguucccaugacauucaguguagaauuucuagagaaguguguuugauacugguagacauguggguuuuuuaaaguaacuuuuauugauaagaugggaacgagaugcuaaaggcuucagacaguuuuucuuuuaaaggaauaauucaugccuccccgacagccuuguuuucugugcaccacuggagaguguggcguuuuaagcuaggucacauuucuauaacacacuuccauuauuagcuuggcucucuagcauuaugcuucacuuuauguugguuaccaagagacuaaaagccacuuagagaguuaucgcuugugaaucucaucacuagaauuuaguuuuuaaagcacauuuuuuucucuuuuccuuuuugauagugcugggaacugauaaaaugugauuugaucuuugauuggcauaagagauuaaagagucucauguugcugcucugucuagacucagguuuuguguugagggauuuauuuaagcuuucuucauaguuuucauuauugcuaauucaugacagcuuuuacagcuuuuuugaaauuuauuuggcauauaauuggaccaauuuggugagguugcacauaggaauguggcugugcaacuauccucacagugugcauggugaacaugcccaccguucagugucaccugugccacuuugcccaucucccaguccccaucgcccagggcucaugcuuggauuaggacagaccucacaaggaguggcauugcugacacguguccuuuuaguuccaguucagacaucauaagagaucuucuggaagaagaggaagccugggaagcggcucacaagugaguucccacgaccagcaaacguguguacuucggccugagaaaugagaauucucuagagcugauuucuguacaaacauuugugcuuucugcuguaagagaauaccaauccagguggaaggcucugccguguuucuuguuuguauguucuuucucacuguggaacuggaguccucacauaacaacaaguuacuugugugaugucaggucuauguccacauuauuucuuuggacagugauagucuguuaagcaaagucucacagcaaauaaauauccuccccaugucucuuucugcuucauuccuccccccuugucuggagccacucucuuuguccuucuuugucuuacacagacagccacucccucucaacugggucuuucucauuuuguucucagugugcagugggaaccuuuguguagcugcagguaauucuccuucuguagcuucuguaggugaugucaacuugcauuuuguuucuuuaucuuccauuuuugcccuuugaaggccuccagacugcuaaauccagaggucguuuucagaauucacuuuccuugccucuuuagcaguacuuucauaccaagcagaaagaucggaaauucaaaguccuuuucagcaagugucaaguuugaggccagcauggccuacauaagacucugucuuauaaaugaugaugauggcagcuacaugagacccugucuuagaggaggugauggugauggugguggcgauguuuuuaagauaaauagaacaaauuuaaaguggauuaaaaugcugcaauggaagauaucuggauaacaccaaagaagacagagaugauggaauagagaaaugacaacaaagaaagcgccacacacacucugcuuugugggugacugcaggcauggguuauacaaccacaccagagucagacacuguagaacagauuggaagagauagauacugugcaccuuugcuuuccuuacaaggaacgauuuuauaauucuaagacaccgauacauugaaaacaaaagaacagaaaaagauaugccauagccauuucaaacagggcuaacauguuacugucagacaaggagacuuaaagguaaaaacuguaauagagccaaagacauuuauaaugcuugaaaaggucaaucuaucaagaagacaaaaugauugagaacauguauacauguaacaagagccgcagacuacacgaggcaaaagaugauggcaaggaaaaccaccacagacaacagggagaaaaauuucaccaucaccaccacuacuccucaaacaaucaaaaagcaagaaccuauugccguggacucugucguguccucaucaacucuuuguggagagagggccaugggcugcagugagcugcagaucugcgugcugaugcugcuccacucucuaguguccuccugccuuccccagaacagugugguaaagcaggaaaacuuggcaguucucuggcucugugagucuuucauggccuccaggugccagcuagcgccucuccgcucuucuaaagugcacuucugucaggaguggacuucagacacagaccucccuggaucucagucucuuccuuuugucuuguuuaguuuugccuuucauuuucuagguacuguucucaaaguacaguuuuuaguuuugaugaaauguauaaugucuguuuuauuauuuuuguccaaccuaggaaaccuuuucccaaccccaaaucaccaagauuuuuuuucuuuuuguuuuuuauggcuuagaaguauuagguuuugcguuaagguuuguaagcuauuucagguacauuuuuaagagugucauaagguguggagaugaccgugguucaauacuucuuuuuggcaugaggcuuucccauugcuacagcacuagguauugaagagaugacccaugucuguuucauauguguguguauuuguuucuggaaucaccuuuguguucuauugcauaaagauaccuuuuaaauacuuuguuaguugcuguucaguauuguuuuaaaucaguaauaugagacuuuuaaaauaaaugcaaugguuuauacuagaguuuauuuguuguuguuguauuucuuuugauaaauguauaagguggcagaggaagggauaacacguucccuggcaguguagcugcuauggccugguauaaaguugagaugagccugggaccaggcugccugugcuuauuucaccuugacauguagguucugcugagcucuucuggucuuugaaucugugaugacccauugcagagugggacuauccugguaaagaguguugaagucuuaguuagcauccacaugggacucuagcauugcauacuagguggcuuaaaccauagaauugcguuuguccacagcucuagaggcuggaaguccaaugucaagguggugauugaauugaugacugaauacuacuguauccagaaaguguacaaaguacaaaauuuaaaaacaaauccucagaguucaaacaaagccuucucaucuauuugugugcaugauacuucuuucuccaaacagcaucucuggacuggcucuguugguguacccucugagugggaguuuggccaagguuaaacuuuauucuuuuauuaaacugcuguagcccuggguugagguuggcaaaccauagccugccuaugagccagaucugcuccacugucugauuuuguuaauaaagcuuuuuuuguuguuuuuaagaacauagccauacauuccuuuugccauugguucacauugcuucuuuguuguuccguguuacaacagaggcaaguaguugcagcagacugaguugucaaagccauaaguauuuaggccacuaaaaaaaauugugcaagcccuuauucuaaaucagaagaauuuaaaccauuggguuaaguacacuacuggcugacagcuuuuacugugacccacccuggcaaaauuggggaagcauuaggaaucccugcaaguuuuauaaaaaugucuuuagcccccuugcauccgacccuccuggguaagaagacuggauaaaugugggagaucauuuaaacagaggugacauucaaacuaauaggaaagggcacacugacuuuguggaggggaaggcuacuaacauagaugccugaacagaggaccuuguagacagaaagagaaugggggacucugaccuucaaagcaauccauggaaggcuccucacccugaaaaacgccacugugagagucucccagauggcugcaacugccuuagacuuuccugccugcucuccugugagaugaccaggaacaucauuugaucuucacucaucguggccuccuucuccgcuguugagcagauccugccccuucucccagaagcauguuacuuccuccaggugaggacgaucucaccauucucauacuguugcucaggcgucucaccccacagguggccuggacagaugagaugagguguacuggugguccagacagucuuaaaaagcuaggaguggacuugguucuuugaacugaguaagaaauuaucuugauguauacuaacuggccagacagucuuguaggaagugucaucaacccauguaccccaguugguguugaugccguuuugugggaaaccagcaguuauaaauaccacuuucucuucaggagugcuacuuguaugaaagccagguagguguuaaugucccuuccucccagaaacaugacuaacacacuagugguaaucauuaccaauuuguaagaauucaaagaaacaccacugguagaucaugaggccccuagauaauuauggagagcucuccagaucaaagcugccuuuuguuacuuggggagagcuuucuugaagaaugugaaugguaguguaugcauacccugcuguuccuaaaauaagaaccauccaauucuuugucuuugaccuuaccuugggugaguguuacugucuugccccuggaagguauugagacacuggagauuguauguggcuuucugagguagccacugaaggcuuauagcauuguucugcuuguugggucuaagacccuggccucauacuuggguuuacuguugcaaauucaucucauccugcuccuagacuuuuaguuaaacacucugugagacaaauaguguacuaacaccaauuucugucagcuggucaaagugacugacgaaccucaguuuuccagaagaccacgcugguacagaaacuggguagcuauugaugggagacauaugucuguaggagucuugcuuuucuguuugugcugacugcuccuggugagcaugugucuaggccauugugugauaaguagcauuggaagacuuccugccgagaaacgggagaagacaaaguauggcauuaaaaaguuucccaacacaaugcuugccuguucugguguugccuugugggaaccaggcuuggagcagcucagaugucucagaugcucucugccugugcuaaaacacaaaccacuuucugcagaagccuagccuaucgcccucucugguguuggugaagcugucgggccaacuaaucguuugcccuugguucucuuagggcuuuccuaauucuugacguauucuugaugccuucagaucuaugagaaccaacagcaguguuuccaugccguacuuucuguuccugguccccuugugguguauuuacuccuacgcauguuaaauggcugcagauuggcagccggugaucgugcuuguuugauguaggaagcuuccuuaauauuucuuauguuauuucuuaauuguauuagccaccaguccuccuagcuuuugucugugaugucucuucucagcuuucaucuuuaaaagcuguuuuugcugggagcggcuucuagguugacaguuuuucuucuggcacuuucaagccaccacugcgucaccucaaggccugucugguuugugaugcgaagccuacuggaaaucuuauuuaucccucuauggaauguccuuuagcucugucugccuucaaagauuuucagcacuuugaauauguaucuagguguuuacuguuuguuauuuguuaaugggggcagggcuaacuaacuagcuuuagucuauuugaugucuuuaauugauuuuuagaaaacucaguauuguaauuaauuuuauagucauuucuucuucagggauucuagucauguacacacacaugcaauuuuuuucuguuuuaguuuggacuuaaauuuuuuuuuuuuuuuuuuuuuuuacuuauauguauguauguguguaagagaggguguuugugucaugugugcgcagguugcgggugaagagaacauugaauccccuggaacuggaguuaaaggugguuaagagcucccuucuguguucaggagcaagcgcucuuaaccacugagccaucucuucagcccccaguuugauguuuuuugcugacauaucuuuuaaauuuacuguaucauucaucaguuucauacuuuauacguaauuguccuuuaaagaagcauuucuucucugaugcuuuagaacuuuucaguguuuccauuugauuuguucauaucauuuccaugucugugggaguucucuggauguuccuuuucuuuuguguuagagcccucaguguauaucacuggucauaguuauguuugaggucauguggucuggugggcccaguauuugggcugccucugcaucaguugcuuugugcaugacaguagggucucuuucuugauuguucuuugucuucauuuuuagccuaagacugaacauccuguguaggaugccugagaucgagcuaaauaauguuugugccuagaaaagagccuacuucugucuaaccaguaauguggggaguugagccaggcgaucugggaguuggccugguuggguuuuagugguugcucugacugccuucgccaaagaauccgugagaucaucagcucuuguuuuuccaucagaagcucagagacuuuugucugaguuccagggaccagugcauuccuauucuucacagaagagaagcauccugggagggagacaugcuuucugccucccuccuggcugucucaauaggcacuccuauuucuggccuguuuuaggcuuccucuugaguacccagcagaagaguaaggcuuauuuauaagugcguguggacucacauguuugucuuguacuuaagaagccaaaccagccuggccuacauuguuuucaggugagccagagcuacauaauaagacucuaucucaacaaaacaaacaauagcagcaacaaaguuaaugguaaaagaaaaaaaaauaugugcuuaauauauuaaagcccaggauuccuuccauucccaacaucagaauaaacgaugaaagaaaaaacuccugagaaguuuagcuuagugcacaguaucacagcaucccucuugcucccuuccucccucuucucucucucucucucucucucucucucucucucucucucucucucucucucucugucucugucucugucauuaucugauguucugcccaaagugagggaauuuguguggcccaucuaucuguaaagggggacuuggguuuuguuuggugugugugugugugugagucagagagacagacaggauuucucacuggccuagaacucaauaaauaaguuaggccugcuuucagugagccucagcccaaggcucuauccaccuauccaccucccaguccugggauuacaaguacuuggcuuuuuaauguagguuuguccuagugaagguuucuguuaacugugaagagacaccaugaccauggcuacucauauaaaggaagguguuuaauuggggcgggcuuacaguuucagagauuuagucuguuaucauggcaggaagcauggcagcaugcaggcagacauggugcuggagaaguagcugagaguucuacaucugaaccugcaggcaacaggaagagggccaacacugggccugccuggggcuuuugaaaccucaaagcucaccccucuccccaccccacauacacacccaaugauacacuucuuccuacaaggccacaccucuuaauccuucucaaguacugcuacuaccugaugacuaagcauucaauucugggagccucugggggccauucuuauucagaccaccaccgaggucuagggaaggaacucaagauuuccaugacuuaguuaucuccccagcucuguuauuuugagaccaagucuggauauaguauuuguaccuucuuccaggauagccuagaacucacaauggaggccaggauguagucaaaaccacauuuuccuuccucugccucccaaguacuagaauuauagcuauaccacucagcuuuugacucagguauguacgcagcuuuuuaaagcuacggguuuuugauucaagggaaagacucuuuucuuugguccuuauaaguucauuguucucauacuuaacacaauaagaaugauauaguaauaauucaaauuauagguuugucuuuagaagagaggcaacuguggguuuuaacgaagucaugaaugugaaaguaacugcuuaguauacuaggaguucccacagaguaugacuguuguuuucugauaugccauuucuuuucuuguuuucagaaaugaucaaaacagagaagucagcccacaacagacucgccgcacuagagccagugaauguguugagauugaaccaagaaacaagcggaauaagaauuaguaugggcuuugugccagcuuuccguacagugaccugaauaugauauuguuauugccauguauggcuucauauuuaacaauauccaaggaagacuuuuaagucuaaauguaauaguuaauuuauuuucaugcuucuuugccuuccugaacaacaacaaaacaaacacacacacacacacacacacaaacaaaaaccaaaaacaaacaaacaaaaaaacgugaaauguucugaaaugacucuucuuagucaguugguuccuuccuuuccuuugagacauuucuccccuaaaaucauacucaccagcuuugcacagaguauacauuucuuagcgggagcguuuuccuugguuugacuucucuauuucaggauguuuuuaagucauuuuuuauuuuuuccacuggggaccaaaccucagaagcagcuuuucauccucuugacaguugcaagccugccgcugagagugugcaugcucuuguccuaaccacacacccuuggugggagcgccugcugccaggccaccgcaguuacugcuuaguacccaaguugacuguguuuguuagacacaccuguguuuacuuauagacuagguuuauaauggggcgggguaggggucauuuuaugguguuugaaagcuggggaaguagggaugucagugcugugcuuuaagggcgcagucucaaugacugaagcauauguauguccuucugaaguggcacuuaaaguuaucacucuuaguguucuuccacuggggucaggcagaucucuaacacuuugaaucccagcuguuaaacaaacaaacaaaaaagugacauaaauguuauuuaucaaugaauaugcaauguguaaugucuuugaaacaguggcuugugaguauuugaauagagccuacaaaauuuuauauugcauuugucauaaaauuuguuucugugugaaaaaugccuuuauuucccaguuuuaccugccuuuguuuggcaauucaaagccauccugccccuaugucaaucccucagacacaugaucuuucacucaccacagcacauacggcuguguuucaacaaugagucuguuucugaugggaaaacuguccccucucuccagaaaauagcucuguggacaugggcuuguuggugugcuuuggaacuucuggcauacacauuucucucucucucgccauguauguauguauguauguauguauguauguauguauguauauauguguacacacacacacacauauauguauacauauauauauacacacacacacacacacacuguuuagcuccuauauaacuaaauuuuguuaccauuaugaguugcaguguaaaucuguguguuugauggacuuacgugugucugucugucucuggggggguggcaucucauggcaagaguugaauguuuucacacuggcacugccauugguuuuccuuguguguucucugaguuugggaaauggacagcaagaccacucacugcgucuuaucugaaauaagugagcagagguuagcauuaacguguuuuauaucucugaguuaccagauauuagacuauagugaaagcuguuucauuaaagaugacauaaucugccauccauuaaacuggaagcaguuacugguaugucugugggaacccagcaugugaguucagauagcaagcucucggucagggaacugacuugggauggaaugauggcgagcauucguuacauugugaaaacaguucucagcagaacagacaggagagcuugugccucaaggacaggugagcac

SEQ ID NO: 3280 - RNA, 2139 nt, Mus musculus
cacugcggagggcgcucuccuagcgagcggaugcucgguuguucuacuuccucugcccucagugucgagcacuggggugagacugggacuugauuccagucuuaaagccagagaaaccgaggcuaaagagauucuucucccccauucccgucuugcacaacacucuuuacuuggaauuucuuuuugagauuggagucucacuauguagcccugacuggccugcucguuuugucgaucguucuguccuggaaaucacagauauccgcugucucugccuccgggaugcuaggacuacaggugugcgccaccauacccggcuuggauucugcagggaccggcaagcugugcuguaacuagaguauagccccuagccuagccugcgguuuucagaucauguuucucuauauaugccaaagguuacauuuccuauauuuuaguuacauguauuuccuguguguguggagggagcuugugugccacaccugaggucagaggacaacuuggcagaaguugcuucucuuccaccacguggguuccagugauccagcucagcuaaucaggauggguagcaagagccuuuacccucuaagacgucucaccagccccaaauguaacauuuuaaaagaggaaacuuagaacucaacagaaagagacagccggauuuuggggggggggggggagcgaugguggagagauggcucagugauuaaggcuugcuuuuccagagaauucaaauuugguacccagcacccacccaccucuggccgcucucaauaccuguaacuucaggggcucugacagccaagucuggcuccaagggcauuaugacacugcauugcaaucucucucucugccucuccccucauccucaccaauaaauaaauaaauaaauaauaaaaauuguuuaaaguuucagugguggcagcagcagcugaggcauggagccacacuguccuugucagcacggacaaugagaaagguaaaaaccggauccuugccuuggaugcaucaaagaguuuaggagcagccaguaucguagaaagcggcguuguaguuuaguaaaaaauaaaaaaggggucugacaaacggcccagcauguaaaaggugucugccaucaagccuggccaucugcauucuauccccaggacccacacuguggaaggagagaacaaacuccauggguugcccccugacuuccacaaguguaccgugagauccucaccuccauaaauaaauguuugggagguggggcagaugguggggcuuaccaucuuuaauccccgcacuugggaggcaagggcaguugagucucugaguuugaggccagccuggucuacagaaugaguuccaggacagccaaggcugucuuaaacaaaaaacaaaaaaacaaaacaaaaaaagcaccugaaaguguagcccucucaaaacagcaaacuuuauuaaagacaguguuagcauagauuuuaagccuagaaauucagaauaacaacucuuaguggcucugaaauuacaucucaaauggaaaagaaagcuuuauuccuucuuuauuuuucauaaaugagauuauaggauguuucagaaguaccuuggaugggauuacacucuaauaaaaccggaagccacuaggguuguacaaagggguuaggacaugcccuuuacuaaauggaguuucugaugagaguucuagaaaauuauagguucugagaugagaaaggagaaaggccucaagcaguugcuaaguguuuuggaaucugugauucucagcuguugagagagcggcuccuuuugcuucucagguccuuguaauuucuccuuucuauccugcuuuacaaaggacuugcaucagagcuuuuggaaaagguacaugaaagaccaauauaaguacaugaaguacauggucacuaucaccaaucauuagggaaauguacacuaacacuaacuuuaugauaacuauucaaauggcaaguuugaaaagcaaaaaucaucucuuauaggaaggauguggagcaaugaaaucuugcugcugucgaugcaaaaugugacagccacguuagaauucaguuuagcuuuucugaaagaggcguaacauagauccaccauauuaccuauucuaccagcaagcauauuauacucagaaga

SEQ ID NO: 3281 - RNA, 9908 nt, Mus musculus
aggggcacgcgggacacgcccccucccgccgcgccauuggccucuccgcccaccgccccacacuuauuggccggugcgccgccaaucagcggaggcugccggggccgccuaaagaagaggcugugcuuuggggcuccggcuccucagagagccucggcuagguaggggaucgggacucuggcgggagggcggcuuggugcguuugcggggaugggcggccgcggcaggcccuccgagcgugguggagccguucugugagacagccggguacgagucgugacgcuggaaggggcaagcggguggugggcaggaaugcgguccgcccugcagcaaccggagggggagggagaagggagcggaaaagucuccaccggacgcggccauggcucgggggggggggggcagcggaggagcgcuuccggccgacgucucgucgcugauuggcuucuuuuccucccgccgugugugaaaacacaaauggcguguuuugguuggcguaaggcgccugucaguuaacggcagccggagugcgcagccgccggcagccucgcucugcccacuggguggggcgggagguagguggggugaggcgagcuggacgugcgggcgcggucggccucuggcggggcgggggaggggagggagggucagcgaaaguagcucgcgcgcgagcggccgcccacccuccccuuccucugggggagucguuuuacccgccgccggccgggccucgucgucugauuggcucucggggcccagaaaacuggcccuugccauuggcucguguucgugcaaguugaguccauccgccggccagcgggggcggcgaggaggcgcucccagguuccggcccuccccucggccccgcgccgcagagucuggccgcgcgccccugcgcaacguggcaggaagcgcgcgcugggggcggggacgggcaguagggcugagcggcugcggggcgggugcaagcacguuuccgacuugaguugccucaagaggggcgugcugagccagaccuccaucgcgcacuccggggaguggagggaaggagcgagggcucaguugggcuguuuuggaggcaggaagcacuugcucucccaaagucgcucugaguuguuaucaguaagggagcugcaguggaguaggcggggagaaggccgcacccuucuccggaggggggaggggaguguugcaauaccuuucugggaguucucugcugccuccuggcuucugaggaccgcccugggccugggagaaucccuucccccucuucccucgugaucugcaacuccagucuuucuagaagaugggcgggagucuucugggcaggcuuaaaggcuaaccuggugugugggcguuguccugcaggggaauugaacagguguaaaauuggagggacaagacuucccacagauuuucgguuuugucgggaaguuuuuuaauaggggcaaauaaggaaaaugggaggauagguagucaucugggguuuuaugcagcaaaacuacagguuauuauugcuugugauccgccucggaguauuuuccaucgagguagauuaaagacaugcucacccgaguuuuauacucuccugcuugagauccuuacuacaguaugaaauuacagugucgcgaguuagacuauguaagcagaauuuuaaucauuuuuaaagagcccaguacuucauauccauuucucccgcuccuucugcagccuuaucaaaagguauuuuagaacacucauuuuagccccauuuucauuuauuauacuggcuuauccaaccccuagacagagcauuggcauuuucccuuuccugaucuuagaagucugaugacucaugaaaccagacagauuaguuacauacaccacaaaucgaggcuguagcuggggccucaacacugcaguucuuuuauaacuccuuaguacacuuuuuguugauccuuugccuugauccuuaauuuucagugucuaucaccucucccgucaggugguguuccacauuugggccuauucucaguccagggaguuuuacaacaauagauguauugagaauccaaccuaaagcuuaacuuuccacucccaugaaugccucucuccuuuuucuccauuuauaaacugagcuauuaaccauuaaugguuuccagguggaugucuccucccccaauauuaccugauguaucuuacauauugccaggcugauauuuuaagacauuaaaagguauauuucauuauugagccacaugguauugauuacugcuuacuaaaauuuugucauuguacacaucuguaaaaggugguuccuuuuggaaugcaaaguucagguguuuguugucuuuccugaccuaaggucuugugagcuuguauuuuuucuauuuaagcagugcuuucucuuggacuggcuugacucauggcauucuacacguuauugcuggucuaaaugugauuuugccaagcuucuucaggaccuauaauuuugcuugacuuguagccaaacacaaguaaaaugauuaagcaacaaauguauuugugaagcuugguuuuuagguuguuguguugugugugcuugugcucuauaauaauacuauccaggggcuggagagguggcucggaguucaagagcacagacugcucuuccagaaguccugaguucaauucccagcaaccacaugguggcucacaaccaucuguaaugggaucugaugcccucuucuggugugucugaagaccacaaguguauucacauuaaauaaauaaauccuccuucuucuucuuuuuuuuuuuuuuaaagagaauacugucuccaguagaauuuacugaaguaaugaaauacuuuguguuuguuccaauaugguagccaauaaucaaauuacucuuuaagcacuggaaauguuaccaaggaacuaauuuuuauuugaaguguaacuguggacagaggagccauaacugcagacuugugggauacagaagaccaaugcagacuuuaaugucuuuucucuuacacuaagcaauaaagaaauaaaaauugaacuucuaguauccuauuuguuuaaacugcuagcuuuacuuaacuuuugugcuucaucuauacaaagcugaaagcuaagucugcagccauuacuaaacaugaaagcaaguaaugauaauuuuggauuucaaaaauguagggccagaguuuagccagccagugguggugcuugccuuuaugccuuuaaucccagcacucuggaggcagagacaggcagaucucugaguuugagcccagccuggucuacacaucaaguucuaucuaggauagccaggaauacacacagaaacccuguuggggaggggggcucugagauuucauaaaauuauaauugaagcauucccuaaugagccacuauggauguggcuaaauccgucuaccuuucugaugagauuuggguauuauuuuuucugucucugcuguugguugggucuuuugacacugugggcuuucuuuaaagccuccuuccugccauguggucucuuguuugcuacuaacuucccauggcuuaaauggcauggcuuuuugccuucuaagggcagcugcugagauuugcagccugauuuccagggugggguugggaaaucuuucaaacacuaaaauuguccuuuaauuuuuuuuuuaaaaaauggguuauauaauaaaccucauaaaauaguuaugaggagugagguggacuaauauuaaaugagucccuccccuauaaaagagcuauuaaggcuuuuugucuuauacuuaacuuuuuuuuuaaaugugguaucuuuagaaccaagggucuuagaguuuuaguauacagaaacuguugcaucgcuuaaucagauuuucuaguuucaaauccagagaauccaaauucuucacagccaaagucaaauuaagaauuucugacuuuuaauguuaauuugcuuacugugaauauaaaaaugauagcuuuuccugaggcagggucucacuauguaucucugccugaucugcaacaagauauguagacuaaaguucugccugcuuuugucuccugaauacuaagguuaaaauguaguaauacuuuuggaacuugcaggucagauucuuuuauaggggacacacuaagggagcuugggugauaguugguaaaauguguuucaagugaugaaaacuugaauuauuaucaccgcaaccuacuuuuuaaaaaaaaaagccaggccuguuagagcaugcuuaagggaucccuaggacuugcugagcacacaagaguaguuacuuggcaggcuccuggugagagcauauuucaaaaaacaaggcagacaaccaagaaacuacaguuaagguuaccugucuuuaaaccaucugcauauacacagggauauuaaaauauuccaaauaauauuucauucaaguuuucccccaucaaauugggacauggauuucuccggugaauaggcagaguuggaaacuaaacaaauguugguuuugugauuugugaaauuguuuucaagugauaguuaaagcccaugagauacagaacaaagcugcuauuucgaggucucuugguuuauacucagaagcacuucuuuggguuucccugcacuauccugaucaugugcuaggccuaccuuaggcugauuguuguucaaauaaacuuaaguuuccugucaggugaugucauaugauuucauauaucaaggcaaaacauguuauauauguuaaacauuuguacuuaaugugaaaguuaggucuuuguggguuugauuuuuaauuuucaaaaccugagcuaaauaagucauuuuuacaugucuuacauuugguggaauuguauaauugugguuugcaggcaagacucucugaccuaguaacccuaccuauagagcacuuugcugggucacaagucuaggagucaagcauuucaccuugaaguugagacguuuuguuaguguauacuaguuuauauguuggaggacauguuuauccagaagauauucaggacuauuuuugacugggcuaaggaauugauucugauuagcacuguuagugagcauugaguggccuuuaggcuugaauuggagucacuuguauaucucaaauaaugcuggccuuuuuuaaaaagcccuuguucuuuaucacccuguuuucuacauaauuuuuguucaaagaaauacuuguuuggaucuccuuuugacaacaauagcauguuuucaagccauauuuuuuuuccuuuuuuuuuuuuuuuuugguuuuucgagacaggguuucucuguauagcccuggcuguccuggaacucacuuuguagaccaggcuggccucgaacucagaaauccgccugccucugccuccugagugccgggauuaaaggcgugcaccaccacgccuggcuaaguuggauauuuuguuauauaacuauaaccaauacuaacuccacuggguggauuuuuaauucagucaguagucuuaaguggucuuuauuggcccuucauuaaaaucuacuguucacucuaacagaggcuguugguacuaguggcacuuaagcaacuuccuacggauauacuagcagauuaagggucagggauagaaacuagucuagcguuuuguauaccuaccagcuuuauacuaccuuguucugauagaaauauuucaggacaucuagaguguacuauaagguugaugguaagcuuauaaggaacuugaaaguggaguaacuacuccauuucucugaggggagaauuaaaauuuuugaccaaguguuguugagccacugagaauggucucagaacauaacuucuuaaggaaccuucccagauugcccucaacacugcaccacauuugguccugcuugaacauugccauggcucuuaaagucuuaauuaagaauauuaauuguguaauuauuguuuuuccuccuuuagaucauuccuugaggacaggacagugcuuguuuaaggcuauauuucugcugucugagcagcaacaggucuucgagaucaacaugauguucauaaucccaagauguugccauuuauguucucagaagcaagcagaggcaugauggucagugacaguaaugucacuguguuaaauguugcuaugcaguuuggauuuuucuaauguaguguagguagaacauauguguucuguaugaauuaaacucuuaaguuacaccuuguauaauccaugcaauguguuaugcaauuaccauuuuaaguauuguagcuuucuuuguaugugaggauaaagguguuugucauaaaauguuuugaacauuuccccaaaguuccaaauuauaaaaccacaacguuagaacuuauuuaugaacaaugguuguaguuucaugcuuuuaaaaugcuuaauuauucaauuaacaccguuuguguuauaauauauauaaaacugacauguagaaguguuuguccagaacauuucuuaaauguauacugucuuuagagaguuuaauauagcaugucuuuugcaacauacuaacuuuuguguuggugcgagcaauauuguguagucauuuugaaaggagucauuucaaugagugucagauuguuuugaauguuauugaacauuuuaaaugcagacuuguucguguuuuagaaagcaaaacugucagaagcuuugaacuagaaauuaaaaagcugaaguauuucagaagggaaauaagcuacuugcuguauuaguugaaggaaaguguaauagcuuagaaaauuuaaaaccauauaguugucauugcugaauaucuggcagaugaaaagaaauacucagugguucuuuugagcaauauaacagcuuguuauauuaaaaauuuuccccacagauauaaacucuaaucuauaacucauaaauguuacaaauggaugaagcuuacaaauguggcuugacuugucacugugcuuguuuuaguuaugugaaaguuuggcaauaaaccuauguccuaaauagucaaacuguggaaugacuuuuuaaucuauugguuugucuagaacaguuauguugccauuugcccuaauggugaaagaaaaaguggggagugccuuggcacuguucauuuguggugugaaccaaagaggggggcaugcacuuacacuucaaacauccuuuugaaagacugacaaguuugggucuucacaguuggaauugggcaucccuuuugucagggagggagggagggagggaggcuggcuuguuaugcugacaagugugauuaaauucaaacuuugagguaaguuggaggaacuuguacauuguuaggagugugacaauuuggacucuuaaugauuuggucauacaaaaugaaccuagaccaacuucuggaagauguauauaauaacuccauguuacauugauuucaccugacuaauacuuaucccuuaucaauuaaauacagaagaugccagccaucugggccuuuuaacccagaaauuuaguuucaaacuccuagguuaguguucucacugagcuacauccugaucuaguccugaaaauaggaccaccaucacccccaaaaaaaucucaaauaagauuuaugcuaguguuucaaaauuuuaggaauagguaagauuagaaaguuuuaaauuuugagaaauggcuucucuagaaagauguacauagugaacacugaauggcuccuaaagagccuagaaaacugguacugagcacacaggacugagaggucuuucuugaaaagcauguauugcuuuacgugggucacagaaggcaggcaggaagaacuugggcugaaacuggugucuuaaguggcuaacaucuucacaacugaugagcaagaacuuuauccugaugcaaaaaccauccaaacaaacuaagugaaagguggcaauggaucccaggcugcucuagaggaggacuugacuucucaucccaucacccacaccagauagcucauagacugccaauuaacaccagcuucuagccuccacaggcaccugcacugguacacauaauuucacacaaacacaguaagaagccuuccaccuggcaugguauugcuuaucuuuaguucccaacacuugggaggcagaggccagccagggcuaugugacaaaaaccuugucuagaggagaaacuucauagcuuauuuccuauucacguaaccagguuagcaaaauuuaccagccagagaugaagcuaacaguguccacuauauuuguaguguuuuaagucaauuuuuuaaauauacuuaauagaauuaaagcuauggugaaccaaguacaaaccugguguauuaacuugagaacuuagcauaaaaaguaguucauuuguucaguaaauauuaaaugcuuacuggcaaagauuaugucaggaacuugguaaauggugaugaaacaaucauaguuguacaucuugguucugugaucaccuugguuugagguaaaagugguuccuuugaucaaggauggaauuuuaaguuuauauucaaucaauaauguauuauuuugugauugcaaaauugccuaucuaggguauaaaaccuuuaaaaauuucauaauaccaguucauucuccaguuacuaauuccaaaaagccacugacuauggugccaauguggauucuguucucaaaggaaggauugucugugcccuuuauucuaauagaaacaucacacugaaaaucuaagcugaaagaagccagacuuuccuaaauaaauaacuuuccauaaagcucaaacaaggauuacuuuuaggaggcacuguuaaggaacugauaaguaaugagguuacuuauauaaugauagucccacaagacuaucugaggaaaaaucaguacaacucgaaaacagaacaaccagcuaggcaggaauaacagggcucccaagucaggaggucuauccaacacccuuuucuguugagggccccagaccuacauauuguauacaaacagggaggugggugauuuuaacucuccugagguaccuugguaaaucuuuguccugaguaagcaguacaguguacaguuuacauuuucauuuaaagauacauuagcucccucuacccccuaagacugacaggcacuuuggggguggggagggcuuuggaaaauaacgcuuccauacacuaaaagagaaauuucuuuaauuaggcuuguugguuccauacaucuacugguguuucuacuacuuaguaauauuauaauagucacacaagcaucuuugcucuguuuagguuguauauuuauuuuaaggcagaugauaaaacuguagaucuuaagggaugcuucugcuucugagaugauacaaagaauuuagaccauaaaacaguagguugcacaagcaauagaauauggccuaaaguguucugacacuuagaagccaagcaguguaggcuucuuaagaaauaccauuacaaucaccuugcuagaaaucaagcauucuggaguggucaagcaguguaaccuguacuguaaguuacuuuucugcuauuuuucucccaaagcaaguucuuuaugcugauauuuccaguguuaggaacuacaaauauuaauaaguugucuucacucuuuucuuuaccaaggagggucucuuccuucaucuugaucugaaggaugaacaaaggcuugagcagugcgcuuuagaagauaaacugcagcaugaaggcccccgauguucacccagacuacauggaccuuucgccacacaugucccauuccagauaaggccuggcacacacaaaaaacauaagucauuaggcuaccagucugauucuaaaacaaccuaaaaucuucccacuuaaaugcuaugggugguggguuggaaaguugacucagaaaaucacuugcuguuuuuagagaggaucuggguucaguuucugauacauuguggcuuacaacuauaacuccaguucuaggggguccauccaacauccucuucuguugagggcaccaaauaaauguauuguguacaaac

SEQ ID NO: 3282 - RNA, 84459 nt, Mus musculus
gauguacaacuaugauuguuucaucaccauuuaccaaguuccugacauaaucuuugccaguaagcauuuaauauuuacugaacaaaugaacuacuuuuuaugcuaaguucucaaguuaauacaccagguuuguacuugguucaccauagcuuuaauucuauuaaguauauuuaaaaaauugacuuaaaacacuacaaauauaguggacacuguuagcuucaucucuggcugguaaauuuugcuaaccugguuacgugaauaggaaauaagcuaugaaguuucuccucuagacaagguuuuugucacauagcccuggcuggccucugccucccaaguguugggaacuaaagauaagcaauaccaugccagguggaaggcuucuuacuguguuugugugaaauuauguguaccagugcaggugccuguggaggcuagaagcugguguuaauuggcagucuaugagcuaucuggugugggugaugggaugagaagucaaguccuccucuagagcagccugggauccauugccaccuuucacuuaguuuguuuggaugguuuuugcaucaggauaaaguucuugcucaucaguugugaagauguuagccacuuaagacaccaguuucagcccaaguucuuccugccugccuucugugacccacguaaagcaauacaugcuuuucaagaaagaccucucaguccugugugcucaguaccaguuuucuaggcucuuuaggagccauucaguguucacuauguacaucuuucuagagaagccauuucucaaaauuuaaaacuuucuaaucuuaccuauuccuaaaauuuugaaacacuagcauaaaucuuauuugagauuuuuuugggggugauggugguccuauuuucaggacuagaucaggauguagcucagugagaacacuaaccuaggaguuugaaacuaaauuucuggguuaaaaggcccagauggcuggcaucuucuguauuuaauugauaagggauaaguauuagucaggugaaaucaauguaacauggaguuauuauauacaucuuccagaaguuggucuagguucauuuuguaugaccaaaucauuaagaguccaaauugucacacuccuaacaauguacaaguuccuccaacuuaccucaaaguuugaauuuaaucacacuugucagcauaacaagccagccucccucccucccucccucccugacaaaagggaugcccaauuccaacugugaagacccaaacuugucagucuuucaaaaggauguuugaaguguaagugcaugccccccucuuugguucacaccacaaaugaacagugccaaggcacuccccacuuuuucuuucaccauuagggcaaauggcaacauaacuguucuagacaaaccaauagauuaaaaagucauuccacaguuugacuauuuaggacauagguuuauugccaaacuuucacauaacuaaaacaagcacagugacaagucaagccacauuuguaagcuucauccauuuguaacauuuaugaguuauagauuagaguuuauaucuguggggaaaauuuuuaauauaacaagcuguuauauugcucaaaagaaccacugaguauuucuuuucaucugccagauauucagcaaugacaacuauaugguuuuaaauuuucuaagcuauuacacuuuccuucaacuaauacagcaaguagcuuauuucccuucugaaauacuucagcuuuuuaauuucuaguucaaagcuucugacaguuuugcuuucuaaaacacgaacaagucugcauuuaaaauguucaauaacauucaaaacaaucugacacucauugaaaugacuccuuucaaaaugacuacacaauauugcucgcaccaacacaaaaguuaguauguugcaaaagacaugcuauauuaaacucucuaaagacaguauacauuuaagaaauguucuggacaaacacuucuacaugucaguuuuauauauauuauaacacaaacgguguuaauugaauaauuaagcauuuuaaaagcaugaaacuacaaccauuguucauaaauaaguucuaacguugugguuuuauaauuuggaacuuuggggaaauguucaaaacauuuuaugacaaacaccuuuauccucacauacaaagaaagcuacaauacuuaaaaugguaauugcauaacacauugcauggauuauacaagguguaacuuaagaguuuaauucauacagaacacauauguucuaccuacacuacauuagaaaaauccaaacugcauagcaacauuuaacacagugacauuacugucacugaccaucaugccucugcuugcuucugagaacauaaauggcaacaucuugggauuaugaacaucauguugaucucgaagaccuguugcugcucagacagcagaaauauagccuuaaacaagcacuguccuguccucaaggaaugaucuaaaggaggaaaaacaauaauuacacaauuaauauucuuaauuaagacuuuaagagccauggcaauguucaagcaggaccaaauguggugcaguguugagggcaaucugggaagguuccuuaagaaguuauguucugagaccauucucaguggcucaacaacacuuggucaaaaauuuuaauucuccccucagagaaauggaguaguuacuccacuuucaaguuccuuauaagcuuaccaucaaccuuauaguacacucuagauguccugaaauauuucuaucagaacaagguaguauaaagcugguagguauacaaaacgcuagacuaguuucuaucccugacccuuaaucugcuaguauauccguaggaaguugcuuaagugccacuaguaccaacagccucuguuagagugaacaguagauuuuaaugaagggccaauaaagaccacuuaagacuacugacugaauuaaaaauccacccaguggaguuaguauugguuauaguuauauaacaaaauauccaacuuagccaggcgugguggugcacgccuuuaaucccggcacucaggaggcagaggcaggcggauuucugaguucgaggccagccuggucuacaaagugaguuccaggacagccagggcuauacagagaaacccugucucgaaaaaccaaaaaaaaaaaaaaaaaggaaaaaaaauauggcuugaaaacaugcuauuguugucaaaaggagauccaaacaaguauuucuuugaacaaaaauuauguagaaaacagggugauaaagaacaagggcuuuuuaaaaaaggccagcauuauuugagauauacaagugacuccaauucaagccuaaaggccacucaaugcucacuaacagugcuaaucagaaucaauuccuuagcccagucaaaaauaguccugaauaucuucuggauaaacauguccuccaacauauaaacuaguauacacuaacaaaacgucucaacuucaaggugaaaugcuugacuccuagacuugugacccagcaaagugcucuauagguaggguuacuaggucagagagucuugccugcaaaccacaauuauacaauuccaccaaauguaagacauguaaaaaugacuuauuuagcucagguuuugaaaauuaaaaaucaaacccacaaagaccuaacuuucacauuaaguacaaauguuuaacauauauaacauguuuugccuugauauaugaaaucauaugacaucaccugacaggaaacuuaaguuuauuugaacaacaaucagccuaagguaggccuagcacaugaucaggauagugcagggaaacccaaagaagugcuucugaguauaaaccaagagaccucgaaauagcagcuuuguucuguaucucaugggcuuuaacuaucacuugaaaacaauuucacaaaucacaaaaccaacauuuguuuaguuuccaacucugccuauucaccggagaaauccaugucccaauuugaugggggaaaacuugaaugaaauauuauuuggaauauuuuaauaucccuguguauaugcagaugguuuaaagacagguaaccuuaacuguaguuucuugguugucugccuuguuuuuugaaauaugcucucaccaggagccugccaaguaacuacucuugugugcucagcaaguccuagggaucccuuaagcaugcucuaacaggccuggcuuuuuuuuuuaaaaaguagguugcggugauaauaauucaaguuuucaucacuugaaacacauuuuaccaacuaucacccaagcucccuuaguguguccccuauaaaagaaucugaccugcaaguuccaaaaguauuacuacauuuuaaccuuaguauucaggagacaaaagcaggcagaacuuuagucuacauaucuuguugcagaucaggcagagauacauagugagacccugccucaggaaaagcuaucauuuuuauauucacaguaagcaaauuaacauuaaaagucagaaauucuuaauuugacuuuggcugugaagaauuuggauucucuggauuugaaacuagaaaaucugauuaagcgaugcaacaguuucuguauacuaaaacucuaagacccuugguucuaaagauaccacauuuaaaaaaaaaguuaaguauaagacaaaaagccuuaauagcucuuuuauaggggagggacucauuuaauauuaguccaccucacuccucauaacuauuuuaugagguuuauuauauaacccauuuuuuaaaaaaaaaauuaaaggacaauuuuaguguuugaaagauuucccaaccccacccuggaaaucaggcugcaaaucucagcagcugcccuuagaaggcaaaaagccaugccauuuaagccaugggaaguuaguagcaaacaagagaccacauggcaggaaggaggcuuuaaagaaagcccacagugucaaaagacccaaccaacagcagagacagaaaaaauaauacccaaaucucaucagaaagguagacggauuuagccacauccauaguggcucauuagggaaugcuucaauuauaauuuuaugaaaucucagagccccccuccccaacaggguuucuguguguauuccuggcuauccuagauagaacuugauguguagaccaggcugggcucaaacucagagaucugccugucucugccuccagagugcugggauuaaaggcauaaaggcaagcaccaccacuggcuggcuaaacucuggcccuacauuuuugaaauccaaaauuaucauuacuugcuuucauguuuaguaauggcugcagacuuagcuuucagcuuuguauagaugaagcacaaaaguuaaguaaagcuagcaguuuaaacaaauaggauacuagaaguucaauuuuuauuucuuuauugcuuaguguaagagaaaagacauuaaagucugcauuggucuucuguaucccacaagucugcaguuauggcuccucuguccacaguuacacuucaaauaaaaauuaguuccuugguaacauuuccagugcuuaaagaguaauuugauuauuggcuaccauauuggaacaaacacaaaguauuucauuacuucaguaaauucuacuggagacaguauucucuuuaaaaaaaaaaaaaagaagaagaaggaggauuuauuuauuuaaugugaauacacuuguggucuucagacacaccagaagagggcaucagaucccauuacagaugguugugagccaccaugugguugcugggaauugaacucaggacuucuggaagagcagucugugcucuugaacuccgagccaccucuccagccccuggauaguauuauuauagagcacaagcacacacaacacaacaaccuaaaaaccaagcuucacaaauacauuuguugcuuaaucauuuuacuuguguuuggcuacaagucaagcaaaauuauagguccugaagaagcuuggcaaaaucacauuuagaccagcaauaacguguagaaugccaugagucaagccaguccaagagaaagcacugcuuaaauagaaaaaauacaagcucacaagaccuuaggucaggaaagacaacaaacaccugaacuuugcauuccaaaaggaaccaccuuuuacagauguguacaaugacaaaauuuuaguaagcaguaaucaauaccauguggcucaauaaugaaauauaccuuuuaaugucuuaaaauaucagccuggcaauauguaagauacaucagguaauauugggggaggagacauccaccuggaaaccauuaaugguuaauagcucaguuuauaaauggagaaaaaggagagaggcauucaugggaguggaaaguuaagcuuuagguuggauucucaauacaucuauuguuguaaaacucccuggacugagaauaggcccaaauguggaacaccaccugacgggagaggugauagacacugaaaauuaaggaucaaggcaaaggaucaacaaaaaguguacuaaggaguuauaaaagaacugcaguguugaggccccagcuacagccucgauuugugguguauguaacuaaucugucugguuucaugagucaucagacuucuaagaucaggaaagggaaaaugccaaugcucugucuagggguuggauaagccaguauaauaaaugaaaauggggcuaaaaugaguguucuaaaauaccuuuugauaaggcugcagaaggagcgggagaaauggauaugaaguacugggcucuuuaaaaaugauuaaaauucugcuuacauagucuaacucgcgacacuguaauuucauacuguaguaaggaucucaagcaggagaguauaaaacucgggugagcaugucuuuaaucuaccucgauggaaaauacuccgaggcggaucacaagcaauaauaaccuguaguuuugcugcauaaaaccccagaugacuaccuauccucccauuuuccuuauuugccccuauuaaaaaacuucccgacaaaaccgaaaaucugugggaagucuugucccuccaauuuuacaccuguucaauuccccugcaggacaacgcccacacaccagguuagccuuuaagccugcccagaagacucccgcccaucuucuagaaagacuggaguugcagaucacgagggaagagggggaagggauucucccaggcccagggcgguccucagaagccaggaggcagcagagaacucccagaaagguauugcaacacuccccuccccccuccggagaagggugcggccuucuccccgccuacuccacugcagcucccuuacugauaacaacucagagcgacuuugggagagcaagugcuuccugccuccaaaacagcccaacugagcccucgcuccuucccuccacuccccggagugcgcgauggaggucuggcucagcacgccccucuugaggcaacucaagucggaaacgugcuugcacccgccccgcagccgcucagcccuacugcccguccccgcccccagcgcgcgcuuccugccacguugcgcaggggcgcgcggccagacucugcggcgcggggccgaggggagggccggaaccugggagcgccuccucgccgcccccgcuggccggcggauggacucaacuugcacgaacacgagccaauggcaagggccaguuuucugggccccgagagccaaucagacgacgaggcccggccggcggcggguaaaacgacucccccagaggaaggggagggugggcggccgcucgcgcgcgagcuacuuucgcugacccucccuccccucccccgccccgccagaggccgaccgcgcccgcacguccagcucgccucaccccaccuaccucccgccccacccagugggcagagcgaggcugccggcggcugcgcacuccggcugccguuaacugacaggcgccuuacgccaaccaaaacacgccauuuguguuuucacacacggcgggaggaaaagaagccaaucagcgacgagacgucggccggaagcgcuccuccgcugcccccccccccccgagccauggccgcguccgguggagacuuuuccgcucccuucucccucccccuccgguugcugcagggcggaccgcauuccugcccaccacccgcuugccccuuccagcgucacgacucguacccggcugucucacagaacggcuccaccacgcucggagggccugccgcggccgcccauccccgcaaacgcaccaagccgcccucccgccagagucccgauccccuaccuagccgaggcucucugaggagccggagccccaaagcacagccucuucuuuaggcggccccggcagccuccgcugauuggcggcgcaccggccaauaaguguggggcggugggcggagaggccaauggcgcggcgggagggggcgugucccgcgugccccuggcgccggcacugggaauccccgugcggucaguggcguuuccgcucgggcagcgggcugagugagcugccgccgcugccgccgcugccgccgccgggggaggggcggccgccgcccgccugcgcucagagacucacgcagcccuagucccgccaguccgccaacacaguagugccggcccccuccgccccuggcccucccccuccccgccucgggcucgcuccgccuuuucugccccccacccccaccucacggguacgggccauucccggccaggaaacgccguggcgccgcguugggccuaacucgagucucgcugccucccgggagugccgugcgccgcagcccgggcccaggccccggcagcgccugggucaagguaaggguccaacagaaaagagacaccgaaccacacgaccgggccccgggggaaagaagggucaccucagucucccugcguucccucuccucggggucgugggccugggccuccccagccugguagcaggaagaugcuugcccuuuucgucuucucagcuaccuuuacacaccauugcaccgcucuugcccagagagaaaggcucuccuucaucuagucgaccccacuaccuuuuuaaugucuucccugggucaggacucuuccccucccccuacucuggucuccccuuuuugccuggguauugccuacuccacguuuauacccuuuucaggagaggccucccaacccugcucucaaaauacacauacuuuuuuuucugucccugagccccccaccuccccuguucuugcggccuugugacaacucuggucgcucgugggggcccaguccuccccuccauaaucuuccugaacgccucuccucugguuuuccaguuccuaucucagauggcugcugcuuuucccacaccaaagacauuaccuucgccacccccaccucacauucuuggacucccuguggcguaugccccaguauccuugcgauaucccuguugaauuuguaggguucuagccuggaauugagccagauuuugucguuuucccugccuagggcguggagagcgaucuuuuaagaacgacucuaaagaagagggggagggauaugccccuaugaauccgugcaagccaagauccuagguaaaugguagugggcaaaagcccugguuuuaguagguaaucgcucagaaggaaaguuuuaacuccugggaaagccccuucuaugcuaauuuauucuaucgggcgccuuugccuuucucauucuuaggaauaaggaucuuucuccuguguacugaugcugcagcccgcccugcuggccugggucaggggugcguggaugaccugcauuuucugcuuucucauguuacuuguguaacgucuucaccagcaacucauuuuucgcccagagcucugggcucuggguuuugucuauaccuggauuccuuuugccaauuguuccugugcucaaaauacuuaaaaagauucagguucucgaauuuccuccauaccuugacuaaauuguuuuuagaugacauauuugugaccaaggucauguuuacauuacuuccuugcuuauauguuaaauaccuauacuuuugauuggggaggauccagauggaggagguuccaggaggagguuugugugcagcauauugagaggaaaguguuuugaugguuaauuugauauuaauaaugguuuaggucgcuaggaggaaaacuuuaagagguuauuuuagaugugugcaaucugaccuaggacuaaagcagagaauacugacauaauuagagauuucugaguuuggaggacacaggaauuucuuuucccuggauuucuuccaguuuucucaggaggaucauuaguucucuguccaaaauuuguggccuguuaugggauuagaggcuuuaagguuauucagauugucauguguagaauauugaguuauguucuuugguaggacaugacccaaggcucuuguuccuagcuguaaauuuaaauaugauugcugaauguuuggaaaauugaccuuuuuaaaacuaaaacuuaaugcuuauauccacauugcugguuuaauuaaaacgaauauuuggaauuugguauuuguugauuuucaaaucaaagaccucaauuuaaaagugaccuuaggauuguuccuuucuaaaagcauaguuccaauccuuccagcauggagcacuuguucccccccccccccaaaaaaaaguguguuaagaagugggggugggguaaagaaaagguugcuccuguguuggaucacaggagugaguauacaaggcggcagcagcugcuggcucuggagcucugguugcuacgugagaagcuugaguagugcuggcugcugucuccagggaaggacagcagugcagcguccauuaaugcuguuggcugcagggaacugcacuuagugauggcugcucaggcuggaaagaaaccuugcuugcuuuccugggaaauuguacugcugagcugcuuugcuuuuugcuagugaagagaccagaauuagcaauucauaacuguauccauuuauggauaucagcaucugaaaacuggaucaaaguuaaagacuugggguuuuuuguuugaggagggguuggaagcuuuuuguuacuaucugagguuuuacccuucacaggacuuaaaguucauuaguguuuugaucuuuuuuaaccccuaaaaaaccuaaaaauaguaauguggguaauagggugaggaggaucuuuguuuuguuuucccagugcaagugacaugaauuccuccaucuuuuaauugcuugagucauuucagauuuguauuugucucuccguauuaggccguauuuaccuuugugaauagauugauguucuuugaaacaucuuacuauauauuuggaugccuaaacuaaaaagagcugcuuuuggauuaaugcuugguuuguuguuaauucuaaauuaaucuguagaccucuccagauuagauauacuuacugauaucugaccuauaaauuggauuaaucguguauguguuggauuauagacuuuccaccgaacaaagauguguuuuggcaguaauccaucagagacacagaaggaauauucagaaauugaguaaguuuaguucaagauacuaagaaggcagcaagaguccauucuaagcccacccuaccccuaaccaaauagaaccagggugaucuuugauuaagccuuuuuaaguaguuugucuggcaaggaauauuugaaacugaaccaucacccaggcaugugcagcacauaaaaucguaggguuuuuccucccuaggauuauuacugcaaccaaugccuuuuccuucgggagucuguuuaauuuuguacaaauuuauuuagaucccauaaauguaaugguucuagaauuuguagcaaaaaaugaagaaacauuguagaguauuuugaauucacaaauguaguucauauuguuuuuccagugcuaaaagcaaguccauaaaacaaaacucuguuaaugauuguuuuagaugguuguaauaauauuuuuguuacguagauuaggugcuguaucccauaaguaugauaucacucauacugauauuacaguucaagguauuuacaguuaaggugcaaguguuuugagcuuaauuauaauauacaaguucccuuagaaaauaaugacuaccacuuuuauuuccuguuuuuuuggaucugauuguggucuuacaguaaucucuggaagaucaagaggcuuuuuucuuagaaggauuacuugaacugacacacuuaaaaaugccuacaucuugauacugcuuaguaucuagaagccuguauacuuuagaaauuauucugacccuuuugaugaagguggaacuuugaaacauaaggcaauaguagucaguaauuauugaguacauaucuacaauaaauuagaucauaaguaaaauaaaauuuuauuacaacuuuuggcuaaacuaguuuuuuuuuuuuuuuuucaguuuaauuugaaauuaggaggccugacuaguggugaacuuagacugaaauaugcguauaauaugcguauaauaguucaacugguagucauuuuuuuuaaacugguagucauuuauaauuugguuuaaaguguccuuucagauagacuuagaaaagaagagcaaugcaccuaugagguagauaagucuuggagcccagauauucuaacacaucuaguaaauggcaugaccuucauuugguauugugauucguuucucuaguggcuggaauucagggaaauugcaaaagguaaaaggaguagccuuucuuucacuuaacgauacguauagugaaauugucuuguuguguauuaaguuauaaacuggguagacaugccaguaacccugagaguugguucuguuagaaagcaucccuuggacgaguucuuacucaguacuugaagaaaggagcugugagguacacaaaaguacagucuauguuuuucuuaugaguaaggguucucaaaccccaaccccuuccuuccauuacuguuuccuuccuuccuuccuuccuuccuuccuuccuuccuuccuuccuuucuuucuuucuuucuuucuuuuuuucagaguaucuagggaaaugccugaauguaaauuuccauaaaguaucuuuggugucaggaaagugauuuuuuuuuuuaaucuuuuaaaaaucauugguauucucaaaacccuaagaguauugcucaguuuuguuugugguguguguguuugccacuuccaugucucuucugucuuguaguaugaggcuucccagaguuuucauggcacauugaagugauaaucauacauguauauaccagagaugaagaaaccuaauuuagggauuacaacacaaaacagcaacaaaucaguggcuauaagaauucuggcuagagaaucaaguuuuugauuuauacuacggaaucgaggggaaaugccaguuccuugcugcucuauuugagaacuagguggaaguaugggaggagccacagaccucugcagcaggauuuugugugaguagaaaaggaagauuuuuguuugaaaucgccagcugcuuaugucagacugacucccuuauuaugccuccaguaggccugucaauauggccaaacagcuagauaagugcggggcaggacaaagggcucuuugcacagcagggaggcaguguuggugggggaggggccggagguagggaaggaaagagauuuuuuuuucccccuaggagaguauucacuuugguuuacaauuaaagaaacuguuuuuaguuuucacuuacgccuuuaauuuaugucaagcacauacuuuuaaaacccaaauuucauacggucuagaaaucagaaagaaccuauccuaucuucugaggaguggggaggccccaaagcuuuguauggauuaaagugaguuccauguucccuguccuuauaaauguaaguugccuccuuaguggaccaggucuagagcaucuagguuuuaguaaugauuggaaugaccuauucuguguaaaguaaauuuguauuucaguauaugcaguauguuuaguuggguuuagauuugacaagguguacuguuuuccuuugugcaauauuuauauguuugaucauuauguaaaaugugaacugaaaaaggauuuuuauaagggccuuuuagcuuacaucuguauguucuguacucaggaaacugacucaagagacugagccaaagacugaugccagccaaacuauaaaauaagacucugccgggugugguggcgcacgccuuuaaucccagcacuugggagguagagacaggugaauuucugaguucgaggccagccuggucuacagagugaguuccaggacagccagggcuacacagagaaacccugucucaaaaaacaaaaaacaaaaacaaaaacaaaaaaaaacaaaaaaaaagaauaagacucuuguaucaacaaacaaacauacaggaacccccuuccuccccacccccaaacacauaaggagagcuuaccuuauuguuucagucuuccuccuacuuccugcagaaucugauaugcucuggagauuacuaccuguccccaucuuuuaguuuaggcuuaauucuauuaguuugugcuugacucucagcaaaaggugauugcaucuagcuuauuacuuaaugaaaauuaugguguuagagguguguaaguuguaucucuuauaggcaaagccaugagagauacugccaaaauuagguuccuguugaagguguuauuaaaauguuaaagacucuauccugaaucauuucagguacuuuaaaggaaaugucaaauguuacauguaugcuaguucauuuuaaaaauuacacucacaaauuagacaguaguuauuuagauuacaaaaguucuuccuuauagaguaguauaugacagcacauuuccacgaacgaauguuuugcuuuaagagaauuaauuuuuagaaauccuugaacuguuuuuccaagagcacaucuguugcuugagugagauagagaaucggaaugaugauuacuuuguguagcaaagaagacauuguuguagacgaacauaaccagaaugcugcauguaauguacauugaucgaguuuuuguuguuuuguuuugcaucauuucucucuuuuguaaaaagaaguacagcauguuacccauguaacauuuuauuuuaaguauggcagucuuggcaguuacaguacacaaaauauuuugaucugaaaaaaaauuaaaagacuggucgaaggcucaguuggucagguauuuguaaaaagaguacuugaguucaguuucucaaacucacguaaaauugugugugcugcuuguaaucccagcccugggcagacagagaugccaggucucuagggcuuacucacuggucagccuggccuacuuguccaguuuaggcuaguaagagacccugucugaguuguggggaaagaauuccugaaaaaugaaaugagguuguccucuggccugaacaugcauacccuuguucacacaugcccaaacaagaaaguacauuuguguuauuaucacugcugggaaacauuucucaucagcaaaauagcaacaauuuuaaugugaacucuagugauaccucauuauacauuacaauagaaauuuagauggucuuuucuucuuuuuauagucuguuaacauggauuauucccauaaauuugugggaacuaaaaggaagcugguuuuucuagcuccagugucucuaucaaauaucuauugcuagcauuaggguucccuugcaaaaaauacuagaaauguagcuuuuauugcuucaaccgaaucaaacuagagaccuaaaacagauucugacaaacgugagaaaguaggagauuacaucuugauuccaguaauauuuauaacuuguagcuucccaaauagcuaauuucauuuuuguaagaucgaggcagcaguaggccagcauggaggugaagcacacacagcaccucaucuuggugugcagcugcuccaccuuacuuccugcuauuauuaucccacuacgccucuucccagcaaaaaaagaaacuaggacaaagggggaaauugaaugggcugcuguaguuuauagcuuauguuagguuguggauuuguuuauauguucuaaagcuaguacuuuaaaggcuagugacaaauaacuuuuauaucuuccacucuugguacacuguuucagauucugagcuuacagaaagauuuuuaaagcauguaauaucauuggcuguuuauaauaauuaccacuaccagaugccauuguauuauaaggugaaauccauucucuauuuguaguuuuuauuuugcagcuugggucuaugacuagaauugagauuuuuaacauuaaaccuaucuaucuaccuauagauaguuagauaaagauauauaccucucuaacaauuaaauagucgauugaauaugaaaauuucaugccugaauuauuuuaaacuuucuuuuccaacauuacucaaacugaaauuuuuauuuuuugccauuuuuguuguauuuuggugcucagauuuucucccucuucacuccugaaauguggagacuuggaccccaccccuacccccaauaauucauaugguacaugugugcuacuauuauaguaagaguggaaacuuuguaauucuuagacauuaugaucugguuagaauuuucuagguuugugcucaaaucaauccacagggauuucauuauuuuauguuuacauuuauuguugauuuguauuaggaaguuauuguuuucucucccaauguauauaacucuuuaaaaaaauuuauucuugucuuguucugauuuuuaucccauacugaaaaauucuauuuccuaucaccaaccauagcauauacuuuugugccuucaugucuucugugaaggagugcaaugcaaucuacagcuaacaaucaacugaacacucuugguauccaagcaagguuuuacuuaggaaaaagaaccuuaaaggauauuuuagcaauuaguuuuccucugcauuuauuuguauuacauuuuucuucauuuauuuuuuuuuuuuucuuuuuccaauggacuguugagaauuggcuuguuuuuaggggguaguuauauuuauucuuaaaauaaaugugguuauugugacauuugagauagacucaaaagagugcuuuuuugucguuuuugagucuugaacccaggaccuugcauguauugguaagugcuauauauaugugagcccagaaggauacuuaaaacaaguauuuaaccaccuaaugcagaacaaagauagguuuuugaggcagugagauugaccacagggugaauguaacauuaaauugcuguacgaacacauaaauuuuauuuuucaauucuguggcacaaacaacuacagccauggaaauagguguguuucugugcccacagccugaaaauguuagcuagauuuuuuuuuaagaacaaaucuagaaaaaauguaggagcaagucuaaaauuguaggcucuuuuaaaauaguuccguucuuucuagacaaauuuacuuuuauuuauaccagauaaaacuuuuaauucaugacccagcaaaaguacaaaaccaggucagguugguuaugucaaagaacaucuuaagaugaagcuaaaaauauaugaaauuguuaggauguuuguguuuaggcuacuuuuauugagagagugucaauguuuaaaaaucuuuaaaacaaaaucuucccagguuaacaaucacuuuauugacugcacaguaaauaagcagaaguaucaaagaaucaaaacaaguaaacauugcuagcaucagguauauugcucagaaguuaguguugcuauauaaguauuagaacaaguaaauaagaaagcuaacuccaagguacuuuuacuuugggaucuugggcuuaauugacuuaaaccaaauguuuuuauuuuacucauacuuggugcuuaggucauuaggcuucacaguauugcuaguccuaauggaucaguucaugauuugaguagaaaucuagucuuuuuuuuuuuuuuuuuuuuugagaaacaugacucuggauugguguaacuuuccuuuguaguuuauuaugaacuguuaguaugaaaaagaauggcuggaaauuugcauaguauacaaagcaacaagaaguaggcauacucuauaaaauagugugggagcuggauagcucaggauuaagagaacuuccugaucugcuguaguggccuucugcaguaggguccuaaugcugcgauucuuuaguacaguucuuuauguggugacccaccagccauaagguuauuuucauugcugcuucauaacuguaauuuugcuacuauuaugaauuguaaguauccguguuuucugauggucuugaaggcuaccugagggagucacaaccaacauguugaaaaccacuguauagaggaucaggauccaaguuuggugccuagcacacucaagcuuaaggggagcugauggucucuucuggccgucaagggaaccacauucauaugcauacaauuuaaaaauaagggaaccacauucauaugcaaacaauuuaaaaauaaaucuuucacaaaaguugcaauguucuaaacaagagaggugaaaaguaauuuuuuguggaaugaguuaguuuugccuaaauguguaauaauaguaauacauuucuauugcagguaauugugcaaaggauucaacuacauuuuuuaaaguucuguuuauuuucuaguuauggguguuuugucugcaucuguguuugugcaucaugauuuugcaugauaaccuguagaggccagacaaaggugccagauccucuaguauugaauuuacagaugguuauaagccaccauuugaguucuaggaauugaacucugguccucuccagcaccucagaugauugucuuuuugagaacaauggggggggggggaagcaaguguucuaucacuacacccuagacccaaaauuauuuuucuuaaucuuuuaugaggagggaccaugaguuucccuagaacagaccaucaacuggaggaaacucuuagucccuaccuagcaaaccaguuuucuuuguagaguucugauucugugcuagaauuugucuguuggucuuuuauucuccccuguaagcaauuuuuagaauguauuuuuuuuuuauuuaauaguauggcaagaaguagcuagagauuagauuaggaaaaauguauuuccuuuggacuuuauaaaauuguuaguuuaaaauaccuuauuuagagcagggaaggugguauaagcccuagauucuccuaccacacccuacucaaauucacuugguuaagggccauaaugggacuggagaaauggcucagcaguuaagagcacuugcugcuuuuauagaggauccagguuggggucucaacauccagaagguagcuuacaacccucuguaacucuaguuccagggaaucugacacccucuucuggcuuccacagucaucaggcacaccugugguucugacacauaaauacaggcagaacaccccauguagagagaaaucacuuuuuuuaauuaauuuauuuuuuuauuagguauuuuccucguuuacauuuucaaugcuaucccaaaauuccccccauacccaccccccccaauccccuacccacccacucccccuuuuuggcccuggcguuccccuguacuggggcauauaaaguuugcaagaccaaugggccucucuuuccacugauggccgacuaggccaucuucugauacauaugcagcuagagacaagagcucccggguacugguuaguucauauuguuguuccaccuauaggguugcaguucccuuuagcuccuuggggaauuuuucuagcuccuccauugggggccgugugacccauccaauagcugacugugagcauccacuucuguguuugcuaggccccgggagaaaucacuuuuuaagguaaggucaauauauugggcuuuauugguuugagucuguagguuuuaccuccuuuucuuuuguguccuguguauauuuuuuuaaaugcuguuuuacaguuucuaauuuuuuggguuuaaaggcuagauugucauuaguacauuuuacugagagauauccuuauaccuauauuucauaugaauuggugaugaguuagauugcagggauacuuuauaaugguaguauguacuuuguugaauuucauaguauuugccuaauuaugauauuaaacaacuguugauauugguggccuagaucaacuacccucacacuuuaaaguauuaaacaugaguucccaugaguucccaaagaauuaguguuugagugguucucuacacuaagauuuaguacuugaaguuaaaaccagaauaauucuggagcaauggcuuagugauccagaacauaugcugcucuuccagagaaagaguucaguuucaggcacucaugcagguagcucacaagugccuucaucuagccuccuuggcaugcacacuuguacacuuaagagauaaauccugggcugucgagauggcucaauggguaagagcacugacugcucuuccgaaggucccgaguucaaaucccagcaaccacaugguggcucacaaccaucuguaaugagaucugaugcucucuucugguguguccgaagacagcuacaguguacuuauuuauuauaauaaauaaauaaaucuuuaaaaaaagagagauaaauccuuaaaguuuuuaauuacuaauaggaauuuuuaaaaaagacuuauuuauuacauauacagcauucugccugcauguaugccugcaggccagaagagggcaucagauuucauuauagaugguugugagccacuaugugguuugugggaauugaacucaggaucucuggaagagcaaccagugcucuuaaccucugagccaucuuuccagcccacuaacaaggcuuuuaaaaacaaggaguauuguugacaugccuguuuguuuguuuguuuguuuguuuguuuugagacaggguuucucuguguagcccuggcuguucuggaacucacucuguagaccagguuggcaccuaguuuacagagaucugccugccucugccuccugaaugcugguauuaaaggcuuucacaaccaccacccagcuugauaugaacaauaacuuucuauuuuuuuaauuacauuauuuuacaauuuugcaaaucucuuuaguaucuuaauagaagacagcuguguuuucaaaacugcuucuuuaauuuucacaaucagcugaaaacaggauauccauauacucauggauauacagucagaaaauaggaaacucagggugccccuugagggagucuagcagugaaauacuacuguuuugugcucaugguuuugaauauguuuaauguguuagcauucugcuguauuuuugacauauucagauuauacugccuuuagcuguuagcuaaauaaauccuuuaaauucaucuuaguagcuuccuugcuuguuucauugcucucuaguucuuguguucuauuauaacccaauguuuuaggaucauuuuuaccauuuuucaccccaaacaguugcuggguugugugguugugcauguguggagugaggguguuucauuuuccuuuugugacagggucuugggcacaggcuugcccuagaaccucaggucuuccuuucuacuuugguugucucacacagucuugguuuguuuuaaugguaaaugauccuuagagacaaggaauguucauuggucuuuaauugaucuguuucuagaucuuuuaaauaagcaaagcuuuaaaaaugauuuuuuuuaaaacacccgacuacuuauauuucaaauucaguaccacauaguuaauguaaacugaucuuuuuuucugugcacaacucccaauuuccagugacaccaacauauuucuucacuuuauuuuugccacaguauacuugaaacaguuucagauuaguagaacaauaugauuacuaaaaguugaaugguuugcuuuauucuguuuacuuuucuuuaaaacauaucccuucgaauauagucaucuaaauuacagcauuuuaaauuuuuuggugugugcucugauuauaccaccagcuagaaacuuagugaaguaauuuuuauuucacuuucagauuuuucagggauuaccuuuugcuuugcaaguaaauaaaauauuuuucuaguuauuauguaaaauauagaaagcuaaguaugauaaaaaaaaauccugcuuuuagcccugaggacuucaucccuguucucuuucugucacacacucagacuucaccuauucuuuauuaaacauacuguuuaauaaagaauauauguuuauaaagaagagguguauuuuuuugcauuuacauuuauuuuuggggaggcaugcacauuuacaugccugaagucagaaguuaacucgugaguuaguuuucuuggcauauguauucuggggaucaaaugugaaccaucuugcuaacucacagugguauuuucucaggauacuucuguuuuaagugucuaaaaaguaaguuaauacaaacuaucucauuuuagauuuucaauaauuuuucaauagauaguuuuauaccauaaaaguaguggcauagaguuucuuagaaaccaggauuucuugacuuaguauaauuuauugggguagaaauacgccuuuuucuucuaaaaauguguguugaaaugcuaggucauguuuguuccugguggacgccacugcugcaguagcuccucagcagacauuccuuuuuuuuuuuuuuuuucuucgagacaggguuucucuguguaucuuaacucagaaauuugccugccuccgccucccaagugcugggauuaaaggccugcaccaccacacccggcuagcagacauuucaugaauguuuauaaaaaguaccauuucagaugaauucagguguuuuaaaaaugaguuaaauguuuuauucuugcuaacugagauauccuaagaguuacaguuucacauuuuaacacuaucaaguuguaauaaguagacuaacauuauuaaacucacaacaggugagucagugaagaaauagugauuacaaggaugugaagguucuaaaagggaaaaauauaugguguguauuuuuguauauaaauuuaaauuaaaaagaaagcaaauagguacacuuugaguuguccccacuucagcccacacaaaacuauaugggagcucugaaauuguauagacuuuaauucauguucuggugcuucuguuaaugugugugcacacguuaauaaaauaaaaaaucagguacuugaaggcaagaagguggugcaggaucuccuagagauggaauuaaguauuugugagcaguccaacauuugugcugggaauugaacuuacuucuuuugcaagagcaguaugcacucuauuaacugcugagccaucucuucagacccagauucuaguuuguuuuuuuccaagacaggauuucucuguguauccuuggcuguccugaaacucagagauccaccugccucugccucccaagagcugagauuaaaggcgugcgccaccacugcccagccugauucaagugucuuggcaaauuuaauuugcccuaauagaaauagugccuuccucauagaguuguuauuauaaauguuacauggaaauggaauauagaaaaacuuucugguacagaauaaucaguaaaagguagcuuuuaauuugaaaguugguauucugcugugcguaucugauuaguuuuuaaacuucaaccuuacuuaggguuauguucauaauuuuguaaauagcaccugauuuuuauuauuccauugauuauaugaaaauaacuaauuguuuuuuuuaaaaaggaguaauugguacuuagcugaaauuugaagcuucugagagcuuugccuguacuuagcaguguuuugccacagagcuauauucccagucccucuuccuuuaagucuuuguagcccagguugacauugaacuugugaaucugacugccuccaacaccuaaguuucacuacauguuuucauuaucauacuaggcaggucucucauuuuauaaauaugccaguguuuacuucagaaauguaaucagguuaaaaauucuugcugugcuguccaacuagagaucagucucuagaucucacuuaaaguuggaaggagagcaccagcucccaaaagauugucccauggggccuagagagauagcucagcaauaaagaacacugucucagucuuccagagguucugaguucaauucccagcaaccacaugguggcacacaaccaucuguaauaggaucugauacccucuucuggucugucugaagacagcuauuauuuguauauacaugcugaaguauugcuuaugauaggcuaucugugauuugcuuuggaaugaaaaucaguuguaggauuuguaaaacuggcuaaugacuauaugaacuagaauuauuucaguuuugugccuauuuaaaaaucuuccuuauaaaacauuuuaaauuuagaguaaaaguugaccauagugggaccuggucaagcagacuacaauagcagaaucagcggguauaccuguaaucugaauacuuguugguguagguaagacagacucguuuagaguuggaagccagccugggcuucagaauaggguccaaucucaaaauaaaaacaaaacuccaaacagaaccagaugguuugguuucucccuguuguuuacuguauguacuaugagccaaguucaucuccugaccaucacauauuuccagucaacaacgaaauggaguggcucaauaaaaauauaguggccuauauagaguagggauuuuuuguuuguuuguuuuucugguuuuguuuugagacaggguguagccuugguugcccuggaacuuccuuuauagaccagacugagauauaucacaauuuuuaaaauuuuaaagaagucuacaaaguuuggaaagccuucuugacuggaagauugaggagguaaauuuguuaauuauuaauauguucaguauauaguagaucuuugaguuggcugaauuuuuggugaagcaucucauaaauaccagauuuaugccaaauacugaagcuuuaccaaagaaaucugaccugguauuuaaauaagccuguuuacuacucaggccuuagcaucacuagugacauggaacaaaacuguccauuccucaacuucacuugaaacgguugccuuagaagaaggaguuccuuguuuguuuucaucuuaguuccuauucuauuccuuuuguauuggaaagcuguauaucaaaauuuguaaugugcuaaguucuuagaaccaugcacuuaggugaauuauaacagauuuaauuagaaugaccacacagcuaaauaauaugguauaucaaaucugucgauuucaagaucuuuucauuauaccaugucacucuucugauuucaggaaccuuugacugugcuguuaaaaucuucacuuucuuccauuuguuguuuagauauauuuugaguuuuuuuuccuucaggcugcuuugucagaagaggaaauaaaugggaaguuauugagaguuaucccuuauuauagugauugcaaauucuuauuuccugguaaugggaggcaaagcuuccagauaucuguauaccauaaguugcuuuugagccuccuuuauuccagacuaguugcaguucagaagauauauauauagagcaaaaacuuggguuucuggauacuuuagaucauauuuugauuuuuuuguuuguuuuuguuuuugaggaaaaguuguauggucuuuaucagguuauuauggauaucaaugaccacuccuuaacagcaccuguuuuucauuauuccauugauuauaugaaaaguauaagaacuacagauauccuagaauuuguuuaagaaagcaacauauaccagauucagcuaauuuuuuggucugaaaaggguaacaaacuauuaugaagcccaccuaugaagcaguucuugucugaguaaagacuuguauauauaguguaaacaaaguucucaguacaugaauggauguucagugcaacacugcagaguaccaaaaaugaguaucugccugcugaagaaucauuuaaauuauaaugaaucaauagaacagugcuacaguaucauugaagaaguacauauuuaaauauggucacguuaaauaucaaaaccaguuuacaaaaccagucagacuauuccuuuucucuuuuaagaggauacacgagaauuuuacuucuguuuuuuauguucuucuaaugauagguuuuuuguuuguuuguuuguuugcaauauauaguaucacuguguggcucuagucagccugaaacuugguauguagacuaaccuuaaacuuagaaaaagucuuugucucuucauguuguagaauuccugccauuugcccagcacacccaguuaugauuguauacuuuauaagcaucuuuguaauagagccggaccacugcagugaggaggccucuuguacacaucagaguauuaugcuuaagguuucuuugguguuacuguccuuagcugucauuugagaaaucuucuaucauauuuuccuuuauuacgguaagaaaaaguuuguguuuucuaaacaacaagcuacuuacacaagaaacuccccugguaaacaaugcaguggauuggcuuuuaagcagacaggaggguuacuuucccuucagaauuugacucaguuauaggaagaaacauaguuaagagguauuuuugguuugguaugauuuuuguuuuucuuguaagugguugucaacauguaauucuugucacaugaguaaaccuaaagaguuaaacauauucaaggacagggugaggugaugauuccacauccuaaauccagcauuuggguggaggaggcaggaucuuuuaaguuugaggaguucuaggccagccagaacaauauagugagaccaagugucucaaaaaaaaaaaaaagaagaagaaggcggcuucagggcugauaauguggcuuaguugguaaaagugcuugccuaccaugcaaacagcucuagacuugauuccuaucaccauauaaaacucuagguguuuugguacaucccuauuauuagcaugcaggagguagaggcaggugaauuggaguuugaaaucagccuacagaguaccuaagauggaagacacaccuucagauagcuuuuauguucauaguaauuguuuguugucauugauaaagggagaagugggaaaucugcauauauaaaacucaagguaaagcuacauaauauaaauucccccagagagcuggaagauucuggacuuguuaauaaacacacuuuuaauuuagauauugcuacccaacguaauuaguuuaauaaauaaaagcuacguguuaaaaucuuaauuuucuuuugaaaucugcuguauuugugacuuucuugugaguaaauucccccuuucauuguuacucauacaacccagagcuuauugaaugcuaggcaagcacucuaccacucagcuauaccuucaguucccugaguuaaucuuuuucuaauuauguuuuugucuguaaaauaaucaagguuuggcgaugucucagugauuaaaaguacuugccucacaagcaugagagcuggguuugaguaaacccaugcaaaacuguacaggucuguuauuccagccuguaagagaguccagacaggaaagucaccagaaucgccugauaacuucagguaucagucuuccucugaccugcauacuuguguguucacacagagguuuuuaaaaaccaucuucuaaguccuaaaacuauuuuuaugaaguugaauuuauuuaagccaguacaauuaugagguaugccuccuaguacauguaaauaacuaucuaggaaagguaaauguacgccuugaccucuaucauagccauuauaaguaggacuuucuuuuuaauuggucuuaaaauugcuucauaguaagcgaagcuuuacagacauuuuaccaguuccagaauccccuagagagaauguaaauuuuaagaaaccaaaggauaaacaagaguuagaagaaaaggaaauuuuaucuuggcuugaauuguuaagucacauauuucagauuaugccaaucuguuucucuuucuuucuuuuuucuacaacuccuggaucuauuuccuguauucacuaucuucacaguuaagcccaauuuacuauuguguaaauuaggugagcuucucaccagaucucugaauauuuauaaauacuccuguaguauuuauccuuucucucccuuuuacuguuugguuuguugguuuuuauuuugagacggucucacugugugcccaccuugaccuggaacucacagggauugccuuucuaggacugagacuaaaggcuuuuaccaccacacccagccuauaucuuuuggguuuuuguuuggguuuuauugugggguuuuuuacuucuuugucauauuuuucccauuuccucuuccuauacuuuuuggguguggaaaggcggaagcuauuuuuagccacauucaaguuauuaguguggcacuucuuucuuuguagauucuucuaauucuacaagcuucauaaauauccuacugcagauucuucuccauguguuucuuagagcgggacaguauucuuucuguuguaccuacuugagacauaaauugccaagcaaguugaggauucacagaaaauaugaagcaggaaaaaagaaaauaacuauuuuauauugauacauuuagaagucaucuaaaacaaccaaaaaaaaaaaaagucaucuguguaauacaauguuucuggagucauugagcuaaauugugggcuauaucacaaaauuucuagcuccuuauguaaucauuuuuccuaauauccuuuucucccaaagcaaaaaaaaguaguacugcuaguuuuuuuucccuugggauaguuggguuuuggcuagaaauggauaagcauauaauucagaugguacaugaguucugcagaaagcugauuguaugcauuaaaaacccacauuuugaacugguguguguguguguguguguguguguguguguguguguguguaguaaaaggaggaguaaagccgugguggagcacgccuuuaauuccagcacuugggaggcggagacaggcagauuacucaauucaaggccagccuggccuacaaagugaguuccaggacagccggggcuacacagaaaaaccgucuugaaaaaucaaaagaaaauaaaaaggaguaaagcaggacaagcuggguuugcuaguggauccaguauucuguagaucugguagguuguucauugaugggaaagugaaacuacauauuuuuuucuuuuucguucuuucuuucuuucuuucuuucuuucuuucuuucuuucuuucuuucuuucuuucuuucuuguuuuuguuguuguuuuuucaagacacguuuucccuguguagcccugacuguccuggaacucacuuuguagaccaggguggccucgaacucagagaucugccugccucugccucuggagugcugggauuaaaggccugugccaccacgcccugcaagacuuuaucauuuuaaaguccucauaagaguucccacuuuguuaaaaaaaaaaaaaaaaguuuuucauuaauuuauuuuuccuccccucuucuccucccagcccuacucucucaauccccccuuuuaaauuuuauagucauaagaaaaacugauuuaagagaaaauucaacucacaugcagacggaaagauccaaucauaaaauugcaauuuuucccccaaccccuuugcaauuuuuuugaaggguuuuuguuuuguuuuguuuuuuaagacagggcucacauaucccaaauuugcccaaaauuugcuauauguaacccagaauaaccuggaauucugauaauucuaccuguaccuccaaaguccuaggauuauagauagccucauaacaccaugccaaauuugugcaaggcuaagaaaacucagggcuuuguggugccaggcaaguacccuaccaaauuaucucuuuguacaaauuuucucucuuaauucaguuacucauuagccuacuaaagaauuuucagagcugugcuauauguguuaauuuccauuaucuaaauacaggguugaacauaaugcuuucaguaauauauauguguaagaaaccugaaucuugaauugugucccaguuuaaggauggugguuuuaaaaagaaauuugguuugaggcuuccuguaguugaaguucccuaaccuaagucuuuaacaaggugagaaacaauauuguauaugaaaaacccaguaccuaaacugaaaagaaauugggccuaugaugacaauucuagggaagauuuuuaaauugaauguauauuuaagcuggagucuaaguaaauggauuauaaucauuaacucuaguaagaucugaagucaugcugccccuagaaaaggaggcguuguaccuaacauuguaaagacacuuuguuaauguuuaucuugaccuaagcuagaguagauuuucuuuuuucucuccuagaugacauuguuuuauguacugaguuccauguaauuucagaauucaaaauauaccucucugacccuagauuagucuaaauauuuaucuuuauuuuugugagucauaauugaguaucagauuucauaacaguuuuuauacaagaaacuauugugucccagguuuuucuugggaaacugaggaaaauuaguauaaauuuuuacuguaaaggccuuaucguuaauauguuuagagaauucugcucaucagaguaaaaauauuuuugguguuucauuugaaauauaauuaugagugguggagacuuuaaacacaguuaaaggaaagcagggaagacaaagggcucucuaagaaaagggcuugggaugcgugggguagggauauucccuuuauuuuaucagagacugaaauggaagaaauuugacauucugguggcuuauggggagcugcucagagauugcuucuuggcugaguugcugucugcaaaggcugcuaacaaucgcuugucuggcagcagaucuuguucaucaggauugcaucaucucugggagaguggccaagguccacagccucaguacaaagacugucugaagcauacgaggccuguucucuuucuaaagcugcacucuucuuccugccaguccucuucacaggauugcuaaagcugacuugugcguuucuuucauuggguugacuguuuacuggucucuugucucccagcugcuuccgccucaccugucugauacauuucuucugaaaucuuaaaagucuagaaacuacauauaaaugguaacucucaaaagagugcucaguauuggaagacaggcuggguuuguuaguggauccgguauuuuguagaucugguggguugauaauugauggcagagugaaacuauauuuuuacuuugccucuguccuuccucuuacuugcugcugcugaauacuugacuauuuuauuucuucuuuuuacugucaccuucaaaccuuuuuuuuuuucacuucaaaauugugaauauacuuuugaaaauauuuuucuaaagauuacuuuguuuuccagauuuuuaaaaauuggaaacaugcgcacgcccacacccacacacauaaauguaaagggcaugccuucuaauggauggugacuugugaacagcuuucuuccauguuuaugaccuguuauuauuuuggauauugagagcucauuuuggucaguacuauauuugacuuugugaaauaaaaacaugaauuuaagaaauucugaucaccuacucuucccuuucuucauucucuuuccccaaauuuaauagguucucuauuuuccuuuccuuuuggggauauaguaaguugauggaauugaccccagguagaaccgauucccccugcccccaguuuuuauaaggaauggaauggggaaaagaaaggagucaucauuuaauauguuuugcuaggccuguauccaaaguaaaucugguauuugaugaaaagaggucugugccccaugugguggugugugccaauaauagcacuugggagggucagccaaggaggauacaaguuuaagucugaugugggcuauagcaauugcuuaaaaacaaacaaaacaaaacagaaauguaaaaguuacugaguuuggaacccccauggaaagacaagaaaaacuugagaauccugaggggaacaguuuugauagaagggaagagaagggcaguaucucaucaccuuggaaaccaaggccauuuccuucccucccuuaguuauuuuguguuagauguaaauggaaaguaacaaguaauacagaaauaaaauuauuaaucuguaguguuccacuuuuugagcacaucaauguuucuucauauauuaaacugugucucagccuuuucuaggguuucagagcuacucgcagauaauugggggaccucaaaggugacugccccaaauccuuuucauuuguuauauuuugaauuuuaguaaauguugaacuugguuacuaugaugggaucacucaguaaacauuucuugauuccucuugauaugucaggcauaguauuuaaucauuggaacuacagcagugguuuaaaaaaaaaguuuuguuuuuuaaucccugccauaauuuguguucuggugauaagaguuuaaguaauggaauaaauuauauuuugaaauuauuuuugucuagacacaguucuuacacaucuccaaauuaggagauuaaauuaauaguuacucuagcuaaaauuuagcuugauaaaccagaguaaauguuuucuuacaugagauauuauaauaaaagauuguauauggauaaucuaguaaaaguucuuuaucauuuaaauagcuauauuuuacaucauuuuucagugaaggaaccauauaaagagaguuucguguaucagaauuugaauuaggaaaccucaucauuggggcuugagagauaacccagcaguuaagagcccuggcuguucuuccagaaaaucuaaguuuaauucccaguacccacaaccaucuauaauuauagcuugaugggagcugauacccuuuucagauguacauucagacaaaacagacauuuaaaaagaaaccccauuauuaugauuuaggacaacauggucaagcuggccuauuaagauugccuuuaucagaauaguagcaguaguacaguuauauaacaauuggcaagaggaaaaagaauuuacaaagagaaauuaauaagcuaacuucuuaauguuucuuaaaguuguguaucaacuguccagauagcugguguaauaucucaccacugcauuugagacaaguauguaguccaggcuggucucucuugaaccuucugccuuggccuauugaaugcugggauuacugggugugugugccuagcuauuguguuaagauuucauaaggcaauguaaaaauaauuuauucacucuugagaggagguacuaccugaaguaacuuuuucauuuuugccuuguaauacaucuuuuuuuaaaguuacuaucauagggagaaaauuaacuaugugugucuguagauaauagguaguuggauggguaauaauuauuuuuaugaaucuauuuagcuuaugaaucuauguuagcgguggcuauagcaaagaaucauuaauauuguugaguaauuuuuaaggccuuuucugacauagaacacaugauuugaauucuucugaguaaugaucaucugacagauucuggugguuaucuggucaaacaacuucuaggcuuuucuuaaugcaaauuaucuaacuaaaauuagaagaaguacccuucaaaaugcucuuuggguuuauuugugaguguucucuuuguuuugccauuugaagauuuuugugucauuuccccaauugcuuggguguuuuuugagaauucuuguuuagcuacuugaggggggauggauauuuauuugcaaguugguacaaagacagcaaguggagcagucacacugaucaugaauugugucaagucgauaggaaaguucacuucauuugcauuuuaguuuuaguuuuaacagugucacccugaguuggaugagaacagguauuuugccacaccccguuucaagaggcccagguacuacagaaagcugcuuuaguuuaucgcaucgguagcuuucucaaguaauggugcaaaaguaauaccuuuauauggucuuaauuuuggacuaauugaccauucagaauuaguuuucuuuugccacauuaaugucucauuuaucaaaaugaaauccacaugacucaaaucaguaacuauuuaaaaucuucguuaauugauuuuaguugguaucauauacuuuuuguuuuauuuagcuauuuuuuaauaguauugauaauuuuacuucuuucuuuuucagauuuuagaggcaggguuucucuggguaggucuggcuguccugggaaucacuauauacacuggacuggccuugaacuuaaggauucccccccccccgccucugccuccugugugcugggaucaaaggcuuaugccacccucaccaccuggcugauaauuauauuuuaccuacuguguucacgagagucuuuuuagucuagaggucuuugacauuauauugacuucuaaacacauaaaaugcuucuuguuucaucuuuuagugacucuucuuacauuaguaugaaaccacuaauaugaaucaugcuaauucuguuuuuaccuccaaaugccuuaaucugauuuuuuuccccauauuuacuacucacugauuuuuuuucuuccuaaauaauaccaguuuaugguuaccaaaucaaaguuuguucauugcuuuuuuuaugcaaaauaauauuugucauacaauguuguuuaggauuucuguuacguacauguauacauccuuuuaaagugguuauuaaaucaaaacaaaguugagcaggagguacaaguuucuguauguccucuauauccacacauacuuagcucucucccuccaccccucucacacauacuuagcucucucccuccaccccucucacuuacguuucucuucauaucuaucaguauauauugcugcacaauuguggguuuuagauaauuacaugaucucuaagacuaguuaaaagaagucagagaggguggagaaauggcucagcaguuaauuaaaaacaguggcuuuucuucuacaggaccuuggauucaaggccuagcacccacauagcagcuuacagcugucugaaacucuauucugaggggauccaaugcccucuucuggccccugugggcacuacauacacuuaauguacagcaugcaagugaaacacauagauuuuuuuuuuuuuaacaaagcaaguugggggcauaagaaauggcuaucugaucaaacaacuaauugauaucuucuaccagguuuauuuuagaagggauaagugaguguugauuaaacuaugcuuauugauugccuagaagaaguuuaagugaaauuauuaaggaauaauaguucuaggauucuucugauaaccauccugaaucuuaaaauuuguuugguauauccuagacuacuagaaaagugugucugcugggcagcuaacgagugaggaacaugugcuuuuuaguaagccaguuagacuauuguuuucacuuuggcagaaaagaaaauaaugaaaauagaaauuuaaaaauaaucauaacguuuaccaaucuccuuuguagaacauuaguaaauuaaaauacauaauaagccaacaaacaacuuuuuaaaaaccuuauaucuauucagggagcuagagagauggcucacuguauaaaaagcacuuguacaacuuugaggaccugaguucaaaucuccagugugcauguaaaggacaggagauuguugcuucacaugccucuaaccaauaucagcaggcauagauccuauaagucaauccuaccaacuuacuggccagccugcuaacccagccaaaacggugauuuugcaguuuaguaagagacccuaucucaagggaauaagauuugagagccauagagaaagacagccagaauccucuuguuuccaugugcauacaugaguacucucaaacauacacacuugacaagcauacacugugcagagacaccacaaacacaaagaguacuauccuaacaauacaaaacacccuauagcauuuaagauaaauuuaagaaauucucuagucagugguuauuuucauuuuuuguggcaggauuccucauguccguaacauguuggcugaggcucugcaguucacccccacucuuugaguggucagucuccauuaauuggaccccgugauucccaccuucugcugucuuggacgucaugagcauugcaaucccucugggagucaccacaccagauacuuccuacucagauauggcugcuggaucagaguaagugguauuuccuagauaauaggauugcuacaaguucgugugaggauggauuucuucugggcaguucauaagcuauauguaauauuuucuuaaaaccuaucccacuaaagaaaacauuaggcauacccucccccuccccaccccccaguuggagggacaaagaaauuagaagggggaggaaaggagcuuuuaaggagggauuucuggguaaauagaaucaaaguugcaaagcagugguuacauuuuccuuuguuuuauggguggggaagauugcaaugaaguagguguuaccaccuccuucuaaagaguuaauucugaugaagagagauagguuuucuuuccaacugauuuucuuugaaggccucuuccuauguacuugucauuauucuagaauaaaggggcugaaacuuuauaugggcagacugcuuaaccagcucacugugggguagaaggcauggagagcuguaucaucuguuuuuacaauauucguugccuagaaagaggaccuucaaagucagugguaccaaacuuguuuuucagcuaagagcagcguuaggaauucagaauuuguggaaaggcccaaucccuaaaauagacucaguucuuugaagaauuuaaaugccaaaugacaaugaagguaggccuucauuauacaauucuauauauuauucaguuuaaauuuuuuuagccuuuuguaucccuucucuuuaaguuguccaagauugcccccgcucacagauuccccccucuuguccuuuuaccucccuuguacccaaucuuccuugcuuacagaaaggaaguggaagcccccuaccuuucaagacgaaguggcacuacaccaggaugugaaaguccagcgaaagagacccaaggggccuagggggcagcacacccccagaagccaagucuauuccaggcaguaccagggauuagggucugggcuggaaaaauccugguguuuugaauauguucagguccaguucagacucuugaucccacagccacuucuugagugagguggguguugcucuaauucccguuucucuugccauuuucagucccugggaauucuuuccccuucagcaaagcaaagcgacuguuccagaauucuggguugaauggcgucccuuguuaauagugguuuccuuaaaacugaggauacuauuaaagagcauguauauuucuucauaaagcuacauaauguugauuuuuauuguguuccuuaaagaggaagacaugaaacuacccuaggaaguaauauaugauauucugggguagucuggaauugaaagucauuuuuaagcuuauucccauaauacaaugggaggagggagggcauaggaaagacuaguugucuuucuuuauuauagugguuuuuguuguuguuguuguuguuuuguuggugucauuuggguugguuuuugugugugugugugugugugugugguuugguuuugguuaugguuucugcaugccaacaagauuuaguuaaauacuauuagcugagacuuccaauuguguaauuuuucucuaaaauaaaguacuuaaaacucuucuguguuauuggauagccagcucaauuguacagugguuauaggucuuuauaaagucagaaaauaacaaccuacugcaauguuaacaaaugauguaucaguagaaaguacuaauauauaugaaaaauaaagaggcuaaacaaguaaguuuggaauugguagguaaggaaaaaaccuaaaccaguuauuuuuaaacagauaauuucuucaaaguauaacaguagcugcacauauggucuggggaaucgaggaauaaugcaagaaugaaaguagccuggccuguacuacaacuguagugcuguguccuagaacuuucuaagcuucucauucauugucugcagacaaaauucugauaacuauggucaacaaccaauuucacauuucuuguugauuaguuuuacaaaggguauuaaugucaauaauucagcuuauuugcuagucuuacuaauuauuaaugauauuuguccuuacuucaucaugucuaaccauuguuccaagcauucucaagauuaaaugugguauuaagggcaacauagcuagccaaggaagaaaccuauaccuugccuucugaaauuauuaacucuugauuguaguaguuuacauuuuacaauuauauauaccagguuacuuguagggaaacuuguagauguaacaacgaccauaaaaagaucuuuucaucucuugcaugaccaaaaaucaguuacuuucuaagagguggccuuauaagaggcugcauauugcucauugaacauaauugaugggauauauuuguugugagcccaauuucucuguguaugcccaauucuuaagacauuuuagucacaggaggaaaaaggauaaucauuugcauaaaaugguugucuaauaaagacaugcaauacuaauacuuuuuugugugguuuuuuuguuuuguuuuguuuuuuguuuuuuuuuuuuuuaguccugaggcuugaacccagguccucacagacuaaacacucuaugacugagcuaucuccccauauccuauacuauaaauuuuuaaucuauauuuuaaaauacucauaaaaaucauuguauaauuucuaaccaauguagacauuguaaaguuuccucauuuaaucuaaauuuuagauuagguacgcauaacaauauuuuaaauggcugugcuugagcuugacuacauauuauggagcaguaggauggccuguuaaccuccacaauauacguuuuauuuuuauucccuagacuugcacaugaagugcauauguucauauuuacccaguuuggagauggguaagauauaaccaacauagcuccaucuccauggccaucuuuuauuucaugcaacuuuuuuuuucugucccacaaaaagcuucauuucuaauaaacaacuuucuuauuucaccccauguguuuaaugguauaaaauccccuacauaaaaauauguacagcccuuugaauuacuuaccuaguaacauacauagucaauaacaauguauaaauccauuacuuucuuuuaacuguccaucauagaaacuaaauucuaccuucauuuuauuaaugcuugucugccuuugguuucauuuaggaaacccuaccuguuuccuaacacucagccaauugccucagugacccauguucaaaucauccuuuucucaagaauacuuaccugcauucuugauauccccuuccagccaccccacugccaauucccaaagugcaugcaccucacuaacagagaauacuuuccucugucuaaguuccucaccuagaaaugaccuuugcuguuauuaauaagaccccuucucacaguuguggaccauaaaacuaggugaguucaauacauaucucagagucuucucaucccucaugucucaguucaugugcuaccuugaauugcacgguuuauuccugcuuaguuuuguguguuuuauguaucuugaagcaggaagguaguuauuuggaacaaacugaauuaauugauuagcuaaaacccuuugaucucuggaguuguguuaacacugguguugcuaaugggugaauuuguucugauuaauauacauuacggauaauccauucuuacuucucccaagucauagaauuacauuccuuaauuauucuucaaaauucuauaaaaccaaaccagguaacaaaaguaaagaaacaaggaaaaaccuauuuuauccuuggcuauggaugccuuuuuuuuuuuaaucaaauaaacuuacauaaaauuuauaaccuugaaugugaaaaaaaaaaauucugggcuuaaaggccucaauacaguuuauagauagaauguuauccuugcuuucaaacaaugcauaaugggaaaggaagaggcuuuggagucaggcaaacaacuuuguuucaaauccugacucuuaucagcauacgugcuuagaaaaaucauguaaucucaccaccuuagcuucacuucccucucuauaaaaagggggugaccaugcuuaauaauugcagguauuaaaugauuuaauacauguagacccaaguaauagaugauucauaaugguagucaugguuacuauuuaauaugaagcaaauuuaacucccaaauucaguuuuauuuugaaguucuauguuacugucaugcagcuguuaaacaauuguguccuugaauaugcuugcauguccuugguggaugagaaauucuaauaugugaaagguauuuggggguucaucaagaugagaggugugauaaauauaagaugccauuguuuuugccuguacuuucuucaggguauccugucuugguagugaauggaagagggccuggucccuggggcagugcagaaggcacuuucaucaucucacucacugcaaaugucaugugagguuucauggaaguauuaagagauccaauuaagaagaauaguucugagucuaaaccagcccagaguggcuucucuaggggaaacuccccgcucugcugguacguuuguguuugucauuagggacaccuuguaucccaggugccugccuugagacaucugccuguacuggcuucauguuacacacaaauccacauucaauaacacuauuauuuauaggcguaguuauguuaaacagacuuucacuaaguucuuauucuaguggcuggugguuguggaaagagaagggauuaggaugggaagugaacuguuaguuuaagggaagaguagguguuaugcuaucaugcauugcuuuucgccuuugugcagcccugaaucuguggaggcuaguccagcaguuaaugagaagagcguguauuccacucauaauuaugggaccacucagaggcaugggugucgaggacugccuuaugcugugaguaugcacuuguuucucuccagagcagugaucuucuuggaguguaauccauucuuauacauugugacuuucuugaaauguuuauaugcagcaugacgaaguugccccuuuugcacuucccugccuccagcggacgucuagcccugcaucauuguucuuguuuuuaugucccaguugaccuuggcauuuuguuuuaucacuuuccugguugaagccaaaaaacgaaggguacuacuuucuucuuucuuuccauauguaccauacuuuaggggagagaggggccaguguuuggacacuguugauuuaaaaaaucuuauuuucaggaucauaauuacggagccccuccuccuccgacaccuccugcuucucccccuguccagacgaucaucccucguucugaccugaauggccugccgucgcccguagaggaacgcuguggagacagcccgaacucugaaggagagacuguuccuaccugguguccuuguggucuuucucaggauggcuuccuucucaacugugacaagugcagguaagauccuguuucaucuaaauucaaaccuggguugcugggauuaggguuucuuaucaguagggaaaagcucaaaguauuucuucuuguguuuguuaauguagaugauuccuuagugcuccuuggcucgaauucucugcacuaggugagaauugcugacaacaaggaaugagagauugauguuaaagcuauugaauuugauaagaaauuuaauguccuggaaacauuugguaggugggagggaggggguaguacauacgcagagacacuucucccauguaugaugugcugugcugcaugcugcuggaaggacuacuuuaaguuuauuuucccucuuuaggggaaugagcagggggaagguuauuagacuucaucggcggaagcaggacaacauaucaggugagcagaagguggguuaagcccacauuuugacuaaauauuuugauuuaaauguucuccuauaguacauagcuauuuucacacaaagaaguuccaccaaaaccacuguaucuaucuggaaauguuucuuagaccucuaacagucaaauuauccuuuguaagcaccagaaauaauuuuuuuuuucuguuaaguuacccauuuauaguuaaagacagcagaguguggaaacuacuuugaaggggaaaaauugauggaauacagacuaaaucuuacuucaugccaacaacaacaacaaaaaaucuuguuuucagaagaaaggugggggucuauguagaguuauaguagagguaauuuuuuaccugguguagggcauauggaaaggaggaagaagaugauauuagugccugagcugugugaucaucuuuuuuucagguggggauagcagugcaacagaaagcugggaugaggagcuuucuccuuccacuguguuguacacagcaacacagcacacaccuacaagcaucaccuuaacuguuagaagaaccaaacccaagaagcggaaaaagaguccagaaaagggucgugcagcaccaaagacgaagaagaucaagguaugcaagguguauaaaaacaccuugaauacaaguaugucugaaauagcucaaacauuugauucaagcaaaaauacucuaaaauucuuugaagaaauuugaugccaguguuuggccacuuuuuuucuacuuucaaaaagucaccugaucaauauauacaaacagaacaaacucucuucuaaccuucguaaccaucaccacaggcucaguuucuucuacuucaaccaccaucccagguauggaaugccagcccuugcugguaaauucucaugugagauacagccuugaaucuaagcuuccacugucuuugcagcaucucccuacuucucugucacaaagcagucugaaguucuugucuuguuuacauggcugaccucaugucauugaggucauuaggcugauugauuguccuauaucuaaacagaacaauaacaugaggaaauuuaucuugaauggucuagauuuucuuauugucuuggucacuuuucuauacucuuagauaaagggucucuagaagaaacauuugucuuuucuauucuuucuuccccaucacagcaacuugguugcuccuaggucacuugcccacccuuugugaaggggaucagucuuuguuuccuuccuaauuucaaaacuaauaaucugcaacuugaggauuauaauuacuuucugcuuggugucagcaguuuguauagucuauaaguggugcaugcucuuaccuauuaauugucucauaccaucaaaguauuggaauucauguccguguucaugagccuuugaacuguccuuuuucuugaucaugguuugauguaccguuguauuuguuacacugaaaaugagacagcauaggauacugguuaguaccuuacuuaguuuuagucacauggauauaacugucauucuugguaccaaguuuuguuuuguucuacuuguuuuccucuuugggauaggcauuucgagagggaucccggaaguccuugcggaugaagggaagggguaaaccuuuccugaugcugcauuuuacauuuggucuugccuuuugauggcuucuuuccuaacguugauggucugagacucuuggagucugcuuuucacaagguuguaauguugccauucaguuuucauaaauauuuucuccagaguggacuuucuugucuauuuuaugaaauauuuucauguuucuguuucauugugguagugugggagauaagucacaguuuuuaaaaacaaaacgaggcuagucuguuuuauuccagugauuggacucaaccucaggagugagaauuuucuggugaugagccaggcucucuuguaaacucuccuugacaacuuuggcuuugaauuauuguuugaaaggauaacucuuuaguagaaaauugguguuguuaauaugugauagucuuacugaaaaagcacuauuuuucuuggcaucuuuuggcauuucuuggcaucuuuuucuugguggagauuuauguaaugcugcuuaucaaauaggacugguguguguguguuuggagaaguaauguacuuuuuagauacuggcuggguuucguuguacugguuaguuuucaaagauuugguugucguuucuuauaucuucuuuuguccugcccaugaguaaguugacauaccuccuaaaaguuuaggauuuaagagcuuuaguuugaauuugaguuguacuuugguucuucuaaguauucguaucccuaaaucucuuaaguuguccauuaaauaaacagugacucuuugaguuaggauaaacuuauuaggauuacuuuguaguuggagcaccaguggauguugucauugaugucaagugacauuuuaccuuaaauuugaaagucugaccucuuauguggauaggagauucuuuaaugagauaaaucuacaaguugccacguguauuuucaacugcucguuucauuuuauuucauuuacuaacagggaccuuacauagaauuuggggacuaacuuuagaccuaaacuguaaggcccucuuuuuuuuuucccccugcuaucaacuaauacuauaacuagcucaacuuucgauaccuguaagcaaaaugaaagccaucucuuucucucagagaaguuuauauacacuuuuugcuuacaguuucaacagagccuuguagauauguuaaaauuuaaauaggaaaaaaaaaaagguuuuacuuuaauuaucuuauaauuuuuaaguuaaguuauaaauuuugucuuuggaauuaaugaaaacuuucauaaagauacagguaguagcuauaggaauauaaagagaauagcauuugaauuuuuaaucucaaaaccaagagcuuuccuacaagacacaacucuuagccaguguuuuaggucagcaaggugagugaacagguaaaggaacuugcugccaagccugacaacuugaguguaaucccuggaacacuuuugguggaauaagagaauuccuacaagguguccucuguggcacaggcauaccagcaaaauauauguuaaaaauagaacaauaaguaaaccaguguaucuucaauacauuuggauaaguaauucugugugguaauuuacauaaaaugauggaacauuauucaacguguauuugauaaugguuccaaaugguaauuucccugugaguguuaacauuaugaacuagguauugcuauuagaaauaauaggugucucagaaacaaauaggugacucauucuccuaauacaaauacaaaccauuuuuacugcuauacuaacacagcgaauaucagccuauuuugaaauuuuaugcacuacaacaacuuaaaauucuuuuuugucuuuuuaugacucccccaaggaauuugaugucaaucuuucuuucuuuuuuuuuucuuuuuuuuucuucccgguuuuugguuuuucgagacaggguuucucucuguagcccuggcuguccuagaacucacuuuguagaccaggcugaccucaaacucagaaauccaccugccucugccuccccaagugcugagauuaaaggcgugugccaccaccgcccggcugaugucaaucuugauggauugaucuuuacuacugaaaauggucaugaaaccaguaauggaugaagauacuaagucagauuacuuucucacuuuauaauuagacaaaugaggaaaucauuugaagguguccaagaccucauaauugguugauaguagaagcuaaaaccccugauuucaguccauugcucuuacacuacaccaacugucaaguaaaaacaaguaucuugcuuauccugccguguucaugaauggucucuuacuaauucacuuaucuuugaucucuacagaauucucccucggaagcacagaauuuagaugaaaauaccacugagggcugggaaaaucggauaagacuauggacugaucaauaugaagaagcuuucacuaaucaguacagugcagauguacagaaugcccuugagcaacaucuccauucuaacaaggaauuugugggcaaaccugcaauuuuagacacuauuaauaaaacugaacuggccuguaauaauacaguaaucgguucccaaaugcagguaagagcuaaagcuuuaaaagcacuaagagauugaaauuacuuuaauaaccaaagaaccagaauggaacaaaaucauuauuccauaccaaauaacaaaugaacuaccuuccugcugauaaucucuguucaaaaucagguuauaguaacuaaacugucuaggcacauguuugagaaauaaaagcuauaaauuuauaaagcagacacagcuccacugacaucuuaaguucuucuuugaucuuaccuucucugggaccacuaauuggaacauguuuccuggaaacuugagauuaugucaaaaagaaaauuuuccaaucuucaaccuauuuaauacacugauaaaaccugaaaguguuaguaccuuuuuaacaguuaugaaacacuguaaauguuuaccacacugcuauugcuauucuuaaacauuaacacuguuuuuauucaguuacagcugggaagagucacucguguucaaaagcaccggaaaauccugagggcugcaagagauuuggcuuuggacacucuuauaauagaauaucgugggaaagucauguuacgacaacaauuugaggucaaugggcauuucuuuaaaaaguaagaacaucauuuguugagcauugagggcuugcaugguucugacugacgagucauucaaauaagcucguguuuugucuguuugcuguugauucaaaagggcaaauaaaucugcaaaucguguauguacacuagugaugacuccuuuccaagcccaacauuccuugcuuuuugcuuauucauuaaugaaaagcagacaagucugugguguuugcuaccuuagguauugcaaaugacuguuccuuauugagucaguguauacaucacauuugugggguggcccuuuuguuuguguugagaauuacaggaauuuuaauuauaucccuagaccauaucccuuugugcucuucuacucaaaauucaaugguguagagaugugugucgaugcucguacuuucgguaaugaugcucgguucaucagaagaucauguacaccaaaugcagagguaagcuaucuuuagcaacuucccuuucaauggagccaucaaaggacauguuuaauugaagaaacaaucugaaaacuucacccagauaaaggucuguagcuaauaguuguaugauuuuuaaugcagagaugaaaaaguaaaaguguggugucuuauggagauggaauaaagacaagaaauagguuuucuuuagagaggacagaaaugaaaaaaaaaagaaguaauaaaacagacuggauaagaugucuauaaauugaauuggaaaaaauuuaaaauauuaaaaugucaugugguaauaguuugucuuugcuauugugggaaacagugguaaaaauuuguaaacauuucuaaaguucauuaaucgauguauucacaguaagugcaguaagguuaacacagcuuuguuuccaggcuaaggaauuuuuaauucuuuagcagaaugcagauacuuuuaagaauaaaauaauaguuucacccuuuucuauuuugaagaaguuuaacagauuguucacuaguguauuaucaugaagugauagagguaaauaaaauaacagauuacucaaaauaggcagaaauuauuugggucaugcuuuucccauuuauggaaaacuugguuuugguuuugaaggcaaacauaaugaugucuuguucauauaggugagacacaugauugcagaugggaugauucacuuguguaucuaugccguaucugcuaucaccaaggaugcagaagucaccauugcauuugauuaugaauauaguaacugguaagaccucagaaauuuuuauaagcauagauggccuuaagauuuuaauaucuuaauauuaaaauuguuuuuaaaucuugcccuccuuuuuuuuuuaauuacuguauuuuuugccaagaaucuguacuccuacuacauaggaggcagaagcauauggaucuguaugaguuugaggucacuaaggcauuccaggccaaccaggcccaccaggccaugacucugaaaagaaaaauaaaaagcaguagggagaaagaauuagucgagguuuguguucuuccugauucugugcugcauagguuagagguagacauauacagaaaaacugaaauuuugaaaguauuauaccaauucuaauuuauuuaacaauaacaucagaggaaauuuuuauaccaguuuuucaauaaggcgaauaguuaguaugccauaauauucuguuuacaagaauacugagauacuuaugguuguuucuuuggcacaguaauuacaaaguggacugugcuugucacaagggaaaccggaauugcccuauacagaaaagaaaucccaaugcugcagaauugccacucccaccuccuccuagcuuucccaccauuggagcagagaccagacguagaaaagcacggcggaaagagcuggagcuggagcagcaaaaugagguuccagaagagaauccugacccgcaaccacaagaaguuccagaaaaaguaacuguauccaaugagcaugagguaaucucuguaaccaagucaggauggucugaucccauguguuguuucagagagcuauacuaaaacauuaacugcuauuauacacaucaucaugaauauacuuacuuagauuuucuuuucacuuuaugauauucagaaccaugagcaaagccaggguauaguggcacacugcuccaguauucaggagacagaggcaggugcaucucugugaguucuaggaaagcccaggcugaugcacaaagaaaccuugucaaaauauaaagagagggagggagagaaaggaaaggaaaaaagaaaagccuaagaccugauucagaaagaaaaauaauaauaucagaaaccauccuuuuagggccugguauggugauacucacaucuaaucccagcaucuguagggcugaggcugggugguuaugaauuugaggcuaggcuuaggcaguauaauaagucccugucucaagaaacauacaacaaaaauagagcauccuuugacucacagaucacaugcuuugcacacagaaggaccugggcuuaauuccuauuguagagcauaaaaagaaguggggagguagugaugccagaauaaagcagguugaugcucaguguuugaauaugaucuaauagugcuucugucuuaaaggaaguugacaauccagaagaaaaaccagaagaagaagaaaaagaagaggcuacagaugaccaggagaacucugcucauagcagaaggguaaguccuguccaguagaugucucuguacuuuccuaacgcugagguuuuaccauaaaguacguuucauuacauauaggcaugcucacaguuguuuaugauaacuaucuguuaguggcuuuaagauauuuccuucuaacaacuggauuucccuaaaacuuggugaugaagaccaaaguuuguuggcuuaguuuucuuacuuuguuuuguguuuuuauauuuaaaaacuaaaaucaagaagagcugcugauagcacaguuguauagcagcacaaggucuugaguucgaucccaaauuacugggagaagaggaagauaaucagcacugugagccucugucccugugacagaaaugcugugaaaaacaacuugaaggaggccaagcuuaccuaugcucagguuacgcagguucaggucuguugucuucauugcuuucagagcaagccgaaauaagacaguaggaguccacugcaaagaaaaucugcuuaccucauugcuaccaggaagcugagaggaaaaaaagccaagaggccaaagauggaagaguauauucuauacuuuuccauggcacccaguggcuugcuuccuccaagaaggcgcaguuccuggggucuccacaaccucccaauagcacuuaccacaugaguucugagccuuuaacugaacuugagccuuuggggcacauucauauccaaacuguaguaauuuuuuuuuugucagauugauuaaaaacauuugcuaauuguguucauuugugcuuagaaaaaauuuaaugacaauuuacuuugguuuugagcucugaauguaggacagaaauugcuugucguugcuuuaugcacuaaaauguguugagguagcucaccuauuuuaaaacauuuaguuuuaaauuucugcuauaacuguuuacuauauuuaaaauaauuuuaauuuuuuuuaucuuaaaguuuagugaugcauaugcuaucuuaauaauacuuugaauaaauucuuauaaacccuacuaauuuuacuuuugaaauagcuucugguugaugcuuuuuuuauuguuguuuuuaauacuuuucuacccccagacucgagaagaccgaaagguugaagccaucaugcaugcuuuugaaucuuuagagaagagaaagaaacggcgggaucagccuguagaacagagcagcucggacauagagauuacuacuagcaguucagagauaguaguuggagaagagacaaaaacugcagccccugagucugaaguuagcagcccuguuucaaauguugcuaucccaagcaccccacagagcacuggugugaauacucggagguccucccaugcugggguaagagggaaagcucugaaaaguccugcguaugcuaaugucaguugucuuuuucuauagugguagaaguuaguauuuucaacguugcucuguaucagaauaagcaaagcuauuuugaucucaacagcugguuugugggaugcagagagacaggugaggucaacauuugaaugacaaagucccuuagcacuuaagugucucccagauaaguucauagaauccuuugguuugggagaaugcauacugagcacgaaggcuucaccuagcucagucuccaucucuaagggaagaaaccaaaucuuuggguuucucucacugauucucugaauagcucagguacaugacugaccuuccagggccuucucaggacuaguguuuaacauaggacuucuggguguagaaaagaaacaagaauuaucuugccuaagaaccuuaauauuagguaccuagcuuuaauuggcuuuugaccuauuuuauuuuauacauguuuguuagaaauagaauuaacuaaggcagauguuugucuauggucuauuuagguaauaaagucuauaaaauuuuguauuuuuuuuaauuuguuuugugacagggucuucccauauaguccuccuggcuggccugaaacuugcuuuguagaucagauuaaccuuaaauucacaggggucuaccugccucugcccucucuaccucugauuccaccuccugaaugcugagauuaaagauaggugacguggugccaaguucagauuuauuuauuuuuauauuuaugugugaacagacagacacacaccuucuuacauguauguauguguaucauguauguacccuacccacagaggcuagaagaugggauuggauccccaucuaaaacuaaaacuccuaguuagaggacuuugugaacacuaaaaacugaaccccagucuuugcugcaagagcaccaagugguguuaauuggggauuaaucuuccagccuuaaggauuaauugaaaaucauuuagaaugcuuuaaauagauagaaaacuaagaaacagguaagacauuucugaugcuaggugagaggagccuugucuaauccuaguacucagcaaacuaaggcaaccugggagauccugucugcaaaggagaagagaauuuucuaguaaacauuuggccuugauauuguuacaggauguagcugcagaaaagccaaucccuaaaccaccuccagcuaagccuucuagaccccgaccgaaaaguagaauuucucgguaccggaccaguucagcccaaagacuaaaacgccagaagcaggccauugcacaacaggcagaacugucgcaagcugccuuggaagaaggaggaaguaacaacucaguaacuccuccugaagcuggaaauacagacaguucaggagagaacagacagcuaacagggucugacccaacugugauaucaguuacuggaucccaugucaaccgugcugcaucuaaauaccccaaaaccaaaaagguaagcgacgauauaaauuucauaugguaaggaguaucacgcuaaagcaagagggccuauaauccccaaggaagaaguaaccuuagaauuauuagauugaacauuuuacguaaaaaguuguuugugcuggaagcugaaaccauccuacuuauuuuuguucacuugauuuuagacagaauuuaaaucacugguaaaacacuauuuuuaucugucuuugugagcauggaaaauguaaaggaaagauaccuuauacucugaaugcucagcucaucuucacugugguugcugaucuguucuaguuuuaguugaaguuugauuugugaacuacacuacugcuucuggcagcuguuacaaaugcagugauaacuaaugguuuuuguuuuguuuuguuuuuuuaaaccuuuaguaucuaguuacagaaugguuaaaugacaaggcagagaagcaagaaugcccuguugaguguccuuugcguaucaccacugacccaacuguguuggcaacaacccugaacaugcuaccaggucuuauucauuccccauuaauuuguaccacccccaaacacuacauucgcuuuggcucacccuuuaugccugagaggcgucgaaggccccuucugccugauggcacauucagcuccuguaagaagguaugugccuuucugucugucucuaucuaucuaucugucuaucugucuaucucccccucuaccccccacccccuccccgugugugucuguguguguauaccugcccaugaaugaaaauauguuuaauacuguagggugcauauaguuguaguauauuuuacauaauugucuagauaauucgagaaucucuagauaacuuugugaguuuauauuguguuguuaaacauggaaguagacucuuuagaagucacuguggucaaguuggaauguauacagcauuuuuggugcucaaacuugugacuguuuaccuguccauaccuagaagcuuuucacauuacugagagcacaaggcaauugaugggauggauguguuuuguauaugcuuuugugauacugguuagcaugguaauuugugacuauuguaugauguuggaccccaaauaauuagagaacaguuauauucauaaaagcagauaagauugucguuguaacuauauaaucaauuacuauuauuucuuaaaggaguuuagacaaaaaauuaucuuagaauuuuauuggacaauaaaaagacuuauucccugccuuucugggacucuaguuguuuugggucuagcaccagcaauguuugguaguuguuuugggaaugcacuuuauuaauucccacauuuguacacauguuccaagggugucuugggaauagauuguucuucaagccuauaaugcucuucaauguuuucagaaacacagaacacacuuuaucaggucuuccuuuagguaggguucuuuucccuggaccacccuuuucucugauccucagaucaggauucaggcugccgcccucauugucuggccuugaccucuuccucgggcaucacauacaugaggaugcugcauguagcuuauuugaugugaugaaguuuccaauuccaggcaggucuucccugauuccucuaaacuuaaaaagauuuuuuucuuuccccaagaucauaaguuacuucuuggggacgggaauauaaaggaucaacagaaugacauggccuauugaaggggagcaaggaaacgggagucugcauagggaaaggcagugcugcugagucaguaguacauugcagaagccuaaguagcacauccuauaaaguacugcacuuacuugguuuguauggggaaaacucccaaauggaagauuuucugagaaauuagauuucaagguccuugucaaagagauuuuggauaaugcaguaaguaacuuggugaaauaaguaauaacaguagaaagauuuugaaaaucugaucacuauaggaauuuugucuagguaaugaagagcugggucucuagggaauucacuuauaccacucacuuagcuucucuuggaucuuguguuuaucagaaaaagaaaaugguuuguuguacaaaaacaccauuacccaugauaaccagguaugauagucauguuacaucauacaguaggccaagacaaggguguuauauuacuagccugggcugcaaaaaucucaucucaacaucuagaauggcaaaacagacucaguucuucaguaaguaaaacaggaagcugaugugauggcuaauuaggcaaacacuugaauucuaucccuugacucauguaaaaguggaagaugaccuguugauguaguuguccucuaacauccacaccagcaugaaaucuguagucccccgcaaaauaaugauuucuuaagauguaauauuuaaauaauagcagaauccuagcugcuuuuaugaggaguguuaaaaguuagaaaggacccugucucucccuaaggcuauauacucaguuuauuaugggaaggauauauucuucagugguaagagguacuacacugguaagauacucuugugaacaacccaaauagaaacucugcuuauuagguuuaaaaauaagaaaguagagucauugguuauaaaaagggaagauuagagugaaugggaaugggagaggaauaagaaagaauggaaagggcauaaguauagacaaaauacaugauauguguauauagaaaaguaugagacccauuggauaguuaguaugugcuaagaaaagcaacuuuuaaaaaaagaauuauuuuauguaugugaguacacuguagcucucuccagacaucagaagaggacaucagagcccagaugguuuuagccgccauaugauuucugggaauuuaacucaggaucucuggauaagcagucaguguuaacuguugagccaccucuucacccccaaaaagcaaccuuuuuuuuuuuuuuuuuuaagacaggguuucuuuggguagcccuggcuguccuggaacuuacccuguagaccaggcuggccucaaacucagaaauccuccugcuucugccucucaaguucugggauuaaagauguacaccacugcccugcucaaaaaacaacuuuuuaaaaagaauauuggaguguaaagcauuuuuaucaaggcaguaaaaucagguuguaaaaucuauccugaugucuuaagaagaguuacugggggcuuuggagagacgccucaucaagaacacuugcugcucuugcagaagacccagauuugguuccuaguaacuacauggugguucacaacugcuguaauccccggucccgaagauuugaugagccauacacauacauacauacauacauacauacauacauacauacauacauacauacaggcaaaacggucacauaaguagaauuaaucuuuuuuuaaaaggagcgauugaugguaauuuagcagggauuaauauaaagaucguuauaaaguggacuaacauuugaaaugccuuauugguaauuauacagaauugcaaucuuuuuuuuccuuucuuguuugucgaacuagcagagagccaagcaaacaaacuuguguaaaaguauaacuuacauagaaaauguacuugcuugagcuuuuguuguuguugcauuacuauguauagggggaggugauucaaaguaucaaaauaauccaggcuuaucuguauaucuacauagaguagauugacuugagacucguggagaucugccugccucuaucucuugaaugcugagauuaaagacauagaccacaacacuuggcaguuauauauguaguaucuccauuggcaacccauagaaagaaauugaauuuaacugaacuccacauugcauucuccaagacugugaccagucuccuacuuaguugucucccacaccucuuuuuuuaagcaggguuagaacaagcuggauaagcacuuuaaccaccgagcuauaucuucagcucuguaucaaucacuauuuuuagaaagagacuaucauagaaaggcugccucauuaaaauuaaucuuaaaauuguuauggccagugauguggcucagcuggaagagugcauaccauucccaauggugguggggguccucauaaaacuuagaauagcuguggugcagauuuguugucuuagccuugggacagguggaggcagaaagaucagaaauuugaggccagucucauaagacccccuuacccucccuuccuaaaacccuuauuuacauuggaauucaguuuaaauugcugcuuuaauauuuccugagaaaaauccagauuagauuauacaacauaaacauuuugugggcggggcaaacuaaccuauuuuuuuuuaaagcuagaaaucugagucaacuuuuucuuggguaugagcauuuuaccugcauauguguaaguguuaccacaugcaugccugggcauucagaggccagaguugaguuggaguuugagauggccucuauaugggugucaguaaccaaacuuagguccucugcaagagcaacaugcacucuuaaaccacugagccaucuccaaagaauaauauauauucuuacuaauagaccuacuguuucauauaucauugaaaaaccuccuaaguuaaaagcaguauaggacaaguuugugucuauauguuuauacccagauuguucacuugugaagacauuuauuaaucuuccaggagugucuaaauuuaauuaauuugagauagauagacacaaauaaauucaugucuccugguuuuuuuuugucuuuguuguguuuguuuaaggauuuuuuuuuuauaugagugcacuguagcugucuucagacacaucagaagagugcauuggaucccauuacagaaaagguugugagccacuauuugguugcugggaauugaacucaggaccucugaaagagcacuuagugcucuuaaccgcugagccaucucuccagcccuguuuuguuuuauaauaaacauguaagccuuuagucagugucccucuguguuguguauaaagucauuugaacauauggaaagaaucuuuggugucaagauugcuuagaaaguuaguguugucugcacuguugcuuuauuuaccuuugaacauaaacauacugcuagaauuagcagggagaggugauuaauagauaagggagugaguauauuuaaaauagauaauauauucaaaugcacuuaaaucauuaacggaagaaguugaaaguuuggaguguugaaaucauuggcuacuguguauaaaccgagucuuuuugucucgaccagaaauggguucagaaacuugcccaaaguaaagcaucucuaguaauggggagagcuuguuuccuaccaggucuucacauuccaaagcuuaguuaguucacuguucucccucauuuucaaaaaugccucaccuaccuuuugggccuucuaaaaacuuuucaguauauuuuacagaaaacagaauuguuuucagacuuaaauauuuucuaaauagaauuugcauaggagaacagaauaggaauuugaaaguaaucuuuuauccauagaaagaaguggucauguuccuuuuuuaugaaucuuaaauauuguuuaaaaaaaugaaugagaggacacugaaaaaaggguuacuugauuugacucuguuuagccuuagagacaagacuggugacaucaucucagugccccaucugcuuuuauauaagcucuuuuuuuucuagucuuaagaucuagaaugucaacacuuauauggcuuucuuacacuaaaaauauuuuaguguaaauguuuuuuccuuuucucuuuuccuuucuuuuuuugagggaacuauaggaaucucuaauuugaguuccuaucuucugcucuaaguggaaaaauaaauugaaaauaaccuguauauaauauaaauuuuaaaacuugcauauucauaacuaaggauuuuucauuugucuuuccaggcuaauauccccuacccgugagaaagggcuuuagaccaagaugaccucagagggucugugcuuuugaugaccugugugcuaagacuguguaagagagcauaucacucuuggucuuggcuuuuuagacaucuugucauguccuagaacauugaugugauucaaaugauucuuaauuuuauuuauauuuauauauacagauguauauauacacauagacauauucauuuaccucuguuuacguucuccuucaacuuaguaaaccacggauacuuauguaauagagaauuuuucauaauaaaauuuccuugaaggcuucccagguucuaauuaaccacuggcuacuaaucuucuauaacuacucuguugagaauauuuacugaccuauguucucuaaagguauaaaauuauacuaauuuaccuuuuccuauuuggagacagucugucugaaauuaauguuuaucaaaauuggaagugucuuauguuaggauaggagagcuacagaauggugaacaacuuaaaacugugucuuuuaaaaaaaaaaucacauauaauaauuucuuuuccacagaauccuaccuuguaauuuuuguaagcauucuuauuucucauccaucuagauuacauauuagcaacuaaaaaaaguaaguggagagaauucuugaaaaaguuuuuccacuuuuuuuuuauuucuucagaaccucuuuuuuuuuuuuuuccccucucuccucuccucagugaucugcaguuacuggggcauaauuugugcuugagauaggaucccacagcuuugggagcuuugccuaguagaaacacugacuugacugugggaaauggagcuugguugauagaaucccucccuuggcccagucccuaucaccacauacauaaacuugauauugugguagacaccuacccagaggaugaagcagaagcaucauuaucaccacauacauaaacuugauacugugguagacaccuacccagaggaugaagcagaagcaucauuaucaccacauacauaaacuugauacugugguagacaccuacccagaggaugaagcagaagcaucauuaucagggugaucuuuagauacuuaggauguuugaggccaaucuagguuacaugagacuauuucaaaacuaaucuucauuaaagagaagggaaagaacagccaaagccagccuuggcugcacaggcccgacccugucuagaaccuaugugaauguauuuguauuguauuacucaccaauuaauuuguaaugaucugguuagugcacugaaaauagauaucuuuuaaaugguuauugaaaauucucuggguuuucccucccauuguagcgcuggauaaagcaagccuuggaagaagggaugacucagacuucaucugugccccaagagacuagaacacagcaccuauaccaaaguaaugagacuaguaauucuucuaguaucuguaaagacaaugcagguauguaucugauccuuuucuaaauuugauaagaacagucaccauuugagguucacagugaaauuuucaguguugguucucugauauaaaaagaaauaguguuuucucuaaauaguuaauuuacaucugucuuuacagaggaagagaaagaucucgagucagggaucaguuuucccaggacgacaaagaaggaacuagacaguguacagauaacagcagaaaugguuauaaaaaagguuagauacguuuaacguaguaaguuuaggaaauauuuauuuguacuuauaaggggagacaguagaaagugguggaacacuuucaaggggaacaguuggaacuguuaaguggcuuguugggugggaucugacuaaaggggcaggaaauaauggcauccuugaggaaucauuguuguuuuguuuuuuuucaaaagaacuugccucccagaacuauaaaauuucugacuaagacauaaagauaugggccaaauggcuaugaaaaaaggaccugaucauugucuuuuacaguguucuguuucagacuucuagcugaaauuauugguauauugacuuaugauauccuauuuguuuguuuacuuauuagacaggguuuuucuguuuaaucuaagcugguaucaaacauccucucugguacucaaauucggaucaguuuucugaauauuguauaaucaaaaaaugcuguaacuggauacaaugauacuuaggauccuaguacuuggaagacaaaauaagacaagaggauugcugcaaguucaagacccucccugucucaauaagaaacaacaacaacaaaauuuaccaacacagauuaguuacuaaaacucacuuuuaguuuugcuuugguuuauuggauaaagagagguguuugugggguuuuuuuuuuuaaaccaccauuuuuugacuugcugaguauuuaugaagcugaauuuaaaagaauuuuguaaguaauugcuuuauauuaaaauucuuagguuuuaaucuguucaccuaaugagacagauucauucagguuuaguuuaauaaaaauuuuaaggcagcuuugaauugugucaacuuacaacuuuaagaguagcugaauuagacuaugguguguguaugugugugugugcgugcauguacgcgccuuccucuaucugguggguauguugcacacauauacacauauauaguugauuuggagaacagacugcauguccuggcugucacacacucagagagaacuuguccuuguuacuacauacccucaguggaauagaauuagcacuguuagucaucaacuuguauuacauuucuauucuucucuccagcaagcugugagaaacauuguuagaaaacaccuugcccuuaaguaucaauauaaaccaaaggaaagcauuacauaaagagauuaauggcacagaauuacuguuuguugaguuuuaaaaguuuuguuuacaacaauauggaggaaaguugaugaagaaagugaagagauguguugacacagauaaaaauaucaaauagaccuuuauuugaggucuaguuuucuauccugugugauguuacuaaaugucucugaauuucaccuguaagugccugcuucauaagguuaauaagaaauugaauaauuuuuacuaagugcuuaguucaguaucagacccauaucugaauuacggcugucauucuacauagaauacucuuucuugucacauaugaacuaccuagauuaaagaugauaaauucuuccacuggugugguugugcuuaauguguacaauaccaguaaucaagacugauggaaaaaucuugguuuucaggccagucugggcuguauaguaacucuaucacaaaaagaaaagucaaaggauauuaaaagauaaaauugaauaaaaauaagauguauuaccauugacauaaagaagagaucagauauucauuuguaaauaacaugaauauaucccuagaaauaccuuaauaaucaacugaaaaauucagaacuaauaacaguugaauaaaauccuugguuagaaguaaauaucccuuaaauacuuaagaaaaugaaugaaaacagguuuuugucauccucauuuuuagcaaagcuaagaaacuaccugagaauuuucauacuuggauaugugaugcaaacuauuauugagaaauacuuugcaaguuugagcauaaaggaaauucuguauucaauaauuggauguauaauauucuuucuacuccuaugguuuccuagagccaucuuuaaaauuuugauuuuaaguucauuaaaguuuuuaaaauaaaccuuggaaggguaauaaguacuuugcugaaaauacacaccuaguuuucaugggacacucgugguuaaauuaucauggcgaaugagaauacggaacugaauagcuagacuaggcuuugaaauaggggcaugguaaauugcucuaaaaagaaaauugcuuucuaaaaagaaaaguuuucaguuacuugggagauuguaaagugauuggaucuuuugccaaugcaaauucuaagugaacucaaauacuuuuucuuacaauuuuuuggguucuuuguguuuugugguugguguguuuggguuuguuucuugagacagguuuucacuauguaauccuggcaagcuugcuugccaucuuccugccucacucuccuaacugcguguaccaccacacccaauacccuaauucaaauaguauuaacucuuguuucugugaucaugcugacuuuaaguuaauauaguaagaaaggauuuucaguaaaaaaaauauauauauaacaauauuccaauugucuauucagauucauuaugugcuuuaaagauuuauucuuaagcucacuaguucuagcuauuguacaagauauaaaaaccaaauauuuagguacaaaaauauuuauaauuacuaguagcuccaaguuauauuuuuaaauauaauucuuaaaauuaaauuuaaauuuuuuaauuuauaaaauuauauuuaagcauaauuuuuaaaagccagaacuccaacugaugagagaguaauagaaauuguuauuugaucuuuguucauauauaagaucuugauaguuuacacugacauuggcauuuuuaaaaauugugugugcauguacuuggugggagggugagcucgcgcgcguaugugcgccugcucacucccacacauuuauacacuugauauuucauauaggauaacugacagaaccuucuaccuuguaggucuugagaauugagcuuaaguaaucauaaucagccuuaccagcaagccuucacuuucugagccaucgaaugggcccuuuuaauuugaauuauuaauuugagguuguugcucaaugauaguacuugccuaacaugagaaaaacccuugguuugaucucugguuccacaguuuuuuaaauaguuuagcuuuguuuuaucaaauugauuuaagaccacaaaaaaaaaaaaaggauagcauuacauguaaauuagauuuacuuaucuucuugaaucuugaagagaacuaaaggauaauuauaugaccuauucucucauaacuauaaaguuggcuugauaauuguuuuuuaacauuugaaauggagagaagaauguaacagccauucaugaauuugauaauaaauuaucaugcuauaauuuuuuaaugaauuuaucuuaaaagaugagcucucaagcuaggccuuugaucacagcacgcgggacagagacaggcagaucucuggaaggaagccaaccuguuuuacagaacaaguucuagaacagccaggccuucagaaacccugucucagaggggcaccgaaguaagcuaucaaagcuaagaaaauggcuuagugggcaagaacacuuucuuuauaagccuaaagacccacauuugaacaaauugaauucccagaauccauauuuuaaaagccaggcauggauucauauuccuguaauaaccacuuugggagguagaaacagagcuugguggcuagccaaaauagugagguucauauccagugggagacugucucuagguacaaaguggaagcacuaacauaaaacaucuaauguccucuggcuucugcauguaccgguacacucccaaccacacauagauuugcacacauaugccacacacuaccagaauuaaaaaaccauaugugaauuaucagguuacuccacuguuuuauuauuauuuaacauauucuggaguuuuuagcuauaagcauacuugccucuuccaaagggaaaggauguauaaguacuaguaaagaggggugacugucaucauaugcaaguaauacaguuagauuccuagaacagcugagaaaauuggcuggaaccaauauguaaacauuucauuauaacauuaagauggacaaauggagaacaugggaaacgaaggcucucgguuaugaggagggaaucaaggcuugaauagcuaaaagaaaucaugcauagucauuggugaggguggucuccccgaguuauauuaccaaaguacugagauuagauugucuaauuauuauacuucauugauaagaauauugugcuagucuuuccagaaauauuuuggauagaguugggaacauuucuagccaauuuuuaaaaagacgaaauaucaguauugcuagaugugguaugugccuagaaucuaguacuggagaggcugagaaagaaaaacacaaauuugaggccaaccuaggcaacauuacaagacucugucucaucacuaggggggagagcauuguagcucaauauuaaaguacuuuccuaaaauauacaaggaccaaaaaaauguauaauaauagucuaauggagaaaagauucuuuuuaauucaaugaagaaagauaagaguuguucaaagguaguaggcauuugcuacuagaaaggugggguaggaaucaaugcucuaaaguuaauugugcauacuucuuccuuaagaguuuaaguauaacuuagggggccagggggaugacucagugaguaaaagcgcuugccacucaagccugagaaauucagauuccagaaccguguaagugugacuaaucccagcacugcuguggcaagaugagauuguggagacaagugaauaggccagaggaacacaagacagcuaaccuggaauaugguuuucaguagaggcucugcuccaacaaggaguacaccaacucuggccuccacacuuuagguaauacaaacauggacacauuuuuuuuuucuuaaguguaaauuagggaaggacuauaacuaagugguagagugcauacacagcaugugugguugucccucaguucauuccucaaacaagauaguauuggugcuuuauacauacugucccaaaacuucaacagugaguacuguugcagccuagacuacauucugggccucagugagagacacaaaacauaaacauacugacuuauagacaaccuaggcucaaucaacccuugagacccccaugguaaaggagaaaaucaacucaccaaguuguucuuugacuuccaacugcauggcacagccugcauguaugcauacacacacacacacacacacacacacacacacacacacacacacacacgcgaaauaaaauauuuuuaaaaacuaaagaauuaaauguuaaccuaaagguuaaaacuaaaggccaaugggugguauuuucauaguucagggauagaauugcaaguucguuaguuagauucauucugcuaauuaaagccauuaaaacagacgauuaaaaaaacaucuuuagauuuaauuuuuguauaugaguguuuugacuauacauauguauguguaccacauguuugcguggugccaauggaguucagaagagggcauuacauuuccugaaauuggaguuauagaugguucugagcugccaugugggugcuagcaauugaaccugguuuuucuguaagaguagacaguguucuuaaucacugccaucucuccagcccuguuaaauacauuuuaaaaacaaacuagccaacggugguagcacaggucuuaauccuagcacuugggaggcaauagccaaccuggucuacaaagugaguucugggacagccaaggcuacacagagaaacucucuuagaaaagccacuuuaaaagagagagagacuggggcuggagagauggcucagugguuaagagcauugacuauuccagaggucaugaguucaauuuccaguaaccacaugaugccucacaaccaucuguaaugggaucugaugcccucuucuggugugucugaagacugugaucauguacucauauauauaaaauaaaucuuuuuuuuauaaagagaaacugaaaaggucaauuuuuaacucuuaaaaccagcauacugauacaguguaagcuagacauugcaaaucauucacacaauuaaauacagagguaguaagcauguguaaguguggauguacaugcauggagaccagaggaauugaucagguauuuuguucuucaugcuguuuugaaacauugucucacugaaccuccauuaggcuggcagccagcaagcucccaccccagcacuggaguuacaggcuaaaguacagcuauagcuggccuuucgugaguauuggugauucaaacucacauucucaagcuuguucaacucccaccuuaaaguugagagagagagagagagagagagagagagagaguccuguaguuguccuaacaaauaaguagagaaaaguuuuuuaucauaguagacucaacaauugcaauacaggaaaauacuuaauaauucaacauagguuaaauuuuggcaauacuaaugucacauacccauuuuuaaaagguauucauaaaucggguaugcuaacacaugccugugacaggaggaugcuaguuugaagcuagccuggauuacauggccacuucaaggacagcuuaguuuacaaugauaggauccuauuucaaaaacaugcuaccaccaaagaaagaaacauacaaaaauuuauucacuaacagaaauuucugggaaaucauuuuaauuuauguauauauaauggguagcauggguuuaaauguaugaguuugcauaaucuugagcaguauugaggcaggguuuuaaaaaaugaguguguauguuaauauauauuugacaacuauaccaaaaagaaaacaaauagcaaagacuaccaacugaccuuuaggcaaucgcuggguuuuuaaauauagcaucuuaaguguucauugaauaucaaauauagaucacauucauuuauguaguaauuccuccuaguuuuccuacaguaauacacaaaauguauuuagcaguuacauuguugaacccucaguacagaguucuuaaagauuggcuuugaagucuuuagaaaugcuuaaaaauuauuuuacagauuagucuugaauuacauguuuauuuguuuguuuuguaccuaggcacauuaaaaaggauaaaacaucacaugcuauaaagaacaagaggaaaaguauucuuucaauguagagaaaugaaaaauccuaagaaacaaaaaaaaauuuauuuaaacauaucagugccucacaccuuuauauuggcuacuuuccuaacuccaguagguuugcacuuggaguuacaucaccagagaaaucuuccuaagcacaucccugaucucgggccacauuugccuggcaugauugucguuguuugcaccaagccauggugcuacaguuuagcaugcuuuuauuaagaccauuugccgaaugacuggagaugaauggccaauugguaaaagugccagucuaagguauaaaaugccccagauuugaucuccagcaccauaugaggcaggugaccauggacugggugcuaccaugucuagucuuucuauaugcaucagaaucuucaucuuugauacagggugauguuaauaacagaaaugcuggauuuauagauaccuuaauuuucauaucaaacacaccacacagugccugguaaacaucaccuuaacagugauguucuuuuacuuguuuuauuuucuaagaaauggaauucauaguguuguucgggcccaagcuagccuucagcucuuggacuuuugagcaguccuuuuacuuuagccacccuaguagcugagacuauaguucuuggacacuguaucucacuuuaccuacuuugaaggguauuuauguguuuaucaucauuccugaggggccacacuacacaugcagacuucagaagacaacuuuuggaagucaguucucuaccuucaugugggcuccagguuuggauaacaagcaccuugucaaauaaucucgaaagccucuuuguaacuauuggagccacuuauuuacuuaguuauuuuuaugcagggucucacuaugaaucccaggcuggccuagaauuugcuguguagacuaggcuggccuagaauuugagauaauccugucucugccucagaagugguaggguuauagucaagcuuaaccaauaagaaacuuaacauuaaacauuauuuugcauguuuucucuaagcucuuugaaaauagaaugugcaguagcccuuacauacauaccauugccauauagugcauacuaaguaaaugaaugaucuuuaacuguuuacucacuuuuacuuaaguauauuuuuccucugagguguguuuuguuccugaagauccucuuaaaaacaagaaaugauaguacauaaaauauggucaguaaaauacuuaauaauaaccugcuuuuuaaaauggaccuaagaaugcaguuagccuaaucaggagucuuguuuuggguuuuguuuuguuuuguuuuuuuuuuuaauagaaaccauuuucuuuucuagacccuaguguuuguucaguauuuggacauuaggagcuauaugaggauacaagaucaagugugucuccucuuacuuaugaguguuugcuagaagagcugcagccuagcaagugauaauguagaaguaaagaguggguuuaacagcacaaguuuaagauucucuaaaucucaguggaaggaaaccuauauuucacuccagaagaaaaaguagugaaugcccuuggcauugaccauuaaaauugucuauauucauauugaguuucucugggacaugaaaugcuucauaaguuguauucauggaagugauuagacguuuguuuaggcagccaggcaguaguggcaaaugccuuugauccuaggcaaaggcagguggaucucugugaguuagaggccagucugaucuaaaagcaaguuaugcgagagccaggguuacacagcaaaacccugucugaaaacccccgcgucucccaaaaaaguauguuuacacuuuuggccuaauuagcagaggguauuuaaugggaugagauauaggaucuguugcaaauuagagguuagugccuuugcuaccuagccuucaggaagauaugauucagcucucaucaaagcuuuguguuucacagacuuacugagcccauuaaagaaauggaagucucgcuaucugauggagcagaauaucaccaaguugcuucagccucugucuccaguuacaccacccccacccagcucaggcucaaagaguccccagcugaccacaccuggccagacucacccaggagaagaggagugucgaaauggauacagccucauguucucaccaaucacaucucuuacuacugcuagucguuccaacacuccucugcaguuugaggugauugggguuuuguuguugggacugauaugaaaaucacuguuuauaccucuuuauuucaaauauaauauaauuucagguguuuuuaacugucuucguucaucucuaugagaaccauuagccugggguaacugggcuguggcuguagccucuugucuuggcagccccuguucugccagaguaguaauaguguugccgugaucccuucagcuuucuuuucacagucaguccuucaaucauauuugagugagcauacaagaucauuaucuuuauuaucuguguuggucaacagaggugcuugggugccugauacccguuaguuucacaagccugggagcucagacuacacagugagcucacaucuguguaucaagaccugccuauaacuauaaaguggcuuucccagguucuuugguggcucgccuguggccagggaaacagggacuuaggaacauuggguuucuaaggaugguggcggugcuguugcuguuuguuugcuuuucuacuucagcugauuuuauuccccucccuguuacaguguauuaggacugaguagacuggaggcuaguaacacacauuaauuguuggauuacauuagaaauacauguauaaacuguuucuaaaacuguuauauucaaucacuuugauauugaaguucaaguggcaaguaugaauauauaauccauguguuuuuaaaaacucauuugcauguuucuuuauuuaaauggauauuuguggggggggggaagaggacuugaucuacccacuaaaccucuggcuuucacuuuucuggauguuguguugaugaaguugaauaucuagcagaucacacuucucugaagacuuuuaugacuguaaggauuaacaaugccuggguucuaaaggcacuagcaacugaaaguacaugagugugcugcucugcuucuaacucaguccaguagugacuuacuguagagcaaaccuugguauggaaaaaacaucauccugguuacauuuuuuuucuagguaaauuaucauauuucuguguccuuuuuaauugguuauuaaagaagaauucagauuuaauaguuaagcuuuuguuagcaauuagaauuucaugguaagguauccaaagaaaaguugucccuguagugcaaucaguuauggagauagaguugcaccuuuucguggcaaguuucauuauuaauuugaaauuacagaaauuagaagucuuccaaaauaauuuuauauguuuccuaccacugcugcauuuuaauaacuauaaaacagcaugcaaaugaaagguauuuuaagauagagaacauagauuuuagugaaucucagucuaagaauaauguuuaaacaccaggaagcaggcuagcucagcaguaaaggcacuucugcaagccuggcuuccugaggucagucccugcaacccaugugguaggaagccaacuucacaagugacuuccccacauagacauaaaauaaaugugauuuuuaaacauugaaacaagggacuaaagauagcuuagcagucgagagcuugcacuacucuugaagaggaccagaguuccauagccagcacccaaguugggagagucacaacgauuuauaacucuacuucuuaagaggugaaacucccuauugucucuuccucaggcaccugcacacaugugcaaagacacauucaugcaucauuuuuuaaguaaguugaaguauuuuagggacuagaaaauggcucagccauuaagagcacuuggugcucuugccaagaacugggcuuugauucuuagcacccacaugguggcucauaacccucuaacuccaguuccagggauccgaugcccucuucuagcuuccauagguaccagacacauugugcacagacacuuauaugcagguauaaaauaaauaaauaaauauauauacacacacacacauacauacauauauauacauaaaaaugcaaaaauaaaauaauuuuuaaaagauuaucaggaaggaaagaaaguagcgaaaauuuuaaauacaugauuauaaaguacuaauuuaauaaugcaacgucaccauucucauaaaaacagcuuugccauccuaccagucauaccaucauucugauagcaaggcucuuuccuguuuuugaguacagaaggguugguuugcaaccuuuuuuucaucagaaacuauagcaggggguugggugcuuuggguauacaucuauuauuugaagacaccaaaaguuugagcccacucugagcuacauuagcaagacccugucuuuuaaaaggaaagaauauauugaaagaugauauaauacaaauuuuauuuccauauuguuuuuuaaacauaaaauuauuauuugaaagaagaaaauguugaaauaaacuugucuguuaaacguuaaaaagagcugggcgugguggcgcacaccuuuaauuccagcacucgggaggcagagacagguggauuucugaguucaaggccagccagggcuacacagagaaacccugucucaaaaaaccaaaacaaaaccaaaaaaagcuaaaaaaaaaauauuaaaaugcaggcuagagugaugacugccauuaagagcacuggccauucuuucagagaacccaauuuuuaauucccauaacacccauaugguuccucacagcuaucuguuacucuagucucuagggauuuaaugcccucuucugacauuuccuggcauugugugcauguuuuacacaggcacacaggaaggcaaaccacuuguacaccuaaaguaaaaauaguauuuuuaaaaauuugugaaaaauaaaguagcagugaaauaucaauaagugucaggaguaaaaccagcuccaaguggaaaggaaaaaccuugaauaagaagcguguucauaucuagaacugaggggaugagguacacagucacagagaaggaggggaaagaaucuagaagaaggaaaacaagagcccugugcuuuguacacccagcacccuccccauucuaaaacauugcuauccaccuuguuuugcugaagcagcuccauuuauauauccuagcauagcauagcccacgucuguuuucugggccucaguuguugauagucuguauauugagaacuuucccuuuuccccagugccugguacagaguccuugucauagcugcuaucaucacuuucauguuacccuucacaccaucaccucaagagcucacucuccaguucccauguguuagagagguauuaccucagcaaaauguucuguccuaugaaagucacagaaaaaauacacauauacaugguauuggggugggagggugcuuuguuuguuuugugauccaguaaguacaauggauuuuuaacucuguuagaugugugcagguguauaacagucacuugagaggaacugaucauaguucacagguauaccccuaaagcuaguaagagaauaaagaaaagaaagauuauaaucagaggaaguauggggugaagaaacagaguuccucuaggaagaauaaggaguagguugugccccaccauaagaaacacugugagcccucuaaaaugauucaccuaauucuuuccugaguucuaauugagguguucauugauagcaugaaacauuauaaguccuuucuaagguaccaggaagcauuuagcugaacuaaccacuuuguggaagugaguucugcaguuaaacauuuaccauaugcauaaacauuaaccauccucaccaccaaaucccucccuaaaaaguguggcaaacagccaugcuuaucguuacuuucuguuuugcuucuugacucugagaagauaaauaacaagauacuuuuuccuccucuagaacaucuccuccccugaggguuccccugcacauaggccuaagccccugucaccagagguaguuaccauaccaucucaaucacaugcaggcugagagugagugcacaagggugguccugaauuggggggugagggggcuggacuggaggguggccucucauucacagcaaauagaguggaucuuauauaaaaacugacugcacaggaccguggggaaaugaguagcuguuuuuauguugugggguugcuuuuguugucauuugggagaaggaauggcugaagaguuucauuaaagagaaucuucagaggauguagauucuaugugcaugagagcauuguuagagaaagucaugaauaacauccuccuguuaacaaggaaacuggaguuggucgacacugucucaguaucaugucagcaauguauaauugggguuaaacugacagcucacacggcugggugucugggcuuugggugacagaugagcagcuuccuuuagggaauccagcguucucuggcuuuccuucauuuccucuggagugccuaguuggguguaaguauguaaggaagcuuaagcccaagcucuggguuacaaaccuucucuugugcagaggcugggauacaguuugugugcagugauuuauaccucuuaggauaccaauuucaguacuuugcuaagaaacccuccuacccuaaagauccaaaaucaugauuucaguguuagcaguuauaauaagcuuuagacauguaauuaauuauuaacccuauaaaucuacauggagcuuuuuuucucuguaccuuuucaaaauuaacuggccuuuagucucacuuuccaaaauaauuagggcccuacucccugacuaaucaccaaauucucagucaguaggauauucuguagaucaucaugaaacugaaaagauuauauuccacuaguuuauuguuaacuuccugaguauugugaguccaucuuguugggaaaguauagauugcucugucuuggguugcuaaagauucaauauuagaaaggcuuugauaacugaucugucuaguuaagggaauguugguguuaagcgauacagauaagcaguaaugggucgguuuuaucacuggugcauuucagccuuugauaugcuuuuuggcgguaggcuuuagcaguucuuugauagauugauagacagcagaggacacggaauugaacagacagaauguugcaugagaaacauaauccaagguacaaguaaauaaggaauggauucguugcaaccuuuaaugcuauucuccuagugaguaauuuaccaugcuuggcuuuucaacuaccuccugcuuuucuccaccuucccuuacaccuuccauugaaacuaauuuaauaauauauaacaucagaagccagcaacuuaagaccuuucuguggugugugugcuuggggcucagauacaucccuggcuacacugccagccccacauaugcugucaaacgaugugaugaaggcugagcagaguagucauguuugcagaauugccugaugccuucauucccuuuuugcccuuugacuuuuucuguuauaccaugucccauaucucuguugauuuuuauuucagcuuugucaccgaaaagaccuagauuugacaaaagugggauucccagacuccagcacucacagcugcgcugauaggcccucccugcuuaacugcaaucauccugaccuggcuucucaucccucuguuguucccaccuccgaggcuggcuucccaagcaggaguggagaugguccucagaccuugcugagaaacucagaccaggcguuuaggacagaguucaauuugauguacgccuacuccccuuugaaugcuaugccucgagcagauggacuguauagagggucucccuuggugggagacaggaagccuuuacauuuagauggaggauauuguuccccugcugaaggcuuuuccagcagauaugaacauggcuuuaugaaagaccucucucggggauccaugucaccugguggugaaaggaccugugaaggagucccaucugcuccucagaacccaccgcaaaggaaaaagguaaguauucauguuacucuuuuaaagaauauuagucagauaauucagaacuuucuaagcuccagugcauaacacuuguccuacucuuugcuaugaccuguaaaaauuaguucuuuuauuugauuacauuacuucuuuggcuuaugugggggggggggggcaugaacaugccaaaagcacauacauagaaaucagauuacuugugggaaucaguucuuugcuuccaccauguggguccugggauugaacucaaguuaucggucuuggcagccacagccuucaucaauugaguagacucuauuaguauaacuggaaaguguugugaauagccggcaggacugaagugcagucaguaaaagaguguagccaugaguaaggcuuuccaucuuuagcaucccaaauacaaauaaagcaaauaucuagcuugccuuagaggcacaugucugugaaccuagcauucuggagguugaagugggauuagaaagcuaaagcuaucccagguuuuuuaaacacagcaaauuuuacauaacuguuguaugcaacugaaaggcuagcacacuggaagaauaccaaaagcuguguuacucagagaacccaguuuggggcauagcuuuaagaccaucagauguguuuucccaggcagauguaguuguucauguuuguaaucccagcacccauucaugauguugaggcagaaggauugagaaguucuaugccagaggccaaagagcugggucaucaguuaagagcauauacuauucuuccaaaacacucaaguugacuucccagugccugaaguguuuaccaaugcuuagaacuccagcuccaggagaucugaugaccucuuugaccuucaugaguacuugccaacccaagccacauagaggcccauguuuuguuucaguaauucauuuuguaaucacagcgguuauauaauuagggaauguccuuaucuugcacaugagaaaacugaagcuaguuaaauaacuuguuaaacaacaacagauaaacaaaggaguaaaggcacuguccugauucugauuccagauuacacaaucuaguuguuaauauuauaugauagauuugauugccuccuagagucugcacuaauagagccucccuagaaaauugcacuaggagauucugaauuacagugguuguaguugcuccaaaggaguuguucacaucuuagcagaggauaaguuaaggaaugaacaagaagucuuuuauuucgcuuauuugagggguagaaauggaaaggcgguagguuuagccacauuucaaaugauguguaggaaucagccugcgcaucaagagggagguguuccugcgcagucagucugugauacuacacugggguacagauggguucugauagcuggcugcaguuacaaugccagggagcaccaggaagcaggugcagagagcaguggguagaucagaccuuagagaucuugccauggccuggggcuuauaaaacucaaaaaaccuaacagcugcuuuuccccccuuaaauauuguuuugggauuauuuuuggguugucauggugacuuggaugaauuuauuguuagggauucacaaagcugaguauacuauguaugacagucuuacagagaaacuaguuauauccucauagaaauaaaggcucgugacuuuauuucaauuauaauaauguucauuauccaaguuuauuaacuucuccaauauuauauguaaaaaggcacacacaaaauuauuuuuacuguuauuuuugugguauuucacacuuaggcagaaaauuaagagcaccuuggauaggaaaaggaaacacuagcacacaauaggaugacaauggagcucuuccuuacaugagcaguacugacuuugaaauuguauaacaugacauaucuuugcaucucuaguuuuauuuguuacauauacaaguaauugaaguuagaauuuguuucagaaauauuucuaaaauauuugggcacuugugauuuuuguacuaaauguuaacaguaaaaaaagcuaaggacuggaugacuggagagauggcucugcaugaaaaagcacuuacagcucugucagaggaccuaacaccuauaugcagcagucacaaacaccaauaacuccagcucuaaggcagcccacauccccuucuucccucugaaagcacauacauauggguaaauaaaauauuuuuuagggcuaaacacauugccaagccuggcaaaucugaguuugauccuaaagacacacgguaagaggaaaacaccacuuccccagguucuccuuugaccuacauacaauaguuaauaagugggguuuuguuuuguuuuuuaauuaaauuuugauuaaagcuaacuuuaauuuuauuaaagcuaaagcauauaugugauaccauauaccugugauaucaggaccugggugacugagguaggaagauccuaaguccaaugccugccugagcuacaaagauccugucucacaaaaaugaaugagugaaugauauaauuuacagauuaaccaaaaaaaaaccaagauucuacaguagauuuaauaggcaauagaauacaguaguggauggauaggaaaagguuuguuucugauagcaggaugauauaugaguaaauaauuagaagguaguuugaggauugggaaaaaguuucuagguuguagacagguugcugaaguauauaaacaaaauaauuucuucuuacuuuaguucuuuaauaccuuucuucccuuauauguaauacagauagucuuaaaucccauaguaugucuucaaauuuugaauauuaugaagagcccugaaauacuggcuuuuuccucuuggugugauagcuuauuuauuguggauuauuuuuguuuguuguuaauggaguaaguguuccuaaggaaugaagaacuuuuuuccaggauacaaaagcauucuguuuuuucugccauacuuuuuauagaugcccccauuuugguauauaacugauuguagguuaccaaggugauaguaaucucacaaguuucucugaagaaaguaaaaggauauagucuuauuugagcaccauuguuugauagaauauuuuuuguccucaccaguuucugaguggcuugagucuguagcacugcucagaucucuuuuauaccuaaaaaaaagauuguuauauagggacuggaaaggucccucagugauucagagcucaguucccaacacgcacagcagauggcuacaacugccuguugcucuccucuccaguaguguuccaacuccugcacucagccugugcacacacacagcuguaaauacaguaaaggcuauuacaguugauaccuaagccacucacuaaugauacauuuucuuuuucauaucuagguauccuugcuagaguaccgcaaaagaaaacaagaagcuaaggagaauucuggugggggaaaugacucuucacagagcaaaagcaagucuucaggagcugggcaaggcagcaguaacucuguuucugacacuggugcccauggugugcagggauccucagccggaaccccgucauccccucacaaaaaauuuuccccgucucauuccucugcaucgcauuuggaggcgguaagcccgucagauuccaggggcacuucuuccucucacugcagaccucaagaaaacaucagcaguaggugguaaguuuauguuuaauuagcuuuauaauuaaauucaggugggaaguuacacauucauuuccaguuuuaccugaaguuuuuggagcacuuaucuaagacaggcagguaauuugccaucuguuuguucagcuaguuaguguaagccaaaucuucucccuucagagacucacugaacagugagguuuuggguguccacgcgcuauuuuuuuuuuuuuuuuuuuugaugagagguaaguaaacaguccagccaaaucgcuccccucccccaccccuugugugcacguucauauaugcacucuuggucacucauacaugcauauggaggucagagaacacuuaaaggaaauaguucuucccuauuuaaaggaaauaguucuucuggagauugaacucagaucuucagacuuaaccuuuaccuacugagccaucuugcugacucugguuuucucaaauugaaaaagagcugugucccaugcugcuagcauauacagagaaaugcaagacggucugaaaagaguugucuaguuuagaggcuggagaaacgacucugguuaagcgacuaacugaucuuccagaggagccagguucaauucccagcacccacauggcagcucacaacugucuguaacuccaaucuuugacacccuuauacagacauacaugcaggcaaaacacuagugcacauaaaauaaaauaaaauaaaauaaaauaaaauaauuaccaucucacaguuuugugcuggagagauaguucagugguuaagagcacugacugcucuuccagauuuccugaauucaauuuccagcaaccacauggugccucaccaccaucuguaaugggaucugaugcccucuucuggugugucugaagacaguuacaguguacucacauacauaaaauacauacauacaugcaugcaugcaugcguagacuugucaagguuagaagguaucauaaaaaauaaguaauauuaaugacaaguucucaguauugaaugagauaguuucuuuuguuuuuuucuuuugcaauuuuuugacauaggucucauagccuugaacucuuugauccaccugucucuucuuucuggguccuaggguuauaaauaugcaucacagcuaggaguacagcauucauucuuuucuuuuuucagagguggggugucuacauuuggagacucgagaccaccuuacuuuaugauaaaggaucgcucacugaaccuggagcucacugauuaaucccgagucucuggccaguaagcuccagggauccucaagcaugggaucuugaaaugagccugggaaagaagauacaggucucaaaguauuauauucuuuaaucucuaagaauccuauaaaaaacuauuucaaagcugggcaugguggugccuuaauuccagcacucgggaggcagaggcagguggauuucugaguucaaggccagccuggucuacagaguugaguuccaggacagccagagcuacacagagaaacccugucuuggaaauucaaaaaaaaaaaaaaaaaaaaaagaaagaaagaaaacuauuucaagaacacaguuucagaggaggaaauuucacauucagacagaguuuaaaagaaguuaauaucuuuaaucuacuuuucccagauugcuuucucacugccccuacuuuuauacauugcauaguuugaagcagaggaaaugccuuguucucaguagguccuggagaaaauaguguaaggaugguuuaagagucuguacuacaccaucuuuaucauggugauuuguuucagacucuuagcccuuaaucucuguggcuucuguaccuuugcaggaugguuccuacaucaguugaacgacuccgagaaggagguagcaucccuaagguucuucgaagcagugugagaguugcccagaagggagagccuucuccaacaugggagaguaacaucacagagaaagagucaggugagcuaaggucugcaguucacagcaaauguugggauaaaguaaguuaguuucugaccuacucagguucugcuuuaugcuagcuuccagcucagucuuacucuuugggcuacaguauacgugagaucuagcguugcuugcucucugucugcucuuuucccaagggauacuuuucuguaacucucaucuccaauguuccggagcuccaccuucaugaaggaugaagagaaagaaggagacgagaauaagaugaggcauuuaaaauuuagcgcauaauuaaccacuuacuaugcccuucuggcaugcugcgcucauuuuuucacagagaucagcauguauugaugauuugacugaaugauaccuauuuccuauguguucuaagaagccaaguugauucuuguaaugccuuccagacccugcagauggagaaggcccagagccauugagcucagcacucucuaaaggagcaacuguuuacagcccuuccagauauagcuaccagguaagucaagagacuucugggcucuagagaaagaagugccuguggaguucagauccuguguuccuagucgugacacacugucagcugcuaaagucugcauaguauagcccuguaagucaggcaucugcucaucugcucaccucagggaucuuuuuuuuuuuuuuuuuaauuuauuauuauauguaaguacacaguagcugucuucagacaccccagaagagagcaucagaucucauuacagaugguugugagccaccaugugguugcugggauuugaacucaggaccgucagaagagcagucagugcucuuaacugcugagcugucucuccagccccaccucagggaucuuaguaaagcaaaugcaugcaucagaaacugauguuugacugcuuuuguuagccauuaaaauguucugggggaaggaggagcaggcuaaugauggcucagugagugaaggcuaucaagccugaugaccugaguuuaauccccagaacccacacaguagaagaaaagaauggacucuuacugguuaugcuguguacuccacauuacuguuauagcacacacacaaccuuuuuagugugcagaauaaaagaauguuauaagcaggucaaguuauugaagggacuaaguuaaacuuccuuaugcuuuucucccaacucuuuuaagcuccugcagugugacaguccacggacagaaucacaaagccuccuucagcagaguucgucccccuuuagaggacaucccacccaaucuccaggauacaguuaucgaacuacugcacugagaccuggaaacccucccucucacgguucuucagaauccucccucucuuccacguccuaccccagcccugcccacccugugucuacagacucguuggccccauuuacggggacuccaggguauuacagcagccagccgcauucuggaaacagcacuggcagcaaucuuccaaggaggagcuguucuucaagugcugcuagcccuaccccacagggccccucagacucaccgaccucagacucgguuucucaguccagcacaggaacucugaguuccaccuccuuuccucagaacucuaggucuucauugccaucagacuuacggacuaucagucugcccaaugcugggcagucagcugccuaccaggccuccaggguaucugcgguuuccaauucacagcacuacccacaucgugguaguggggguguacaccaguaccgacuccagccacugcaagggucaggagucaagacucagacaggacuuuccuagggcuucuggauaugggcaaacugaacuuaaugagcccauagcugcuuccuuccagcugccucuggaaucaaggccgagcauaucgcuggggaagagggguacaaggugccagaggaaugggucuggucagcaagaaaugagacuuguggucaugacuggccuccggccuuggagaaagauguaaaucuugucugaagcagagacuauaaagaaguuucucccugcuguuaaggguacauuguuaacaagcaaaugguguuucgguuaguaacgguucuaagugcaaugacuuguguugaagccuaugucucccauccuugccuguagccuguagucacuugugcagugaggacaucuuuuucaauaauuuuuuuuuuuuucuuuucaaaagaaaaaagugggaaagagccaaucuuaaagccccaagccaucugaguaguguuaggguuuuaugcacuuaagggaaaaaaagguagguauguaaaugucugcugugagacaaccauuccuaaugcagaugcauggucaagguguguccaccuggagugcucccugccuuugucuuaaagccaccaggaaaugggcagggagaggaaugugggugccuacucugacugaggcuugcccggcucucugagaggaggagcuccuggguauuugggagcagauuugggauggacugggcuccagcuguuaccauccacuccuccuuccaaguuguuucacaguuuaaugauagcccugugaaguagagaagugaggcaggccaguuuaggaaacauccaguggucuggguaaucuuugaauuuuaauuuuccuauucccaguuaaucaggaguugcuguccuaagagcaggacggccuccgugacugaaaagcaugcacucaugacugcaggguaagaaugggacagauaggguugcggaguggcaccgacagggcugugauuguguguggggcauaccugccccacguuucuauggggaaugcuuauaugacagugagcaggugagaguuagcaagucacccauaccccuaacacuguucuguaggagagacaaagagcagacuggcuucuccccaucagugcauugugccuguuguacaccccuggaggagcccugaagccagcccaggugggguacacaaucuuuuuaaauuccauaugguugccagcuuauuucuuucacuuguuuacuguaauaccuggcguguuuuuauuuaucuaauuuuguauucagcuauaaccaugguaggguagugaguguaugacagugugaucccuggugcugcaguggaccguacuucuuuuggacaagauauacugugagucucccuccuuaccucuaauuguuuucuuucccauucccuagacucuuucaucuccuuuucuacccugaccuacaacuaucauaugcacagucuucucucuuugugugugacuguuacaaauuuucacuuuucaaaauugaaaucagguguuugcucaaaugaggggagaauuuuuuuuuuguuuugguuuuauuuguuuuuaaugcugaacccucggcauaguacuuucuguuguuuuccccacaaacccaucagucugggagagcauugggaguggaaaucauguugccugggaugcugguuucuuuguauauuauauaaaacguauguaaaugucucuccauuugggcugggguuugcauucucccauuggcuaaaagccaaggggagaggccagcgggcaggcggcccucacccugccuggcacgugcagagaccccagccacucugugugggcagggugcugucaagaccagaccucugggggggaggguggggggaggggggacucuuggaagggaaggagcaccacuucuuccucaaguggaguguuuacaccuugcuguaacauuugaacuuucacaagagauguaauaauuuugauaauaaaauucuuaaccauaaucaucauaauguuaac

SEQ ID NO: 3283 - RNA, 97622 nt, Mus musculus
gguguguguguguguguguguguguguguguguguguguguguaguaaaaggaggaguaaagccgugguggagcacgccuuuaauuccagcacuugggaggcggagacaggcagauuacucaauucaaggccagccuggccuacaaagugaguuccaggacagccggggcuacacagaaaaaccgucuugaaaaaucaaaagaaaauaaaaaggaguaaagcaggacaagcuggguuugcuaguggauccaguauucuguagaucugguagguuguucauugaugggaaagugaaacuacauauuuuuuucuuuuucguucuuucuuucuuucuuucuuucuuucuuucuuucuuucuuucuuucuuucuuucuuucuuguuuuuguuguuguuuuuucaagacacguuuucccuguguagcccugacuguccuggaacucacuuuguagaccaggguggccucgaacucagagaucugccugccucugccucuggagugcugggauuaaaggccugugccaccacgcccugcaagacuuuaucauuuuaaaguccucauaagaguucccacuuuguuaaaaaaaaaaaaaaaaguuuuucauuaauuuauuuuuccuccccucuucuccucccagcccuacucucucaauccccccuuuuaaauuuuauagucauaagaaaaacugauuuaagagaaaauucaacucacaugcagacggaaagauccaaucauaaaauugcaauuuuucccccaaccccuuugcaauuuuuuugaaggguuuuuguuuuguuuuguuuuuuaagacagggcucacauaucccaaauuugcccaaaauuugcuauauguaacccagaauaaccuggaauucugauaauucuaccuguaccuccaaaguccuaggauuauagauagccucauaacaccaugccaaauuugugcaaggcuaagaaaacucagggcuuuguggugccaggcaaguacccuaccaaauuaucucuuuguacaaauuuucucucuuaauucaguuacucauuagccuacuaaagaauuuucagagcugugcuauauguguuaauuuccauuaucuaaauacaggguugaacauaaugcuuucaguaauauauauguguaagaaaccugaaucuugaauugugucccaguuuaaggauggugguuuuaaaaagaaauuugguuugaggcuuccuguaguugaaguucccuaaccuaagucuuuaacaaggugagaaacaauauuguauaugaaaaacccaguaccuaaacugaaaagaaauugggccuaugaugacaauucuagggaagauuuuuaaauugaauguauauuuaagcuggagucuaaguaaauggauuauaaucauuaacucuaguaagaucugaagucaugcugccccuagaaaaggaggcguuguaccuaacauuguaaagacacuuuguuaauguuuaucuugaccuaagcuagaguagauuuucuuuuuucucuccuagaugacauuguuuuauguacugaguuccauguaauuucagaauucaaaauauaccucucugacccuagauuagucuaaauauuuaucuuuauuuuugugagucauaauugaguaucagauuucauaacaguuuuuauacaagaaacuauugugucccagguuuuucuugggaaacugaggaaaauuaguauaaauuuuuacuguaaaggccuuaucguuaauauguuuagagaauucugcucaucagaguaaaaauauuuuugguguuucauuugaaauauaauuaugagugguggagacuuuaaacacaguuaaaggaaagcagggaagacaaagggcucucuaagaaaagggcuugggaugcgugggguagggauauucccuuuauuuuaucagagacugaaauggaagaaauuugacauucugguggcuuauggggagcugcucagagauugcuucuuggcugaguugcugucugcaaaggcugcuaacaaucgcuugucuggcagcagaucuuguucaucaggauugcaucaucucugggagaguggccaagguccacagccucaguacaaagacugucugaagcauacgaggccuguucucuuucuaaagcugcacucuucuuccugccaguccucuucacaggauugcuaaagcugacuugugcguuucuuucauuggguugacuguuuacuggucucuugucucccagcugcuuccgccucaccugucugauacauuucuucugaaaucuuaaaagucuagaaacuacauauaaaugguaacucucaaaagagugcucaguauuggaagacaggcuggguuuguuaguggauccgguauuuuguagaucugguggguugauaauugauggcagagugaaacuauauuuuuacuuugccucuguccuuccucuuacuugcugcugcugaauacuugacuauuuuauuucuucuuuuuacugucaccuucaaaccuuuuuuuuuuucacuucaaaauugugaauauacuuuugaaaauauuuuucuaaagauuacuuuguuuuccagauuuuuaaaaauuggaaacaugcgcacgcccacacccacacacauaaauguaaagggcaugccuucuaauggauggugacuugugaacagcuuucuuccauguuuaugaccuguuauuauuuuggauauugagagcucauuuuggucaguacuauauuugacuuugugaaauaaaaacaugaauuuaagaaauucugaucaccuacucuucccuuucuucauucucuuuccccaaauuuaauagguucucuauuuuccuuuccuuuuggggauauaguaaguugauggaauugaccccagguagaaccgauucccccugcccccaguuuuuauaaggaauggaauggggaaaagaaaggagucaucauuuaauauguuuugcuaggccuguauccaaaguaaaucugguauuugaugaaaagaggucugugccccaugugguggugugugccaauaauagcacuugggagggucagccaaggaggauacaaguuuaagucugaugugggcuauagcaauugcuuaaaaacaaacaaaacaaaacagaaauguaaaaguuacugaguuuggaacccccauggaaagacaagaaaaacuugagaauccugaggggaacaguuuugauagaagggaagagaagggcaguaucucaucaccuuggaaaccaaggccauuuccuucccucccuuaguuauuuuguguuagauguaaauggaaaguaacaaguaauacagaaauaaaauuauuaaucuguaguguuccacuuuuugagcacaucaauguuucuucauauauuaaacugugucucagccuuuucuaggguuucagagcuacucgcagauaauugggggaccucaaaggugacugccccaaauccuuuucauuuguuauauuuugaauuuuaguaaauguugaacuugguuacuaugaugggaucacucaguaaacauuucuugauuccucuugauaugucaggcauaguauuuaaucauuggaacuacagcagugguuuaaaaaaaaaguuuuguuuuuuaaucccugccauaauuuguguucuggugauaagaguuuaaguaauggaauaaauuauauuuugaaauuauuuuugucuagacacaguucuuacacaucuccaaauuaggagauuaaauuaauaguuacucuagcuaaaauuuagcuugauaaaccagaguaaauguuuucuuacaugagauauuauaauaaaagauuguauauggauaaucuaguaaaaguucuuuaucauuuaaauagcuauauuuuacaucauuuuucagugaaggaaccauauaaagagaguuucguguaucagaauuugaauuaggaaaccucaucauuggggcuugagagauaacccagcaguuaagagcccuggcuguucuuccagaaaaucuaaguuuaauucccaguacccacaaccaucuauaauuauagcuugaugggagcugauacccuuuucagauguacauucagacaaaacagacauuuaaaaagaaaccccauuauuaugauuuaggacaacauggucaagcuggccuauuaagauugccuuuaucagaauaguagcaguaguacaguuauauaacaauuggcaagaggaaaaagaauuuacaaagagaaauuaauaagcuaacuucuuaauguuucuuaaaguuguguaucaacuguccagauagcugguguaauaucucaccacugcauuugagacaaguauguaguccaggcuggucucucuugaaccuucugccuuggccuauugaaugcugggauuacugggugugugugccuagcuauuguguuaagauuucauaaggcaauguaaaaauaauuuauucacucuugagaggagguacuaccugaaguaacuuuuucauuuuugccuuguaauacaucuuuuuuuaaaguuacuaucauagggagaaaauuaacuaugugugucuguagauaauagguaguuggauggguaauaauuauuuuuaugaaucuauuuagcuuaugaaucuauguuagcgguggcuauagcaaagaaucauuaauauuguugaguaauuuuuaaggccuuuucugacauagaacacaugauuugaauucuucugaguaaugaucaucugacagauucuggugguuaucuggucaaacaacuucuaggcuuuucuuaaugcaaauuaucuaacuaaaauuagaagaaguacccuucaaaaugcucuuuggguuuauuugugaguguucucuuuguuuugccauuugaagauuuuugugucauuuccccaauugcuuggguguuuuuugagaauucuuguuuagcuacuugaggggggauggauauuuauuugcaaguugguacaaagacagcaaguggagcagucacacugaucaugaauugugucaagucgauaggaaaguucacuucauuugcauuuuaguuuuaguuuuaacagugucacccugaguuggaugagaacagguauuuugccacaccccguuucaagaggcccagguacuacagaaagcugcuuuaguuuaucgcaucgguagcuuucucaaguaauggugcaaaaguaauaccuuuauauggucuuaauuuuggacuaauugaccauucagaauuaguuuucuuuugccacauuaaugucucauuuaucaaaaugaaauccacaugacucaaaucaguaacuauuuaaaaucuucguuaauugauuuuaguugguaucauauacuuuuuguuuuauuuagcuauuuuuuaauaguauugauaauuuuacuucuuucuuuuucagauuuuagaggcaggguuucucuggguaggucuggcuguccugggaaucacuauauacacuggacuggccuugaacuuaaggauucccccccccccgccucugccuccugugugcugggaucaaaggcuuaugccacccucaccaccuggcugauaauuauauuuuaccuacuguguucacgagagucuuuuuagucuagaggucuuugacauuauauugacuucuaaacacauaaaaugcuucuuguuucaucuuuuagugacucuucuuacauuaguaugaaaccacuaauaugaaucaugcuaauucuguuuuuaccuccaaaugccuuaaucugauuuuuuuccccauauuuacuacucacugauuuuuuuucuuccuaaauaauaccaguuuaugguuaccaaaucaaaguuuguucauugcuuuuuuuaugcaaaauaauauuugucauacaauguuguuuaggauuucuguuacguacauguauacauccuuuuaaagugguuauuaaaucaaaacaaaguugagcaggagguacaaguuucuguauguccucuauauccacacauacuuagcucucucccuccaccccucucacacauacuuagcucucucccuccaccccucucacuuacguuucucuucauaucuaucaguauauauugcugcacaauuguggguuuuagauaauuacaugaucucuaagacuaguuaaaagaagucagagaggguggagaaauggcucagcaguuaauuaaaaacaguggcuuuucuucuacaggaccuuggauucaaggccuagcacccacauagcagcuuacagcugucugaaacucuauucugaggggauccaaugcccucuucuggccccugugggcacuacauacacuuaauguacagcaugcaagugaaacacauagauuuuuuuuuuuuuaacaaagcaaguugggggcauaagaaauggcuaucugaucaaacaacuaauugauaucuucuaccagguuuauuuuagaagggauaagugaguguugauuaaacuaugcuuauugauugccuagaagaaguuuaagugaaauuauuaaggaauaauaguucuaggauucuucugauaaccauccugaaucuuaaaauuuguuugguauauccuagacuacuagaaaagugugucugcugggcagcuaacgagugaggaacaugugcuuuuuaguaagccaguuagacuauuguuuucacuuuggcagaaaagaaaauaaugaaaauagaaauuuaaaaauaaucauaacguuuaccaaucuccuuuguagaacauuaguaaauuaaaauacauaauaagccaacaaacaacuuuuuaaaaaccuuauaucuauucagggagcuagagagauggcucacuguauaaaaagcacuuguacaacuuugaggaccugaguucaaaucuccagugugcauguaaaggacaggagauuguugcuucacaugccucuaaccaauaucagcaggcauagauccuauaagucaauccuaccaacuuacuggccagccugcuaacccagccaaaacggugauuuugcaguuuaguaagagacccuaucucaagggaauaagauuugagagccauagagaaagacagccagaauccucuuguuuccaugugcauacaugaguacucucaaacauacacacuugacaagcauacacugugcagagacaccacaaacacaaagaguacuauccuaacaauacaaaacacccuauagcauuuaagauaaauuuaagaaauucucuagucagugguuauuuucauuuuuuguggcaggauuccucauguccguaacauguuggcugaggcucugcaguucacccccacucuuugaguggucagucuccauuaauuggaccccgugauucccaccuucugcugucuuggacgucaugagcauugcaaucccucugggagucaccacaccagauacuuccuacucagauauggcugcuggaucagaguaagugguauuuccuagauaauaggauugcuacaaguucgugugaggauggauuucuucugggcaguucauaagcuauauguaauauuuucuuaaaaccuaucccacuaaagaaaacauuaggcauacccucccccuccccaccccccaguuggagggacaaagaaauuagaagggggaggaaaggagcuuuuaaggagggauuucuggguaaauagaaucaaaguugcaaagcagugguuacauuuuccuuuguuuuauggguggggaagauugcaaugaaguagguguuaccaccuccuucuaaagaguuaauucugaugaagagagauagguuuucuuuccaacugauuuucuuugaaggccucuuccuauguacuugucauuauucuagaauaaaggggcugaaacuuuauaugggcagacugcuuaaccagcucacugugggguagaaggcauggagagcuguaucaucuguuuuuacaauauucguugccuagaaagaggaccuucaaagucagugguaccaaacuuguuuuucagcuaagagcagcguuaggaauucagaauuuguggaaaggcccaaucccuaaaauagacucaguucuuugaagaauuuaaaugccaaaugacaaugaagguaggccuucauuauacaauucuauauauuauucaguuuaaauuuuuuuagccuuuuguaucccuucucuuuaaguuguccaagauugcccccgcucacagauuccccccucuuguccuuuuaccucccuuguacccaaucuuccuugcuuacagaaaggaaguggaagcccccuaccuuucaagacgaaguggcacuacaccaggaugugaaaguccagcgaaagagacccaaggggccuagggggcagcacacccccagaagccaagucuauuccaggcaguaccagggauuagggucugggcuggaaaaauccugguguuuugaauauguucagguccaguucagacucuugaucccacagccacuucuugagugagguggguguugcucuaauucccguuucucuugccauuuucagucccugggaauucuuuccccuucagcaaagcaaagcgacuguuccagaauucuggguugaauggcgucccuuguuaauagugguuuccuuaaaacugaggauacuauuaaagagcauguauauuucuucauaaagcuacauaauguugauuuuuauuguguuccuuaaagaggaagacaugaaacuacccuaggaaguaauauaugauauucugggguagucuggaauugaaagucauuuuuaagcuuauucccauaauacaaugggaggagggagggcauaggaaagacuaguugucuuucuuuauuauagugguuuuuguuguuguuguuguuguuuuguuggugucauuuggguugguuuuugugugugugugugugugugugugguuugguuuugguuaugguuucugcaugccaacaagauuuaguuaaauacuauuagcugagacuuccaauuguguaauuuuucucuaaaauaaaguacuuaaaacucuucuguguuauuggauagccagcucaauuguacagugguuauaggucuuuauaaagucagaaaauaacaaccuacugcaauguuaacaaaugauguaucaguagaaaguacuaauauauaugaaaaauaaagaggcuaaacaaguaaguuuggaauugguagguaaggaaaaaaccuaaaccaguuauuuuuaaacagauaauuucuucaaaguauaacaguagcugcacauauggucuggggaaucgaggaauaaugcaagaaugaaaguagccuggccuguacuacaacuguagugcuguguccuagaacuuucuaagcuucucauucauugucugcagacaaaauucugauaacuauggucaacaaccaauuucacauuucuuguugauuaguuuuacaaaggguauuaaugucaauaauucagcuuauuugcuagucuuacuaauuauuaaugauauuuguccuuacuucaucaugucuaaccauuguuccaagcauucucaagauuaaaugugguauuaagggcaacauagcuagccaaggaagaaaccuauaccuugccuucugaaauuauuaacucuugauuguaguaguuuacauuuuacaauuauauauaccagguuacuuguagggaaacuuguagauguaacaacgaccauaaaaagaucuuuucaucucuugcaugaccaaaaaucaguuacuuucuaagagguggccuuauaagaggcugcauauugcucauugaacauaauugaugggauauauuuguugugagcccaauuucucuguguaugcccaauucuuaagacauuuuagucacaggaggaaaaaggauaaucauuugcauaaaaugguugucuaauaaagacaugcaauacuaauacuuuuuugugugguuuuuuuguuuuguuuuguuuuuuguuuuuuuuuuuuuuaguccugaggcuugaacccagguccucacagacuaaacacucuaugacugagcuaucuccccauauccuauacuauaaauuuuuaaucuauauuuuaaaauacucauaaaaaucauuguauaauuucuaaccaauguagacauuguaaaguuuccucauuuaaucuaaauuuuagauuagguacgcauaacaauauuuuaaauggcugugcuugagcuugacuacauauuauggagcaguaggauggccuguuaaccuccacaauauacguuuuauuuuuauucccuagacuugcacaugaagugcauauguucauauuuacccaguuuggagauggguaagauauaaccaacauagcuccaucuccauggccaucuuuuauuucaugcaacuuuuuuuuucugucccacaaaaagcuucauuucuaauaaacaacuuucuuauuucaccccauguguuuaaugguauaaaauccccuacauaaaaauauguacagcccuuugaauuacuuaccuaguaacauacauagucaauaacaauguauaaauccauuacuuucuuuuaacuguccaucauagaaacuaaauucuaccuucauuuuauuaaugcuugucugccuuugguuucauuuaggaaacccuaccuguuuccuaacacucagccaauugccucagugacccauguucaaaucauccuuuucucaagaauacuuaccugcauucuugauauccccuuccagccaccccacugccaauucccaaagugcaugcaccucacuaacagagaauacuuuccucugucuaaguuccucaccuagaaaugaccuuugcuguuauuaauaagaccccuucucacaguuguggaccauaaaacuaggugaguucaauacauaucucagagucuucucaucccucaugucucaguucaugugcuaccuugaauugcacgguuuauuccugcuuaguuuuguguguuuuauguaucuugaagcaggaagguaguuauuuggaacaaacugaauuaauugauuagcuaaaacccuuugaucucuggaguuguguuaacacugguguugcuaaugggugaauuuguucugauuaauauacauuacggauaauccauucuuacuucucccaagucauagaauuacauuccuuaauuauucuucaaaauucuauaaaaccaaaccagguaacaaaaguaaagaaacaaggaaaaaccuauuuuauccuuggcuauggaugccuuuuuuuuuuuaaucaaauaaacuuacauaaaauuuauaaccuugaaugugaaaaaaaaaaauucugggcuuaaaggccucaauacaguuuauagauagaauguuauccuugcuuucaaacaaugcauaaugggaaaggaagaggcuuuggagucaggcaaacaacuuuguuucaaauccugacucuuaucagcauacgugcuuagaaaaaucauguaaucucaccaccuuagcuucacuucccucucuauaaaaagggggugaccaugcuuaauaauugcagguauuaaaugauuuaauacauguagacccaaguaauagaugauucauaaugguagucaugguuacuauuuaauaugaagcaaauuuaacucccaaauucaguuuuauuuugaaguucuauguuacugucaugcagcuguuaaacaauuguguccuugaauaugcuugcauguccuugguggaugagaaauucuaauaugugaaagguauuuggggguucaucaagaugagaggugugauaaauauaagaugccauuguuuuugccuguacuuucuucaggguauccugucuugguagugaauggaagagggccuggucccuggggcagugcagaaggcacuuucaucaucucacucacugcaaaugucaugugagguuucauggaaguauuaagagauccaauuaagaagaauaguucugagucuaaaccagcccagaguggcuucucuaggggaaacuccccgcucugcugguacguuuguguuugucauuagggacaccuuguaucccaggugccugccuugagacaucugccuguacuggcuucauguuacacacaaauccacauucaauaacacuauuauuuauaggcguaguuauguuaaacagacuuucacuaaguucuuauucuaguggcuggugguuguggaaagagaagggauuaggaugggaagugaacuguuaguuuaagggaagaguagguguuaugcuaucaugcauugcuuuucgccuuugugcagcccugaaucuguggaggcuaguccagcaguuaaugagaagagcguguauuccacucauaauuaugggaccacucagaggcaugggugucgaggacugccuuaugcugugaguaugcacuuguuucucuccagagcagugaucuucuuggaguguaauccauucuuauacauugugacuuucuugaaauguuuauaugcagcaugacgaaguugccccuuuugcacuucccugccuccagcggacgucuagcccugcaucauuguucuuguuuuuaugucccaguugaccuuggcauuuuguuuuaucacuuuccugguugaagccaaaaaacgaaggguacuacuuucuucuuucuuuccauauguaccauacuuuaggggagagaggggccaguguuuggacacuguugauuuaaaaaaucuuauuuucaggaucauaauuacggagccccuccuccuccgacaccuccugcuucucccccuguccagacgaucaucccucguucugaccugaauggccugccgucgcccguagaggaacgcuguggagacagcccgaacucugaaggagagacuguuccuaccugguguccuuguggucuuucucaggauggcuuccuucucaacugugacaagugcagguaagauccuguuucaucuaaauucaaaccuggguugcugggauuaggguuucuuaucaguagggaaaagcucaaaguauuucuucuuguguuuguuaauguagaugauuccuuagugcuccuuggcucgaauucucugcacuaggugagaauugcugacaacaaggaaugagagauugauguuaaagcuauugaauuugauaagaaauuuaauguccuggaaacauuugguaggugggagggaggggguaguacauacgcagagacacuucucccauguaugaugugcugugcugcaugcugcuggaaggacuacuuuaaguuuauuuucccucuuuaggggaaugagcagggggaagguuauuagacuucaucggcggaagcaggacaacauaucaggugagcagaagguggguuaagcccacauuuugacuaaauauuuugauuuaaauguucuccuauaguacauagcuauuuucacacaaagaaguuccaccaaaaccacuguaucuaucuggaaauguuucuuagaccucuaacagucaaauuauccuuuguaagcaccagaaauaauuuuuuuuuucuguuaaguuacccauuuauaguuaaagacagcagaguguggaaacuacuuugaaggggaaaaauugauggaauacagacuaaaucuuacuucaugccaacaacaacaacaaaaaaucuuguuuucagaagaaaggugggggucuauguagaguuauaguagagguaauuuuuuaccugguguagggcauauggaaaggaggaagaagaugauauuagugccugagcugugugaucaucuuuuuuucagguggggauagcagugcaacagaaagcugggaugaggagcuuucuccuuccacuguguuguacacagcaacacagcacacaccuacaagcaucaccuuaacuguuagaagaaccaaacccaagaagcggaaaaagaguccagaaaagggucgugcagcaccaaagacgaagaagaucaagguaugcaagguguauaaaaacaccuugaauacaaguaugucugaaauagcucaaacauuugauucaagcaaaaauacucuaaaauucuuugaagaaauuugaugccaguguuuggccacuuuuuuucuacuuucaaaaagucaccugaucaauauauacaaacagaacaaacucucuucuaaccuucguaaccaucaccacaggcucaguuucuucuacuucaaccaccaucccagguauggaaugccagcccuugcugguaaauucucaugugagauacagccuugaaucuaagcuuccacugucuuugcagcaucucccuacuucucugucacaaagcagucugaaguucuugucuuguuuacauggcugaccucaugucauugaggucauuaggcugauugauuguccuauaucuaaacagaacaauaacaugaggaaauuuaucuugaauggucuagauuuucuuauugucuuggucacuuuucuauacucuuagauaaagggucucuagaagaaacauuugucuuuucuauucuuucuuccccaucacagcaacuugguugcuccuaggucacuugcccacccuuugugaaggggaucagucuuuguuuccuuccuaauuucaaaacuaauaaucugcaacuugaggauuauaauuacuuucugcuuggugucagcaguuuguauagucuauaaguggugcaugcucuuaccuauuaauugucucauaccaucaaaguauuggaauucauguccguguucaugagccuuugaacuguccuuuuucuugaucaugguuugauguaccguuguauuuguuacacugaaaaugagacagcauaggauacugguuaguaccuuacuuaguuuuagucacauggauauaacugucauucuugguaccaaguuuuguuuuguucuacuuguuuuccucuuugggauaggcauuucgagagggaucccggaaguccuugcggaugaagggaagggguaaaccuuuccugaugcugcauuuuacauuuggucuugccuuuugauggcuucuuuccuaacguugauggucugagacucuuggagucugcuuuucacaagguuguaauguugccauucaguuuucauaaauauuuucuccagaguggacuuucuugucuauuuuaugaaauauuuucauguuucuguuucauugugguagugugggagauaagucacaguuuuuaaaaacaaaacgaggcuagucuguuuuauuccagugauuggacucaaccucaggagugagaauuuucuggugaugagccaggcucucuuguaaacucuccuugacaacuuuggcuuugaauuauuguuugaaaggauaacucuuuaguagaaaauugguguuguuaauaugugauagucuuacugaaaaagcacuauuuuucuuggcaucuuuuggcauuucuuggcaucuuuuucuugguggagauuuauguaaugcugcuuaucaaauaggacugguguguguguguuuggagaaguaauguacuuuuuagauacuggcuggguuucguuguacugguuaguuuucaaagauuugguugucguuucuuauaucuucuuuuguccugcccaugaguaaguugacauaccuccuaaaaguuuaggauuuaagagcuuuaguuugaauuugaguuguacuuugguucuucuaaguauucguaucccuaaaucucuuaaguuguccauuaaauaaacagugacucuuugaguuaggauaaacuuauuaggauuacuuuguaguuggagcaccaguggauguugucauugaugucaagugacauuuuaccuuaaauuugaaagucugaccucuuauguggauaggagauucuuuaaugagauaaaucuacaaguugccacguguauuuucaacugcucguuucauuuuauuucauuuacuaacagggaccuuacauagaauuuggggacuaacuuuagaccuaaacuguaaggcccucuuuuuuuuuucccccugcuaucaacuaauacuauaacuagcucaacuuucgauaccuguaagcaaaaugaaagccaucucuuucucucagagaaguuuauauacacuuuuugcuuacaguuucaacagagccuuguagauauguuaaaauuuaaauaggaaaaaaaaaaagguuuuacuuuaauuaucuuauaauuuuuaaguuaaguuauaaauuuugucuuuggaauuaaugaaaacuuucauaaagauacagguaguagcuauaggaauauaaagagaauagcauuugaauuuuuaaucucaaaaccaagagcuuuccuacaagacacaacucuuagccaguguuuuaggucagcaaggugagugaacagguaaaggaacuugcugccaagccugacaacuugaguguaaucccuggaacacuuuugguggaauaagagaauuccuacaagguguccucuguggcacaggcauaccagcaaaauauauguuaaaaauagaacaauaaguaaaccaguguaucuucaauacauuuggauaaguaauucugugugguaauuuacauaaaaugauggaacauuauucaacguguauuugauaaugguuccaaaugguaauuucccugugaguguuaacauuaugaacuagguauugcuauuagaaauaauaggugucucagaaacaaauaggugacucauucuccuaauacaaauacaaaccauuuuuacugcuauacuaacacagcgaauaucagccuauuuugaaauuuuaugcacuacaacaacuuaaaauucuuuuuugucuuuuuaugacucccccaaggaauuugaugucaaucuuucuuucuuuuuuuuuucuuuuuuuuucuucccgguuuuugguuuuucgagacaggguuucucucuguagcccuggcuguccuagaacucacuuuguagaccaggcugaccucaaacucagaaauccaccugccucugccuccccaagugcugagauuaaaggcgugugccaccaccgcccggcugaugucaaucuugauggauugaucuuuacuacugaaaauggucaugaaaccaguaauggaugaagauacuaagucagauuacuuucucacuuuauaauuagacaaaugaggaaaucauuugaagguguccaagaccucauaauugguugauaguagaagcuaaaaccccugauuucaguccauugcucuuacacuacaccaacugucaaguaaaaacaaguaucuugcuuauccugccguguucaugaauggucucuuacuaauucacuuaucuuugaucucuacagaauucucccucggaagcacagaauuuagaugaaaauaccacugagggcugggaaaaucggauaagacuauggacugaucaauaugaagaagcuuucacuaaucaguacagugcagauguacagaaugcccuugagcaacaucuccauucuaacaaggaauuugugggcaaaccugcaauuuuagacacuauuaauaaaacugaacuggccuguaauaauacaguaaucgguucccaaaugcagguaagagcuaaagcuuuaaaagcacuaagagauugaaauuacuuuaauaaccaaagaaccagaauggaacaaaaucauuauuccauaccaaauaacaaaugaacuaccuuccugcugauaaucucuguucaaaaucagguuauaguaacuaaacugucuaggcacauguuugagaaauaaaagcuauaaauuuauaaagcagacacagcuccacugacaucuuaaguucuucuuugaucuuaccuucucugggaccacuaauuggaacauguuuccuggaaacuugagauuaugucaaaaagaaaauuuuccaaucuucaaccuauuuaauacacugauaaaaccugaaaguguuaguaccuuuuuaacaguuaugaaacacuguaaauguuuaccacacugcuauugcuauucuuaaacauuaacacuguuuuuauucaguuacagcugggaagagucacucguguucaaaagcaccggaaaauccugagggcugcaagagauuuggcuuuggacacucuuauaauagaauaucgugggaaagucauguuacgacaacaauuugaggucaaugggcauuucuuuaaaaaguaagaacaucauuuguugagcauugagggcuugcaugguucugacugacgagucauucaaauaagcucguguuuugucuguuugcuguugauucaaaagggcaaauaaaucugcaaaucguguauguacacuagugaugacuccuuuccaagcccaacauuccuugcuuuuugcuuauucauuaaugaaaagcagacaagucugugguguuugcuaccuuagguauugcaaaugacuguuccuuauugagucaguguauacaucacauuugugggguggcccuuuuguuuguguugagaauuacaggaauuuuaauuauaucccuagaccauaucccuuugugcucuucuacucaaaauucaaugguguagagaugugugucgaugcucguacuuucgguaaugaugcucgguucaucagaagaucauguacaccaaaugcagagguaagcuaucuuuagcaacuucccuuucaauggagccaucaaaggacauguuuaauugaagaaacaaucugaaaacuucacccagauaaaggucuguagcuaauaguuguaugauuuuuaaugcagagaugaaaaaguaaaaguguggugucuuauggagauggaauaaagacaagaaauagguuuucuuuagagaggacagaaaugaaaaaaaaaagaaguaauaaaacagacuggauaagaugucuauaaauugaauuggaaaaaauuuaaaauauuaaaaugucaugugguaauaguuugucuuugcuauugugggaaacagugguaaaaauuuguaaacauuucuaaaguucauuaaucgauguauucacaguaagugcaguaagguuaacacagcuuuguuuccaggcuaaggaauuuuuaauucuuuagcagaaugcagauacuuuuaagaauaaaauaauaguuucacccuuuucuauuuugaagaaguuuaacagauuguucacuaguguauuaucaugaagugauagagguaaauaaaauaacagauuacucaaaauaggcagaaauuauuugggucaugcuuuucccauuuauggaaaacuugguuuugguuuugaaggcaaacauaaugaugucuuguucauauaggugagacacaugauugcagaugggaugauucacuuguguaucuaugccguaucugcuaucaccaaggaugcagaagucaccauugcauuugauuaugaauauaguaacugguaagaccucagaaauuuuuauaagcauagauggccuuaagauuuuaauaucuuaauauuaaaauuguuuuuaaaucuugcccuccuuuuuuuuuuaauuacuguauuuuuugccaagaaucuguacuccuacuacauaggaggcagaagcauauggaucuguaugaguuugaggucacuaaggcauuccaggccaaccaggcccaccaggccaugacucugaaaagaaaaauaaaaagcaguagggagaaagaauuagucgagguuuguguucuuccugauucugugcugcauagguuagagguagacauauacagaaaaacugaaauuuugaaaguauuauaccaauucuaauuuauuuaacaauaacaucagaggaaauuuuuauaccaguuuuucaauaaggcgaauaguuaguaugccauaauauucuguuuacaagaauacugagauacuuaugguuguuucuuuggcacaguaauuacaaaguggacugugcuugucacaagggaaaccggaauugcccuauacagaaaagaaaucccaaugcugcagaauugccacucccaccuccuccuagcuuucccaccauuggagcagagaccagacguagaaaagcacggcggaaagagcuggagcuggagcagcaaaaugagguuccagaagagaauccugacccgcaaccacaagaaguuccagaaaaaguaacuguauccaaugagcaugagguaaucucuguaaccaagucaggauggucugaucccauguguuguuucagagagcuauacuaaaacauuaacugcuauuauacacaucaucaugaauauacuuacuuagauuuucuuuucacuuuaugauauucagaaccaugagcaaagccaggguauaguggcacacugcuccaguauucaggagacagaggcaggugcaucucugugaguucuaggaaagcccaggcugaugcacaaagaaaccuugucaaaauauaaagagagggagggagagaaaggaaaggaaaaaagaaaagccuaagaccugauucagaaagaaaaauaauaauaucagaaaccauccuuuuagggccugguauggugauacucacaucuaaucccagcaucuguagggcugaggcugggugguuaugaauuugaggcuaggcuuaggcaguauaauaagucccugucucaagaaacauacaacaaaaauagagcauccuuugacucacagaucacaugcuuugcacacagaaggaccugggcuuaauuccuauuguagagcauaaaaagaaguggggagguagugaugccagaauaaagcagguugaugcucaguguuugaauaugaucuaauagugcuucugucuuaaaggaaguugacaauccagaagaaaaaccagaagaagaagaaaaagaagaggcuacagaugaccaggagaacucugcucauagcagaaggguaaguccuguccaguagaugucucuguacuuuccuaacgcugagguuuuaccauaaaguacguuucauuacauauaggcaugcucacaguuguuuaugauaacuaucuguuaguggcuuuaagauauuuccuucuaacaacuggauuucccuaaaacuuggugaugaagaccaaaguuuguuggcuuaguuuucuuacuuuguuuuguguuuuuauauuuaaaaacuaaaaucaagaagagcugcugauagcacaguuguauagcagcacaaggucuugaguucgaucccaaauuacugggagaagaggaagauaaucagcacugugagccucugucccugugacagaaaugcugugaaaaacaacuugaaggaggccaagcuuaccuaugcucagguuacgcagguucaggucuguugucuucauugcuuucagagcaagccgaaauaagacaguaggaguccacugcaaagaaaaucugcuuaccucauugcuaccaggaagcugagaggaaaaaaagccaagaggccaaagauggaagaguauauucuauacuuuuccauggcacccaguggcuugcuuccuccaagaaggcgcaguuccuggggucuccacaaccucccaauagcacuuaccacaugaguucugagccuuuaacugaacuugagccuuuggggcacauucauauccaaacuguaguaauuuuuuuuuugucagauugauuaaaaacauuugcuaauuguguucauuugugcuuagaaaaaauuuaaugacaauuuacuuugguuuugagcucugaauguaggacagaaauugcuugucguugcuuuaugcacuaaaauguguugagguagcucaccuauuuuaaaacauuuaguuuuaaauuucugcuauaacuguuuacuauauuuaaaauaauuuuaauuuuuuuuaucuuaaaguuuagugaugcauaugcuaucuuaauaauacuuugaauaaauucuuauaaacccuacuaauuuuacuuuugaaauagcuucugguugaugcuuuuuuuauuguuguuuuuaauacuuuucuacccccagacucgagaagaccgaaagguugaagccaucaugcaugcuuuugaaucuuuagagaagagaaagaaacggcgggaucagccuguagaacagagcagcucggacauagagauuacuacuagcaguucagagauaguaguuggagaagagacaaaaacugcagccccugagucugaaguuagcagcccuguuucaaauguugcuaucccaagcaccccacagagcacuggugugaauacucggagguccucccaugcugggguaagagggaaagcucugaaaaguccugcguaugcuaaugucaguugucuuuuucuauagugguagaaguuaguauuuucaacguugcucuguaucagaauaagcaaagcuauuuugaucucaacagcugguuugugggaugcagagagacaggugaggucaacauuugaaugacaaagucccuuagcacuuaagugucucccagauaaguucauagaauccuuugguuugggagaaugcauacugagcacgaaggcuucaccuagcucagucuccaucucuaagggaagaaaccaaaucuuuggguuucucucacugauucucugaauagcucagguacaugacugaccuuccagggccuucucaggacuaguguuuaacauaggacuucuggguguagaaaagaaacaagaauuaucuugccuaagaaccuuaauauuagguaccuagcuuuaauuggcuuuugaccuauuuuauuuuauacauguuuguuagaaauagaauuaacuaaggcagauguuugucuauggucuauuuagguaauaaagucuauaaaauuuuguauuuuuuuuaauuuguuuugugacagggucuucccauauaguccuccuggcuggccugaaacuugcuuuguagaucagauuaaccuuaaauucacaggggucuaccugccucugcccucucuaccucugauuccaccuccugaaugcugagauuaaagauaggugacguggugccaaguucagauuuauuuauuuuuauauuuaugugugaacagacagacacacaccuucuuacauguauguauguguaucauguauguacccuacccacagaggcuagaagaugggauuggauccccaucuaaaacuaaaacuccuaguuagaggacuuugugaacacuaaaaacugaaccccagucuuugcugcaagagcaccaagugguguuaauuggggauuaaucuuccagccuuaaggauuaauugaaaaucauuuagaaugcuuuaaauagauagaaaacuaagaaacagguaagacauuucugaugcuaggugagaggagccuugucuaauccuaguacucagcaaacuaaggcaaccugggagauccugucugcaaaggagaagagaauuuucuaguaaacauuuggccuugauauuguuacaggauguagcugcagaaaagccaaucccuaaaccaccuccagcuaagccuucuagaccccgaccgaaaaguagaauuucucgguaccggaccaguucagcccaaagacuaaaacgccagaagcaggccauugcacaacaggcagaacugucgcaagcugccuuggaagaaggaggaaguaacaacucaguaacuccuccugaagcuggaaauacagacaguucaggagagaacagacagcuaacagggucugacccaacugugauaucaguuacuggaucccaugucaaccgugcugcaucuaaauaccccaaaaccaaaaagguaagcgacgauauaaauuucauaugguaaggaguaucacgcuaaagcaagagggccuauaauccccaaggaagaaguaaccuuagaauuauuagauugaacauuuuacguaaaaaguuguuugugcuggaagcugaaaccauccuacuuauuuuuguucacuugauuuuagacagaauuuaaaucacugguaaaacacuauuuuuaucugucuuugugagcauggaaaauguaaaggaaagauaccuuauacucugaaugcucagcucaucuucacugugguugcugaucuguucuaguuuuaguugaaguuugauuugugaacuacacuacugcuucuggcagcuguuacaaaugcagugauaacuaaugguuuuuguuuuguuuuguuuuuuuaaaccuuuaguaucuaguuacagaaugguuaaaugacaaggcagagaagcaagaaugcccuguugaguguccuuugcguaucaccacugacccaacuguguuggcaacaacccugaacaugcuaccaggucuuauucauuccccauuaauuuguaccacccccaaacacuacauucgcuuuggcucacccuuuaugccugagaggcgucgaaggccccuucugccugauggcacauucagcuccuguaagaagguaugugccuuucugucugucucuaucuaucuaucugucuaucugucuaucucccccucuaccccccacccccuccccgugugugucuguguguguauaccugcccaugaaugaaaauauguuuaauacuguagggugcauauaguuguaguauauuuuacauaauugucuagauaauucgagaaucucuagauaacuuugugaguuuauauuguguuguuaaacauggaaguagacucuuuagaagucacuguggucaaguuggaauguauacagcauuuuuggugcucaaacuugugacuguuuaccuguccauaccuagaagcuuuucacauuacugagagcacaaggcaauugaugggauggauguguuuuguauaugcuuuugugauacugguuagcaugguaauuugugacuauuguaugauguuggaccccaaauaauuagagaacaguuauauucauaaaagcagauaagauugucguuguaacuauauaaucaauuacuauuauuucuuaaaggaguuuagacaaaaaauuaucuuagaauuuuauuggacaauaaaaagacuuauucccugccuuucugggacucuaguuguuuugggucuagcaccagcaauguuugguaguuguuuugggaaugcacuuuauuaauucccacauuuguacacauguuccaagggugucuugggaauagauuguucuucaagccuauaaugcucuucaauguuuucagaaacacagaacacacuuuaucaggucuuccuuuagguaggguucuuuucccuggaccacccuuuucucugauccucagaucaggauucaggcugccgcccucauugucuggccuugaccucuuccucgggcaucacauacaugaggaugcugcauguagcuuauuugaugugaugaaguuuccaauuccaggcaggucuucccugauuccucuaaacuuaaaaagauuuuuuucuuuccccaagaucauaaguuacuucuuggggacgggaauauaaaggaucaacagaaugacauggccuauugaaggggagcaaggaaacgggagucugcauagggaaaggcagugcugcugagucaguaguacauugcagaagccuaaguagcacauccuauaaaguacugcacuuacuugguuuguauggggaaaacucccaaauggaagauuuucugagaaauuagauuucaagguccuugucaaagagauuuuggauaaugcaguaaguaacuuggugaaauaaguaauaacaguagaaagauuuugaaaaucugaucacuauaggaauuuugucuagguaaugaagagcugggucucuagggaauucacuuauaccacucacuuagcuucucuuggaucuuguguuuaucagaaaaagaaaaugguuuguuguacaaaaacaccauuacccaugauaaccagguaugauagucauguuacaucauacaguaggccaagacaaggguguuauauuacuagccugggcugcaaaaaucucaucucaacaucuagaauggcaaaacagacucaguucuucaguaaguaaaacaggaagcugaugugauggcuaauuaggcaaacacuugaauucuaucccuugacucauguaaaaguggaagaugaccuguugauguaguuguccucuaacauccacaccagcaugaaaucuguagucccccgcaaaauaaugauuucuuaagauguaauauuuaaauaauagcagaauccuagcugcuuuuaugaggaguguuaaaaguuagaaaggacccugucucucccuaaggcuauauacucaguuuauuaugggaaggauauauucuucagugguaagagguacuacacugguaagauacucuugugaacaacccaaauagaaacucugcuuauuagguuuaaaaauaagaaaguagagucauugguuauaaaaagggaagauuagagugaaugggaaugggagaggaauaagaaagaauggaaagggcauaaguauagacaaaauacaugauauguguauauagaaaaguaugagacccauuggauaguuaguaugugcuaagaaaagcaacuuuuaaaaaaagaauuauuuuauguaugugaguacacuguagcucucuccagacaucagaagaggacaucagagcccagaugguuuuagccgccauaugauuucugggaauuuaacucaggaucucuggauaagcagucaguguuaacuguugagccaccucuucacccccaaaaagcaaccuuuuuuuuuuuuuuuuuuaagacaggguuucuuuggguagcccuggcuguccuggaacuuacccuguagaccaggcuggccucaaacucagaaauccuccugcuucugccucucaaguucugggauuaaagauguacaccacugcccugcucaaaaaacaacuuuuuaaaaagaauauuggaguguaaagcauuuuuaucaaggcaguaaaaucagguuguaaaaucuauccugaugucuuaagaagaguuacugggggcuuuggagagacgccucaucaagaacacuugcugcucuugcagaagacccagauuugguuccuaguaacuacauggugguucacaacugcuguaauccccggucccgaagauuugaugagccauacacauacauacauacauacauacauacauacauacauacauacauacauacaggcaaaacggucacauaaguagaauuaaucuuuuuuuaaaaggagcgauugaugguaauuuagcagggauuaauauaaagaucguuauaaaguggacuaacauuugaaaugccuuauugguaauuauacagaauugcaaucuuuuuuuuccuuucuuguuugucgaacuagcagagagccaagcaaacaaacuuguguaaaaguauaacuuacauagaaaauguacuugcuugagcuuuuguuguuguugcauuacuauguauagggggaggugauucaaaguaucaaaauaauccaggcuuaucuguauaucuacauagaguagauugacuugagacucguggagaucugccugccucuaucucuugaaugcugagauuaaagacauagaccacaacacuuggcaguuauauauguaguaucuccauuggcaacccauagaaagaaauugaauuuaacugaacuccacauugcauucuccaagacugugaccagucuccuacuuaguugucucccacaccucuuuuuuuaagcaggguuagaacaagcuggauaagcacuuuaaccaccgagcuauaucuucagcucuguaucaaucacuauuuuuagaaagagacuaucauagaaaggcugccucauuaaaauuaaucuuaaaauuguuauggccagugauguggcucagcuggaagagugcauaccauucccaauggugguggggguccucauaaaacuuagaauagcuguggugcagauuuguugucuuagccuugggacagguggaggcagaaagaucagaaauuugaggccagucucauaagacccccuuacccucccuuccuaaaacccuuauuuacauuggaauucaguuuaaauugcugcuuuaauauuuccugagaaaaauccagauuagauuauacaacauaaacauuuugugggcggggcaaacuaaccuauuuuuuuuuaaagcuagaaaucugagucaacuuuuucuuggguaugagcauuuuaccugcauauguguaaguguuaccacaugcaugccugggcauucagaggccagaguugaguuggaguuugagauggccucuauaugggugucaguaaccaaacuuagguccucugcaagagcaacaugcacucuuaaaccacugagccaucuccaaagaauaauauauauucuuacuaauagaccuacuguuucauauaucauugaaaaaccuccuaaguuaaaagcaguauaggacaaguuugugucuauauguuuauacccagauuguucacuugugaagacauuuauuaaucuuccaggagugucuaaauuuaauuaauuugagauagauagacacaaauaaauucaugucuccugguuuuuuuuugucuuuguuguguuuguuuaaggauuuuuuuuuuauaugagugcacuguagcugucuucagacacaucagaagagugcauuggaucccauuacagaaaagguugugagccacuauuugguugcugggaauugaacucaggaccucugaaagagcacuuagugcucuuaaccgcugagccaucucuccagcccuguuuuguuuuauaauaaacauguaagccuuuagucagugucccucuguguuguguauaaagucauuugaacauauggaaagaaucuuuggugucaagauugcuuagaaaguuaguguugucugcacuguugcuuuauuuaccuuugaacauaaacauacugcuagaauuagcagggagaggugauuaauagauaagggagugaguauauuuaaaauagauaauauauucaaaugcacuuaaaucauuaacggaagaaguugaaaguuuggaguguugaaaucauuggcuacuguguauaaaccgagucuuuuugucucgaccagaaauggguucagaaacuugcccaaaguaaagcaucucuaguaauggggagagcuuguuuccuaccaggucuucacauuccaaagcuuaguuaguucacuguucucccucauuuucaaaaaugccucaccuaccuuuugggccuucuaaaaacuuuucaguauauuuuacagaaaacagaauuguuuucagacuuaaauauuuucuaaauagaauuugcauaggagaacagaauaggaauuugaaaguaaucuuuuauccauagaaagaaguggucauguuccuuuuuuaugaaucuuaaauauuguuuaaaaaaaugaaugagaggacacugaaaaaaggguuacuugauuugacucuguuuagccuuagagacaagacuggugacaucaucucagugccccaucugcuuuuauauaagcucuuuuuuuucuagucuuaagaucuagaaugucaacacuuauauggcuuucuuacacuaaaaauauuuuaguguaaauguuuuuuccuuuucucuuuuccuuucuuuuuuugagggaacuauaggaaucucuaauuugaguuccuaucuucugcucuaaguggaaaaauaaauugaaaauaaccuguauauaauauaaauuuuaaaacuugcauauucauaacuaaggauuuuucauuugucuuuccaggcuaauauccccuacccgugagaaagggcuuuagaccaagaugaccucagagggucugugcuuuugaugaccugugugcuaagacuguguaagagagcauaucacucuuggucuuggcuuuuuagacaucuugucauguccuagaacauugaugugauucaaaugauucuuaauuuuauuuauauuuauauauacagauguauauauacacauagacauauucauuuaccucuguuuacguucuccuucaacuuaguaaaccacggauacuuauguaauagagaauuuuucauaauaaaauuuccuugaaggcuucccagguucuaauuaaccacuggcuacuaaucuucuauaacuacucuguugagaauauuuacugaccuauguucucuaaagguauaaaauuauacuaauuuaccuuuuccuauuuggagacagucugucugaaauuaauguuuaucaaaauuggaagugucuuauguuaggauaggagagcuacagaauggugaacaacuuaaaacugugucuuuuaaaaaaaaaaucacauauaauaauuucuuuuccacagaauccuaccuuguaauuuuuguaagcauucuuauuucucauccaucuagauuacauauuagcaacuaaaaaaaguaaguggagagaauucuugaaaaaguuuuuccacuuuuuuuuuauuucuucagaaccucuuuuuuuuuuuuuuccccucucuccucuccucagugaucugcaguuacuggggcauaauuugugcuugagauaggaucccacagcuuugggagcuuugccuaguagaaacacugacuugacugugggaaauggagcuugguugauagaaucccucccuuggcccagucccuaucaccacauacauaaacuugauauugugguagacaccuacccagaggaugaagcagaagcaucauuaucaccacauacauaaacuugauacugugguagacaccuacccagaggaugaagcagaagcaucauuaucaccacauacauaaacuugauacugugguagacaccuacccagaggaugaagcagaagcaucauuaucagggugaucuuuagauacuuaggauguuugaggccaaucuagguuacaugagacuauuucaaaacuaaucuucauuaaagagaagggaaagaacagccaaagccagccuuggcugcacaggcccgacccugucuagaaccuaugugaauguauuuguauuguauuacucaccaauuaauuuguaaugaucugguuagugcacugaaaauagauaucuuuuaaaugguuauugaaaauucucuggguuuucccucccauuguagcgcuggauaaagcaagccuuggaagaagggaugacucagacuucaucugugccccaagagacuagaacacagcaccuauaccaaaguaaugagacuaguaauucuucuaguaucuguaaagacaaugcagguauguaucugauccuuuucuaaauuugauaagaacagucaccauuugagguucacagugaaauuuucaguguugguucucugauauaaaaagaaauaguguuuucucuaaauaguuaauuuacaucugucuuuacagaggaagagaaagaucucgagucagggaucaguuuucccaggacgacaaagaaggaacuagacaguguacagauaacagcagaaaugguuauaaaaaagguuagauacguuuaacguaguaaguuuaggaaauauuuauuuguacuuauaaggggagacaguagaaagugguggaacacuuucaaggggaacaguuggaacuguuaaguggcuuguugggugggaucugacuaaaggggcaggaaauaauggcauccuugaggaaucauuguuguuuuguuuuuuuucaaaagaacuugccucccagaacuauaaaauuucugacuaagacauaaagauaugggccaaauggcuaugaaaaaaggaccugaucauugucuuuuacaguguucuguuucagacuucuagcugaaauuauugguauauugacuuaugauauccuauuuguuuguuuacuuauuagacaggguuuuucuguuuaaucuaagcugguaucaaacauccucucugguacucaaauucggaucaguuuucugaauauuguauaaucaaaaaaugcuguaacuggauacaaugauacuuaggauccuaguacuuggaagacaaaauaagacaagaggauugcugcaaguucaagacccucccugucucaauaagaaacaacaacaacaaaauuuaccaacacagauuaguuacuaaaacucacuuuuaguuuugcuuugguuuauuggauaaagagagguguuugugggguuuuuuuuuuuaaaccaccauuuuuugacuugcugaguauuuaugaagcugaauuuaaaagaauuuuguaaguaauugcuuuauauuaaaauucuuagguuuuaaucuguucaccuaaugagacagauucauucagguuuaguuuaauaaaaauuuuaaggcagcuuugaauugugucaacuuacaacuuuaagaguagcugaauuagacuaugguguguguaugugugugugugcgugcauguacgcgccuuccucuaucugguggguauguugcacacauauacacauauauaguugauuuggagaacagacugcauguccuggcugucacacacucagagagaacuuguccuuguuacuacauacccucaguggaauagaauuagcacuguuagucaucaacuuguauuacauuucuauucuucucuccagcaagcugugagaaacauuguuagaaaacaccuugcccuuaaguaucaauauaaaccaaaggaaagcauuacauaaagagauuaauggcacagaauuacuguuuguugaguuuuaaaaguuuuguuuacaacaauauggaggaaaguugaugaagaaagugaagagauguguugacacagauaaaaauaucaaauagaccuuuauuugaggucuaguuuucuauccugugugauguuacuaaaugucucugaauuucaccuguaagugccugcuucauaagguuaauaagaaauugaauaauuuuuacuaagugcuuaguucaguaucagacccauaucugaauuacggcugucauucuacauagaauacucuuucuugucacauaugaacuaccuagauuaaagaugauaaauucuuccacuggugugguugugcuuaauguguacaauaccaguaaucaagacugauggaaaaaucuugguuuucaggccagucugggcuguauaguaacucuaucacaaaaagaaaagucaaaggauauuaaaagauaaaauugaauaaaaauaagauguauuaccauugacauaaagaagagaucagauauucauuuguaaauaacaugaauauaucccuagaaauaccuuaauaaucaacugaaaaauucagaacuaauaacaguugaauaaaauccuugguuagaaguaaauaucccuuaaauacuuaagaaaaugaaugaaaacagguuuuugucauccucauuuuuagcaaagcuaagaaacuaccugagaauuuucauacuuggauaugugaugcaaacuauuauugagaaauacuuugcaaguuugagcauaaaggaaauucuguauucaauaauuggauguauaauauucuuucuacuccuaugguuuccuagagccaucuuuaaaauuuugauuuuaaguucauuaaaguuuuuaaaauaaaccuuggaaggguaauaaguacuuugcugaaaauacacaccuaguuuucaugggacacucgugguuaaauuaucauggcgaaugagaauacggaacugaauagcuagacuaggcuuugaaauaggggcaugguaaauugcucuaaaaagaaaauugcuuucuaaaaagaaaaguuuucaguuacuugggagauuguaaagugauuggaucuuuugccaaugcaaauucuaagugaacucaaauacuuuuucuuacaauuuuuuggguucuuuguguuuugugguugguguguuuggguuuguuucuugagacagguuuucacuauguaauccuggcaagcuugcuugccaucuuccugccucacucuccuaacugcguguaccaccacacccaauacccuaauucaaauaguauuaacucuuguuucugugaucaugcugacuuuaaguuaauauaguaagaaaggauuuucaguaaaaaaaauauauauauaacaauauuccaauugucuauucagauucauuaugugcuuuaaagauuuauucuuaagcucacuaguucuagcuauuguacaagauauaaaaaccaaauauuuagguacaaaaauauuuauaauuacuaguagcuccaaguuauauuuuuaaauauaauucuuaaaauuaaauuuaaauuuuuuaauuuauaaaauuauauuuaagcauaauuuuuaaaagccagaacuccaacugaugagagaguaauagaaauuguuauuugaucuuuguucauauauaagaucuugauaguuuacacugacauuggcauuuuuaaaaauugugugugcauguacuuggugggagggugagcucgcgcgcguaugugcgccugcucacucccacacauuuauacacuugauauuucauauaggauaacugacagaaccuucuaccuuguaggucuugagaauugagcuuaaguaaucauaaucagccuuaccagcaagccuucacuuucugagccaucgaaugggcccuuuuaauuugaauuauuaauuugagguuguugcucaaugauaguacuugccuaacaugagaaaaacccuugguuugaucucugguuccacaguuuuuuaaauaguuuagcuuuguuuuaucaaauugauuuaagaccacaaaaaaaaaaaaaggauagcauuacauguaaauuagauuuacuuaucuucuugaaucuugaagagaacuaaaggauaauuauaugaccuauucucucauaacuauaaaguuggcuugauaauuguuuuuuaacauuugaaauggagagaagaauguaacagccauucaugaauuugauaauaaauuaucaugcuauaauuuuuuaaugaauuuaucuuaaaagaugagcucucaagcuaggccuuugaucacagcacgcgggacagagacaggcagaucucuggaaggaagccaaccuguuuuacagaacaaguucuagaacagccaggccuucagaaacccugucucagaggggcaccgaaguaagcuaucaaagcuaagaaaauggcuuagugggcaagaacacuuucuuuauaagccuaaagacccacauuugaacaaauugaauucccagaauccauauuuuaaaagccaggcauggauucauauuccuguaauaaccacuuugggagguagaaacagagcuugguggcuagccaaaauagugagguucauauccagugggagacugucucuagguacaaaguggaagcacuaacauaaaacaucuaauguccucuggcuucugcauguaccgguacacucccaaccacacauagauuugcacacauaugccacacacuaccagaauuaaaaaaccauaugugaauuaucagguuacuccacuguuuuauuauuauuuaacauauucuggaguuuuuagcuauaagcauacuugccucuuccaaagggaaaggauguauaaguacuaguaaagaggggugacugucaucauaugcaaguaauacaguuagauuccuagaacagcugagaaaauuggcuggaaccaauauguaaacauuucauuauaacauuaagauggacaaauggagaacaugggaaacgaaggcucucgguuaugaggagggaaucaaggcuugaauagcuaaaagaaaucaugcauagucauuggugaggguggucuccccgaguuauauuaccaaaguacugagauuagauugucuaauuauuauacuucauugauaagaauauugugcuagucuuuccagaaauauuuuggauagaguugggaacauuucuagccaauuuuuaaaaagacgaaauaucaguauugcuagaugugguaugugccuagaaucuaguacuggagaggcugagaaagaaaaacacaaauuugaggccaaccuaggcaacauuacaagacucugucucaucacuaggggggagagcauuguagcucaauauuaaaguacuuuccuaaaauauacaaggaccaaaaaaauguauaauaauagucuaauggagaaaagauucuuuuuaauucaaugaagaaagauaagaguuguucaaagguaguaggcauuugcuacuagaaaggugggguaggaaucaaugcucuaaaguuaauugugcauacuucuuccuuaagaguuuaaguauaacuuagggggccagggggaugacucagugaguaaaagcgcuugccacucaagccugagaaauucagauuccagaaccguguaagugugacuaaucccagcacugcuguggcaagaugagauuguggagacaagugaauaggccagaggaacacaagacagcuaaccuggaauaugguuuucaguagaggcucugcuccaacaaggaguacaccaacucuggccuccacacuuuagguaauacaaacauggacacauuuuuuuuuucuuaaguguaaauuagggaaggacuauaacuaagugguagagugcauacacagcaugugugguugucccucaguucauuccucaaacaagauaguauuggugcuuuauacauacugucccaaaacuucaacagugaguacuguugcagccuagacuacauucugggccucagugagagacacaaaacauaaacauacugacuuauagacaaccuaggcucaaucaacccuugagacccccaugguaaaggagaaaaucaacucaccaaguuguucuuugacuuccaacugcauggcacagccugcauguaugcauacacacacacacacacacacacacacacacacacacacacacacacacgcgaaauaaaauauuuuuaaaaacuaaagaauuaaauguuaaccuaaagguuaaaacuaaaggccaaugggugguauuuucauaguucagggauagaauugcaaguucguuaguuagauucauucugcuaauuaaagccauuaaaacagacgauuaaaaaaacaucuuuagauuuaauuuuuguauaugaguguuuugacuauacauauguauguguaccacauguuugcguggugccaauggaguucagaagagggcauuacauuuccugaaauuggaguuauagaugguucugagcugccaugugggugcuagcaauugaaccugguuuuucuguaagaguagacaguguucuuaaucacugccaucucuccagcccuguuaaauacauuuuaaaaacaaacuagccaacggugguagcacaggucuuaauccuagcacuugggaggcaauagccaaccuggucuacaaagugaguucugggacagccaaggcuacacagagaaacucucuuagaaaagccacuuuaaaagagagagagacuggggcuggagagauggcucagugguuaagagcauugacuauuccagaggucaugaguucaauuuccaguaaccacaugaugccucacaaccaucuguaaugggaucugaugcccucuucuggugugucugaagacugugaucauguacucauauauauaaaauaaaucuuuuuuuuauaaagagaaacugaaaaggucaauuuuuaacucuuaaaaccagcauacugauacaguguaagcuagacauugcaaaucauucacacaauuaaauacagagguaguaagcauguguaaguguggauguacaugcauggagaccagaggaauugaucagguauuuuguucuucaugcuguuuugaaacauugucucacugaaccuccauuaggcuggcagccagcaagcucccaccccagcacuggaguuacaggcuaaaguacagcuauagcuggccuuucgugaguauuggugauucaaacucacauucucaagcuuguucaacucccaccuuaaaguugagagagagagagagagagagagagagagagaguccuguaguuguccuaacaaauaaguagagaaaaguuuuuuaucauaguagacucaacaauugcaauacaggaaaauacuuaauaauucaacauagguuaaauuuuggcaauacuaaugucacauacccauuuuuaaaagguauucauaaaucggguaugcuaacacaugccugugacaggaggaugcuaguuugaagcuagccuggauuacauggccacuucaaggacagcuuaguuuacaaugauaggauccuauuucaaaaacaugcuaccaccaaagaaagaaacauacaaaaauuuauucacuaacagaaauuucugggaaaucauuuuaauuuauguauauauaauggguagcauggguuuaaauguaugaguuugcauaaucuugagcaguauugaggcaggguuuuaaaaaaugaguguguauguuaauauauauuugacaacuauaccaaaaagaaaacaaauagcaaagacuaccaacugaccuuuaggcaaucgcuggguuuuuaaauauagcaucuuaaguguucauugaauaucaaauauagaucacauucauuuauguaguaauuccuccuaguuuuccuacaguaauacacaaaauguauuuagcaguuacauuguugaacccucaguacagaguucuuaaagauuggcuuugaagucuuuagaaaugcuuaaaaauuauuuuacagauuagucuugaauuacauguuuauuuguuuguuuuguaccuaggcacauuaaaaaggauaaaacaucacaugcuauaaagaacaagaggaaaaguauucuuucaauguagagaaaugaaaaauccuaagaaacaaaaaaaaauuuauuuaaacauaucagugccucacaccuuuauauuggcuacuuuccuaacuccaguagguuugcacuuggaguuacaucaccagagaaaucuuccuaagcacaucccugaucucgggccacauuugccuggcaugauugucguuguuugcaccaagccauggugcuacaguuuagcaugcuuuuauuaagaccauuugccgaaugacuggagaugaauggccaauugguaaaagugccagucuaagguauaaaaugccccagauuugaucuccagcaccauaugaggcaggugaccauggacugggugcuaccaugucuagucuuucuauaugcaucagaaucuucaucuuugauacagggugauguuaauaacagaaaugcuggauuuauagauaccuuaauuuucauaucaaacacaccacacagugccugguaaacaucaccuuaacagugauguucuuuuacuuguuuuauuuucuaagaaauggaauucauaguguuguucgggcccaagcuagccuucagcucuuggacuuuugagcaguccuuuuacuuuagccacccuaguagcugagacuauaguucuuggacacuguaucucacuuuaccuacuuugaaggguauuuauguguuuaucaucauuccugaggggccacacuacacaugcagacuucagaagacaacuuuuggaagucaguucucuaccuucaugugggcuccagguuuggauaacaagcaccuugucaaauaaucucgaaagccucuuuguaacuauuggagccacuuauuuacuuaguuauuuuuaugcagggucucacuaugaaucccaggcuggccuagaauuugcuguguagacuaggcuggccuagaauuugagauaauccugucucugccucagaagugguaggguuauagucaagcuuaaccaauaagaaacuuaacauuaaacauuauuuugcauguuuucucuaagcucuuugaaaauagaaugugcaguagcccuuacauacauaccauugccauauagugcauacuaaguaaaugaaugaucuuuaacuguuuacucacuuuuacuuaaguauauuuuuccucugagguguguuuuguuccugaagauccucuuaaaaacaagaaaugauaguacauaaaauauggucaguaaaauacuuaauaauaaccugcuuuuuaaaauggaccuaagaaugcaguuagccuaaucaggagucuuguuuuggguuuuguuuuguuuuguuuuuuuuuuuaauagaaaccauuuucuuuucuagacccuaguguuuguucaguauuuggacauuaggagcuauaugaggauacaagaucaagugugucuccucuuacuuaugaguguuugcuagaagagcugcagccuagcaagugauaauguagaaguaaagaguggguuuaacagcacaaguuuaagauucucuaaaucucaguggaaggaaaccuauauuucacuccagaagaaaaaguagugaaugcccuuggcauugaccauuaaaauugucuauauucauauugaguuucucugggacaugaaaugcuucauaaguuguauucauggaagugauuagacguuuguuuaggcagccaggcaguaguggcaaaugccuuugauccuaggcaaaggcagguggaucucugugaguuagaggccagucugaucuaaaagcaaguuaugcgagagccaggguuacacagcaaaacccugucugaaaacccccgcgucucccaaaaaaguauguuuacacuuuuggccuaauuagcagaggguauuuaaugggaugagauauaggaucuguugcaaauuagagguuagugccuuugcuaccuagccuucaggaagauaugauucagcucucaucaaagcuuuguguuucacagacuuacugagcccauuaaagaaauggaagucucgcuaucugauggagcagaauaucaccaaguugcuucagccucugucuccaguuacaccacccccacccagcucaggcucaaagaguccccagcugaccacaccuggccagacucacccaggagaagaggagugucgaaauggauacagccucauguucucaccaaucacaucucuuacuacugcuagucguuccaacacuccucugcaguuugaggugauugggguuuuguuguugggacugauaugaaaaucacuguuuauaccucuuuauuucaaauauaauauaauuucagguguuuuuaacugucuucguucaucucuaugagaaccauuagccugggguaacugggcuguggcuguagccucuugucuuggcagccccuguucugccagaguaguaauaguguugccgugaucccuucagcuuucuuuucacagucaguccuucaaucauauuugagugagcauacaagaucauuaucuuuauuaucuguguuggucaacagaggugcuugggugccugauacccguuaguuucacaagccugggagcucagacuacacagugagcucacaucuguguaucaagaccugccuauaacuauaaaguggcuuucccagguucuuugguggcucgccuguggccagggaaacagggacuuaggaacauuggguuucuaaggaugguggcggugcuguugcuguuuguuugcuuuucuacuucagcugauuuuauuccccucccuguuacaguguauuaggacugaguagacuggaggcuaguaacacacauuaauuguuggauuacauuagaaauacauguauaaacuguuucuaaaacuguuauauucaaucacuuugauauugaaguucaaguggcaaguaugaauauauaauccauguguuuuuaaaaacucauuugcauguuucuuuauuuaaauggauauuuguggggggggggaagaggacuugaucuacccacuaaaccucuggcuuucacuuuucuggauguuguguugaugaaguugaauaucuagcagaucacacuucucugaagacuuuuaugacuguaaggauuaacaaugccuggguucuaaaggcacuagcaacugaaaguacaugagugugcugcucugcuucuaacucaguccaguagugacuuacuguagagcaaaccuugguauggaaaaaacaucauccugguuacauuuuuuuucuagguaaauuaucauauuucuguguccuuuuuaauugguuauuaaagaagaauucagauuuaauaguuaagcuuuuguuagcaauuagaauuucaugguaagguauccaaagaaaaguugucccuguagugcaaucaguuauggagauagaguugcaccuuuucguggcaaguuucauuauuaauuugaaauuacagaaauuagaagucuuccaaaauaauuuuauauguuuccuaccacugcugcauuuuaauaacuauaaaacagcaugcaaaugaaagguauuuuaagauagagaacauagauuuuagugaaucucagucuaagaauaauguuuaaacaccaggaagcaggcuagcucagcaguaaaggcacuucugcaagccuggcuuccugaggucagucccugcaacccaugugguaggaagccaacuucacaagugacuuccccacauagacauaaaauaaaugugauuuuuaaacauugaaacaagggacuaaagauagcuuagcagucgagagcuugcacuacucuugaagaggaccagaguuccauagccagcacccaaguugggagagucacaacgauuuauaacucuacuucuuaagaggugaaacucccuauugucucuuccucaggcaccugcacacaugugcaaagacacauucaugcaucauuuuuuaaguaaguugaaguauuuuagggacuagaaaauggcucagccauuaagagcacuuggugcucuugccaagaacugggcuuugauucuuagcacccacaugguggcucauaacccucuaacuccaguuccagggauccgaugcccucuucuagcuuccauagguaccagacacauugugcacagacacuuauaugcagguauaaaauaaauaaauaaauauauauacacacacacacauacauacauauauauacauaaaaaugcaaaaauaaaauaauuuuuaaaagauuaucaggaaggaaagaaaguagcgaaaauuuuaaauacaugauuauaaaguacuaauuuaauaaugcaacgucaccauucucauaaaaacagcuuugccauccuaccagucauaccaucauucugauagcaaggcucuuuccuguuuuugaguacagaaggguugguuugcaaccuuuuuuucaucagaaacuauagcaggggguugggugcuuuggguauacaucuauuauuugaagacaccaaaaguuugagcccacucugagcuacauuagcaagacccugucuuuuaaaaggaaagaauauauugaaagaugauauaauacaaauuuuauuuccauauuguuuuuuaaacauaaaauuauuauuugaaagaagaaaauguugaaauaaacuugucuguuaaacguuaaaaagagcugggcgugguggcgcacaccuuuaauuccagcacucgggaggcagagacagguggauuucugaguucaaggccagccagggcuacacagagaaacccugucucaaaaaaccaaaacaaaaccaaaaaaagcuaaaaaaaaaauauuaaaaugcaggcuagagugaugacugccauuaagagcacuggccauucuuucagagaacccaauuuuuaauucccauaacacccauaugguuccucacagcuaucuguuacucuagucucuagggauuuaaugcccucuucugacauuuccuggcauugugugcauguuuuacacaggcacacaggaaggcaaaccacuuguacaccuaaaguaaaaauaguauuuuuaaaaauuugugaaaaauaaaguagcagugaaauaucaauaagugucaggaguaaaaccagcuccaaguggaaaggaaaaaccuugaauaagaagcguguucauaucuagaacugaggggaugagguacacagucacagagaaggaggggaaagaaucuagaagaaggaaaacaagagcccugugcuuuguacacccagcacccuccccauucuaaaacauugcuauccaccuuguuuugcugaagcagcuccauuuauauauccuagcauagcauagcccacgucuguuuucugggccucaguuguugauagucuguauauugagaacuuucccuuuuccccagugccugguacagaguccuugucauagcugcuaucaucacuuucauguuacccuucacaccaucaccucaagagcucacucuccaguucccauguguuagagagguauuaccucagcaaaauguucuguccuaugaaagucacagaaaaaauacacauauacaugguauuggggugggagggugcuuuguuuguuuugugauccaguaaguacaauggauuuuuaacucuguuagaugugugcagguguauaacagucacuugagaggaacugaucauaguucacagguauaccccuaaagcuaguaagagaauaaagaaaagaaagauuauaaucagaggaaguauggggugaagaaacagaguuccucuaggaagaauaaggaguagguugugccccaccauaagaaacacugugagcccucuaaaaugauucaccuaauucuuuccugaguucuaauugagguguucauugauagcaugaaacauuauaaguccuuucuaagguaccaggaagcauuuagcugaacuaaccacuuuguggaagugaguucugcaguuaaacauuuaccauaugcauaaacauuaaccauccucaccaccaaaucccucccuaaaaaguguggcaaacagccaugcuuaucguuacuuucuguuuugcuucuugacucugagaagauaaauaacaagauacuuuuuccuccucuagaacaucuccuccccugaggguuccccugcacauaggccuaagccccugucaccagagguaguuaccauaccaucucaaucacaugcaggcugagagugagugcacaagggugguccugaauuggggggugagggggcuggacuggaggguggccucucauucacagcaaauagaguggaucuuauauaaaaacugacugcacaggaccguggggaaaugaguagcuguuuuuauguugugggguugcuuuuguugucauuugggagaaggaauggcugaagaguuucauuaaagagaaucuucagaggauguagauucuaugugcaugagagcauuguuagagaaagucaugaauaacauccuccuguuaacaaggaaacuggaguuggucgacacugucucaguaucaugucagcaauguauaauugggguuaaacugacagcucacacggcugggugucugggcuuugggugacagaugagcagcuuccuuuagggaauccagcguucucuggcuuuccuucauuuccucuggagugccuaguuggguguaaguauguaaggaagcuuaagcccaagcucuggguuacaaaccuucucuugugcagaggcugggauacaguuugugugcagugauuuauaccucuuaggauaccaauuucaguacuuugcuaagaaacccuccuacccuaaagauccaaaaucaugauuucaguguuagcaguuauaauaagcuuuagacauguaauuaauuauuaacccuauaaaucuacauggagcuuuuuuucucuguaccuuuucaaaauuaacuggccuuuagucucacuuuccaaaauaauuagggcccuacucccugacuaaucaccaaauucucagucaguaggauauucuguagaucaucaugaaacugaaaagauuauauuccacuaguuuauuguuaacuuccugaguauugugaguccaucuuguugggaaaguauagauugcucugucuuggguugcuaaagauucaauauuagaaaggcuuugauaacugaucugucuaguuaagggaauguugguguuaagcgauacagauaagcaguaaugggucgguuuuaucacuggugcauuucagccuuugauaugcuuuuuggcgguaggcuuuagcaguucuuugauagauugauagacagcagaggacacggaauugaacagacagaauguugcaugagaaacauaauccaagguacaaguaaauaaggaauggauucguugcaaccuuuaaugcuauucuccuagugaguaauuuaccaugcuuggcuuuucaacuaccuccugcuuuucuccaccuucccuuacaccuuccauugaaacuaauuuaauaauauauaacaucagaagccagcaacuuaagaccuuucuguggugugugugcuuggggcucagauacaucccuggcuacacugccagccccacauaugcugucaaacgaugugaugaaggcugagcagaguagucauguuugcagaauugccugaugccuucauucccuuuuugcccuuugacuuuuucuguuauaccaugucccauaucucuguugauuuuuauuucagcuuugucaccgaaaagaccuagauuugacaaaagugggauucccagacuccagcacucacagcugcgcugauaggcccucccugcuuaacugcaaucauccugaccuggcuucucaucccucuguuguucccaccuccgaggcuggcuucccaagcaggaguggagaugguccucagaccuugcugagaaacucagaccaggcguuuaggacagaguucaauuugauguacgccuacuccccuuugaaugcuaugccucgagcagauggacuguauagagggucucccuuggugggagacaggaagccuuuacauuuagauggaggauauuguuccccugcugaaggcuuuuccagcagauaugaacauggcuuuaugaaagaccucucucggggauccaugucaccugguggugaaaggaccugugaaggagucccaucugcuccucagaacccaccgcaaaggaaaaagguaaguauucauguuacucuuuuaaagaauauuagucagauaauucagaacuuucuaagcuccagugcauaacacuuguccuacucuuugcuaugaccuguaaaaauuaguucuuuuauuugauuacauuacuucuuuggcuuaugugggggggggggggcaugaacaugccaaaagcacauacauagaaaucagauuacuugugggaaucaguucuuugcuuccaccauguggguccugggauugaacucaaguuaucggucuuggcagccacagccuucaucaauugaguagacucuauuaguauaacuggaaaguguugugaauagccggcaggacugaagugcagucaguaaaagaguguagccaugaguaaggcuuuccaucuuuagcaucccaaauacaaauaaagcaaauaucuagcuugccuuagaggcacaugucugugaaccuagcauucuggagguugaagugggauuagaaagcuaaagcuaucccagguuuuuuaaacacagcaaauuuuacauaacuguuguaugcaacugaaaggcuagcacacuggaagaauaccaaaagcuguguuacucagagaacccaguuuggggcauagcuuuaagaccaucagauguguuuucccaggcagauguaguuguucauguuuguaaucccagcacccauucaugauguugaggcagaaggauugagaaguucuaugccagaggccaaagagcugggucaucaguuaagagcauauacuauucuuccaaaacacucaaguugacuucccagugccugaaguguuuaccaaugcuuagaacuccagcuccaggagaucugaugaccucuuugaccuucaugaguacuugccaacccaagccacauagaggcccauguuuuguuucaguaauucauuuuguaaucacagcgguuauauaauuagggaauguccuuaucuugcacaugagaaaacugaagcuaguuaaauaacuuguuaaacaacaacagauaaacaaaggaguaaaggcacuguccugauucugauuccagauuacacaaucuaguuguuaauauuauaugauagauuugauugccuccuagagucugcacuaauagagccucccuagaaaauugcacuaggagauucugaauuacagugguuguaguugcuccaaaggaguuguucacaucuuagcagaggauaaguuaaggaaugaacaagaagucuuuuauuucgcuuauuugagggguagaaauggaaaggcgguagguuuagccacauuucaaaugauguguaggaaucagccugcgcaucaagagggagguguuccugcgcagucagucugugauacuacacugggguacagauggguucugauagcuggcugcaguuacaaugccagggagcaccaggaagcaggugcagagagcaguggguagaucagaccuuagagaucuugccauggccuggggcuuauaaaacucaaaaaaccuaacagcugcuuuuccccccuuaaauauuguuuugggauuauuuuuggguugucauggugacuuggaugaauuuauuguuagggauucacaaagcugaguauacuauguaugacagucuuacagagaaacuaguuauauccucauagaaauaaaggcucgugacuuuauuucaauuauaauaauguucauuauccaaguuuauuaacuucuccaauauuauauguaaaaaggcacacacaaaauuauuuuuacuguuauuuuugugguauuucacacuuaggcagaaaauuaagagcaccuuggauaggaaaaggaaacacuagcacacaauaggaugacaauggagcucuuccuuacaugagcaguacugacuuugaaauuguauaacaugacauaucuuugcaucucuaguuuuauuuguuacauauacaaguaauugaaguuagaauuuguuucagaaauauuucuaaaauauuugggcacuugugauuuuuguacuaaauguuaacaguaaaaaaagcuaaggacuggaugacuggagagauggcucugcaugaaaaagcacuuacagcucugucagaggaccuaacaccuauaugcagcagucacaaacaccaauaacuccagcucuaaggcagcccacauccccuucuucccucugaaagcacauacauauggguaaauaaaauauuuuuuagggcuaaacacauugccaagccuggcaaaucugaguuugauccuaaagacacacgguaagaggaaaacaccacuuccccagguucuccuuugaccuacauacaauaguuaauaagugggguuuuguuuuguuuuuuaauuaaauuuugauuaaagcuaacuuuaauuuuauuaaagcuaaagcauauaugugauaccauauaccugugauaucaggaccugggugacugagguaggaagauccuaaguccaaugccugccugagcuacaaagauccugucucacaaaaaugaaugagugaaugauauaauuuacagauuaaccaaaaaaaaaccaagauucuacaguagauuuaauaggcaauagaauacaguaguggauggauaggaaaagguuuguuucugauagcaggaugauauaugaguaaauaauuagaagguaguuugaggauugggaaaaaguuucuagguuguagacagguugcugaaguauauaaacaaaauaauuucuucuuacuuuaguucuuuaauaccuuucuucccuuauauguaauacagauagucuuaaaucccauaguaugucuucaaauuuugaauauuaugaagagcccugaaauacuggcuuuuuccucuuggugugauagcuuauuuauuguggauuauuuuuguuuguuguuaauggaguaaguguuccuaaggaaugaagaacuuuuuuccaggauacaaaagcauucuguuuuuucugccauacuuuuuauagaugcccccauuuugguauauaacugauuguagguuaccaaggugauaguaaucucacaaguuucucugaagaaaguaaaaggauauagucuuauuugagcaccauuguuugauagaauauuuuuuguccucaccaguuucugaguggcuugagucuguagcacugcucagaucucuuuuauaccuaaaaaaaagauuguuauauagggacuggaaaggucccucagugauucagagcucaguucccaacacgcacagcagauggcuacaacugccuguugcucuccucuccaguaguguuccaacuccugcacucagccugugcacacacacagcuguaaauacaguaaaggcuauuacaguugauaccuaagccacucacuaaugauacauuuucuuuuucauaucuagguauccuugcuagaguaccgcaaaagaaaacaagaagcuaaggagaauucuggugggggaaaugacucuucacagagcaaaagcaagucuucaggagcugggcaaggcagcaguaacucuguuucugacacuggugcccauggugugcagggauccucagccggaaccccgucauccccucacaaaaaauuuuccccgucucauuccucugcaucgcauuuggaggcgguaagcccgucagauuccaggggcacuucuuccucucacugcagaccucaagaaaacaucagcaguaggugguaaguuuauguuuaauuagcuuuauaauuaaauucaggugggaaguuacacauucauuuccaguuuuaccugaaguuuuuggagcacuuaucuaagacaggcagguaauuugccaucuguuuguucagcuaguuaguguaagccaaaucuucucccuucagagacucacugaacagugagguuuuggguguccacgcgcuauuuuuuuuuuuuuuuuuuuugaugagagguaaguaaacaguccagccaaaucgcuccccucccccaccccuugugugcacguucauauaugcacucuuggucacucauacaugcauauggaggucagagaacacuuaaaggaaauaguucuucccuauuuaaaggaaauaguucuucuggagauugaacucagaucuucagacuuaaccuuuaccuacugagccaucuugcugacucugguuuucucaaauugaaaaagagcugugucccaugcugcuagcauauacagagaaaugcaagacggucugaaaagaguugucuaguuuagaggcuggagaaacgacucugguuaagcgacuaacugaucuuccagaggagccagguucaauucccagcacccacauggcagcucacaacugucuguaacuccaaucuuugacacccuuauacagacauacaugcaggcaaaacacuagugcacauaaaauaaaauaaaauaaaauaaaauaaaauaauuaccaucucacaguuuugugcuggagagauaguucagugguuaagagcacugacugcucuuccagauuuccugaauucaauuuccagcaaccacauggugccucaccaccaucuguaaugggaucugaugcccucuucuggugugucugaagacaguuacaguguacucacauacauaaaauacauacauacaugcaugcaugcaugcguagacuugucaagguuagaagguaucauaaaaaauaaguaauauuaaugacaaguucucaguauugaaugagauaguuucuuuuguuuuuuucuuuugcaauuuuuugacauaggucucauagccuugaacucuuugauccaccugucucuucuuucuggguccuaggguuauaaauaugcaucacagcuaggaguacagcauucauucuuuucuuuuuucagagguggggugucuacauuuggagacucgagaccaccuuacuuuaugauaaaggaucgcucacugaaccuggagcucacugauuaaucccgagucucuggccaguaagcuccagggauccucaagcaugggaucuugaaaugagccugggaaagaagauacaggucucaaaguauuauauucuuuaaucucuaagaauccuauaaaaaacuauuucaaagcugggcaugguggugccuuaauuccagcacucgggaggcagaggcagguggauuucugaguucaaggccagccuggucuacagaguugaguuccaggacagccagagcuacacagagaaacccugucuuggaaauucaaaaaaaaaaaaaaaaaaaaaagaaagaaagaaaacuauuucaagaacacaguuucagaggaggaaauuucacauucagacagaguuuaaaagaaguuaauaucuuuaaucuacuuuucccagauugcuuucucacugccccuacuuuuauacauugcauaguuugaagcagaggaaaugccuuguucucaguagguccuggagaaaauaguguaaggaugguuuaagagucuguacuacaccaucuuuaucauggugauuuguuucagacucuuagcccuuaaucucuguggcuucuguaccuuugcaggaugguuccuacaucaguugaacgacuccgagaaggagguagcaucccuaagguucuucgaagcagugugagaguugcccagaagggagagccuucuccaacaugggagaguaacaucacagagaaagagucaggugagcuaaggucugcaguucacagcaaauguugggauaaaguaaguuaguuucugaccuacucagguucugcuuuaugcuagcuuccagcucagucuuacucuuugggcuacaguauacgugagaucuagcguugcuugcucucugucugcucuuuucccaagggauacuuuucuguaacucucaucuccaauguuccggagcuccaccuucaugaaggaugaagagaaagaaggagacgagaauaagaugaggcauuuaaaauuuagcgcauaauuaaccacuuacuaugcccuucuggcaugcugcgcucauuuuuucacagagaucagcauguauugaugauuugacugaaugauaccuauuuccuauguguucuaagaagccaaguugauucuuguaaugccuuccagacccugcagauggagaaggcccagagccauugagcucagcacucucuaaaggagcaacuguuuacagcccuuccagauauagcuaccagguaagucaagagacuucugggcucuagagaaagaagugccuguggaguucagauccuguguuccuagucgugacacacugucagcugcuaaagucugcauaguauagcccuguaagucaggcaucugcucaucugcucaccucagggaucuuuuuuuuuuuuuuuuuaauuuauuauuauauguaaguacacaguagcugucuucagacaccccagaagagagcaucagaucucauuacagaugguugugagccaccaugugguugcugggauuugaacucaggaccgucagaagagcagucagugcucuuaacugcugagcugucucuccagccccaccucagggaucuuaguaaagcaaaugcaugcaucagaaacugauguuugacugcuuuuguuagccauuaaaauguucugggggaaggaggagcaggcuaaugauggcucagugagugaaggcuaucaagccugaugaccugaguuuaauccccagaacccacacaguagaagaaaagaauggacucuuacugguuaugcuguguacuccacauuacuguuauagcacacacacaaccuuuuuagugugcagaauaaaagaauguuauaagcaggucaaguuauugaagggacuaaguuaaacuuccuuaugcuuuucucccaacucuuuuaagcuccugcagugugacaguccacggacagaaucacaaagccuccuucagcagaguucgucccccuuuagaggacaucccacccaaucuccaggauacaguuaucgaacuacugcacugagaccuggaaacccucccucucacgguucuucagaauccucccucucuuccacguccuaccccagcccugcccacccugugucuacagacucguuggccccauuuacggggacuccaggguauuacagcagccagccgcauucuggaaacagcacuggcagcaaucuuccaaggaggagcuguucuucaagugcugcuagcccuaccccacagggccccucagacucaccgaccucagacucgguuucucaguccagcacaggaacucugaguuccaccuccuuuccucagaacucuaggucuucauugccaucagacuuacggacuaucagucugcccaaugcugggcagucagcugccuaccaggccuccaggguaucugcgguuuccaauucacagcacuacccacaucgugguaguggggguguacaccaguaccgacuccagccacugcaagggucaggagucaagacucagacaggacuuuccuagggcuucuggauaugggcaaacugaacuuaaugagcccauagcugcuuccuuccagcugccucuggaaucaaggccgagcauaucgcuggggaagagggguacaaggugccagaggaaugggucuggucagcaagaaaugagacuuguggucaugacuggccuccggccuuggagaaagauguaaaucuugucugaagcagagacuauaaagaaguuucucccugcuguuaaggguacauuguuaacaagcaaaugguguuucgguuaguaacgguucuaagugcaaugacuuguguugaagccuaugucucccauccuugccuguagccuguagucacuugugcagugaggacaucuuuuucaauaauuuuuuuuuuuuucuuuucaaaagaaaaaagugggaaagagccaaucuuaaagccccaagccaucugaguaguguuaggguuuuaugcacuuaagggaaaaaaagguagguauguaaaugucugcugugagacaaccauuccuaaugcagaugcauggucaagguguguccaccuggagugcucccugccuuugucuuaaagccaccaggaaaugggcagggagaggaaugugggugccuacucugacugaggcuugcccggcucucugagaggaggagcuccuggguauuugggagcagauuugggauggacugggcuccagcuguuaccauccacuccuccuuccaaguuguuucacaguuuaaugauagcccugugaaguagagaagugaggcaggccaguuuaggaaacauccaguggucuggguaaucuuugaauuuuaauuuuccuauucccaguuaaucaggaguugcuguccuaagagcaggacggccuccgugacugaaaagcaugcacucaugacugcaggguaagaaugggacagauaggguugcggaguggcaccgacagggcugugauuguguguggggcauaccugccccacguuucuauggggaaugcuuauaugacagugagcaggugagaguuagcaagucacccauaccccuaacacuguucuguaggagagacaaagagcagacuggcuucuccccaucagugcauugugccuguuguacaccccuggaggagcccugaagccagcccaggugggguacacaaucuuuuuaaauuccauaugguugccagcuuauuucuuucacuuguuuacuguaauaccuggcguguuuuuauuuaucuaauuuuguauucagcuauaaccaugguaggguagugaguguaugacagugugaucccuggugcugcaguggaccguacuucuuuuggacaagauauacugugagucucccuccuuaccucuaauuguuuucuuucccauucccuagacucuuucaucuccuuuucuacccugaccuacaacuaucauaugcacagucuucucucuuugugugugacuguuacaaauuuucacuuuucaaaauugaaaucagguguuugcucaaaugaggggagaauuuuuuuuuuguuuugguuuuauuuguuuuuaaugcugaacccucggcauaguacuuucuguuguuuuccccacaaacccaucagucugggagagcauugggaguggaaaucauguugccugggaugcugguuucuuuguauauuauauaaaacguauguaaaugucucuccauuugggcugggguuugcauucucccauuggcuaaaagccaaggggagaggccagcgggcaggcggcccucacccugccuggcacgugcagagaccccagccacucugugugggcagggugcugucaagaccagaccucugggggggaggguggggggaggggggacucuuggaagggaaggagcaccacuucuuccucaaguggaguguuuacaccuugcuguaacauuugaacuuucacaagagauguaauaauuuugauaauaaaauucuuaaccauaaucaucauaauguuaacaauguguuuguucgcuucuggaacaucacguucccugauuuaaccuuuccucacgaaaggcaagguggacccguguccuggguugcucuuaguggaguucugccuagaauggggucaaaacccugacuccucuuccucugaccaucuaugcgugauaccaggccaguguuaauacaaaccugcaguauuaggacauaccucuggaagcugacuggucaucugcccugcagcuaugaaacauugauguuuuucauuuaaaggcaaagccagccauuaucugugguaaaaggguauuaugcugauuaaaacagaaaugggucugaacaaagcaaugucucuucucuccuagaacuucuguauaggggagagguaaacacugguguguaguuuuaauauucacuuccaguuuauugugcuuguuuucaccauggugauaccaaaagcauaaaguagaaacacuuuccaaaccccaacagcauuuggagaccaccuccauauuacuagaggauaccccagucuagauaaaccaacugucaccacuuguccucucagcagcccaaauagccuuggaagagcaccccaggaaaaauaagcaaucauaguccccugacacugagccugcaugaaaaagaggcagcacuugucuucaaugguaagugucaagggcaauagugucaggugaaacuggcugugaagcaagcagcucugugaccuugaucgguaccccgauuaagccagauagaagaaagcagaacggccaacuggcuacugacucuggugcuauuaggugguacaggcaaaguugggaucauccaaagccccugcgugccgcagguauccugggauagcuaugaguauggcccaacacacuuguuaaccacaucauguugcgguaccaaagacuaggugauugaagguaucuaccguauccccauuagaaacaccucaggcgguguuacuguuuccuggacaggucacugugguuaaaagggccacacuuguuugucagaaaaagucuccaaggaguugccacugaaacugagaccuuagugacuggggagcguuacuggugaugccaguuacuucagaaagugugagcuccguuagaagcuugauugagauggagcugcaaaggggcuaacugaaaguccggugguggacucgaccagacgggcuaaguucugucuguuaccuuacagacaguaugugaucaacuccaguaaaacagcacuucuagaaacagguagcagauuagauuugcuuuguagguuguagcuuauugucccuaaaugaggaauccauauucucagcagucgggaaaaucuguuaagauuuuaagcaaaaaaguggcaugagcuacugugugguuuacugguucuuguuuucuuacacuuaacgcucuuuaagauugucuugauccuguuaaaggaaaaauuaauagaaacugagaaaaccguuuccagacauuaacaauuguugaggcaaacaaugcacuggccucugugguggcuauucuugguugucagcuuggcuacaucuggcauuaucuaaaaugcaaaaauggcgggcacgcuugugagagacuuuuauuuugaaggaggaaugucuacuucaaaucuggaucucugagauaggcaggcacacccugcacucaucuuuugagcugggaaaaggcaugccuuucuuuaaucuggaacucaggcaggaagacucuccucuuaaucucuaacgugggcaacaccugcuggaagcccacggaaggauacggaaggagggagcuuuguucuuugccuccuugcccuuaccuuucuggcaaauccuagagccuccuccuucaagaguccaauguacgcugaagaccugcugagacauccagccuugugaagugugcaacuucuggauucuuggacuuccuguuggguuagcuggaccuuauccguaagucguuuuaauaaauccccuuucuauauagaagagguucauucuguagauucuguuacucuagagaacccugaccuucuguuaaaauggcagugcuagagauaaaaaguaccugauaucagguauauuuugcaguuacacgccaggaaauugacaguggauuugaauggcagaaguuuacucaauaccuccaaccagcuguguuuuggugaguguguauguaagguauucaaacaugguaacuguauuguuucuaaaguaauuggaagcuaaagauuucuuggguauuuuggaguggauguuuuaggaauaccuaaaauaccugucaccauccaccacuuaauucugccucgaauaagaagaaaauaaguggucacaugguucucuuuaaaacaagcauauuccaaccaccacaccuguccaggaugcuguuugguggggauggcucugcaucagguaggaauaugaagacuauuguccaucaucuaugccaugaauuuaaaacugcuuuaaauaaagcuuguuuaagugacaaauaguaaagauagcuagcacagacaccauucacaugagaguuucaacagaagcaccaaggagucuggagaaaaaacaaaagcuacaacugagaaaagcuauccuaagauaaucgaagcuacaaauuagggggaaaauauauauguaauuaauuuuugucaacaugccugggaagagggaaacuuagcuggggaguuaccuccaucagacugaccuguggguauugucuauggggcauuuucuugaucgccgauaguggugguuugaauagguauggccuccauaccuaugacucagcuguuugaaggcuuggcccguagggagugucacuauuaugagguauggccuuguuggaguagguguagccuuguuggaagacgugugugacuguagggguggacuuuguuagucuccuaugcucaagcuacauccaguguagcacacaaucuucugaugccuuuggaucaggauauagaacucucaacucuuucucuaguaccaugucugccugcauguaguccuguuucaugauuaauaauggacuaaaccucugaaacuauacaccagccccaauuaaaauacuucuuuuauaagaguugcuauaucauggugucucuucacagcaauaaaacccaaaacaagacagacuuugcuaccaggagugauagaccugaccaugcuuguguucggaggaauguagaccucgggaauguagauuagaaaagcaguugaaugcuuuaagugaggccuagacaguggugcugagcgugauuugaacuguguggccuggcucaaauuucagaggacaagaauuuuaguauguuagcuagagaucauucuugugauauuuuguaacugcuuuuugucuguguucaaaaaaucugccugaagcuaaauuaaaggguuagagaucaguugcauuugaagaggagauuucaaaacagccugugguuauaaaugaucaugcuuauaaagacuauagugaaaaugggcauccgaagaauguggcuaaauccuguguucaaggaaauaaguugauuaaagaaaaacuggauguugaauacagggaauggugaucagggcaagcuccacccagcuaaacuucugauuuguguaaaaggauuaaagaaaagcuuagguccaggcgugguacuccacacuuuuaaucccaucucucaggagacagaaacgugcagaucucuugaguucaaggucagccuggucugcagagaaagucccaaaauacccaaguuugggcagugaaggaaaccagaaagcuggugaagauguaauugaacaagggggccauuuuccagccccagccagcagcaaaacuaaagaaaguuacugaggccguuguguggcaggggugucccugcauggaagccuagagaggcauugcauaaagcccugaaagugaagccuagauugccucagagacccuaagauguuagaaaugccagagccgugguguaccugcagaggacaacucuggaguggaaccagcccaagauaaagaaguauguugcagccaacaaagcugaaaggaguuggagagccaaagaauauuuugacaucagacauguggauggagaguuuggaguuguccagcuaguuuucaguuuugcucuggcccagcauuuccuuacucugcuccauuucagaaugguaauauauauccuaugccauuaaauguuuugaaguauguggucugguuuuuuuguuguuguuuuguuuuguuuaauaggcaguuaugguuaguagauugcaugaaucuuagaacagacuuugaaaucuggacuuauaaaauuguugagacuaugggacuuuggaaguuggacgaacuacauuuuucauuguguuauggcugcaagccuauguggggcaggaaauggaacguggugguuugaacagguauggcccccauagauucaugugcuugaaugcuuggcccauaggaaguggcacgauuaggaaguaggaccuuguuagaguagguauggcauuguuggagggagucugucauuguggggguacgcuuugaggucuccuaugcucaaacuacacccaauaaugucagucaccuucugcugccuucagaucaaaauguagaacucucuauaccucuaacaugucuaccuucaugaugccauguuucccuccauaguaauaaagaacuaaaccucuggaacuauaagccagccucaaugaaaauguuuuccuuuuauaagaauugccuuggugucucuucacagcaauaaaacacaaacuaagacacugauugggccuuaucauaccuagguccccuggaccuaagcuaugucagaaacgagcuaaguaaaccagucagcagcauuccuccguggucucugcuucaguuucugccuccagguuccugcuuccuccugcccuggugucuccagaugaugaauuguaaaguguaagcugaaauaaacccuuuccccugaguugcuuuggucgugguguuuuaucacagcuacagaaagcaaacuagaacacauacuuaguagauuuaaucccagauaaccaaaaucaagacauccugaggcagacagugccuuacagcagccagcacuugcaaggcugagugaggcaaaaugaucacugaauuugagaucagccuagacuguagacagagguucucaaccuguggaucaugacccuuuuuggaggaucauauauauucaauauccuauauagcagauauuuacauuaugauuuguaacaguagcaaaauuauaaaguagcagugaaauaauuuuaugguuaggggccaccacaacaugagaaaguguauuaaagagucuuagcauuaggaagguugagaaccacuguuauagacugggucugucacucaaaauauaaacaaagaaauucuaauuaagauacuggauuuuauuuuguguuacauucuauuuaguguauagauuuaguguuuaugugccacagucccaguguggaggucagagaacagcuugugugagucaguucuguccuuccaguguggguccuggagaucaaacucagguuaacaggcuuagcuuagguccguuuaccacacugagugaucucacugauccagauagcuggauuuugaaguaaaggaaaaauuccugaguugcguguguguguguguguagguguuugucuccuauuuuauaguggaaugaaaguuagaccacaucaauguuuugagacucuauuuuacagggaaguaggaugucuuuccuuuccuuguugcuuucuugugguacuggguaucaaacccagagccaugugcaugcuaggcacacaccaaccaaucauucugucuggugggaucaauaugcagaaguuaggcaggauguaguaaugugcuuggggagcuagugcgggaggauggugagucaguuccaugcuuuccuguacuacguagggaauuucaggcuagcuacaauugaaauuccuggccagccuuagaugcauaaggagaacuuguaucaaaaccagaguacauuuuugaagaacuugagggaguccacugccaugaacaguuccuugggguuuugaauuuuugcugaccaaacccuugagagacaucaaagucgaaccugacaguaacuuaaaucucauuggcaguguuacugcuaugacacaaaacugcgaaugaacaccggacuaaguaggguuuuagccguaaagcuuuuuaccugcaguguagauacagugccaccguaagugaguaccagguguauccagucgucuuacuggugagguggcaaacagaguggaugucuuggcucugaugacuaucagggugcagaaaugguuuuuaguuuuuuuagggaaaugacugauuacaaguuugaaagaagauacguguaggguuagccuggaacacaucaaugacccaaggauuucaaagauaauauuaagagucaaguuggaaggacucucaccaacauagagaaaagucugcucaucaaagauggggugcuccugagcaaugguuaggauuuuauacacagccaaauagacaauuaaaccuguuuaaauccauguguucauaaccaaaacaauuguuaauuuugaaggauauuagaaagaccucaccauacuuuuuaguguguacuuauuuuuuuuauuuaugcaugugagccugaguaauguaucuguaucauguguguacagaugcccacagagcccagaaaagggcaucagauucccuggagcuggaguuccaggcuauugugagguggcagguuggaacuaggaacugaacuccaguccuuugucaguaaguacucguaaguguagcgggacauauuaaaaaauggacuggcgggcuucgcacgcuaccaccagcaaccaguggaccacauggcuccagccaggugaucgcaacucaguggucucugauggggcugggcuacucucucugccugacaacucuccagcagggcuggcccucccgaguucucuaccaugccagccccacgcaacaaccguccaccccauggucagcugccacaccacccaucaaccacguaaaucaaacucuuaaagcuuguaauuaaccaaccagauuuauguaucaguaaauucucaacuuacacgaugccaauacaauaauuucaggaccaauugauaaugguaaaagcuuuaucccaauuauucuaaccuuaugagaucauaacuaccuguggcugguuaaaggcacacugguucccgccugccuccaucuuguucuuccuccuucuccccugagacacucucucucccugcaacucuuccuuccgcuucccuuuucccugucuaaucacaggccuccugcuacacuaauguaguugaacagggaaaaucuuguaacacauaagcacugaacaaucccucuauagucaucuucuagccuuugauuuuuuuuucaaacugguaaagauuucaacaguuacaaguauguuauuuccuuuauggaaauauuuccauaaugaacuaaagaucuaagcaauaagcagauguugauaacaaaguuuauauaaucuuuugauucaaaaaaaucuaucaagaagucauuaaaauguaucagcagcuggagggaugacucacuggcugagagcacucuuccaaagggccuggguuugauucccaacaccacauuguggcucacagucaucuguaacuccgguuccaagggaucugauguccugaccuauguggacuagacauacaugugguacacaaacaugccuauagccaaacacccacacacaggauaaaaaauguaaaacacauuaacauguuugaguuugacuaaguauguucaauuaccaguuugcuugaauuaaaaaaaaaaaaaaggcacagcccaacuacugaacaagagaaucuacauagucuugaacacugucaucuuagcaauugggcagcaaaggcagaaauaucacugccaaguauaccccuaaucugcauagagaccucuaggccaaccagaacaucauagugacaaucuaguuuuuaauaaagcaaccaaccaacuaagaaacaaacaaaaauauaaaccagaccuggagaaauggcucagcaauucagacugcuuacugcucuuccaaaggacccaggaucaguucccaguacccacaugguggcuuacaauccuguaacuccagcccagagaaucugaugcucucuuucagcaucuuagagcucuugcaaacacuuugugcacauaaacucacaaagguauacacacauuauuaauaaauacuuuuuaaaacauaaaaggaauuacccagcaagcgggaagccagccaaacuccacuuugggugcuuagccucaaguagaggaugauaguucguuuuuuaaaagggaugagcuauauuuuugagaguuucaguaggagcauaaacaaaaaauauagauaccauacaagucaagccacagucacucugaagaaaaugcugaggccguccuacuucagcagcacaugaaggacuccuucacaugaggauucucuuuaagggugguuuuauagcuuauuaacuuuugugugugugcuaugcugcaucucucaugcauaaucaaugacaggccacuagaaauuggccagagaugguugacaaccccacaagugguuuguuucucuaccccuagggccuaggugccuagccaggguggauguccacugagugcuuuguuuagugagcaaaugaauuugaagacauuccagucaacccggugaauccugcagccagacuccaucuguuaaggugccagcagccaacauugaccuacccuuguucaugugucucaccacaggacugaccuuccagaaugaaugugugcuagucaucuuggcucccaacaccauucuugcccuguagcuacuucccccuaucucuucucucauuggccuuugugcuauguuucagaacaugcuucuccuuuauagauaaacuucaucuccuucaacucaccauuggcuuuauuggggaucacacuuacaccgaagaagugugcucuguguguguguguguguguguguguguguguguuuaaugacagggucucauguaggugagacuugccuucuucuuucuuacuagccaagaacaagaaugcccuugaacucaugauucuccugccucuaccucccuugugggaagagaugggauugcaaagcacgcacugucucauccuuacagaacauuuaaauacucaguuccucucaucugauugcgucaagcuucucauugacucucccagacacuagcaucuuguccacaagauuaaaauacccuccauccugaggcucuugucuuuuacuacguccuuuagcauagugauucucaaccuuccuagugcugugugacauuuuaaugcaguuuuucauguuguggugaccccccaaccauaaauuauuuuuauugcuacuucauaacuguaauuuugcuacuguuaugaaucauaaugcaaauaucuguguuuucugacggucuuaggugaccccugugaaagaguuauucaggucaaaggggucgugacccacagguugagaaccccugcucuacacccuuucauuaccuuuaucguucuacucccuagcaagccucuuuagguugcuuugugguggcuggcucuccagacuaacuuagaccacauuucccccaaauugggggaaaccauguauacagguucuucuccaaagucuuccuggaauauucaggugaccauccagggucuguccucacaauuucuugucuuuccuacuguuucacaaaaaccucaguccuggguggugauggugcacaccuuuaauccaaacacucaggaggcagagaggcagaggcagaggcagaggcagaggcagaggcagaggcagaggcagaggcagaggcagaggcagaggcagaggcagagaggcagaggcagaggcagaggcagaggcagaggcagaggcagaggcagaggcagaggcagaggcagaggcagaggcagaggcagaggcagaggcagaggcagaggcgcagggaggcagagaggcagagagagagaggcagagaggcagaggagaggcaggaggcaggaggcaggaggcaggaggcaggaggcaggaggcaggaggcaggaggcagaggcaggcagaucucuaggccagccuggucuacagagugcauuccaggacauccaaggcuguuauaguacaguaaccuguccccccaaaaaagccaacaaaacagcacacagacagcaagagagacacaggcagagggggagagagagagagagagagagagagaagcccuuaguuccucuuagagccucuuuucaggcccuccuuguccaacacccucuccagaucucagggcagaucuguucccuucuuagccuucccucccauugauuggaacuauggcagauuuguggccaccugccaggccuugucuucagacuuagcuacuugagcauccuuuucuaaccuccacuaccaucucagccucuugguucacugagaaaauagacuucaacaggccagagcuccaacucuaacacaaaagggcaucuuuucagcccccaccucuacacucugggcuggcucccaccccuucagagcuggccccuuugcaguccucucucccauaccuuccucacaucugugagcuuugaaaacacccacauauuuagagacuguugccgccucuggguaaaaagcugguucuuauccucugcugggucauggguccacuuagcagaucaugacggaaccuccacacauaguucucccucuuugccagaugauggauaaucuccacucuaucaccaaccggucuugccccgaacuaaccucacuuuggcugucuccaauguuccuaccaacucccugguggccuuaucaucagcccuguaaugcuggaccucucuccucauccuugguuuccauagcagcacacuugaaguucucucacaaguuggcaugcuucuguccucucucuguguacauuucuuccucugacuggccuuuacaccaggcaucuucuagccuccccuggcagcucucuuuacacugugcagucaguuacauuggauaggcccaucuacacuucugauugcagcuaugacccaagugcagcugcccauggccuacaucugucaggagagccucccacauacgaacugaucagaagucuccugauaucuuagcagaucauucuagucccucaaaaaagaucuuuuuuuuucaagcucccugucuuccucaaugucacugacauuguuucuuuuaucccaaaaacaguuaccaaguguccucagcuccacuccagagcaugaacucacucccucccucagaucuacugccaugaccucaugucacaccaggugucuagcucucucacaucuaaacugucuccucuuuaaauugugucaucccaacuuugauaucacaucuacucaaccugaagcaauguagagaugagcauugcuguaaguguggcacacaaguuugugaagcauuccauauuuuaaaauuuuucacaucuaucugucuaucugucugucugucuauauaucuuccuaucuaucuauuuuucuaucuauguaucuaucuuucuauguauguauguauguauguauguauguauguauguauguauguaucuaucuaucuaucuaucuaucuaucuaucuaucuaucuaucuaucucuaucuaggggagggcauagccacugugcacaugugaaggucacauaaccacuuuugggaguugguucucuccuugugccaugugggucuuaaggaucuaacucaggucaccaaguuuaagaguagacacuuuuacucacagagccaucucucaauccaaaauccaucuucuuuuuuaaaaauuauuuuuauuauuuuuuaaauuauucauuuuuauuuuaugugcauuuguguuuugccugcaugcaugucuaugugagggugucagauccucuggagcuggaguuauagacaguuguaagcugccuuguggguacuggggauugaacuuggauccucaggaggagcagccagugcucuuaaccacugaggcaucuuuccagcccccaaauuuguuauuuaaaaaaauauauuuuuuaauuuacuuuuuaauuaaucucuguguguguguguguguguguguguguguguguguguugccucuguguguguguguugccucuguguguguguugccuguaugugugucuguacaccaugugugucuggcgaucuuggaggccagcagagagcaucaucuccccuggaacuggaguuacagaugggugggagcugcuucguggguauugguccuugacaagagcaggcucuuuaaccacuuaaccacugagccaucucugcagccucccaaaauugucaccuuuuggcccauucauuaucaccauaccaaaguaaucuuccugaaaaugugagcccuguguaaaauacuucugugaacuagaccugggagcugcggugguuugagugugguguucccuauaaggcuuugguacuugaauacuuggucccgguuuggaggcuguuuggaaaugauuaggagguuggccuccaugacagaggaugucacuggagguaggguuuaaagauuuccaagacaucaagucacuccuaguguguucuguguccaagcucuuugaaacugcuccagguuccugccaccugcucugcucugacaucauguacucuaaccuucuggagccagaagcccccaauaaacucuucucuaaguugccuuggucacacugguuuaugacugugagagaaauguaacugacacaguggcauucaccuguaaucccagcccuuaccagcugaugcggaagguugcuuugaguucaaucuacccagggauacacaccaggacccugucucaaaaacaaacaacuccugccauggguggugguguacgccuuuaacuucuguacucgggaggcagaagcaaacaguguccucggucagccugguccacacagugagcuccaggccagccagggauacacagguagacccuggucuacccaccuccaaauaauuaaggaaucuuccaccacucuuaacucugagcucuuucagacccuuguugacccccaggcuugucucugaccccuccgcaccucacauuuccugcuucaccuguccuagcugcuuucagucucccggggauauaauccacccaccugucacucaagcugcuuucucuuccacuguggccugccugucucucgcucccacacaguaagauuuccuccgcauacgcgcauuccaccagaagccauguuagguaccgccccuaagagcacccacaagaagcuggcauucagcagagccugccauguucugacaugcucaucuccacauccagacgcacuuuuagaacaagucauugugugcaguaugugguccacaugggcagcucacacacgugcccccaaccaccugaccacgcccuggaaugcggugaaugucggaauucucaucucuucaguguggauuuuuauuuucuucccuuuggguaagugcucuagaaagagguauccuggcuuccccgaguccucacaaaagaguggagcacuguuacuguggucagaauaccgcaugcagaaucaagacugugccagagggaguauccagagugccgcugcugcugucuccuuuugccgugucacagaaccccgguuucauuugcguuggcaacgugcccaguuaauguuucuagccucuuucaguuacaugugccaggugacucaguucuguggcauuuccaggcagcuucaaguggcucauagaucaaaugacuggaacaccagcagcuaaccuaagcuaugagauacuuuuuaaauuuuuauuaauuuauuaauuuauuggguuucucucucucucccucccccccccccccccgucucuccauaaucucccuauguagcccuggcuagucuggaacuggauauauaaaucaagcuagugccaaacucacagaaauucacaugccccugccuccuaaguauuggaauuaaaggccugugccaucaugacugcccccccuuuuuuaaauuuguauuuuauguguaagggcauuuuaucugcauguaugcacguacuacaaucacaugcaugccugguguagcaggucuccuggaacgagaauuacagaugcuccuggauucugagaauugagcccaguccucuagaagagaagcccuugccugucgcugcugggccaucccuccaaugccaaccccacgucugugagcgaugcuuguggaaaggugauggcuacaggggacaugcagacaggacccgggcuccugcucccaacgugggccauggucaugcuauagaaauacccagacauuuuuuucuuucuugagacuagaucucuucauguagucuaguauggccaugaauuuauaauccuucugcuuccgucuucugaguucugagaucacagguauguauuaccaaaguugguuuuguuuuguuuuuuuuaaagcugugguaaaagaaacugucauuaagucacacugaacauuagcacuccaugaauauacagccauugauaugaauggaggguugggcuguaucccacccaugaggcccugggucaggagucagaagcagcagccagcaugggugauauaaauugugucuuuauuugaacaccauuccaccugcacugaagcauaaauccagcagcagaagggggcgggaccaaaagaaauguuaccaaauuggacagugaacaucuaagacacauucagacagaacuuacuaguggggcacagacaacaccaagcuacccuaacacacagcacagguccuuggaggacugccagucagaguccugggauggcugguggcuccugcucucuucucaggaauaccuccugucccacccaaaagcuagcucugagccagacaagggcccccagaagccucucaugcuagaaggaauccagcccuuccaagaggguuucccuuuuuugguucauaccagaggcuggagaaggacuagucccucugugcucaagagggacucaacuuguagaagcuuccccguccucccaagcgccaucugcaagcugccaucuuggcucuugcaggccccagaaggauguuaauauuccccacauccucaggcccuuggaacagcuuuccuccauagcucugguccuuagagggcaguguucuacuucccucaaccccaaggacuagucuaaacagugcucuggagcagaggcuggaccccauugaagcuauaacugcuuucuccucuccccucucugucaagagcaaagaaauccgcuaacaccaaacaccagccucuccauccagucacaaauagcugaggauuuucagggacccaacaacgggaagcucuugguuagugaucagaaacagagauguugauguccauauccuauccuuccccaaaggcuaacaccagcuccccgcccuaacuguccuacgucaacugccaggaggucaguuagagccucaccugaguucuuggccgaaacauccauuuucuuugucccuaacucuucuaagccuucaagaccacauuuugguucccauugcucccucucuucuuuccccgcgauacccuggggcuccugcagacugcagaccucagccugccagccugaaacuccacacugcaccgcugggcagcagcugguuggcuggagaguggcaagaacacugguagacgacuccucagagggaacucaugcccuuccucucugucauuagcccaccucuaucuaacacagccuggccugcucggucccuuguacacacacaguucucuccaaaggaucagagcuaccgcagacaccaagaagucaauucuauccugucugccaaagcacaagggacccccugggcagcaaguguucuuaggaaaacaggcucuccaagcacacacauggcugcccuccucaaucccuagcguuuccucuucacacacauacccacuaucuucuuucuucucuacauuuuguucuugcucccugugaauuaccccuccauuucccaccucccagguuucuucaucugcugcccauccauggaaaacccauucuaguucuucacuucuccaucguugugugugccucuccagaucucucucucucucucucucucucucucucucucucucucucucucucucucucucucucucuccauucucuccauuccucccuuuccaugccugucgccugucuccugccucaucuuuacuucgccggcuuugcuccugcccgcuucucagucagucacccacuccugccccucucgccacuaccuggacccuccccucugguuugaagcugaggaucugacuuccugcucccuucuccuucugacaaggcucccccacccucccuguccauucccagucuccuggcuaccugcugaagaugacuccagcacucuggcuccagggagggaccagguugggacaagagcuggggaagacaagggcaguggccaaagcucaggaggaggugucuacccuggaggagagaggagaaaauguggagaugggaucuggaacguuccaagugucaggaauucugccaggaaccagcaucagauuccagguaggguccugcuggggcagccuugggucaugggccuggcucaggaauccuaacucagcuccaaguccucugaaaaugaacacaaggacagcaaacucauagacuagccguucuuccucucuggcugaggccaauguaacacagggaagugagacgccuccuggacagccuauaggaggcacacauuccucgacacaaggaccaggcagcaggccguguccucggagacauuauguuugaugacguucgucugccaccccuccacuggaaacuggaggcuuuucuaugauuagauggcucugccaccagauccauaagguagccaaagauggucaaaaacuacaacaaaauaaaaaacaaaacaacaacaacaacaacaacaaaaaaccaccuggaaucucccucguuuuucucucugcuaagggggagggaggggccccccacugcaggagaagagagaucuucucaucugcccuuuccuaacacacgcacacacacacacacacacacacacacacacacgcacacacaaacacacacauacauacauacaugcacacacauacacacgcacacacacacacacacacacauacacacauacacacacgcacacacacacaaacacacacauacacacauacacgcacacacauacucacgcauacacacgcauacacacacauacacacacauacacgcacacacucaugcacacacaccuaccucagcuccaagcacugcccaugagguugcagacccugggcuuaucgcaaggcgagaagugggcaaagaggagaaagaggcagggacaggguaacagggccugggguggggacaaggguacccuguucagaggugaccugcaaguucaaguuaggcagaaaaguaucaaagacgcaagacagucucugcccuuggcagauguccaggguguaggaagcaugagaaggagagggguaaccccuaaguccccaccucugugcccccucuccacagccaccaacccugacaaugggccugagaagucuaugcuguacaaaacaggccaggcucgaggggccagucaccagugagauaucccaguagggaagaggccaggccagccucaggcuggaacuagcuuccuccucccacagccuccagagcccgugucucccccucagacucugaggugaugaaggacuaccagcagcaggaaggaagacccuauccuuucccccucagcacggcucagauucuuuugagagcugggugcaggcuugaaugagggaggcagaggaggccccguuggggggcugguggcaccuggagcuuuguggcagauguggugggaccaucaucagcgaauaaaaauaaaguaggaaagagucuggcccuccuggggcaguguguugaguaagucucuuuaggcgaucaggaccggcaggcaaggacgcagcaggcagcccugcacacugaagggguccaaggagauugcgcggcagagcguccuuucccuggggauccccagggaccuccagcuagucuacacaggagagaaggaaaccgagggaccaaagagggaggcccaggcuccacuagguccaauggaggcggggccagacucaggaucucaagggcucugccuucuugccaggcugccaccuagccccugccucucuucagagcccggaggagguccgugugcagccaguucaagauuugggucuggagcuugaacgcaggaaugagagggcagcagacgggauaugcugaggucaggccaacuccugggcuauaaaaucccggcuuucagggucccugugugugagcaacagggcaugguaggacuccccagccagacacaucaccuccuggccgcagcacggaacuuacuguagugcccacgaaaucugugggaggaagggaggggaggggagaaagagagagggggaaggggagggagaggaagagggagaauguuagagccugugaggucccagcugcccccucagccacuccccaagacacaaauggccagaagugacuagaaccaaguccuugaaugacaggucagccuuaagcacaccauguaacccauuagcugucaugugugaaauaaagacccucucccacuccacagggccauucugaaaggucauagcaaaugccuuugacuuggaacuggccuacaguguccaccuccaugaagcaguuaaggaugcagauggguggagcuccccacaucacugguguggggaguuuuauugggcaggaagggguuguuuuuaacucucuuguauccuaggcuggcuuugaauuuacaagguagcagaggcuagccuugaucugauucuccugccuaugccuucagaguacgaagcuuacagguauacacuaccaugacuggccucccauaucauuuuaacaaugagcuguagcugggaaaguuggcucccaucuuaaucuuaacucuuaacaggaggcugagugaagcauaaggcuugccacagguaugggggcaaccugggcuacacaguaaguuccaguguauccuagucuacaaagcagagccaugucuuucaaguaaaugaacuugugagggagccaugugggaacaggagagagacacugaauggacccauccacugagagguucauccauccauugccaggguagcaucagagaauccacauaggcuuagccuugcacuucuggaaguugccaccaggggguagguccugaccucaaaccaagaccaaagaaccuacaugaugggagggaucugucagagcuuuuaaggucagauuagcagagaaaugucccaggaagcuaauaaaaggggacagaaaaccucuagccuggcugagcuguaagauaaguagcguguuguagaaccuuggccucacugagcucuaagauagguaguguguugucggaccuugguucuggacucgaaccugcguucaagcccugacuucacuacuuagaugacuuggagcaagcucucccucugugugcacaccauccccugccccacccuuguucucaccuguaacccgguguucauaaugccugccugcagaggccuguuagagcugaccgcuuugagcaucccccaaguacuagacccugcuagccgcuuugcauacagaaacuuuccccucaaccugacaguccugggagacggaucuguucucaucacccugguuuuaugaaguaugggaaacugaaacucgagggcaaguaauuccuaggcuuaacccgcuucuacucuagucugugcucaccauucaagaagacuuuaagcacaacacugaggucuccugcuagaugaguagacacgcagcuguguauguuaucauuuaagcucauuguauggugagcagagaccguaagaaaugacuguaaggaguggacaagcuaagcauagguugaaccgcgggaaccacugcucugagacucagucuaaggaccgugugcccauacacacaagcauccaccacaaugccucucucagaacuggggguaggcugacauuagggucagaagacucugcuugaccucagcccuuuggaggcuaucuggcacuguuauuauauuuuauuucugaagaccccaagggaaaaaacuugugaauguguguguggagguagaagaaagauauucacuguagugucaucaggaaaccucagaccuucccuaauagaagaagaauaaaauaaaccaccauucaacccgugcgaugacguguguggguaccaauccgcuuaaaagcaguuaccucugagagucuggcuuucuguguaaauuguuuccuguuguuuugagacaggaucuugauauguggcucaggcugaccuugagaucauaauucuccaaugccagccacaagagaacagggguuaugcagguaugcaugacugaaauuguuuguuuuucuuuuuaauuaaaugaaauuuauuauucaugucuguggaagacaugugagguugugugagaucagaguacagccugggggucgguucucuccuuccacaacggggucuaggcuucaaacucaauuaucaggguuucauaacaagccaucuugauggcccuaaauuauuuccuuguuguauuuuacuguuacuugauauauguaauauguaauacaccaguuauacagcaugauguaauaaauuugugaaugguaccauucaaagcuguagcuguugauaauuugcauauagcacaagccccagucucacacccuagguuccuccccuucagacccaaucccagaugaccacccucccagcuucuguacuuaucuuuuuuaagguuacuuuugucaggcgugguggcacaugccuuuaaucccagcacuugggaggcagaggcagguggauuucugaguuugaggccagccuggucuacagagugaguuccaggacagccagggcuacacagagaaacccugucucaacaaaaaaacaaaaaacaaccaaacaaaaaaagauuauuauuaaaauuuuauuuauguguguaucucuguguugguguaagucacauguguucacacagaugcuuguggcagccagaagagggcuuuggcuccccagggucuagagucaacagacagcugugagaugcccaaccugggugcuaggaaccaaacucauguccucuagaagaacugcacaugcuuuucaccauugagcucucucuccagccccauuauuucuuuguuuuuaauauauauuaaauacauugguuauaaaugaaaauauauuaaguauauauuaaauaaauguaauauauuuaaauauauuauauuuuaauguaucauuauauauuauauuaaaacaaauuauauauguuauauaauauauauguauauauguguauauauauguauguauauacauauguguguauaauauauauguguauauauacauauauguguguguguguguguguauauauauauauauacauauauauauacacauauauauguguguguguauguauauauguauauaugaccugguguguugguguaggucuguaaccugaauacuugaagugugauuaaaggaagauuaaggcuaucuuugauuauauagugacuugaaagccagcuuggagaugcugucuaaacaacaacaaaaugugugggaauggugacucuccuguaauccaaguacuuaagaaguugaagcaggaagagcgcugucaacgucaaauccagccugguauugaguaagacccuauuuuuauuuuuuuuuuaauuuuauuuuuuguuuuuuugagacaggguuucucuguauagccuuaacuguccuggaacucacucuguagaccaggcuggccucgaacucagaaauccuccugccucugccucucaagugcugggauuaaaugcgugagccaccacugcccggcaacuuccauuuuuuaaauuuuuauuuaagccaugcaucccuuauuucugcuuggcuugggacuuaaugaacacacugcucagucacuucugaacuuuccuuuucccucuccacauauaguuucucagucaccucuguccccucacuucacaguguggggcaucagaugaugggaacccacaaccuuugaaccucagccuguuugcuuaguuuucagguucucugugcgcaugcgugcaugcuugacuguguaagagucucucucucucucucucucucucucucucucucucucucucucucucucucuguguguguguguguguguguguguguguguguaagccaggggacaaauuuuccagggucucuuuccaccuuguggauccuggggaucaaacucagaucaucgaguuuagcaucaagugccuuuuacuguugagccaucuuuuuuuuuuuuuuuuaagauuuauuuauuuauuauauauaaguacacuguagcuguccucagauacuccagaagagggcaucagauugcauuaaggaugguugugagccaccaugugguugcugggauuugaacucuggaccuucggaagagcagucgggugcucuuacccacugagccaucucaccagccccuguugagccaucuuaauggccucuguguacuccuuuuuaaaaucguuuaaguguaugggugauuuugcuugaguguauuuaugugcacuauguggacagugccagaggaggccagaagaggacguugaaucucuagaacuagacuuaaagauggcccuguggcuucacguggauguugggaaucagcccagggccucuggaagaguagccagugcucugaaucgccagcucccuguguguaauuuuugcuucacuccuuuuauugcaucugcgguugcccuuuccugccucacagcaggccuugcccucugguccacacacuugccuuuguucuccuguuugagcuccuccugcagcagguccgucugccgguugcccagcacgaaggcaaggaaggacaggaugagcgcguugaggaugccgaugauggccagaauguacgcccagcgcacugaacagucccccagggaguacuucccugucuuggccccgcacaugucccggauggucucagcaucccagccaucaggaaagaucauacagcccaagacgaggcacagggcuggccaucaggagcaggacccacaccgacguggaguagggaggaaagagaaagcauuauuacuccuuagaagugagacgguggguggaggcuagguccugagaauucccccagccccaucuaccaaucugaaugugugguaacuacuuuucaugcauugggagagcaacguugacccaaagaagcagaaaauggaacccucaacuucuccugcuucaccuugccuuuagggaacaugaacauaucaaugccaggccacgcccccugacagccucuuacucucccccgccccccauccucaucacuccaguuuuuaugaguuugucuuugguuuuugguuuuaauuuuguuauucgaucaacgguggcucacugacacuuugcauucguucaaagaugcuaggcaaacagacugcagaggacugauggcagggccagccuauagauucuccacuucuagcugugacugggaggugagaggugccaggccuaugcguucuguggaauaggaaucauggugcuucagagacauuuagcaaagugccaauuuguucaaacuuugcugugggccuacugucugucaggcacuagagcagagcucagggaggcucuuggaucugugucucauagaguuuacauaggagaaaggaagguugcaguauaggguuuaggauuuaaauguugccccagcucucugcuagcuuugugagccucaauuccuuuauauuugugccucaguuuccaaaucuguaaaaugggggugguuaagacuaucaucaaaugacuauaaagaugacagguggccucaaaguguuuugcacaguaacuuccauauaauguuaguugucaguaucaaaacuagucauaacaaguaguugccgaucuugccaagguucuggguucuguucccagcacccaacauggcaguucacaacaauuaucuauuacagcacuuccaggagaucuaacacccucuucuggccucuguaggaacugcauacacacggaacacauacauaaaugcaggcaaaacacacacagaaaauauaauaacucaaggucaucuucaucuacacaguuacaagccaguuugcccaacaagacaccaucucaaaaaaaaaagccagacaauaaacaaacaaaacaaaaaacccuagucauaacaaaaauaauaauuacacaaauaaggaaauaguucaguagguuucaggugagauagauaaagguagaaagggcaggccaggaugacccuguaaagauaguuccuucauccaaucuacccacuuggguuaaacuaccaaacccucccaacaccagccuaggcugggaguggguggggcaagucugagccaaccaucucacugcguuccuuuggaaacagugguugucuugucuaugaguggcacagggccccacagcaggccaaucagaaggaccagguucaaugggcaacggaaaauacuugcucagcucagucccucugcaguauuuaggucugcagcuugcacaaagcuuuuugagcuguaugacccuugacuccuccagacccaagagcuuaaccuggauauuagacgacauuaggugauauuaguuuggcuggcucucaguucuguccacuauauguggcccauccaguccccacaaugugagaggggugagggcuuugacacuccuccccccaucuccaguaaaagggagugcucccuacgcuccucuucccuccccagaguucugcaaguuggauuccaucccacacccacccauccucagugccugauguaauguccccaacagcacugucaccaaucucucauucuaccagggcugccuucagaaucuucagagaccggaccucccacugugaugggcauaaaagauucuccagcucugcagcagaaccaagccaggagagcuagagacuuaacgucugaagaugcaccuuggugcacaaauagagaaacaagugcagaccccaccccggggcagggggagaacaggagccagaggcuaacccuggaagcuucaggcauccaugggcacuuaaauuugauauuguggaaagcagaaaguaggcaugggacuaagcccugaggugcucuaucacugccauggagcagggaggaguaagaggaggaaaaagaggaggagacuuggaugccguucucccuagaugcccuugauuugucuccucauuccugggcugaggaacucuagcaaaaggcagcaguggggcuaggagcuuucaggggaacaacagacacgcuaucccuucaauugcuucaccgccuuccucucccuaggugccagaguggcuggccucgcuguagucuguuuuugcucgcuccuggugcauccucaucuccauggaaaccacuccuguaucccggagcccuagcuuccuccgccuuuccaacgcgggcacugagaccucagugagauguucuucccugugcuuuccagugcgcuucucucucucucucucucucucucucucucucucucucucucucucucucucucacacacacacacacacacacacacacacacacgcacacaccucauuucucuucgcugcucucucuuucccucuuuuucuuugccuuuguuuccaucuuuuccuuuccucucuccccugucccucccucacugugcucaagucugagcuucaaccuuccuuucuucuuuuuaguuaacauuugaccucucuauucuuuuuucuuccaucucuguaucuaugcccccauccuuuguguucucucucuccucucccucucccucccucuccuccucccucucccucucccccucccccucccucucugucucccuuugccucugccucugccucugccucuacccuugaacaucucacaaauaaauuucuggaauccuugaccccauccugggcccacaggagcggugugucacagacacaggcaggcauggugucuaucuucagcaugaaagggggcguaaaaucaagucacccacuggcugucaugugugugaagggcugucucaaaggaaacagacugggaacagaggccagagcaucaggggcagcuggaaaagacugagacagccucccuaccuccuuggcucugaagagcaccagaugauggcuaugaggccuuaggggcuucucuagaaaugggagagaaccagaggucaaacuacucgagaaaagccagacugagauggguuuucuuaggucuggagggagaggggcagaagucagccucacccaagccucucaaguauggggauggugaaccacagacaagacaggcuucagcacucaccugccugaugcgcucgcugaggucuguggacugugagccucuuucagaagucagauguugguugaaacaucagcggcuccugagucugauacucaaaagcagggcaagcauguggcaaggacucacaaccuucugccuaaagacuuuauggcagagacugcccuguccacuguuggauguucugcuucaucccuggccuccacccacgagaucauaggagcaaauaguuacuguuguauuaaaaaucccucaaaacauuugagaacgagauugcuuacuaaaaaccacugguguagaggcaaagguccuagaauagaccagucauugacccuagagucuacugguacccugggaugcaggcagccaggaggcauuaugacaauuuuagauugauaauaucauacuggaguguagccccaguguuggguaguaguggcaaagugcuugcauaaagcccuaaguucaguacagcaaugauaauaacaacaauaauaauaacaauaauaauuuaucuuuaacaauaacacugaagauggguaugaugacccacacauauuaucccagcacuagggacaauaagggaaagacaugaguaugaggguagccuagacugcauugcaagaccucuguccaaagauaaauaguacugagcauuuaacuauagaccagagugcuaagcucccacauuguuucccugucucauuuaauccuauaaaaaaaagaaaauuaaggguuugcaagaugauucugcagguaaagaugcuugucacacaagccuggugaccugacugugauucccagauggaagagaaaacugacuccacaaaguugcccccugaccugcacgugcaaucugagacacgugugcccacacauacgcaucauggugguaugcacaauaauaaauauuuuucauaaucuaugaggucgacaaaaacaucacuuacaggugagggaacuaaggcucagagcgacagagucucuuaacugaaugucacccaacugggaacagacaaacccuguauucaaccccagacagauacuucaugcuuaucuugggacagacuccuucaaauugucuaauucacuuaauguauauguguguuucgccugccugaacauauacgcacugcuugugugccugguacccauggaagucagaagaggcuaucagauuuccuggaacuggaugugaacugccacguaggugcugagaacugaacccggauccuuggcaagagcagccagugcucuuaaccacugggccaucucucaagucccuugacuauacuuucuguuuccuuuuucuucauguauuucucuauccauccugaugcacagaauacaaguguaaggucaaggaaucuugcagucaguuuuagcaaugaaaagaagggucacauccucggagcgcuggcgcaggaagcugaaugucauuagcaacuauagcaacuguuguacugcuucugggcugccugauucuuggacauuuguuuuaaccuaagaguccagaaucaaggcuggagagaguuuggugcuuagcacccacacugggcacuuagaaccuucuauuuacuccagcuucauggaucguaugcugucuucuaguuucugcaggcaucauacacagacacacacacacacacgaauaaaauuaaaucuucaaaaaguuaaauuaaauuaaaaauuuuuaaauuaaaguuaaaauaaaauucuuaaagagaaacuaaaucuuagauuacuaaaccauacuuauuuaaggucuuccaauugcacacaaaccuaguucuagcagauguaauaauauucccuuuaauuuuuaaacauuuuuggauuuguuuauuggauuucaagacuaaggggguuuuguguuuguuuguuuguuuguuuguguguaucccugucuguccuaaaacaagcuggccucaaacucacagagauucaccugccuccaccccccaagcuccaggauuaaaggcgugugccaccacaccuggcuauuuuuguuuauuaacaaacuuucaacagugugucauuggggaagucccuucaccucucugaaccucuguuuuaugaucuuaagaauggugauaucuacuucucaagcugcaagguagacugagugguaaccaacaucaaaauaguguuugcucuuuugagcgugcuuaccccuaaauccauuuacaucuguuuucuugaagccgcaucuagugcaagagaagcuggaaauuuuuuuccucuccuauccccuguccuccuccccacuuuguacauaguucucccugugcauauacagggaaaauacaugcaguggguuggcugcauagccaacacagguauggacacaucuaugacaagggaacuuguuauaugaaugacagcauuuccaugcccuagaauguuacuaauucaauuuccuuuucuauuucuaguuuauuaauauaggggcuugaaugaaugguuuaaaaaaauuuaagcuggguaguaauggcacaugcucuuaaucccagcacuugguaggcagagacaggugcaucucugaguuugaggccagcgugaucuacagagugaguuccaggacagcuugggacagacagaaaaacucugucuugaaaaacuauaaaacaagcaaaccaacaaaaacaacaacaacaaaauguuacacuagggcacguagcucagugguagaguuguuuagcaagcacaagucccuagguuugaucuccagcauugcaauaugaauuaaucuuuguuucuucucuaguacauacagucaaugcuacaauuuucccuauuagcucuucugcucacaaauccugguguguuuucauguacuuacaaauauuucaaaauuccugggauuuguuuguuggucuguuuauugaucuacauguugcuugauagaaauggccaucucugugauuuugaggccagccuggucuacuuagcaaguucuaggaggcuagcuuggucuauacaguaagaccccaucuuuuuuuaaaaaaauaaauaaauaaagauuucucugacauccaaauguuaucaacucuuuuuuuuuucucucucucucucucuguauagcccugacuguccuggaacucacucuguagaccagacuggccucgaacucagaaauccgccugccucugccuccugagugcugggacuaaaggcgugcgccaccauguccggcgcuaucaacucuucuaucuuucuguugcuucuggcuuaagucaguuuugcucugagcgcagacacagugugguuucgagcuuuguaauuguaacaaccguguggcuuuggguucagaauguggccugccauggcgaacauucuaugugaacuugagaaaaauguauucccuguggcugguggacgccguagccuccagccagcuauuggauagagugauugaugcuauugcugagucggucauguucugagggauuuucuggcagcuggacuucuuuucuuuuggucgucuuccauguguuucaaaacaaggucucauguaucauagucugucuucaaacucacgauguagccaaggggacccugaacuccuaauccuccugcuuccuaccucccgacugcuguuacugcagauaccuaagaccaagccugucuuccuuuauuugcuuuuaauuccuguuucuuuacagcugaaguggguccuugguagacugcacacaggugagucaguuguuuucacccauucugaugauggucuuaauuggcacacuuaggccacuggcacccagcacgcuugcugauguugcaagacucauaccuacucugucugccacacuuuccucuuugugcccuuguuauuuauguuuuuaaaaauaaaagaacaaaaaaugaaccuuuuaaagagccuggaagcgaugucuuuggaaucccagugcuggggaagggagaaagggagacuccugggcucucuggugagcuagcuuagucuaacuggagagcccuggucccagugagauaucugaucucaaaaacaaacaaacagacagauggauagcuccugagggaugacaccuaucaccuaugugcacacgcagacagacagacagacagacacacacacacacacacacacacacacacacaacuccuucuaagauagauccaccacaaagagacccccccucagcuuuucccuuauuucuccuuguuuugaagucaugauccuacuguuucgggucccaguguagcaaggauaacaggcaaauaccaucaugcuuuguuuugaaggucaauuccaucgagugcaagccuucaggacugaaaauccacaguggaggaggacuugccaggcauccgccggcccaggguccaaucaguaacgcugacacugagaggucccagcuguucucagcacaucccaggggaugcugaggcuuccgcucacacagagucccccgugcuccuuccuagcuucccacuugcuacguggucucuguuguucacauugcuuucucggccuccuucucuggcuucucugcugccuguucugugcugguugaugcccugagauguuguucccucuucuuccucaccuugucccugggcaacucugcucacccuaagcgucaugcgauguuaccucagaucuucagguuugacuccagaccuuucucuuugacuucagacccaaacaugcagccauuauuggguucucccccuuacacaucucccagggccccaaaacucaacauuucccugagaggagcucaucucucucugucagaaacacagugcuccucugugaaugcuacuucagaggcuuggcuacccacaaaggacgcuuugccccugccuuagccucagcccacaaacccaguggucucccaaacccgcuccggcuccucucccugcuguugccuggacagucacuugcauguuguuucuccguuguucccugcucccuagguccucccggcagccaccugagcuucgggagcccacgccaggcccugcucacuccuacucccaaaagugauugccacggccuguacgccuguacguaagaccuacgcuccaaggcuggacgcucggaagguuauuggauagcuccuccuccaacccuaccccgccuuucacuuccccucccucucucacacagagcuucguggcaaaagcauucgaccgugggucacaucacagcuauucacagucacgagcauguccuaugucagugcacacaccugugcccacaacacccuuccaaugacuccuaagaggggugaccuauuuguuacaguucaaacaugucucccagcaucguggauuauaauccugaauggcaaugucgaaaggggcaggggaaccuuucagaagugucaggcccucgccuccacagaacagauccccacacaagucaauucccucugcccccaguccuguaaugucuucugcaugugacugaucaacacgcagguccuuaucagcuggccagcuccucagccgugcacuguccagccucaagaaccauucauuaaccagcugggcacacggcucaguagcagagcauguuugccuagcaugugugaaguucuggaucgaucccuaacaccauaacacauacacgcuuuuaaaaauggcuucaugagaacagccaugaucaccagaaaaacaaaaagggggaaaucauguuauccaggcaagguagcauacaccuguaguuccaauguaguuuccaauguaggggggaaaaaaaaaaggaaagcaggaguucaaagcuaccuucagcuagacaaugaauuugaggccagccugggcuacuugagauugucauaaacaaacaaacaaacaaacaacagagacauacaaauauagcauguccaugaccucagaacucaggaggaugcccaugaguuugaggccagacugggcuacauagcaaaagucugucugaacaaaccaaaauaaauaaauaaacuucugucccuuacaaauugcccauguaacagccuguuucugcaguccaaagccaacucagacaccacgagucugcucauuguauaugacaggaaacagaaaugaugggaaaaucccuaagggcucacaaucacugugacaaccagaaugcagcaccagguaucugcucccuccaaaggagcugggugguagagugagucaggacuuaggcgucaucuuucaccuauccauucaacaggacacuucuggggacauaguggcuugugccuacacucccaguacuugaaagucuaagacagggcuggugagauggcacugacugcucuuacaaaggucaugaguucaaaucccagcaaccauaugguggcucgcaaccauccguaacgagaucuggcacccuuuucuagagugucugaagucagcuacaguguacuuacauauuaauaaaaaacaaaacaaaaaacaaacaaacaaacaaacaaaaaagaaagaaagucuaagacaggaagauugacacaaggugacaggaagauugacacaagguucacuggagcuggccuauauaguaagaugcuaucucaaaaauaaaaagcacuaaaaccaaagcaacaacaaagcaaugggcacuuacuaggcaccuacuguacaccgaguggagccuucuggcccaagacucccauugugucacuuaggcacuggagaagcaaucagaucugggcugggggugcaguggacaaggcuggguuuuucaucuuuccccuuacuucccauuccugugccucaucauuaucaacuacuuuagucccagagcaguuuaaguacuuaagggccucuuaaagaauaaugcccccauguuagggagacuagcaacaaccucagcucaagcucuggcugcaagcaccuaaggcacuggucguguaagugaaggaagcuaggagaggugaaugcccacucaacuuuucuaaaacaaacaaacaaaaaaguacuuauuuuauuuuaguauguaaccuguaugaguauucugccugcaugugcaucuguccuuagcugugcacccuagagcaccucugugacccagucacuucaugugugugccacaggaggagacuccucccccccuuuugucuuuugagcucuaagaugcugagcaaggucuguuacccagcauucccagagcccagcacacugauguacagaggaguccuccagugaagggucagugugagagggagggagagaggcaugaggaaguaaggaaaaaggaagagagagaaagugagagggguggggagagagggaaggagggagucccucucaugugcuaauguccuagcaauguaaccagagaucgcuaaauuuuguauacucaauacauauucaauguaacuaaacuucuaaauuuuauuauaugauuaaaaucugaaaccuauccaggugugauaaugugggccuguauucccaccucuaagagaggcugaggcaggaggaucgcugcaagcuaaaauauaacuagggcugccuaucaagagccuaucuaaauaauuaaaucauucauucccaaaggcaaccugaaccaaagucugaggacguagaaagagacacaagugcaugucuugaguuccuguuaugcccacuccugugaccucugaucccagagccugugacccaggugauagccacagccugaagcugcucgccccugcaugacacuaucuagcacucagcuuccgccuccccugccagccucugcacaccaggugaagccuggcaugugcacacacucacaccuggcugaacaggggccaggcucauuuuccuucuggggacagagaagccuagguucccacugugugaccauucagcuguuccuucucucugagcaucuuccuucauucauagcagagucaggcaagccaauagcuucccucuucugcugauggcugacgacuucucaaggcugguggucaucgcaaugaguucaaacucagcagcaaagccuucacaauggcuucccucagacugucucaagcgccgaccauacaugggagucgcauuaaaaaccacuguuccauucuuuccuaucauccuuggaaacagguacaacacuauuuugcagaugagaaaacagaauuagagaggcaaacccacuuguccaagaccacauagcugggaaguauuggcacauuccucugucucauuauaucugaggcacugggggucgaacccaaggucucauucaugguagacaggcagugaugaagauagauucacaucucuucuacuuugcuuacuuuguagcccaaacuguccuccaagacaccauccucuugccugaggucucucugaugcuggcaugugccgccaggccgcagcuugggucuccucucuguuuccuguggauccccucagccccauuucugacucuugcggcucucacccaucgacugugaauucacgucucuuguuccagcugagcagcggaagguucuggacucauuaguacucacacugagacucagcuucccuucuaucccagaugugugagauuggacaggucauuguaauggaaggguggggcaacagugugaagacaucuggcauagaaaccagcggacaagauggcugggggagccgggcgguggugguggugcacacuuuuaaucccagcacuugggaggcagaggcaggcggauuucugagaucaaggcuagccuggucuacaaagugaguuccaggacagccagggcuauacagaaaaacccugucucgaaaaaacaaaaacaaaaacaaaaacaaacaacaaacaacaaacaacaacaacaacaacaacaaaagauggcugggggaagucucuugccucaaaaccuggcaagcugaguucugucuccagaaggcacauagggauaggaggggaaucaacuccacaaaguuguccucugacuucagguaggaggacugagucacaauaaugguuccgugacccagcacaucuauggcuugggacaaauaacuuuuuagcacacagucugguacucaguaacgucuuagaauaugcugacauuuuuuuucuuuuugagacaggaucucacguagcccguguuggcugacccuguucugggaucacaguccugggcaccacucaaagcuaguaguguuuuugaguuguuguaacagucacaguaacuucaaacugcucagucauuagaauccaaacuccccugcccggcacucauccauccaucucaaaucuguugcuccaauagagauacaacacacaagucagacacaccuguccauccggaagccccuguguucacacugaacccguauacagccugcaccugccaacaugacccaccuccagucuugauucccagcuaagccauagccagccuugacuguguaucuacaacauuuguaguucagcacacaucagaguccccagggguugggaacaccugucuguggucaucuuacuccuucuuuuacagucucuguggggacucaccuuucucacuauugagccauguugcagggauagguacauuugggucuuggacagagucaccacgauucauuaggaggcugcuaccaggcaggagucaggcugacagaauucagccuugaaacuuuuacuuccaucauucuuugugugaguguaaguguguguguguguguguguguguguguguguguguguguguguguguguuuugagacaggguuucucuuuguagcccuggcugcccuagaacuugcuguguagaccagauggccucaaacucacagagauccuauugccuuuaucucucuccccaguacugggauuaaagaugucugccaccacacuuggcugcuggcauucauuuuccacagucauugcuaagcuugagcuaugugaaguuggagccacuuuauuuuuuaccuuuaagaggcaguggacuagggacuggagagauggcucaaugguuaagagcauuagcuguuccuccaggggacuuggguucaauucccaucacccacaugacagcucccaacugucuguacccagaggaucugacucccucacacagacauacaugcaggcaaagcaccaaugcacauaaaauaaaaauaaauacaauugaaaaugaaaaagaagaaguaguggguuuuaaaaugagccggcccagggaccaagggauaggaggaucccucagaugucaccugagcaucugcagccacaugaagucagaaacuccugacuuucaaaucauauaagacaauaaacccaauucugcucauuuauuuuauuuaugaugggcugucgucuaucacuccagggcugcugacaauaucaagaaccaaguagaaagucagcuucccgagagcagggacugcacaucguaggcuuaagauucuuguggucggaugcaguuguacauuuuucuaaaaaugccccuggaccauaaagggacagaacuuuauuggaaccuugcagcugagccaauaauaugccuugagauuauuuaagacuauguacuuaaccugcuguccuacugugugcccugguuuaugguuaaacugccuuuaaaagaacaauguagccaggagugguggugcacgccuuuaaucccagcacuugggaggcagaggcagguggauuucugaguuugaggccagccuggccuacaaagugaguucuaggacagccguagcugucuucagacacuccagaaaacggugucagaucucauuacggaugguugugagccaccaugugguugcugagauuugaacucaggaccuuuggaagagcagucaguguucuuaacugcugagccaucucuccaaccaacguuuucuuuuauaagaguugcauugaccauggugucucucccagcaauagaacagugacuaagauacccagcauuguagcauugugcacaggauggccacagaauagguaagaaaaacaaaacauagccaggcagagggagugaggggagaggaggggaggggaggggagaggagggaggggaaaggggaggggaggggaggggaggggaggggaggggaggggaggggaggggagaaagagaucuguaguuucccaaugagaagguuuucuucaaaaugcuuggagggagggaauccaaaggaacaagaaucaagugacaagcguucuaauuccuauaugacaaacaaggcuuugauccugugcugucacuuuaggugauggcucacuuucugagcauaaugaucccagacaaagaguuguuugcaggaguccuacaggcugaaagauacacucucaaccaacugacagucccucagccccagaugagaaaacugggauuaaaacugaaaaggcuuauuuaagaccaugaaggagguuggcaagaugacucaauggauaaaagcacuugccaccagaccuuaaaacacaaaucucaacugaggucccaugagaugggaaaagagaaccaacuccugcagauugucuucugacuuccguacaugcaccacagcauaaacacacacacacacacacacacacacacacacacacacaagugaaugucaugaaaaaguaaaaagacuguaagucguggcauuugugacccauaccuugcaguccaaagcuggccuguuuccuaacgucacuuuauuaagcaauguguaucagucacuuaucuagagaacucagaaaucucugaggaaaaugcaccuaaguucuuaacucugccaacugccuccucaguccuuaggaaaaggaaaagguauuggaccaggaggccaaaaccaaccaacaaccaaccaaccaaacaacaaaaccugcccauagacuggauuuacucccacacuaguggugugacuuugaguaagucuuucacaggucuguggcaguugccgcucugaaacaggagaagugaagaugaaguuugaaggugcugaucgcuaagauuguuaaauuucagugaucacacaguuggacuguccaucaaaucccaggauggaaucucacacggauuacagaggaacagcgggccaagaggucagcauccuagucacacaguccaaauuagaguugaugaguugguuuucuagaugagcauauaucuuuccagcuugccuucaggggagaacacaacggaaacccaugcugucaccucugcacaccacuggaaaacauggaacaauauccacacucccuucauuucucuuucucuguucuuuucaaugguucuuaaagagucccauuaagacagguccauaucugagggcuggagagaccgcucuauguuuaagaaugcuaucugcucuuacagaggaccagaacacaguucucaguacucauaucagagagcuaacaacuaccuguauccucagcuccaugggauccaaugcccucuucuggccuccacacucaacugcuuuugaauguaccuuaucaccaccaccaccccacacacauacacauaacuaaaaauaaaaaagaaaccuuuaaaaauaaaagaacguccauaucugaauauauacuaccuucuuccaaucagccaucuucagaccuucaauaccccccaguaggacagacauuccucccuacauuuguaagaguccacuuggggaagcaaacuagcuucauggccuugacaucacaucuggccuucagcccaagugacaagucuuaauuugaucacuacugcauucuuagcacuugaccuugagugacuuccagcccuuuugaaaaacucacacucuuccuugaaaagauggagauuucuuuccaauggaaagguucaagugaacacauaccacacugcagagacaaguccgugcaguauauccugcggugggauugcuuacaagcugucaucuaucaccuuuccuuugggcaccccuuuugaaaggcugaccacuuguugaacgaucugaagugcuuacugcaaagaagcaucucuaaugcaccauuaucaagccuucucuuuuccuucccaucccuggaaggcuucaaacuucccccuagccucuacccaucuucuuccccacccuucagucccuaggcuccgcuuugcccgguccaacucucuuuuccuuuccugcaauuaggcaaauauccaggcugcugaguuuucaaaaugugacugcgaucgaagaguggguggggacacaggacucuaauggaucaggggaaacugucucagcauuucucauucccaaaaggucuuucccugagccuuaggggaagaugacuaucccagccaaacaguucagagauuucaaaggacucaucaccauugacuguggcacagaacccuuccugaaugugggucagggguacguuuaaaaggauggaaaccuucucuucagaggcuuguguugcaagcuuuccacacgcaucuucucaguaccaacaccacagauagccucccaacucucaggacaggauuucuccucugcaucauuuuacagaugagaaaccaaaccucaaaaaagccaacaaugucagugaguucaagguccaagacaagucucucgagucaccaauuucugcaucaacgcccccagcauaacagaaauugaucauacuuauaguaagcccucacucaggaaaaaaaauuguccuccucaaacgccgccaauaaagacccccaaaacacgaacauagugcuaauccaucaguagacccgagcuuucaacaugagggauccaaauaccaauucuaaagauuguccccugcccuaagguggcucucuguuguugaauguucuccccaguagcugcugagagcuggccugaagugucucaauacagagaagaggaauuuagcccugacucuuccaagaaagagcucccaucuuuagcaucuuugcuaaggguccugcgcccacuccuccccuaccugccaggagcugcauccaggcgcagaucuuguagacaguagcaguguugcagaagaagaaaagagcgaagcaggugaugcagccgagaaucagcaccauggaaagcaacacgaagaaggcggccgccuugaaggcgcuggacgggauggugcugaagucggugaaagagccccggcaggugagcucgcggcccgcuagcccgcugcccacgcaguaguggaagaggccgaaguagccaggcuugggagugcucacgcugucgccuacccaguagggcuggaugaagaccaccacguugaugauggcgaagcagauggugaagauggcccauagcacgccgauggcccgcgaguuccgcauguagugcucaugguagagcuuggaggcuuccugcgagggcagcauggugcccgggggcggggccggcggcagcggcugacagggggccgccggcccaggacugaccaccggccgcggggcgggagcuggggacgcacgcgagaagcagcccugagucuaggaacucgcaagggcggggccugaggcggagcugggaaccugggggcugacuggggagcuaggagggggucaugacaguguuggggcggcgacuugaaggccuccuauuggggggccugagaaggagucaugggaaaguugggggggggaugggaugaggacaugggaucuggaaguaggggggugccagaaagugcucgugggggaguucaagagggggcuugggaacuggugcuggauuaagaaggggacguggggagauguaaugaaagauggagaucaauauuggagcauuaacaagcaccgaauagagagagcugggaagggcauauuggagcuguuauuagggguagugggucugggacugggugucuaaaggggaucugaaagaggauagacgcuucucuauaaggaagagaagagguugucaggggcugguacugagggcacgaggaagguuacaguagggccaggcagaagacuggagcugguacccagggcuaaguguuggaaucaggaugaggcuagcguggaaucaggggcugacacugcagggucugcacuuguggcggggauuggggggcggggauagggggggcuccuuagaagccggggcugaaugucggcugcggggggguaguguaggauuggcgggccagggccgaggagaguggcuuuccaggccaagggaacaggcgaucgaggccagcgggcagucugggccuggaggggcgggcggugggcaggggccgugccuggcgcgggggagccgcugggcccggguagggccagagcugggggggggggggcugccccgcgcccaggccggacacgcgcggaggcugcggccgcggagaagggaugugggaagaccaaccugggccgagucgggacggcugauccgggaccggcagggcucaagcuccggugcucgaugcuccuaacagcgguugccuuggcccaggcggcguccucugcgcggccuccaucuugcuccggcucuccccggggcgcgcucccgcgccgaggcgcgcgcucccgggcacug

SEQ ID NO: 3284 - RNA, 17728 nt, Mus musculus
gaaagugcgucuauacagcgccacgggaccacguuuacccuggcggacgccgucgccgucgcugcugcugccgccgcugccacagccuuugccgccacggucucgccgcugcuguuccugugccgccuccaggagcccccccauugucccggcggcaccggguucccaggccagaagauccaaaagcucgggaaacgcgaaggugcuugcggaauugcgacgcuggggcaccggcgggaccaggaguggcaggggucagcgcgggaagccgggggagccgggccagagagugcggggcaggagccggggcggccagcuucgcuuccgagaguucggguuuccccuucucggcccgucucucaucgccggccucccacacgggguuggagccccggcgggcgcccccggcgaugagcccagacuggagguggccggugaguacgggccggggccgggagguagugccaguggagaaggggcagcccuggcgaggcgccuuaggcuccuccugagccccuggagcagggagaauugacaugccauucguucguggggagcguccgcggcagcaguguucccuuugaggcugccugggccagaggcagaagggaaaccuuguuugacuuguuacacuuugacaaaagggaagcggcgcagcauccgggagauugggcucuagccccgcgggccuugucccaccccuuaccccuuacuuccuucugcuccuggaguucccgggaguaggugcuuccgccauauccaagggccccagggcuuucagagcuaaguucuggacaccuucgugccucugacgccaggucccuuggggcacugugcuaguucgggaaccagggcagcaaagccagaacggcagcguucaccagggacccggcuuggaaaguguugagcuuguuuguaccuauaauugguuuuguguuuaaaggcacagcagcagguaggaaauagaagugaguuggaauugaauguguagcuuggcugacuugcugucgauagauggacgagagcugcccauucuuguaguuaagccucaggagaaggaaggaaaggcugagaguuaguguuugucagggagguuaggcaggcccugcauuggugguccuaggcacuaguucaaacuaguccugagagaaauuggagcgguaccagacuaagcugggcucccugggguuuggugccaucugcugucucuacucacccagaaacugaggugggggaggguuagccuuugagaaccuuggaacauaaugccuagauuuuugugaucauguuuguguccuggcauucaguaggcccugaguuaauguugcaugaaucaguaaaugaggaaaccaaguguagccugugccguuuguccugcggaaaugaccauuucacaagguuucucccuauaucuccccacccaguuccagggugagguuccccauuaagacuucagcgaugcacugauuguguaguucaaugguuucuguuggaaucuaggacucagucauuggccacucacucaggcauacaauaagcaacguuuaaugcguaaucugaucuuccucaacuccuaaucugguggucuucucauucagcuauucacagguuucaugguauuugcccaggcuugggaguccaaugcaugcuaggaacuggggauuuagaaguaaauaggucugguauuuacugaagaucuccuaguagaaugggagaaaaccagaaaaugucacacuggaggugagaauaaaaugccacgggaacagcuuuuccuugagagagugaaaaaaagucauaauaaaagugucauuuggccgggcgugguggcucacgccuuuaaucccagcacuugggaggcagaggcaggcggauuucugaguucgaggccagccuggucuacagagugaguuccaggacagccagggcuacacagagaaacccugucucgaaccccccccccccaaaaagugucauuugaacuaggucuugaagaauuuguaggagcccaccauucaacauuccuaauugagagcccuuugaaccuugagagauuauaacauguagggaauuuuaugcugcagugugagcccaccuccagucugggcuuauugucgggggcgcccgccagggcuccaaccccgugugggaggccggcgacgagagacggggccgagaaggggaaacccgaacucucggaagcgaagcuggccgccccggcuccugcccugcacucucuggcccugcucccccggcuucccgcgcugaccccugccacuccugccaaaccauaacuacugaaaagaaucuagaaaggaagacuagggacagagagcaaaaggaauuucuugaauguuauauuagauggucugaauagaagcuggagagcagcuggaggcuuuuaguaauguaauugguaugaucauugcuacuuaguagaaggaucacucuugucacuuuaugugagacuaagccaaaggaauugagacauaggcagcaauagguuuuaagggcccagacuaggaccuuuguaaagaagcuggcaccuagagaugcucuaaagagagacuggccaggauauccuugggaaaggaaggcugaagagaaucuacuguauggugugggagcuggaaacugucaggccugugcuaauuggucuguguauucuagaugugacagcauggggguggacuuugacgugaagaccuucugccacaauuugcgggcaacuaagccaccauaugagugcccuguggagacuugccgcaagguuuacaagaguuacagugguaucgaguaccaccuguaccacuaugaccacgacagcccaccacccccacagcagaccccacugcgcaagcacaaaaagaaagggcgccagucacgaccagccaacaagcagucacccagccccucugaagucucacagucaccaggccgagaggugaugagcuaugcucaggcccagcgcaugguagaaguggaccuucauggccguguccaccgaaucagcaucuuugacaacuuggauguggugucagaggaugaggaggccccugaggaggccccugagaauggcagcaacaaggaaaacacugagacaccugcggcuacaccuaagucaggcaagcauaagaacaaggagaaacgaaaagacucuaaccaccaccaucacagcgcuccugccagugcugcucccaaauugccugaggugguguaucgugagcuagagcaagauaccccugacgcaccaccccggcccacuuccuacuaccgguaagaccaccaccaucuccuaccucuagaaaaccaaucaaaaccaaucgagaugacagucugauaggagacagccaguaaaggagcacuagucugccaaggcagugugaacuguccuuuagcccuacuggcacaugccagguccuggguucucucacuuccugcucccuuuguaacauuuuuuaagaauugggguuuuuuuguguguauguguuuugauuuauuucuguuuuugagacagucugaguuuucccagguuggccuugagugggcaagagagcuaccuacgucuucuccugaauguugaacaucuagcuauagccacaucuuuauuuuuagaacucgcucaaagcaguccuuguucccauuugccaggccugucaaaagucacauguaggaaucucugaacugagguugagacccauguccagcaagcuucaaaacugcacuguuuccugcacccaacauccugcuucuaaagcccucauccacagagcaggugcagugcuccucccuagggcagaagacauuggcuucauaaggccucaaagaugaaugauaaaucugauguaaucucccacuguuuuguuacugucaccuguccuuuaacagcuuugugagcaggaguucauuguugccauacuaccucuuaccucuccagugcucgcuugcuuauugauuuacuuauuuguguguguguguguguguguaauuuucucuuuauauuccauucauucuaagagcuaaccauaguggcuccuuuugaaguuccaaacauuccuaauguuaaaaaaaucuuuuuuacauuuauuuguuugucugcacauggcacuacagcaccuguggaggcuagagaacuaccugugggacaaaaaaaaaaguucucacuuuuacaaugcauaucccaggucccaggauaggccauuagguuuacuagcagggaucuuuacuuuacugaacuuguuuugcuagccacagacauaauaaagcaaauuccuuuaacaugagaaaaaaagauguagggugguaaggcuguguguagaaaucucagccacaggauguuaucaauaccaauuguaacccccacccccccacccccccacccccccccccccggcagcuaaagccaaaagaacaguuuguucaucuguguuuauuuguaaaggcucuuaugugaaaaguggcuuuugccaaauacacaguccauuugauguuacagugacugucagcaauacagucacuauugugacucccucagagagagagagaauauuacuucucuauagauguuacauuugaugguacaguaagacucgcucucucugagagagagagagagagagagagagagagcgagagcgcauauuacuucucuauagauaaggaaccagggcccagggagcuuaaaagcuuaaacucauuuacuguuauacagagaccaggcaauauggccucggaguuucuaugcaccuggccugcucagagauccauuuuccauguagagagagaggaauuaacguuuugcuagaucaugguauaugucauuugauguagugucccaugucucccuaaauacaauauucauauacauauauaugugaaugaaugauuuacuuuuguaaaaaccugagaucugaggucaucauucuaauaacauauagaucuccucuccuuuguccaaguuuuagcaaguauuccuuauuuuuucuccuuacauccagucccccuuucugguuuuucacuauucucuuuucucuuagaauuuaccauguucucuuuaucccaagcacaggccccucuuugggacuuccucuccuccaauggcucuuggcauaaccugcucucacaggcaguccaccccaacuugcauagcuccuuuucuuucucucuacacauagucacuuucuuccugggaucagaucuuuucuccagaugagcaguuuuuagccuguugcagucaguuaggagcuauguuauuauaguuagcaaauuccccauguuuugaaaugauuuacuuuuguaaaaaccugagauggucugaggucaucaucacucuaauaauuuucucaugcucaaauccaguccacuucuugagggggagugagaggguggugugucagcuggugugucaagaauuguacaugacauacagcccaccuaucugugccagagucuauaaucugggagcuugugggaguguguuauguacuaucaaugacaguuggugugucauggcagaggaauaggcaagaccugacguuuaagagaacuaguauaagcccuagaacuguccagcuaguucacuccagcucugaucauacccuuauucugggagcacaguugcacuagaagacaaggaaagaacuaaggaagaagcugcccucuacgcacauuuuacucucccugucacccucaaaaugccuuucaguugaacaacgcugaggaccuauuucuguacagugaaucagauacgaucccugccuguuagagaacaaguuaggaacaacagcuauaauucaagacaagguggguuaggguuauuacaaagcuaauaaaauugacauuuauugaauauuugcuccaugugaagcacuguucuaagugucucccuuuauuaacucauuucaugcucacaacaacuauggcaggcauauuagcauuauuucucuauagauaaggaaccagggcccagggagcuuaaaagcuuaaagucauuuacuguuauacagagaccaggcaauauggccucggaguuucuaugcaccuggccugcucagagauccauuuuccauguagagagagagaauuaauguuuuccuagaacaugguguaugucacuugacuuagccucccauauccuccuaaauacaaggucucauguaucuuagacuggccuccaacucacaggguaguagccuugaacucuugauucuucugucucuacuucucgagugcuaggauuuacagguaugauaucacaccugguauuauagagugccagggauugaaccagggcuuuguggggauugagccaggacuuugugcaugcuaggcaagcacucuaccaagugaguauaacuccagcuccuuggcuggagccauuucucuuguaaugcuauuuaaaguuaucauuuacugaauauagcccuuguguuaucaguuaauacaagguacaggacagagcagugcuguucugaagguggcagaguggcagagacaaaauuuaaaaccagauuucuucaaagccaaacuccuauucuugucuuguacuauguaauagacaaugccagagucuagucggcuuaagacaggacaguaugcaugccugcugugucauagccaccuagagcugcccucugcucuagcuugcaggcucaaagaauuccaaaguggauguggaaaaggcuaggggcagcgaaugggugacacucuaucgcucccuggugauaugaccuaucugugauagguuguuaacauuuuccucaaagcuucaauucaucuaaaaucacacccucagucuucugucacuguggauaaauaaaugauaauaaagaugauaaggacacuaaucuguuagcuauuaccagaauagcuguaccuuggccuagugccuugcccauaaugaaugcucagucaguuguagcuauuaucuuucaaggcuauucagagaacaaacaggauauauagaauuugagagacugcuagcaucuucugagagaacauccaugugucuuugguacuuaucaucuuugcuaaaggccuguauucauuugccagugauguccaaggaauugccuuccucugacaguacaauccccccauacguucacagggagaccucccugcuccagcauugccccauuuaggggucuggcugagccucuauacuucagggaagaccguaucauaugauagccacagcaugaguacuagagaugugggccuguuuguuuucaugaccagguucuugggcacuuucugaggaaguuaacuucucccacauuuaggucuccuuuucugcaagacaggaaugauucuaauacuauaaaugugggguuaagguaaggcuggagagauaaauguauacaugggcagaggccgagugcuuggaggcaagaacaaugcuuugucugaaggaaaaauaucagccaugugaugccaagcugccugugugcacugcagguacaucgagaaaucugcagaggagcuggaugaggagguggaguaugacauggaugaagaggacuauaucuggcuggauaucaugaaugagcggcggaagacugaggguguaagucccaucccacaagagaucuuugaguacuuaauggaccguuuggagaaggagucguacuuugagagucacaauaaaggugaccccaaugcacuaguggaugaagaugccgugugcuguaucugcaaugauggcgagugccagaacagcaauguuauccucuucugugacauguguaacuuggcugugcaccaggagugcuacgguguccccuauaucccugaaggccaguggcugugccgccguugccugcagucaccuucucgugcaguggauugugcucugugccccaauaaggguggugccuucaagcagacagaugauggccgcugggcccacguggugugugccuuguggaucccugagguuugcuuugccaacacagucuuccuagaaccuauugacagcauugagcacaucccaccagcucgguggaagcucaccugcuacauuuguaaacagcggggcucuggagccugcauccagugccauaaggccaauugcuacacagccuuccaugugacaugugcccaacaagcuggccuuuacaugaagauggaaccugugcgggagacaggugccaaugguaccuccuuuagcguccgcaagacagccuacugugacauccacacacccccagguucugcucgucgccugccugcccuaucccacagugagggugaggaagaagaggaugaagaagaagaugaggguaaaagcuggagcucagagaaggucaagaaggccaaggccaagucucggauuaagaugaagaaagcucggaagaucuuggcagagaagagggcagcagcaccugugguguccgugcccugcaucccgccacacagguacacaggcaacagugggcagggaggggagggagaaacacucagaagaacuggggccugaguagaauggccugcuugcccuccuaucaggagcugcauggaaguuaaaaaguaaguaaauuuaaaggaggugaucuuaaguaagacaucugacuuuugcacuaggggccagaaauacugaacgguuaucuggcagacagaguauguguuuaaaacuacccuuuuugauggugcaguuaagaugaaacagccauaggaaaagugaccuucaagggagaaucaaugguccgguaugcuuuagcaugcauagggaccuagguucaguccccagcacagaaaauaaaacaaugcagcuugguuaugcaccagaagugcuaccguguccgcuguguuccuaaggaccaucuucccaagcuguggacuaugugugcccuguagaguguugcucaagucagccuguggugucaguuguuuuuagcugccuuguguugucuaguugacuucaccauggauuucugcuguacuugcacuuuaucuucacuugaucuuaggaaaaaggccaacaacuuugucuucugcacagucugagagaugagagucuagcuagccgugcccacgcugcagugacuaagcagacuuaaagacagacugaaacuguucuccuuagugcugagcucaguuuccucucugcuauguugugccacucaaggcacuuuuaauuaugccuuaaacccagaguuccaaacuauuccuuuuugcgacagaaucuccuguaggcugggcuugaacuccauagucagaugugaccuugagcuucuggauccuuuuacccucaccucuagguuucugggaucacggugugagcuaccaugccugauuuuccagaccuuuuugaugagcaucaaugcccccacucauccuaauugaggagcucuuccuggcagucaggaccuaacaggguuuuauuuuguucccaggcucaguaagaucaccaaccgccugaccauccagaggaagagccaguucaugcagaggcugcacagcuacuggacucugaaacgacaaucacggaauggggucccacuacucaggcgccuacaaacacaccuucagucucagaggaacugugaacaaguugggguaccguguccaaauccugugggcuguggaaacuaguacuaaaagggcaaggacuaaaauguguagcaauauccuccagcaucaaagagcuuacaguuuuucuaaguuaaauuaacauccccaccccauugcaggcucaacaugaaauguguauauuaucagcuugguagaaaggcauuguuccuguagguucauuaauucaacaaacauaccaagcauuuucuagguucuagccccuggcaacacgugaauaguggugcuuugguaaauuacuggguuuccuccuuggccuagguuuccuggguacuccucuucuggacucuccucuggcuuucuuaccauuuucugaugccccuuuuaccucuacagagagauucugaugauaaaaacugggcccucaaagaacagcucaaguccuggcagagacugcggcaugaccuggagcgagcucggcugcugguggagcugauccgcaagcgagagaaacuaaaaagggagacggugagugcuccagggccaguccugguucucaaaguagaacacguccuggagaagggaaaguguauggccaagagcaucaaggcccauacuggcauucugaguuccagcauuaugugcuuuuaggccugucugugggaggccaaauguuaaaggagauugcacaaaguccaaaccucugugacccaggcagcucaggccaggaguuaaaggaucggggaccaaaguagauaaggacagcuuucuuucauggggucugaaugagaaaagcauguuccuaagccagcaaggaucaucuccuuugaccucugcugagggacuggccaggaccuggcugauccagccuuuuugugugucagaucaagauccagcagauugccauggagaugcagcugaccccuuuccucauccuccuccgaaaaaccuuggagcagcuccaagagaaggacacaggcaacaucuucagcgagccggucccucugucugagguaaccgaauuggacgaaguaagaaucccuuccccucacuccaacuucuuuuucuuccucucccaguuggaccccucccugaugcaggucugaccccaggacuagguugggaccuaaguguaaaggguuugguggcucuggggcagaaugaacugagcuacaugugucaccucgacucuugucuauccuuaccccaccccaagaacucagaauggaagcccaucugcacuccuuccccagagucugccagaucacagggcaggaagaugcuuucagggugugcaacccuagaauagaaacuuuagaagacuaagaauuuaaagagccaacucugaagcccuagguugacccuucuuucugaaaugagacauuugaggccuuaccacaaaccuuaugacaaacaagaacaacaauauacaagaugguauaauuuuuagagaauucucaugauuuuuuuucucauuaaagcugccaguggccaauaaauauauuugccugcauuuuuauuacuauuuccaggagaggaaaauaaggccgaggaaaguuaagagacuuaccaaggucacacagcuugugacuaguaaagccagaacuagaacuuccccuuguacuacaugccugccucuuaacuauggugggaggugguugcuagaugcauuuuaggggggcuguuaagaguaggguuugggagaaugagaauagaucuccacuuagacacuuacccugcucucccagguacccgacuaccuagaccacaucaaaaagcccauggacuuuuucaccaugaagcagaacuuggaggcuuaccgcuacuugaacuuugaugauuuugaggaggacuucaaccucauugucagcaacugccuaaaguauaaugccaaggacaccaucuucuacagggcagcagugcgacuccgugagcaggguggugcugugcuccgucaagcccggcgacaggcagaaaaaaugggcauugacuuugagacgggcaugcauaucccucacaaccuggccggagaugaggucucacaccacacugaagauggugggugauaagucauccgcauguauugagggcaaugcuguagagauggacagcuuuccuaaagucccugggagcaggcaauauaggcagaaagcagcugggcugaggaacagcaagcucuccccaggaaugcucuccuaaaagccagacugagugaauggauggcugggccaccacucuacauacuagugcugcuguuuuaacagcuguucuaggagaagccaaugggaagaguggguuuccucuugccugcccagguucauggggcccaacgggcugcuuugagccugacuuuucuccccccaacucucccuagcaguagaggaagaacggcugguccugcuggagaaccagaaacaccugccaguagaagaacagcugaaguuguugcuggagaggcuggaugaagucaaugccagcaagcagagugugggccgcucucggcgugcaaaaaugaucaagaaggagaugacagcauugcggcggaagcuugcucaccagcgggagacuggccgggaugggccugagcgucauggccccucaggucggggcaaucugacaccccacccagcagccugugacaaagauggacagaccgacagugcugcagaagagagcagcagccaggaaacaagcaaaggucugaacccuauagcaagguggaccccguagcaagccagauuuuaccucuguagcauguacucagcccugcuguucccaagcagaggcccugcauggcuagcuguacuuucuucuucguuacccagucaggggcuucuuagcuaccucucuggcuguugguaugaguuguucuaaaucccaggccccaaaaucaucucaauuuuagauaaugauucuauauucccagggugugacccuggacaucuacccucccuucucaugucaggccccucaccaacucuccuucucucucucucugcuccaggccugggucccaacauguccucaacccccgcacaugaggugggcaggagaaccucaguucuguucuccaaaaagaacccgaagacagcuggaccgcccaagaggccgggccggcccccaaaaaaccgggagagccagaugacccccagccacggaggcaguccuguggggcccccucagcuccccaucaugggcucccuacgucagcgcaagcgggguaggagcccccggcccaguucaagcucagacagcgacagugauaaguccacagaagaucccccaaugggugagccucaucaucacccagcccccaguucccccucuccccugagagugagcagagcugccauucuccccagcuuauuuccuuauaauagacagcugaggagucuuaauuucaccuccucgucuuucauuuguaaaaacugaggcccagagauacuaccccgccagauucacagccacaccccuccccaccaucucuugacguuuucucuucucuucugucuugggaacuuccugcccuuuaagccuuuaugucuuuaggccaaaggaaggugaggugagggucaggaaagaccuuuggccagcugugguagaacugcccagagcuaucuccgcuggccaaagcugaaggaaauuuucagcccagaaagagaacccaaacucuugauuucaucuuacccccccccccccgccccccaugcuggcucugaucuacaucuuccugaccaguugguuccuucccuccuccucuucccucuaagacuuaccagccaauggcuucagcagugggaaccagccagugaagaagaguuucuugguguaccguaaugacugcaaccuuccccgaagcagcucagacucugaguccagcagcagcagcagcagcagugcagccucagaccggaccagguaccauuccuacagaugggaggcaggcugcaggaugccuuuacagguuuucccacuggaaguuggguugcagccauuucaguccaaaggaaggaguucaaacccaaguaucccuguaaaauaaauagauuagucauccuaacagaacagaagaugcugucauagguuaaguagauguuuuggagcaaugcaaacuggugcccuguagcuaggauuuagccaucagacauacuuuauuuuggccacuaagauguuuuuaaaaacugaauacaggcugcucuuccagaggacccugguccaauucccagcacccacacaguauagcucuaguuccagggagauuggaugcccuuugcuggcuuccacaggcccugauacacagacauguacacagacauacaugcaagcaaaaugcuuauacagauaaaaucuuuuuaaaaaacccaaaaggacagaauuacauuuacuuaaaaagcaaaaacuggccgggcaugguggcacaugccuuuaaaucccagcacucaggaggcagaggcagguggauuucugaguucgaggccagcauggucuacaaagugaguuccaggacagccagggcuacacagagaaacccugucuccaaaaaccaaaaaauaaaaaaaaaaaaaaaaaaaaaaaaaggcaaaaacugaauccacauaaaauucucagacucuauguucucuuuaaaaucaagaguaucagcuggguaugguaaaucauauaaucccagcacuuggaagauugaaguagaauugcugcaagccagaggucagccugggcuauggaauaagcuccaggccagccaucucaaggacuggagcuauagcuucuugauggagcacuugccuagcuugugaggcccuaggaucaauuucaagugcuucaaaacaguaaaaaaugaaggagcaucugacaguucugguugguauuguuuguaggcaggcaugguuuccgcuuagugacagaauucugcauuaaucugaauccgagccuaauguuacguugcaaccuucauauagucucagcuuuucaaaagucuagguuuggggacuuaacaaggagaggagcccugccaugccauuccccauuucucccugugaauuacauuccaauuaucuuuccacagcacaacucccucaaaacaaggcaggggcaagcccucuuucucucggggcacauucccagaagacaguagugaagauaccucaggcacugagaaugaggccuacuccgugggcacuggccgcggcgugggccacagcaguaaguacccucacccaaagucaggggugcuggggacccaguuucaaggccuugccagccccccagcugcugauccgcccccucucucccguuccugugaagugguaagaaagagucugggucgaggagcuggcuggcugucagaggaugaggacuccccguuggaugcucuggaccucgugugggccaaaugccgaggcuauccaucauacccagcucugguaggccuaugguuucucuuguucuuagcccuggcuuugcagcccuaggacugggauugauaaguguagccuugcccucucccugcuaagcuauggaguccagggcuccuuagcagguagacugguaggcacauguauuucaguaccucagagagaucccagucaguuuucccaccucucucuaucuccuuuugcacccuagguucugaaauaauaugggucaauacuguaagcccaguaacauauucuuugaguucuuagauagggcuagcuagcuucagggaagaagugaccuauacauaacugagcuuguauuacauccuuagaucauugauccaaagaugccccgagaagguauguuccaccaugggguuccuaucccuguaccaccacuggagguucuaaaacuuggggaacaaaugacacaggaagcccgagagcaucucuaccucguucucuucuuugacaacaaacgaaccugguaaggaaagauggaugcauuuggugugacuuaaagccacagauguauacagccaucuguaauguggcagcagacugccaagagacacuacaaaugauuaguuuauuacaaaguguacaugguguggggugacgacacacuuagaauagcuuuaagaaaaggguguggcccuuagucugaugcacugaguaggcaguagcuggcaaacagcuauaacuagaaaccaaaggaccaucagugacugacagauuuaggguggcucucugcccacauugauggcuucuagacuuauuuuuuccauuuuuuccucuauaguaacaaagugaggaaaaccaaacauaaacauuuaaacuuuaaauccuuccugucaaaaccguguuaaaugccugcagaugacaauuuguagucucccuaaagcagcugggacaggauuuuuacacccaaaagaugcugugguuaugcuguagaauuaauaugccuucccagugagaacucaucacacuuaagaauuuaauaaaggaaagucucuaagcaugcaacuggugcuggcacaaaagggaaccagccucaaacacaaaauuucaccaauuuauagaccagcgugugcgugcauauguguguaugccuuaggcuuauacaucucauguacaccaucauccuuaaaucucuuccagauccaggcugcacuuuaaacaauuuaaagagacaggagacugcaagucugaccacuugggcgggugaaagggagauuauacagcaaagaaauugccagaguuaauuaaggacaccaguguuguuguuuucugaauaguuguuaccuaggaucgucuuggccacuugauagaauuaugcuuuuccuuauaaguaauuuacuugauggcagaccaggaugccauuaauaauaguugucccuugcucugcaaccuuagaggcauguucuuugauacggagauggaccuaguggcugguuuuaagucaguguugccuccuuuuguuuugggaaucuagauuaacuggauaucaaucuuggugagcaaacauuagcagaaacauuuucucagcaacccuagacugccauuuuuguacaaaauugucuuuccuacgguuucuaacacaccuguuuagucauauuggaggcagaauuccuuuagcuaacuucuacuucauguaacucaguauuuccuaagcaagucuuuuaguaaauccuuguagaaucaauguuauugccucaagcaucuccugauucauuuacucccccugaucugcugccugggcuguucuucucaauacaauacacagucccuugauagcagggaugcuaggaguaggcauuccuaacagcacgggguucaaaagggcgagcacucuucuaccugaaaucaugccucaucucaucuucuuaccuucucugacaggcaguggcugccccggacuaagcuuguuccucugggugugaaccaggaucuagacaaagagaagaugcuggagggccgcaaguccaacauccgcaagucagugcagauugcuuaccacagggcucugcagcaccgaagcaaggugcagggugagcagagcagcgagaccagcgauagugacugauacucucagagcccgguggugcugugauggcucuccuucccuuugcucauuguccuggagugaugccgcccucugcacugauuaauuccuggucuuggggccagucucaggggaaguuggguaggggaggucccuccugcccugagugcagcuggacuguacaaaacacuccaagggcccauggccacucagugcaaggagaggagaggucucagaggucuaacgaguucaaaaacucauggcauuguagggcaggguggugggccacaguaagaauacuguaaaaaacaggcccuaccacccuuaccuacucaugccaggggaauucauaccugccuagaggccugaggcccuugcaggugguaagguaaaucagcaucaucccagccuagccgugggauugaugucugucuagccuggaagaggggcacuaggugaccccuccccugcuguuguaaauacuguaauuauuggagaauuuaaauuauucucauuuguaacugcguuuccgggucgcgccagagucauuugguacuaaaaaaagaaaaagaaaaaaaaaaaagaaaagaauggagcuugucucuacuuccuuuccuuuucccauagaacucccccuaccuuucaaacugguuuguauuuauuucaaaggaagaaaauauauugauucuuagaaaauaaagucuauuuagaauucuuu

SEQ ID NO: 3285 - RNA, 18088 nt, Mus musculus
uacaauaagcaacguuuaaugcguaaucugaucuuccucaacuccuaaucugguggucuucucauucagcuauucacagguuucaugguauuugcccaggcuugggaguccaaugcaugcuaggaacuggggauuuagaaguaaauaggucugguauuuacugaagaucuccuaguagaaugggagaaaaccagaaaaugucacacuggaggugagaauaaaaugccacgggaacagcuuuuccuugagagagugaaaaaaagucauaauaaaagugucauuuggccgggcgugguggcucacgccuuuaaucccagcacuugggaggcagaggcaggcggauuucugaguucgaggccagccuggucuacagagugaguuccaggacagccagggcuacacagagaaacccugucucgaaccccccccccccaaaaagugucauuugaacuaggucuugaagaauuuguaggagcccaccauucaacauuccuaauugagagcccuuugaaccuugagagauuauaacauguagggaauuuuaugcugcagugugagcccaccuccagucugggcuuauugucgggggcgcccgccagggcuccaaccccgugugggaggccggcgacgagagacggggccgagaaggggaaacccgaacucucggaagcgaagcuggccgccccggcuccugcccugcacucucuggcccugcucccccggcuucccgcgcugaccccugccacuccugccaaaccauaacuacugaaaagaaucuagaaaggaagacuagggacagagagcaaaaggaauuucuugaauguuauauuagauggucugaauagaagcuggagagcagcuggaggcuuuuaguaauguaauugguaugaucauugcuacuuaguagaaggaucacucuugucacuuuaugugagacuaagccaaaggaauugagacauaggcagcaauagguuuuaagggcccagacuaggaccuuuguaaagaagcuggcaccuagagaugcucuaaagagagacuggccaggauauccuugggaaaggaaggcugaagagaaucuacuguauggugugggagcuggaaacugucaggccugugcuaauuggucuguguauucuagaugugacagcauggggguggacuuugacgugaagaccuucugccacaauuugcgggcaacuaagccaccauaugagugcccuguggagacuugccgcaagguuuacaagaguuacagugguaucgaguaccaccuguaccacuaugaccacgacagcccaccacccccacagcagaccccacugcgcaagcacaaaaagaaagggcgccagucacgaccagccaacaagcagucacccagccccucugaagucucacagucaccaggccgagaggugaugagcuaugcucaggcccagcgcaugguagaaguggaccuucauggccguguccaccgaaucagcaucuuugacaacuuggauguggugucagaggaugaggaggccccugaggaggccccugagaauggcagcaacaaggaaaacacugagacaccugcggcuacaccuaagucaggcaagcauaagaacaaggagaaacgaaaagacucuaaccaccaccaucacagcgcuccugccagugcugcucccaaauugccugaggugguguaucgugagcuagagcaagauaccccugacgcaccaccccggcccacuuccuacuaccgguaagaccaccaccaucuccuaccucuagaaaaccaaucaaaaccaaucgagaugacagucugauaggagacagccaguaaaggagcacuagucugccaaggcagugugaacuguccuuuagcccuacuggcacaugccagguccuggguucucucacuuccugcucccuuuguaacauuuuuuaagaauugggguuuuuuuguguguauguguuuugauuuauuucuguuuuugagacagucugaguuuucccagguuggccuugagugggcaagagagcuaccuacgucuucuccugaauguugaacaucuagcuauagccacaucuuuauuuuuagaacucgcucaaagcaguccuuguucccauuugccaggccugucaaaagucacauguaggaaucucugaacugagguugagacccauguccagcaagcuucaaaacugcacuguuuccugcacccaacauccugcuucuaaagcccucauccacagagcaggugcagugcuccucccuagggcagaagacauuggcuucauaaggccucaaagaugaaugauaaaucugauguaaucucccacuguuuuguuacugucaccuguccuuuaacagcuuugugagcaggaguucauuguugccauacuaccucuuaccucuccagugcucgcuugcuuauugauuuacuuauuuguguguguguguguguguguaauuuucucuuuauauuccauucauucuaagagcuaaccauaguggcuccuuuugaaguuccaaacauuccuaauguuaaaaaaaucuuuuuuacauuuauuuguuugucugcacauggcacuacagcaccuguggaggcuagagaacuaccugugggacaaaaaaaaaaguucucacuuuuacaaugcauaucccaggucccaggauaggccauuagguuuacuagcagggaucuuuacuuuacugaacuuguuuugcuagccacagacauaauaaagcaaauuccuuuaacaugagaaaaaaagauguagggugguaaggcuguguguagaaaucucagccacaggauguuaucaauaccaauuguaacccccacccccccacccccccacccccccccccccggcagcuaaagccaaaagaacaguuuguucaucuguguuuauuuguaaaggcucuuaugugaaaaguggcuuuugccaaauacacaguccauuugauguuacagugacugucagcaauacagucacuauugugacucccucagagagagagagaauauuacuucucuauagauguuacauuugaugguacaguaagacucgcucucucugagagagagagagagagagagagagagagcgagagcgcauauuacuucucuauagauaaggaaccagggcccagggagcuuaaaagcuuaaacucauuuacuguuauacagagaccaggcaauauggccucggaguuucuaugcaccuggccugcucagagauccauuuuccauguagagagagaggaauuaacguuuugcuagaucaugguauaugucauuugauguagugucccaugucucccuaaauacaauauucauauacauauauaugugaaugaaugauuuacuuuuguaaaaaccugagaucugaggucaucauucuaauaacauauagaucuccucuccuuuguccaaguuuuagcaaguauuccuuauuuuuucuccuuacauccagucccccuuucugguuuuucacuauucucuuuucucuuagaauuuaccauguucucuuuaucccaagcacaggccccucuuugggacuuccucuccuccaauggcucuuggcauaaccugcucucacaggcaguccaccccaacuugcauagcuccuuuucuuucucucuacacauagucacuuucuuccugggaucagaucuuuucuccagaugagcaguuuuuagccuguugcagucaguuaggagcuauguuauuauaguuagcaaauuccccauguuuugaaaugauuuacuuuuguaaaaaccugagauggucugaggucaucaucacucuaauaauuuucucaugcucaaauccaguccacuucuugagggggagugagaggguggugugucagcuggugugucaagaauuguacaugacauacagcccaccuaucugugccagagucuauaaucugggagcuugugggaguguguuauguacuaucaaugacaguuggugugucauggcagaggaauaggcaagaccugacguuuaagagaacuaguauaagcccuagaacuguccagcuaguucacuccagcucugaucauacccuuauucugggagcacaguugcacuagaagacaaggaaagaacuaaggaagaagcugcccucuacgcacauuuuacucucccugucacccucaaaaugccuuucaguugaacaacgcugaggaccuauuucuguacagugaaucagauacgaucccugccuguuagagaacaaguuaggaacaacagcuauaauucaagacaagguggguuaggguuauuacaaagcuaauaaaauugacauuuauugaauauuugcuccaugugaagcacuguucuaagugucucccuuuauuaacucauuucaugcucacaacaacuauggcaggcauauuagcauuauuucucuauagauaaggaaccagggcccagggagcuuaaaagcuuaaagucauuuacuguuauacagagaccaggcaauauggccucggaguuucuaugcaccuggccugcucagagauccauuuuccauguagagagagagaauuaauguuuuccuagaacaugguguaugucacuugacuuagccucccauauccuccuaaauacaaggucucauguaucuuagacuggccuccaacucacaggguaguagccuugaacucuugauucuucugucucuacuucucgagugcuaggauuuacagguaugauaucacaccugguauuauagagugccagggauugaaccagggcuuuguggggauugagccaggacuuugugcaugcuaggcaagcacucuaccaagugaguauaacuccagcuccuuggcuggagccauuucucuuguaaugcuauuuaaaguuaucauuuacugaauauagcccuuguguuaucaguuaauacaagguacaggacagagcagugcuguucugaagguggcagaguggcagagacaaaauuuaaaaccagauuucuucaaagccaaacuccuauucuugucuuguacuauguaauagacaaugccagagucuagucggcuuaagacaggacaguaugcaugccugcugugucauagccaccuagagcugcccucugcucuagcuugcaggcucaaagaauuccaaaguggauguggaaaaggcuaggggcagcgaaugggugacacucuaucgcucccuggugauaugaccuaucugugauagguuguuaacauuuuccucaaagcuucaauucaucuaaaaucacacccucagucuucugucacuguggauaaauaaaugauaauaaagaugauaaggacacuaaucuguuagcuauuaccagaauagcuguaccuuggccuagugccuugcccauaaugaaugcucagucaguuguagcuauuaucuuucaaggcuauucagagaacaaacaggauauauagaauuugagagacugcuagcaucuucugagagaacauccaugugucuuugguacuuaucaucuuugcuaaaggccuguauucauuugccagugauguccaaggaauugccuuccucugacaguacaauccccccauacguucacagggagaccucccugcuccagcauugccccauuuaggggucuggcugagccucuauacuucagggaagaccguaucauaugauagccacagcaugaguacuagagaugugggccuguuuguuuucaugaccagguucuugggcacuuucugaggaaguuaacuucucccacauuuaggucuccuuuucugcaagacaggaaugauucuaauacuauaaaugugggguuaagguaaggcuggagagauaaauguauacaugggcagaggccgagugcuuggaggcaagaacaaugcuuugucugaaggaaaaauaucagccaugugaugccaagcugccugugugcacugcagguacaucgagaaaucugcagaggagcuggaugaggagguggaguaugacauggaugaagaggacuauaucuggcuggauaucaugaaugagcggcggaagacugaggguguaagucccaucccacaagagaucuuugaguacuuaauggaccguuuggagaaggagucguacuuugagagucacaauaaaggugaccccaaugcacuaguggaugaagaugccgugugcuguaucugcaaugauggcgagugccagaacagcaauguuauccucuucugugacauguguaacuuggcugugcaccaggagugcuacgguguccccuauaucccugaaggccaguggcugugccgccguugccugcagucaccuucucgugcaguggauugugcucugugccccaauaaggguggugccuucaagcagacagaugauggccgcugggcccacguggugugugccuuguggaucccugagguuugcuuugccaacacagucuuccuagaaccuauugacagcauugagcacaucccaccagcucgguggaagcucaccugcuacauuuguaaacagcggggcucuggagccugcauccagugccauaaggccaauugcuacacagccuuccaugugacaugugcccaacaagcuggccuuuacaugaagauggaaccugugcgggagacaggugccaaugguaccuccuuuagcguccgcaagacagccuacugugacauccacacacccccagguucugcucgucgccugccugcccuaucccacagugagggugaggaagaagaggaugaagaagaagaugaggguaaaagcuggagcucagagaaggucaagaaggccaaggccaagucucggauuaagaugaagaaagcucggaagaucuuggcagagaagagggcagcagcaccugugguguccgugcccugcaucccgccacacagguacacaggcaacagugggcagggaggggagggagaaacacucagaagaacuggggccugaguagaauggccugcuugcccuccuaucaggagcugcauggaaguuaaaaaguaaguaaauuuaaaggaggugaucuuaaguaagacaucugacuuuugcacuaggggccagaaauacugaacgguuaucuggcagacagaguauguguuuaaaacuacccuuuuugauggugcaguuaagaugaaacagccauaggaaaagugaccuucaagggagaaucaaugguccgguaugcuuuagcaugcauagggaccuagguucaguccccagcacagaaaauaaaacaaugcagcuugguuaugcaccagaagugcuaccguguccgcuguguuccuaaggaccaucuucccaagcuguggacuaugugugcccuguagaguguugcucaagucagccuguggugucaguuguuuuuagcugccuuguguugucuaguugacuucaccauggauuucugcuguacuugcacuuuaucuucacuugaucuuaggaaaaaggccaacaacuuugucuucugcacagucugagagaugagagucuagcuagccgugcccacgcugcagugacuaagcagacuuaaagacagacugaaacuguucuccuuagugcugagcucaguuuccucucugcuauguugugccacucaaggcacuuuuaauuaugccuuaaacccagaguuccaaacuauuccuuuuugcgacagaaucuccuguaggcugggcuugaacuccauagucagaugugaccuugagcuucuggauccuuuuacccucaccucuagguuucugggaucacggugugagcuaccaugccugauuuuccagaccuuuuugaugagcaucaaugcccccacucauccuaauugaggagcucuuccuggcagucaggaccuaacaggguuuuauuuuguucccaggcucaguaagaucaccaaccgccugaccauccagaggaagagccaguucaugcagaggcugcacagcuacuggacucugaaacgacaaucacggaauggggucccacuacucaggcgccuacaaacacaccuucagucucagaggaacugugaacaaguugggguaccguguccaaauccugugggcuguggaaacuaguacuaaaagggcaaggacuaaaauguguagcaauauccuccagcaucaaagagcuuacaguuuuucuaaguuaaauuaacauccccaccccauugcaggcucaacaugaaauguguauauuaucagcuugguagaaaggcauuguuccuguagguucauuaauucaacaaacauaccaagcauuuucuagguucuagccccuggcaacacgugaauaguggugcuuugguaaauuacuggguuuccuccuuggccuagguuuccuggguacuccucuucuggacucuccucuggcuuucuuaccauuuucugaugccccuuuuaccucuacagagagauucugaugauaaaaacugggcccucaaagaacagcucaaguccuggcagagacugcggcaugaccuggagcgagcucggcugcugguggagcugauccgcaagcgagagaaacuaaaaagggagacggugagugcuccagggccaguccugguucucaaaguagaacacguccuggagaagggaaaguguauggccaagagcaucaaggcccauacuggcauucugaguuccagcauuaugugcuuuuaggccugucugugggaggccaaauguuaaaggagauugcacaaaguccaaaccucugugacccaggcagcucaggccaggaguuaaaggaucggggaccaaaguagauaaggacagcuuucuuucauggggucugaaugagaaaagcauguuccuaagccagcaaggaucaucuccuuugaccucugcugagggacuggccaggaccuggcugauccagccuuuuugugugucagaucaagauccagcagauugccauggagaugcagcugaccccuuuccucauccuccuccgaaaaaccuuggagcagcuccaagagaaggacacaggcaacaucuucagcgagccggucccucugucugagguaaccgaauuggacgaaguaagaaucccuuccccucacuccaacuucuuuuucuuccucucccaguuggaccccucccugaugcaggucugaccccaggacuagguugggaccuaaguguaaaggguuugguggcucuggggcagaaugaacugagcuacaugugucaccucgacucuugucuauccuuaccccaccccaagaacucagaauggaagcccaucugcacuccuuccccagagucugccagaucacagggcaggaagaugcuuucagggugugcaacccuagaauagaaacuuuagaagacuaagaauuuaaagagccaacucugaagcccuagguugacccuucuuucugaaaugagacauuugaggccuuaccacaaaccuuaugacaaacaagaacaacaauauacaagaugguauaauuuuuagagaauucucaugauuuuuuuucucauuaaagcugccaguggccaauaaauauauuugccugcauuuuuauuacuauuuccaggagaggaaaauaaggccgaggaaaguuaagagacuuaccaaggucacacagcuugugacuaguaaagccagaacuagaacuuccccuuguacuacaugccugccucuuaacuauggugggaggugguugcuagaugcauuuuaggggggcuguuaagaguaggguuugggagaaugagaauagaucuccacuuagacacuuacccugcucucccagguacccgacuaccuagaccacaucaaaaagcccauggacuuuuucaccaugaagcagaacuuggaggcuuaccgcuacuugaacuuugaugauuuugaggaggacuucaaccucauugucagcaacugccuaaaguauaaugccaaggacaccaucuucuacagggcagcagugcgacuccgugagcaggguggugcugugcuccgucaagcccggcgacaggcagaaaaaaugggcauugacuuugagacgggcaugcauaucccucacaaccuggccggagaugaggucucacaccacacugaagauggugggugauaagucauccgcauguauugagggcaaugcuguagagauggacagcuuuccuaaagucccugggagcaggcaauauaggcagaaagcagcugggcugaggaacagcaagcucuccccaggaaugcucuccuaaaagccagacugagugaauggauggcugggccaccacucuacauacuagugcugcuguuuuaacagcuguucuaggagaagccaaugggaagaguggguuuccucuugccugcccagguucauggggcccaacgggcugcuuugagccugacuuuucuccccccaacucucccuagcaguagaggaagaacggcugguccugcuggagaaccagaaacaccugccaguagaagaacagcugaaguuguugcuggagaggcuggaugaagucaaugccagcaagcagagugugggccgcucucggcgugcaaaaaugaucaagaaggagaugacagcauugcggcggaagcuugcucaccagcgggagacuggccgggaugggccugagcgucauggccccucaggucggggcaaucugacaccccacccagcagccugugacaaagauggacagaccgacagugcugcagaagagagcagcagccaggaaacaagcaaaggucugaacccuauagcaagguggaccccguagcaagccagauuuuaccucuguagcauguacucagcccugcuguucccaagcagaggcccugcauggcuagcuguacuuucuucuucguuacccagucaggggcuucuuagcuaccucucuggcuguugguaugaguuguucuaaaucccaggccccaaaaucaucucaauuuuagauaaugauucuauauucccagggugugacccuggacaucuacccucccuucucaugucaggccccucaccaacucuccuucucucucucucugcuccaggccugggucccaacauguccucaacccccgcacaugaggugggcaggagaaccucaguucuguucuccaaaaagaacccgaagacagcuggaccgcccaagaggccgggccggcccccaaaaaaccgggagagccagaugacccccagccacggaggcaguccuguggggcccccucagcuccccaucaugggcucccuacgucagcgcaagcgggguaggagcccccggcccaguucaagcucagacagcgacagugauaaguccacagaagaucccccaaugggugagccucaucaucacccagcccccaguucccccucuccccugagagugagcagagcugccauucuccccagcuuauuuccuuauaauagacagcugaggagucuuaauuucaccuccucgucuuucauuuguaaaaacugaggcccagagauacuaccccgccagauucacagccacaccccuccccaccaucucuugacguuuucucuucucuucugucuugggaacuuccugcccuuuaagccuuuaugucuuuaggccaaaggaaggugaggugagggucaggaaagaccuuuggccagcugugguagaacugcccagagcuaucuccgcuggccaaagcugaaggaaauuuucagcccagaaagagaacccaaacucuugauuucaucuuacccccccccccccgccccccaugcuggcucugaucuacaucuuccugaccaguugguuccuucccuccuccucuucccucuaagacuuaccagccaauggcuucagcagugggaaccagccagugaagaagaguuucuugguguaccguaaugacugcaaccuuccccgaagcagcucagacucugaguccagcagcagcagcagcagcagugcagccucagaccggaccagguaccauuccuacagaugggaggcaggcugcaggaugccuuuacagguuuucccacuggaaguuggguugcagccauuucaguccaaaggaaggaguucaaacccaaguaucccuguaaaauaaauagauuagucauccuaacagaacagaagaugcugucauagguuaaguagauguuuuggagcaaugcaaacuggugcccuguagcuaggauuuagccaucagacauacuuuauuuuggccacuaagauguuuuuaaaaacugaauacaggcugcucuuccagaggacccugguccaauucccagcacccacacaguauagcucuaguuccagggagauuggaugcccuuugcuggcuuccacaggcccugauacacagacauguacacagacauacaugcaagcaaaaugcuuauacagauaaaaucuuuuuaaaaaacccaaaaggacagaauuacauuuacuuaaaaagcaaaaacuggccgggcaugguggcacaugccuuuaaaucccagcacucaggaggcagaggcagguggauuucugaguucgaggccagcauggucuacaaagugaguuccaggacagccagggcuacacagagaaacccugucuccaaaaaccaaaaaauaaaaaaaaaaaaaaaaaaaaaaaaaggcaaaaacugaauccacauaaaauucucagacucuauguucucuuuaaaaucaagaguaucagcuggguaugguaaaucauauaaucccagcacuuggaagauugaaguagaauugcugcaagccagaggucagccugggcuauggaauaagcuccaggccagccaucucaaggacuggagcuauagcuucuugauggagcacuugccuagcuugugaggcccuaggaucaauuucaagugcuucaaaacaguaaaaaaugaaggagcaucugacaguucugguugguauuguuuguaggcaggcaugguuuccgcuuagugacagaauucugcauuaaucugaauccgagccuaauguuacguugcaaccuucauauagucucagcuuuucaaaagucuagguuuggggacuuaacaaggagaggagcccugccaugccauuccccauuucucccugugaauuacauuccaauuaucuuuccacagcacaacucccucaaaacaaggcaggggcaagcccucuuucucucggggcacauucccagaagacaguagugaagauaccucaggcacugagaaugaggccuacuccgugggcacuggccgcggcgugggccacagcaguaaguacccucacccaaagucaggggugcuggggacccaguuucaaggccuugccagccccccagcugcugauccgcccccucucucccguuccugugaagugguaagaaagagucugggucgaggagcuggcuggcugucagaggaugaggacuccccguuggaugcucuggaccucgugugggccaaaugccgaggcuauccaucauacccagcucugguaggccuaugguuucucuuguucuuagcccuggcuuugcagcccuaggacugggauugauaaguguagccuugcccucucccugcuaagcuauggaguccagggcuccuuagcagguagacugguaggcacauguauuucaguaccucagagagaucccagucaguuuucccaccucucucuaucuccuuuugcacccuagguucugaaauaauaugggucaauacuguaagcccaguaacauauucuuugaguucuuagauagggcuagcuagcuucagggaagaagugaccuauacauaacugagcuuguauuacauccuuagaucauugauccaaagaugccccgagaagguauguuccaccaugggguuccuaucccuguaccaccacuggagguucuaaaacuuggggaacaaaugacacaggaagcccgagagcaucucuaccucguucucuucuuugacaacaaacgaaccugguaaggaaagauggaugcauuuggugugacuuaaagccacagauguauacagccaucuguaauguggcagcagacugccaagagacacuacaaaugauuaguuuauuacaaaguguacaugguguggggugacgacacacuuagaauagcuuuaagaaaaggguguggcccuuagucugaugcacugaguaggcaguagcuggcaaacagcuauaacuagaaaccaaaggaccaucagugacugacagauuuaggguggcucucugcccacauugauggcuucuagacuuauuuuuuccauuuuuuccucuauaguaacaaagugaggaaaaccaaacauaaacauuuaaacuuuaaauccuuccugucaaaaccguguuaaaugccugcagaugacaauuuguagucucccuaaagcagcugggacaggauuuuuacacccaaaagaugcugugguuaugcuguagaauuaauaugccuucccagugagaacucaucacacuuaagaauuuaauaaaggaaagucucuaagcaugcaacuggugcuggcacaaaagggaaccagccucaaacacaaaauuucaccaauuuauagaccagcgugugcgugcauauguguguaugccuuaggcuuauacaucucauguacaccaucauccuuaaaucucuuccagauccaggcugcacuuuaaacaauuuaaagagacaggagacugcaagucugaccacuugggcgggugaaagggagauuauacagcaaagaaauugccagaguuaauuaaggacaccaguguuguuguuuucugaauaguuguuaccuaggaucgucuuggccacuugauagaauuaugcuuuuccuuauaaguaauuuacuugauggcagaccaggaugccauuaauaauaguugucccuugcucugcaaccuuagaggcauguucuuugauacggagauggaccuaguggcugguuuuaagucaguguugccuccuuuuguuuugggaaucuagauuaacuggauaucaaucuuggugagcaaacauuagcagaaacauuuucucagcaacccuagacugccauuuuuguacaaaauugucuuuccuacgguuucuaacacaccuguuuagucauauuggaggcagaauuccuuuagcuaacuucuacuucauguaacucaguauuuccuaagcaagucuuuuaguaaauccuuguagaaucaauguuauugccucaagcaucuccugauucauuuacucccccugaucugcugccugggcuguucuucucaauacaauacacagucccuugauagcagggaugcuaggaguaggcauuccuaacagcacgggguucaaaagggcgagcacucuucuaccugaaaucaugccucaucucaucuucuuaccuucucugacaggcaguggcugccccggacuaagcuuguuccucugggugugaaccaggaucuagacaaagagaagaugcuggagggccgcaaguccaacauccgcaagucagugcagauugcuuaccacagggcucugcagcaccgaagcaaggugcagggugagcagagcagcgagaccagcgauagugacugauacucucagagcccgguggugcugugauggcucuccuucccuuugcucauuguccuggagugaugccgcccucugcacugauuaauuccuggucuuggggccagucucaggggaaguuggguaggggaggucccuccugcccugagugcagcuggacuguacaaaacacuccaagggcccauggccacucagugcaaggagaggagaggucucagaggucuaacgaguucaaaaacucauggcauuguagggcaggguggugggccacaguaagaauacuguaaaaaacaggcccuaccacccuuaccuacucaugccaggggaauucauaccugccuagaggccugaggcccuugcaggugguaagguaaaucagcaucaucccagccuagccgugggauugaugucugucuagccuggaagaggggcacuaggugaccccuccccugcuguuguaaauacuguaauuauuggagaauuuaaauuauucucauuuguaacugcguuuccgggucgcgccagagucauuugguacuaaaaaaagaaaaagaaaaaaaaaaaagaaaagaauggagcuugucucuacuuccuuuccuuuucccauagaacucccccuaccuuucaaacugguuuguauuuauuucaaaggaagaaaauauauugauucuuagaaaauaaagucuauuuagaauucuuucuucuugccuucuacuaggacagagggauuccgagggagagcuuugugccucauacuugggauguacuuugugcccaaaggguugcugaugacugugcacggcagucauaagacauauaagcaagcuagauagaguaguagcacgguccuguaaucccaggacgugaggugcugaggcaggagaauugccaugaguucaaaggggaggcagaauaacauaacaagaacccgucuuugaaaaguuugaauagcaaagcuaaguaagagcucacauguccuauguacucucaggcacugcccuaaguaccuagaaauacauaaauugugucuaaucccugcaauaacuauggauggcuaauaauacgcagcuaucuccacagugacaggaccauacuaaguaccuuuagauauacuguugugcaaucuuuacaguaauuaugggguguguuaauuacagguuguuuaccucagaugcuaagguuuagaaaaauuaacucgccaaaguuccuacaacuaagaaguuggagagcuaggacuuaaacccaggucucuuugucuggaaaggugucuuuucagcuagcaccuaagaccagaugaguccauuacugccaucuuaugggauucaguugcuucaaguccuuuguuaggacuguagcugaagggcuucagacacuucaguugaaaacaaaguagguguguaccagccuguuaaugcacaugcaaccuuggcguuuuuccuaacuuaaagucuuguuggagagaaugccuucucagugccaggcaccuguaaggugacaugccuuuagaugagguaaucacaguaaaacauggaugcugagagccuuacagcuacugcuuaaugaaacugagacaaaagacccaguuuguuugauguugguuaauaguguucuagcaggugugcugugccuuucuguagacacacacacacacacacuaaucagcauccagcccugcccuugagucuguaguccaauaauuuaggcacaacccgaaaauuucucugcuugauggaaaaugcccuagugugucaaacuaguguccgaaguucauguuucuuucuuucuuuuuuucuuuucuuuuuuuguuuguuuuuggagacaggguuucucuguguugcccuggcuguccuagaacucacucuguagaccaggcuggccucaaacucagaaaucugccugccucugccucccaaagugcugggauuaaagucaugcgccauaacugcccggcugaaguucauauuucuuagccuaagcauucuuuuuuugucuuaaaaaauuauaaaugauauaguccuuuuuggaacaagguggcuggugcugguuguguuggucccuuaggcugccuagagccacacacuggcauuuggacggagugaacuccaaagaaagcccaucucuccacgcucggacuggagcggguagcugugccgcaggcuguagccagggcgagcaaaccugagacuggccucugaagccugggaagcccgagauggcgcauucggggccuccugacaagacguggaggggacagcgcugaaaaaucacugccucagaagaggcucgguggagaaaggcuugagcaggggaggaugagauucuuucgguuuauuucuugagacagagucucgccaugaagcccagccuaguuaagcuucaaacgugccucccgccucugccuaccgaguucugggacgaccgguguguaccacuacgccccgcaaugauguggcuccagugcgggccagcacgagaaguugcaggcaggcccugagauugcaccgaaagcccugaaauggcagagccgggucucuggcagccaaucgccaagcagcgaggccagcaggccaaccgcucccaccucacagg

SEQ ID NO: 3286 - RNA, 8171 nt, Mus musculus
uuccaaaccucgagggcugcgcaggaggaggaggcgcgcgccgggagguccugggggcggggccacguccggaggaagaggcggggcgugcugcacgggagagcggaguggggcguuuagggguuugguggugugcgagaggcuuuccuacgaggagagggaaauucauucaacagggacucaaauuaaaauuacaccggacccauaagcuaggacccacggugcuacacucccgguguguguggucacuugugugcgaggcuuuaggacuugggaaagucgaguucugauuggacagugccguaaugggcuggggcugcuagccgaauguuauuccguuccuggcugccuagcagcaugagacaucgcacccuaagcuccagcccggcccucugggccucuaucccguguccacgcucugagcugcgucuggacuugguuuuagcuucuggacaguccuuccggugagugacugcacuugggaggacuguucccuaggauguugacuucucagugcugcccacucgggauacagagaauguugggagcaauagaugagaguacauuuuggagucuaagcaccggugguuugccuuuuaaccuucuuuaggaaguagaggugaugacugugcaggauuaugaggaccaugcaauaaaaaucagugggggaagcugagggaugcacucaguaauaagagugcuugcuuuucacgcacuuggcucuugguucaauccccaguaccgcuucuuuuuuauuuuuaagaugaaaacuacaccgggggugguggcacacgccuuuaaucccagcacucgggaggcagaggcagguggauuucugaguuugaggccagccuggucuacaaagugaguuccaggacagccagggcuauacagagaaacccugucucgaaaaaacaaacaaacaaaaagaugaaaacuagcgggggggggggggggggcggcuggagagauggcucagugguuaagagcacugacugcucuuuuggagguccugaguuuaauuccaagcaaccauaugguggcucacaaccauccauaaugagaucugaugcccuguucuggugugucugaagacagggacaguguccuuacauauaaauaaauaaauaaauaaauaaaucuuaaaaaagaaagaaagaaagaaaacuagccgggcagugguggcacaugccuuuaaucccagcacuuggcaggcagaggcaggcagauuucugaguuugaggccagccuggucuacagagugaguuccaggucagccagggcuacacagagaaacccugucucggggaaaaagaaagaaaagaaagaaagaaaaagaaagaagacauaccacuuuuauuuauaacuaauuagucaguuuacaggugggacauuuguaaaacagaaaggaccuuaacgaguucaagauggguaacgaugcuaggguugucuguuggggugcccagguggaaggagcagagcccugcucacuggaguggcgugcuggcagaucaaguauggacacugacucagacggaggaccagcucuauugcacuguguaccgaggagacgacagccaggucagcaggcccacccuagaggagcuggaaacccuacacaaguacuuucagcuagaugucagccuggcacagcuguauagccacugggcuucuguagacucccacuuccaaagaguggcccagaaauuccaaggugaguacaagggggcaggaaugguggcuuacaaguuacaucucugugacucugccuuccguaacaugcagauacagggccaccaggaugguucaucaaauaaaagcacuugucaugcaguuuaaugccccaauacauacuggaaggagaggaccaacucccaaaaguucacgcuaugccacacacacaugauaauagcaaauaauuaagauguacuuacuaaagugcuucuacuuagcacauuguuauuauuauaaugaugaugaucaucauccacaggaaagugauaaagauauggggccuaauccugacuguguguccuggagcaggugacgucauucugucauuauauacccaaucacuuuuacucuuuggugaagaaagaaaaggacacaaaaugaagcccuguucauguggugcuugcauuguggcuuuuuuucucaguggaaugggauggucacccagaccccacaggaugccacaaggcagaagccuagugauuucucgacccgagcagucccuuauucuuccaggucccccuggagccucaagguguagugucugauguggagggauucgagguguguccccaggcuccgaccuuucugcucuccaggugugagacugcugagacaagaccccacugagugccuuuucucuuucaucuguuccuccaacaacaacauugcucgcauuacuggcaugguggaacggcucugccaggccuuuggaccucgacucauucagcuugaugaugucacuuaucauggcuucccaaaccuccaugcccuggcuggugaguaggugcauccguccccuucagcauuuggacagaaagaucuaucuguucaguucuacccaagcuaugagcucccaucucagagcuucccacugugccaaacacugucuccacccagaaguccugggugaaguagucugggcagucccagauauaacuuguccucagauuugaucucugaaacagcagcaccucauuaguuggcuguuugccaguauaugcaguaccucacuagaggaaugucuauacacaguguucaguaguuuagacuuacaggcagauaaucugagacagacugccuagaucugacugaauccuaguucugacacuaacauguucacuucuguuuugagucugugaaauggaaaaugauguuacauauccugucagaauccuuuauucugaggacagaauaaagggagacacaucuugcacccagcaguguuuggaacaggaaauacauagcaauuuuaagcugcugucacuuuagugaguccacuugcucugugaagaaaguauauugguuagcagauaugaggaccaagcuaggugacaugcuuagggacuaaauaguaagaagaacuuugguucauucucaauugggguauuuuuuuggugcuaagaaaaggcucgaguaucugcuuuuggcuuaauaaucauaaguugucaaggaguucauuuaccucucuaagcuuggcuugacuuguuaauagaaugggaauauuagaauauauuuagaaggguuuggggcaggggggauaaguugauugugaggcauugaaaaggaaugaguugggcugaagauggcucagugguuaagagcacugacugcucuucugaagguccugaguucaaaucccaggaaccacaugauggcucaucacaaucuguaacaagaucugauacccucuucuggagugucugaagacagcuacaguguacuuacauauaauaaauaaaucuuuuaaaagaaaaaaaggaaagaaaugaguuuaagaacucaggugcuauccucuaccugggugaaagguccuaucuccaccaugcccauucuuuguguuggagggguagaguugauggguaucuuaguuaggguucccauugcugagaagagacaccaagaccaaggcaacucuuauaagaaacaauauuugauuggggcuggcuuacagguucagauauucaguccauuauuaucauggcaugaagcauggcagcuuccagucaggcacagugcuggaggaaggagcuaagagcucuacaucuugauucaaaggcagucaggagaagacucagcauccucaggcagcuagagggaggaucucaaagccuauccccucuaaccgaggaacacagaggaagugacacacuuccucuagcaaggccacgccuacuccagcaaggccauacccucuaaaagugccauccccugggccaagcacuuuuaaaccaccaugguaggugaguagguagguaguguauggguguauguucauaaauguguucaagugcacacaugcauguguuuauggaaguccgagaucagugucagguguuuuccucaguugcauuuggauuuaguguuguuugguuuuuuuuuuuaauucucucuguaugagugcuucgucugaauguauuuauguacauaacacgcacaugccugguagccacagaagucaauagaggaugucagauccccuacaacuggaguuacagaugguugugaggcagcauauggaugccaagcuggaaccuggucuucuguaagggcagcaaguuuucuuaacuccugaauccugugcccagcccacguagccccuucagugcccuuacuguguccaucuguaaaauguguauacugccauuauugagaaccuuaagaaaagcaagcauaauguacuuugccagucagugugugccuccaucucaccuuacgaaugcuggccuuacagaugugaaccucuacaucuggcauuuuacaugaguucugagaauugagcucagguaaucagguuuaugcugacuaccugcuaggccaucacccaagcucuugcagcuuuguaggccaugggugagagcacuucuugaauaaagcuaaagugcucaaaugggcauucccccagagcaagggucccuagcaccugcuucagagcccagcuaauaggaggugcuaagaggacauuuaugggggcagaacucaggccuuaccuguuucuuucacauccaacuguccacugacuccuagaggacaguaaauaaggaagaggugccuaggaaagcacugggguggagcaucuuacacaagccugaggacaacaacugacuggggauaucugcucuucccuccacacucccacagguccagaagcagagacucaccugaggaaguugggccugggguaccgugcccgcuauguacgugccagugccaaagccauccucgaagagcaaggugggccagcuuggcugcagcagcuucgaguggccccuuaugaagaggcccacaaggcccucugcacccugcccggggugggcgccaaggugaggguccagagagguaggacacgcccuuuuuacccacacugagcguacgagagguagaaacaaggcccagcugagaauccagggagacccggcuucuggagaaagcacaggaaggacaagggaauagcagagugcagagaguauagaagaggcugcccuuuggauaaaucuuuagaaagggccuuugugcggguacauuaugugcacugcuguuuguauguagaaguuuucagagggaagaggcggaaaguuaauacugguuaccuuuggggagacagauggaaagauguuucuauuuuaccuucucuucucuucucuucucuucucuucucuucucuucucuucucuucucuucucuuuucauuacaugugcuuacagaauguuuuguugaugucaauagaucuaucagacuauuagaauuuauaauuuaucuuuauuuuuuauacuccucugugucuuuuuuucuuuuauuuuuuguuguuguuguuguuuuugguuuuucgagacaggguuucucuguguagcccuggcugggcuguccuggaacucacucuguagaccaggauggccucuccucugugucuuaaaaugaauuuucaggagcuggcuagaugaugcagagguuaagaucacucacugcucuuucagaggaccugaguuuaauuccuagcacccccuugucagguggcuuacaacaacuaccuguaacuccaguuccacgggaucuuaugcccuuuucuagucuccaugggaaccuguaagcacauggcaugugcauacucuguuguuacagacgguuguaagucaucaggcagauguugagaauugaacccaggucuucuggaagagcaggcaguagucuuguuuuaauugcuaaagauuuauuuauuuauuauauguaaguacacuguagcugucuucagacgcaccagaagagggcaucagaucucuguuacaggugguugugagccaccacgugguugcugggauuugaacuucggaccuuuggaagagcaggcgggugcucuuacccccugagccaucucaccagccccauugacuuaaagaauuuuuaagggauuggcauuacauuugacauugccuaguuucacugcgugauuuuguccaagacacuugagagccccaguuuccuuaucugaggagaguguggucauaccuucuccccagguuguaugaguguacggcccacacagauguccacucaggaacaagucuucuuggagcuauuuuuagaaguaauggguaauuacugcauacugacugagagugcagaauagugcugccuuagcggaaggaggaagcggauagcuuuggaugcuggccaaauccgccauuccuccacaacaguucucucuuugucaaagguggcugacugcaucugcuuaauggcccuugacaaaccccaggcugugcccguggauguccauguauggcagauugcccaucgugacuacggcuggcauccuaagacaucccaggcuaagggcccgagcccuuuggccaacaaagaacugggugaggagugugaugcuggggcguugggcugagguuggagagccugucauucuuaaccaucuccccacaguucccaucucugugcauggagggcacguguguggcucaauuaauguaguuuccucacuucuaauuuaggaaacuuuuuccggaaucuguggggaccuuaugcuggcugggcccaagcaguaaguauaccuaguccagacccuaaaggacuuucccucacccugccugaccccuggacucuucagcuaccuguucucauaacucccaccacccccauugaccccaguccugaccucagcaugcccuguuucccauagacuccuuaugcccccucccauaggugcuguucagugcugaccuucgccaaccaagccugucucgggagccaccagcaaagcgcaaaaagggaucuaagaggccagagggcuagguagggcucaggggcaaaaggucuuuuuuccuuuguucuccauuucuuucccuugucucucccccccccccaacccccgaccccuaagucucaagucagaaagacuuaacacucccaccucagaggccagaaccccaaaucaaagucaguuuuuacaauagggaaaaaggaagcuauuugagcaaacggaacugucuuguuuuaucuucccuuuauuacaagaaggaacaauaaaauagaaacauuuguauggaaaacgcagugaagagugagaggggaggggugaagagguguggggucagaaacuccccagaucuggagugaggaggaagcaggcugccuccaaccccucucaugaaagaaacccugacuuccuugauguucaauccauggcccuagagcuuggggguggugcagggggcaguuccgagccugguuccacacagcagucucggcagcagcagccagcugcuggcccuguguagagggaaaggguaaggguggcuguagagccggcuccagcuccagccuuguucuuccucauggaccaccuaugcccuuccacgagacccugguucuuaccaccagcuguuggugucagcagcuccccguggcugccagucugccccugccccuccugacugguucccagcugcagcuuccucaugugccgaaccacagcaguggcauugaaagcuugcuguggaaagaggggagggacacugaaaggacgccuaaagggcuuagggucggcaacaggaggcuccccgacucuguaagguguuacugaacgauauucagcuauacauacagcacauauauaaaaugcauacaaagggacacaaaacuauaauucauguaaccaacauucaugugucuacacagcucugagcauguugccugguuauucauucauuaaauccucacaccaucuucugaggcagcacuuucauguuguuucccuuuuuagacaguuuuacuacguauugugccucugccuccagcgugcugagauuacaggcauaugugugcuaccuaccaggaacgacaagcacuguuuuuguuugcgacggggucucacuauguagcacuggcuguccugacucccaagugcugggauuaaaggugugugucacua

SEQ ID NO: 3287 - RNA, 10145 nt, Mus musculus
ugacaucagagccgcaggcgggccgagggagccgagccccagccgagcgccagcgacugagcaggcaaacugaccaggcacagacgcggcgggagcuccgcaccagccaccucggcccucgcagccagccccgaggcggggcagccgcagguacaacugaggguugccccggcucugugcagcggggcgcuccagccacaagauacugaagcccaagggugggaggggcgccuggccccuggacagacagacggaacagggcugggccuuucucucccaccucccgucccaggcccuuuaggugcuaggugaccuccauggauauugccuggauaucagaaaaggguggggaagggucugugugugugugguguauguccaagcgcuaggccugaccauggaagggcgugggcauuuggaagaguagaucggggagggcaugugagggguucccugaagcaggaaugugcuucaguuguguaaagguaucugggaauucauuuuuguuguugcauaugguguucaaggauacacacacacugcugucuggcuugcgggguagaguucaggggagguuuggucuuccucugaggggguuuaguuaggcagauuguuaaggcuugguuugcuguguagggcucugggcugaggaguuggagggcauagacaggacuaaguugcuaugucugguaugugggaacggaugccaccuuguucgugugugcauggaaucaguacugcaguguagggucuggguguuuuggauggacagguaggugugagugguguauaugaacguguguugaugcugggcauaugugcacaaccaggugacguggugugcagugugauggaucuagcaggaaggugucuggacucaagauucauguacugcugauguggaguggugucugcugcaggguguggaacugugagggucauuagugcuggcauccauguggguuugacuuuacauggauuuaccauugccucuuucaucagaaaaccugggaugcuggccaaugcucugggaacaaggucccacucaaggaguggacucucaguucuggucagggugccuucucuucauucuucccaaaggaaccaggagguugcuuucccagagcucuagggcaugaggggcucuguucuggcuucaaacucaguugauucugagauguugacuuuucugaaugauucccccagucuaguagucuccuacuggaccaacacaugacacccuuuguccuuagcaagcuuagcugggacucucuugggcaacucuggacucauucuauccaucuccaaccucaguuuccgagauuucucacaugauacauggggagagaacccacccuuucuuguaagaugacacagagcugucuagggaaagguccaagauagguccccuccaggaggggacagacaggugagaucaguuuuccggcugcugggacacagacagggagucaggagggcuaggucuggggaguuccagcuguggcugauguugccuugguaacagugagaaggagcuauuuaaaaacguggcugagauauugcuggaagcccaggcugccggaaaccugauuuccgagaggcuaggguggcaaggaggaggaggaggaggcggaggaggaggaggaggaggaggaggaggaggaggaggaaggggcccucuagggcgccaucuaugcugcucuggggucucaugugcuaucuuccuugagggggagguuuccuuggguguuaggauugagaaaaagacuggggcaaaauggagaaugaagaauugaaggaaugcacagauaccgagaauuucacuacuagaaaugaucuuuugcaaacaugcugagugaacauaugaugggggaggcugaaugccuguugcuaaugaacagauccaggaaugaaugaacucaugcugccugcucauggggcaugcaguagauucucagagaggauaggcccucugaaucucuuucucuccauuuccuuccuaggagcccuggcuguggcuggggggcagugggccaugccaggggcaguggaaggccccagguggaagcaggcggaagacauuagggauauuuaugacuucagagauguucugggcacgugagucucaggaugggguggugguggggugacaggauugggaagggcuucgcuccugagccugacggcuggaggggcuaagucugggguggugcuuccucuggucagcucacgagcacuuacuucccuuuccuacagaccagggcuuguggcagcuuugccauggugcagacuaguccggccuucugguuuuggcuaacuguggggaggauggggccuuucuuguccagucaugggguccuuaugaagagaaggaaguccaagagaaugggagaacuauuuaucuagauugcugccaagagcuggcuauucuggccuggguuuggaaacugaggcuggacaugguugcucuugaugauggaaauccaaauauaacucaaaccuggucuuuuccuguuauaaguugguccuagagacacggacagacaaacacaaaaugauaggugaaugaguauuauucucuuauugagguuguagaggccagaguagucucuucugccuggguaacacuccuugaaggacaugagaccuuggcuaaaaguaagauggguaagcuuaugcuugucagaaagaaggaagguaauucaaggcagguggaacagugcauguaaaggcucagaagccacugcagaaagaggccgucugcuggaauucacaauuagggcuggggagauguucaagcaguaagaaauggaaaggggcagcgaaugcaaggccuugagaagagcaagaggucauuucacggcacaaaggaagacauuuaagacugaccaacggugcuggagauggcucaucaguuaagaacauuggcuggucuuguagaggacuaggcucaguucucagcacugaugguggcucacaaccaccuguaacuccagauccaacgguauguaugugguuugaacacacauguaggcaaaacacuuguacacauaaaguaacuaaagcugaaaaaaaaagaaaaaguaaaaaggacuagccaucaugugugggcaaacuggagagccaagaauuguaaccgugguaauggugugauucugugagguucuaaagggcauuacauuaccuacaacucaaacugaauccaucaaccacucacauaaucaaguauuucaggggcagaguucaggcccagcuggcucguauguuaccagccuggcuuccuuugguuggcuucaguuuggagcaggcucucccuagguacugacaaagaugacugccauccacuccagguuuacauccuaccagcuuauucacucauucacagugccaggacaccgucauguaagugaccagcuacugagguacugaggcaggggacagacaacucuggcuggccaugucuggcuuaugugaaagacaaagguggucaugacuacggggaauggaggagggcgaggagcugggguucuagcuccuuaucuugcaaaccucugacucacaggggugccuucucagaagugauccuggcagaggacaagaggacucagaaacugguggccaucaaaugcauugccaagaaagcccuggagggcaaagaaggcagcauggagaacgagauugccgucuuacacaaguauguggcaccgaccccuccucauuccucuagauuacuguagaaaugguuugaagucucggccgcacaggacaagaacuuggcagggaguggcuggcccagagcuaaccucccagaugagacugaggugcagggagggcuuguuuacagaggaugaagcuguucauggagccucaaggccagcccacccaucaggugcucaccuaagguccucccauacagugaagcaggcguauuugcugagccccuggcuaaauuagcagccagccgacaggaaaccugcucugcuguaaaacguacagcaagcauuugcuuccagugccucccacuuccuaacgauuugcacagggaggagauggucauuuccuuucccuaauuugggugcaugggauaacgaggccagugagggcaagagauuugcccaaaguuacacagcaagccuaugggggagccaugccuuccuuagccccacgaucaaucaccacagguucaucuguugaguaccgaccugaugcaagcucucaaguagcauguagcagaggcguacccgggccaggucuguuugaccacagaggccagugcuugcuugcuagucuuuucuuaccuucuagcaucagcuuccccccaguggacuccagaaccuugguuccugcccuggaugcaggugccagggaauaggugcgccacccuaagcuuaucucuccuuuuaggaucaagcaccccaacauuguagcccuggaugacaucuaugagagugggggccaccucuaccucaucaugcagcugugaguggccugucugcccacccucaucccucucgcugcugccccacgcacgcucuuggccacuuuccgguccuuugcugcaggguuucagguggagagcuguuugaccgaauuguggagaaaggauucuacacggaacgggaugccagccgccucaucuuccaggugcuggaugcugucaaguaccugcacgaccugggcauugugcaccgggaucucaagguaggaucugaggggccuagugaacuauaugcaccaggggacggcaauggcaaucucugucuguccugcuuugucugucuuugaguaccucucagccccucacuaaagcccuagcuuuccauuugcaaaaugaacuacuugugacucccccuccccccagccccagcuccucuuauuccagcuuagacagggacacaagguaggcugggcugguaucuuaccuuaacaacuuaacaacuuaggugucuuuuucuuauaaugaaacaucucuuuguagagaacaaacggggcagcaaagcuucagagaaaugcauaggggcuuacgcugaaaacacuucaguccaagucagcuguggugguacacagaggcagaggcaggcagaucccugaguucaaggccaaccugguuuacagagugaauuacaagacagucagagccacacacauaccuuaucucaaaaaaucaaaaccaaaaccaaaauaaauagaaccuggcuugaagacuagucuugccaugcccuaacugacucuugggccaaucacugccucuaaaggcauugguuuccuccuugguaaagugggcuuauucaaacuagacaggcugcauaugugguaggguugaaaucagccaaguacuuauccaagauccagcacagaagguauuaaauuuuuuuuauaauacugggauuccuguaagguuucuaaguucuaugaaaauccuuccuacaaccccuuggcuuuguguuuucuagaacuugcagccuucuagcuucuaacggauuuaaugagcuagcuaccauggauuuuggagaagcauauagcacugcuggccucuggcuaccucugacuaccccuucuccucuuucccacccuccaagccagagaaccugcuguacuacagucuggaugaagacuccaaaaucaugaucucugacuuuggccucuccaagauggaggacccaggcagugugcucuccacagccugugggacuccaggauaugugggugaggagggcccuggguuggggauggggaugaggaaagagccaggagcugcaggguagacacaggucaucaccaugugcuuucuuuccacagccccugagguccuggcccagaagcccuacagcaaggcuguggauugcugguccauaggagucauugccuauauacuguaaguggggacauggucaagguggccugugacuacagucaucuucccugcuuugcccacuccucuacaucuaccaaauaaauacuaacaggcaggggucuggagagauggcgcaggcgugaagagcaaugcugcuuuuccagaggacccagguucaauucccaguaugcacaugguagcucacaaccaucugcaacucuaguuccagaggaucuaaugccuucuuuuggucucuauggguacucaugugcacacacaugguacacagacuuacaugcaggcaaaauaucuguauacauaaaaacaaacaaacaaacaaagucuaacaggcuucaaucaggagauaccauguguccagcacugugggagcacugaggaguuagcagaaaaugaaacacuccaagugccugcccuuaagagcugacauguagaaagaaucagugaguaaauaaaucuauauuagugucaccuggucaaagucacugugaagauaaaaucaaacaggaguagggagauguggauagaugucacuucagauagucaaaggcccuuugugaugguaaaaucugaguggcuuuugagccaguuuaggugugauccgguuuagguguggggaggaugucaaacaugaagacccuaugacagcauguucaaggacagaaggaaggccaguacugccagacagaagugagcaagacagaggacuuccugugagucccgucugacucuuggcacugccccaaaaugcucuccaagccaacgaguauuuuuaaagcugacaugaauucucuuucucucugccuaggcucuguggcuacccacccuuuuaugaugaaaaugaugccaaacucuuugaacagauuuugaaggcagaguaugaguuugacucuccuuauugggacgacaucucugacucugguaauugggucuuugccuucuucaucuagccccugccucacgucuucaucugauccaggagucuccccacugucuugccuccgucguauuuuauucccagacuagaagcagaugucguaugucuuaucuuggguucccucugcuuggccccuaucucagagcucuguaggcauucagucuuccaauauaguauuuacaaaauuaccuccccuggagcuuacugacucucugaggcuuaaacagcauuaauauuucuuuuuuuuuuuuuuuuuuuuuuuuuagauuuuuuuuuuuuuuaagauuuauuuauuuauuauauguaaguacacuguagcugucuucagacgcaccagaagagggcaucagaucucuguuacaggugguugugagccaccaugugguugcugggauuugaacuucggaccuuuggaagagcagucgggugcucuuacccccugagccaucucaccagccccaagcauuaauauuucuaucuuccauuuugugucccagucagggaccagcuugugauggcuguacaguaguuuacacacuagugugagcauacugaguggauucuucuguaauuauguucucaaaaaaggagggagcuagaaggcuggaguguguggaguggggcacaggcagacaggcuucuugucacaccuugucagcggagaugugaggggaugagcacugucuuggugcccacaggaauggucacgcuguaucuuugcuuuucucuuggggcuccagccaaagauuucauacgacauuugauggagaaagacccggagaagagguuuaccugugagcaggccuugcagcacccauggugagagcucccacucuaaguuguguuagggugggaccugggggucccaggccugccccaauccucacaggcaacucugcauauaccccauccuaggauugcaggagauacagcucuggauaagaauauccaccagucagugagcgagcagaucaagaagaacuuugccaagagcaaguggaagguacagugcucaguaccagcugcauacaggaccugcccaggagguuuuccaaagaacuucucuguucacucagcaaaggcuuccugauccccaaaguccagagguggcuccuggguuccaucuccagagagacaugauguagcccaugggacccaagggucagaaagguggccacagaccuauaguugacuaguaauuaaccagguguacagaauaugccugagguggagggaacagagugcagagagaccaggguaagagaauguggcucgcuggacuagaggggcugaaggaaccgagggaacugaguauugagaggccaggcuggggaaacugguagaggcugcugggccauugagguccuuaacugcuauagugggacacccaccuaaugcagaggaugacuccagaaagacugaaugcaggaaagggcuuucaggaugcagugaaggcaaggaaggacuccugagaggcccagcaggaugugucauagaugcagcguaugcuggggcuugacucagaagcagcaagaggaacacaggagugggugaaagcaggagggagacucagaagaaacaaagaugggaggcauacugagggagugagaugucaaaggcugccccaaccuuccgguuagggacaaaguagacagggguaccauaacugugauaaugauccuggcacagaaaccugucuugaggggacauggacauaagcagcacauaggacaucugggugaacauaaaaugauagaaacagguaaguuacauaaccuuucugcaccucaguuuccuucacugaaauuaaugcuauuccagcacucagggaggcugaggcaggaggaucagggacuacaugaaaucuugugucaaaaaaagagugggugagaugcugagaacacagcuuaguuggcagagugcuugccuagugugcaugaaacccuaguuuggcucacuagcaucauacaagacugggcacaguggugguagagccuacaaucccaggccucaggagauacgagguagaauggaggauagccaggcuacacgagaacccauguuaaaagaaacuaaugauauuaauagugcuugccaaagccagguguagugacacacaccuuuaaucccagcacuugggagucaggacagccagugcuacauagugagaccccgucgcaaacaaaaacagugcuugucguuccugguagguagcacacauaugccuguaaucucagcacgcuggaggcagaggcacaauacguaguaaaacugucuaaaaagggaaacaacaugaaagugcugccucagaagauggugugaggauuuaaugaaugaauaaccaggcaacaugcucagagcuguguagacacaugaauguugguuacaugaauuauaguuuugugucccuuuguaugcauuuuauauaugugcuguauguauagcugaauaucguucaguaacaccuuacagagucggggagccuccuguugccgacccuaagcccuuuaggcguccuuucagugucccuccccucuuuccacagcaagcuuucaaugccacugcugugguucggcacaugaggaagcugcagcugggaaccagucaggaggggcaggggcagacuggcagccacggggagcugcugacaccaacagcuggugguaagaaccagggucucguggaagggcauaggugguccaugaggaagaacaaggcuggagcuggagccggcucuacagccacccuuacccuuucccucuacacagggccagcagcuggcugcugcugccgagacugcuguguggaaccaggcucggaacugcccccugcaccacccccaagcucuagggccauggauugaacaucaaggaagucaggguuucuuucaugagagggguuggaggcagccugcuuccuccucacuccagaucuggggaguuucugaccccacaccucuucaccccuccccucucacucuucacugcguuuuccauacaaauguuucuauuuuauuguuccuucuuguaauaaagggaagauaaaacaagacaguuccguuugcucaaauagcuuccuuuuucccuauuguaaaaacugacuuugauuugggguucuggccucugaggugggaguguuaagucuuucugacuugagacuuaggggucggggguugggggggggggagagacaagggaaagaaauggagaacaaaggaaaaaagaccuuuugccccugagcccuaccuagcccucuggccucuuagaucccuuuuugcgcuuugcugguggcucccgagacaggcuugguuggcgaaggucagcacugaacagcacc

SEQ ID NO: 3288 - RNA, 11861 nt, Mus musculus
ucagguugggcaccaaauuaggacaggccgaaccggagaaacguuucuuccgguggugcuccccuauccucuccgggcuccucccauuugcaaccguaggguucggccggguagccagucccuugagauuugggcucugggccccaccccagccccgggcugcuuccuagcccgggacuccucaggccuagcauuccaccucccggagauucguagguggccuuagacccccacccccaccccggcccuacaggccaccuugggcuggccguccccgcccucgcgucaacugcagggggcccgcccauagccaguuccggagcaguugcuccgaucgcccugaacuccccgcccccuccugcggcccagggccuguaggaggccgcagagaggagguaggagaggcggggguuguguuaggggcucccuagaggacgaggacccuggaggcgggaucuuggggcgacacacagguggagccagccauuaagcagucccacuucugugccaggcacugaacugggcacuugacgagcaucaccucuuaauccucagaacauuccagggagguagguaauucucgaugcccccauuuuacagauuuauacuucuuaauggggaaauagacugaggcaucaucuuuuguccuggaaaaaagaaaaacaaacaaacaaacaaacaaaaaccggagauucagguuaaauaacauguuuagaaacgcacauaagaaaaugggcuggaacuuaguucuguucaccugaccagccuguguuccaaacuagccagggacacagagaaggugcagagguggaauggagugagacaagaggaggcagggagaacccugucaaauagaaugcuagaaacgacccaacguagggaaacagaggacauaggaagacagggcacacuaguaucuccucuuccuuaaugcugcagauuccagacuucugcgguucaaauugcaacuaggaggccggccuaaucaugcagguuuguacaccuagugacuugggaggcuaaagcagguggaucauaaguucaaggccuggaauucaugaaagggggggggggcuggauguaacuguaacauaauuaaguuuggagaauuugugccuagaaugaacaagcgcuuguauaaaucaggugugguacaugccuaaaauuccaucucuugggagguggagacaaaaccuuggcuacauagcuaguuugagaccaaccugagugcauaucuuuaucccagcacucagaggcaggugcuuucuggggugggggucgggagggggagcucuaugaauccugaucuauguagcaaaugaguaucaggccacucaagacuacauaaugagauuuuugucucccccaccccaaaaugggggugagguagggucuggagaugugugagacccuucagugcuaccaaaacaaaaaaagacaauaaauugcaguuaggagucuaggcauguguacauacucuucuggagucuuuuuccuuucuuugucaaaagaaagaaaccaggcagugguggcacacgccuuuaaucccaguagaggcaggugaucucugaauugaaggccagccuggucuauagaguucauuccaggccagccagaguuguuauacagagaaauuauguugaaugaaugaaugaaugaaugaaugaaugaaaagcauggcaaaaggccccccuuuuaagguuaugugcauaauucagugaagucaaccuagcuugggguacagucagggcucuguugggucucucuccccaugcuacuuugucuccuauccaauggccuucuccccucuaauuuuacagggucccaccuccugggccaugagcgagcugaaggacuguccacugcaguuucaugacuucaagucuguggaccaccugaaggucuguccccgcuacacggcagugcuggcccgcuccgaggacgauggcauuggcauugaggagcuggacacccugcagcuggagcuugagacucugcuguccucugcaagccggagacugcguguacuggaagcugaaacccaggugauuguccauggggggcauccacuagagacauugugucaaguuaugggauggauccuuagguucccucucugcugaggcccagggauggaugggaagagagacccacaugggaaucaugacagaauaguuagcucucaguucagcuuaccguuagccaaggaugcuauccgacuguagguggacaccgcccacguguggccccugaaguugccugggaacuuucugagaugcacugugauacagucaguugcauagacagaaccaccgggugccuuggagugugacauaaagguuagcugggagucuuguucaccaccaccaaaaaacccagcagcagcagauuuccccaggacuaccaugccaaaccguuugugacuagcuugggcggcagcagaagugaaucagaauguagaccuccgguuaaauucaugugagaaaaucacagagaagaacaggcauuuugaaauaugaguaguuugcuuaauaaccucaaauucuagaucucaguuauccauggcggggaaagaagugcccugucucuucucuccgucucagggguugucuuuguguguuucagauccuuacugacuggcaggauaagaaaggggaccgacgauuccugaagcuaggucgcgaccacgagcucggugcuccccccaaacacggaaagcccaagaagcagaaacuggaagggaagacaggacaugggccaggcccuggcccgggacgacccaaauccaaaaacguccaacccaagauccaggaauaugaauuuacugaugacccaaucgacgugccucggauccccaagaaugaugcucccaacagguucugggccugagcacguagcagggagcuggaggggcccagagacuugugguggaggcuuggaaggcccggggcuaaggcugaaggagcaucucacccacuccgggucugcuucugccuguagguucugggccucuguggagcccuauugugccgacaucaccagugaggagguacggacacuagaggagcuccugaagcccccagaagaugaagcugaacauuauaagguagaaaccugagccgcacagucaguacgacagggcucaaaggcgccugaggguccuaggcagcaaagccugcauccaucaccuacuuucuucccagccuccugccugcuccaugaccccugcagacagugaggcucagcuuucucuguccucuagccuuucuccaaagagccucugaacacucuccuugcuuuuacacuugggcgauacuuacuuucuuuaacuauaaaaguuaaguuccgcugggcgugguggcgcacgccuuuaaucccagcacucaggaggcagaggcaggcaaauuucuugaguucaaggccagccuggucuacagagugaguuccaggacagccagggcuacacagagaaacccugucucgagaaaaaaaaaaaaaaguuaaauucugguuuucuuuucuaagacacuggaauuugcuaugguacccaggcugaccuugaaccccuggacucaaccauuguccucucucagcccuucaggucccccccaggugucugggaccacaaacauaccuggguuaaaaguugguuuuuuugguuuugggggauuuuguuuguuguuguuuuuugguuuuuguugguuuguuuguuuugguuuugguuuuugagacuagauuucauuuaucccaggcuagccuugaacuuuguuagcuaacaaauuacccugaacuuaagaucuuuuucuucugacucccuagugcugggauuacagguagguaaugaccaugcccaguugaugcaguccugguacagaagccagggcucucugcauucccagcaagcucucuacuggcggagaucuguccccagcaaguuagcuuuauugaucuuaaaaauaaaauaugcuccauaaaagaaaguagacaaacuugugaggcggggacuccaccacaggacaccugccaucgcaggugcacguaugacacagaucuacuucuagggcuccccugacuucuguuugccacaggauggaguccaaguguuucagugcugggugacaccccaguucucuccaguuguccuuggccacaucuuucuuuccugcugcauuuaucagcuacaccagacauguucccucccccuggccucacaccagggucuacacacaagcucuucucagccuggcagacucccucacuccucaaggccccaaagaugccucugcagacucuccagcagaaaggggcagcugggcccagugccucacccccauugcacucgggaggcugaggcaaguuugaggccagcauggguuuacaaguuugagguccuuucuccaaggagagcaaaggacauggucucacuuggugcuuucaugguccccgggcugcuuuaaaugcacuaaccugaauuugaaaaucauuuaucugcaaccagagauguaguuagucauauugcucagugguagagcaacuucuuagcauggacaaggccccagauucaguccugaccaaaaguacugcuaccaccuauaaucucacagagucagcuuguccuauauaaaagaaguggagaaaaagcaguccauucugacagcaguaaguuuaaagaacacaagaaaauaauuucuucuuaucccugcuuugggcccaaguucucuuuagaggaauuaccgcugaccaagaggauccacagacacaguauuuuauaccuuguaucuuuuuguugucgguaguggugguuguggguuuuugguugguugguuugucugccucccgaguacugggacuaaaggugugcuauccugccuggcuucuauuuuauaucuugcuaaugcauaucagcuucuagguguauuuugauuuuugguucuuguuuguuuguuuguuuauuugagaaaagauagggucucagcccaggcucagacuccugaucagccuaugucagccuccagaaugaucauaggcuagguguguacgccacgccuagcuguguugagucuuucuauacguguuucccuuacuggagugugaguggagagauuggaucuuguuggccuuucguggcaccagccuuggccuugggcaacaaauccgugaggaaagaaagaauaaacggaugcuuccugaccgagucccaugccaggagauccucucacauuccagucucagaugggcaguguuuaccucucagagcugagugagcucuuugcugcagauucccccccuagggaaacacuacucccagcgcugggcccaggaggaucugcuggaggagcagaaggacggcgcucgggcagcagcuguggcugacaagaagaaaggccucauaggaccacugacagaacuggacacaaaagguaagccucagccuccucacagcccaggccuggaucugaggccccggagcuucaggccuccagcuguuguucucccuguccagauguggaugcccugcugaagaagucugaggcccagcaugaacagccagaagacgggugucccuuuggagcccugacacagcgccugcugcaggcccuaguggaggugagcaggccaucugacugggaaccacaagcuaggcaugguggcaucugcuuguaaccccaguggcacuugggagacagaggcucuuagcucaaguucaaucugguuacaugugacugucucagaaaacaaaaaaacauuuacacacaggcucgagcgagcaugcgcacacgugcauacacacacacacacacacacauacacacacacacacacacacacacacacacacacacacacacacacacgagcgcucgugugcuggcacuuuauuguuauuuugcuuuuugagauagagucacacuauggacuagaacuuuuaguccucgugccucaaugccccugugccgggaauagcagauguaagucuccacacaaggcuuccacagacaccuuugcugagcaguggguaaggggauugauuccaugccuccucugacuggacgccugugcuugugaggaacuugagguucagaaaaguuaacuuuuucuuaagaccacagcuaauaagugaaggucggauucaagccucgcuugggguuuccaccuuaaugcccaggccugagcuuagaaacaccauuuacauccucuagccucgguuuccucuuucgucucuaacacuaugauaguucuucucucagagaacagccugggguagacugaggccaggggaagucuggcuuagccccgcagagacuccgucuuauguggcuuuucauccugaccaaggucacucuggguauugugacugcgccaggcccgcagaagcugaguaaggaguaugggaaggaagccuucuggaugugacugugacucuucccuguggacaucacucuccuuggagaaucugucccacaagugccucugacugcaggggugccugggaaauguaguguagcucagcugcugcggggaaggcacaguguugggauaucucccaggccgcaccgugcuccuacagugcugggugccuguggaggcuuccuagccugagcuagucuaucacuguuucugugucucccucuuuuuauauagauaugccucuccccccaaaagaggaauuucuagaacccagaaaggaaugaucaaagcuuuggaggaaucuuuuuaacaugggugggaugaaagagaugacagacgcugcucucuagccugugaagacugucugugccugucagagaaguaggacugcuaugauacucuccuccuaacuucucucugcucuucaggaaaauauuaucuccccuauggaggacuccccuauuccugacaugucugggaaagagucaggggcagauggagcgagcaccuccccgcgcaaucagaacaagccuuucaggugagugcuaucccagcugugcucuaggcuugucugucggcuucacgugucucuucauggggagacgugucuuuguuagcagaaacgcugagaacccuuuaaccaagcccagcgaucucaugugggagugcuggccucauuucuggacgcaggcuuuguccagaccugaucacccuagcucugcuccuacuggagcugagcagagugcccaccugaagggaucgcuggcuaagagccaagacuacaugugcaauaacuuggaacuguuaaucauuacaagaaauaugugccaugaaacagugaaaacagcagaaugccaaauggaaaaggaguaauccuauguguauucaaaauauacuuacgaguuacauaaaauuggggaauagaaaagauuacaacucacaguuugcaacauaucacaaggccuggagcacauguggcuauagugguuucacuaggugaaaggaagagccgggguccucugaggggggccagcuggcccuccgagcucagguccggccuuaucuacagugugccacauaccaagucccuggagagccgcaucaaggaggagcugauugcccagggccuccuggagucugaggaccggcccgcggaggacucagaggacgagguccuugcugagcugcgcaaacggcaagcugagcugaaagcacucagugcacacaaccgcaccaagaagcaugaccugcugaggugagugaggagugccacaccacgccacgccacgccacgucaccaagcaguccugugcccuagguugugucucagauagauccuaaguccaggggugaggcucuagcacccacaauggacagauggauggauuugauuccagauuuagauuuauuucauuuuaaucaugugugugugcuuuugagugugcgaguacaggugucuguaguggcaggaugcccuggagcuggaguuacggguguuugcugcuggccagcgugggugcugggaacugaacgccagcccucugcgagaguaauacacuaaccagugagccaucuccaaccgugacugagcccauuaaguauaguuugguaacauucacaguguugggucacauggcacauuuugucugauuuugucucuuugugugugcuuuguuuuucuuuaugguauuauuucaucgaagagagcucacuggggaaaugcuugccaccaaggcugaccucuugaggucaguuuuccccucccaccuaagagugggccaccgcacagcgcaucucuaaccccagcuuggaugggcacgagcaagcggauccccagagcuugcuggcuggacagccuugcugacuaggucugccuaagauuccagugagagaucugucucaaaagagaaggcaggggccagcaagauugcucagugggugaaggcccucaccaccaagccugagcaccugagugcgguccuuagaauccagauguuagagagaggggaccagcuccugcccguugucuucuggccuccacaugcacaccauagcaugucugacucccaauagacagacugaaagacagauuauaguagaaauaaauaagaugaagcaugauagagacaucuagugucaaccucuacccuucauaugcaucuacacacauguacagguacacauaaaacauacacaaaacacaucacagagaaaauuggaaaugauaaauaccaggaugcuugccgcuccgacagaugaauugcuaauguuguuggccaccugugcguuugauuggcuaagucacccacacuuacuuguguuuuagagaacaaucacacuucauuuuauaucaccucgcauucagcucucccuguacugaugacaagguauaggugaugugugaaggacgguggcagggagcuguccuguuagagcucaagcagggcuccucgccccucacaggcagaugcccccacagagccuccacugcagagcucagucacuugaccagcgcuuauggucucugaugugccaguagggcuagaaaggaggaggagaaauagacuuguguucucguagguggcuaaaggaggcacaccauuuaaaggagaggcagcuggugggcuuugagggcaucugagaauaaagaaagcagugugugcuuaauacccucugugugccagagucuccugcaccgucuuccauuugaaagacaacucagacagugauugguggucucucuauuuaccagaugagggaugaaaggcagugaaguggagccuuguugaaagucacauccaaucgagagcugagcugagauuugcggcaaggcuaguccaagggaauucauauuccuuuucaagggcaagcagaaagccacagaugugaagggcaggaaaguuagggacaaacugaaagagcgauguggugcagcuauagaaaugaggagcgaggcgaggaauggcuuggggcccuccaaaggcugcagcucagccauggccccugcugcagugcugggagcgggucacucuaggcccaagccgcaaggagaacucgauuuccuggauaccuucagcuccaccgccagugaaacuaagauccaugcccagcaggcagaucaccuuugaagauagaccuuuucaaagccauuugaaguucacugugcacaucuguaauucuaagagcuaaugcagggggcgggggcuggagguccaguugaagcugguuuuuccagaucuuuuguucacccaugcucaacuugagccucagucucauggaaauaccauaucuuccuuugcaagauuguugugagaauuagcuagauguacauguguaugcguuguuuaagggguuuuuguuguuguugcuguuguuuuauguguguagauguuuugccugcaagugugucuguaccccaugugagugccugguaccuacagaggacauugaauccucuggaaccagaacuagagagaguuguuagccagcaugugaguacugagaaccaagccugggucuuacagaugagcuuaacugacagcugagcgcucucccaucuccuggguuuucuguuugguuguugggcuugggguuuuuuguuuuuuuggguuuuuuugguuuuuggguuuuuuuguuguuguuguuguuuuuuuuuuuuuuuuuuuuuuuuuuuuuuucuuuugagacaguauuucucuguguagcccugacuguccuggucuauaaaccaggcuggccugaaaaucagagaucugcuucccuuagccuccagagugaugggauuaaaggugugugucaccaugccuggcuucuagguuuuauuuuuuaagcuagggucagagguucacaccuacagucuuagcaauugagggguagaggcaagagaagccuccaggggcaagguucagggccagaggaggcuuuggagucauuuccaggucagccugggcuacaguuugaaacuuucucaaaaaaaaaaaaagaaaagaaaagaaaaaaacauuuuuuuagaguaguuuuagugaacuacuaaaauugaaaggaacaaauugauaggaagauagagcuaucccugugcuccacaugcugccccugcuauaagcaguauuaacauuucagagcacuuaaauaaugccuugcagucaguguggcucugcaucuauaugcacauuggucauuauucaaacaggccaagaagugccagcccccacugggauuauuaggaggcucaguauggaaaaaaaggaagggacaaacccuggagauggcuuuaaccaugacauacgguccccauaggcuggcaaaggaggaggugagccggcaggagcuaaggcagcggguccgcauggccgacaacgaagucauggaugccuuccggaagaucauggcugcccggcagaagaagcgcaccccuacaaagaaggaaaaggaccaggccuggaagacccugaaggagcgggaaagcauccugaagcuccuagacggguagccugaccugcugcuggcuaucccccuggccuggcagaaguccacaacauccuuugaagccuuggccagaggcugccuaucaaaugacaacagucucagggcugaaacacucucaggccacccagcugagcuuugugcagccaguaugcaaggcccuacugcgccugccuggaccuagcauccgccugaugccccagaugagcgggcuuguuccucauccccuccccccuuaccgucuccacaccucuccucagggacuucuuccuugagguuuuguaauguacaaacuuaagaauaaagugacugcuguguuucauuuuuuaaacaaaaaaaaguuauaaaaaaaccacccgcaaguuuaguaucuaucuauuauuugugggguaggaagaacaggcagguggaaggguuuaguggggcaugcuuggggucuccgcuguggccacucacccggaacauuuauuuuugagcucuaauuucugagggucuggugguaggaggguggguuccugguuuccuggggcaggauugcauucagagcuacugcacggggccaccaaggaccuguucccucagguguuucuuccaugccagcuaucacugggaugucucuucagcuguggguggcagacagggucugucacugaggaaaaccuaaagccagcuggccauggccuugucccagaugucccugugugucguuucuaagcccaaauuggggcucuccuaugcauugcuagcacaaucucuuggguuaagggaucuuuuacugcagugguugucaaccugugggucaugacccuuuugggacuagaauaacccuuucgcaggagucgcucaucagauauuuauaucgugauucaugacaguagcaaaauuacaguuaugaauguacaaacuuaagaauaaagugacugcuguguuucauuuuuuaaacaaaaaaaguuauaaaaaaaccauccgca

SEQ ID NO: 3289 - RNA, 4317 nt, Mus musculus
cugaccuggccaccguucucuugagcagagagcacaguccuugguaaacaucugcuuucucauuucugguaaaccagaccaggagguagaacuuuuauuaaguccagagagaagucaccugcccagugccacacagcaaucacguggccucucugggauuugaucuuaguuugucagaccaaggagcccaggggccuuggcugugcucagcaccaacuccacucgccuuauucuuccuauuuuccaucuggggucaggcacagucuacuguugagagagccgaaggcacugcaggguccgagagaaguaagggggcaggggugccagaaguucacuaggggggucccuggauccggugccugggaggaggaggcggugaaggugcaggugcaaaggcaucugggccacuugggaaggacuuaggcggaggugucugagcagggcuucauccaggaccugggaugggaaagacgguggccaucuaaguucuagccagagggagcauuccgcucucauggacacggagggagaccggcaggaccucccugaucuguaacugcaguaauguuuuuuuuucuacagacaggcagaguuuucuucagcuucuuuuguguuuagugaagccaugugauuaagccucuggccaaugggaugugagaagugguacacagaccugguccucaaagccccaacucauacaaaccuccagucuccccuucuggccagaaagcaauagucuuagucccaaguggcugccuagagccaggcccacuucugcugcacucccauucacuggacucaacacgaggaagaaaugaugcacaaacgcucgaaaggaugguggaacgugaggaccuguaaugucagcuuccaccaccuccagcucauggacaagaggccugagccaugcagcaaccgcagggacacagguggcccuagacaccaagccagcugccuccuagucuaaaugugcaugauaucugggagacacaguuccccccaaacccacagagagcaggcauaugggacaggggaccuaccugucucuggggcuugguggucucggcuggccacagaaagcgcuggcccagaacggugcccacacgagcagcauaagugugguccccaagaauuggacagagcuguagagccauguguaccugcagcugauuggggaagacugaaaaggugggugggugggggggagguugggaggcaguugcuuguccuggcugugcaguacugcccccaucccuagaaguaagaugaaaugaccucggccuccagagaggaucaugagaagguaagagcaauggcagcuggcaaccugcccagccugaggguucaacccuacgcaacugaagcaauaaggaugugugcugagugccagauugugggugugcaccuaaaacugcugccucccgcugagcccauucacauaccccugggguccaccacaugcucccugacuguugucaagcacugucuuccucacgggucucauaacccgcagcagacccaccugucaguggcugcagcuggaccagggcacagccacggccuguggccaucacauggaaacggcugaggguccuuuugacaccuuccuggauguccuuucgagauggggacaucacugggacugccuaggguaccagucaagaaugacuuaacacaucccuaggacuuuguugagcaccaccccccacccccugcugccaguugccaguugauguaggacagggccuccacaauggcagcagccauuugccuguuaggagacagcaaaacuagccaccccaggugcacagccuggacuccucuguaaggcaaaaaccgaagggacaccacuucccugguggucucugacuuacaagaucaacgucauucauuuguuccaucuucagaggcaugcagacuguccccucugaaggcucagggaugccaucagugacagcacuaagaaagggaaaggaggucucagagcagccuggugggaccuucccucaguccugggagugacccugcaccucucaccaguagguggcugugggucucugugcucuccuugaguggauaaagaacuucugcaggcggcuugcugucuggggacagcuggagaggagcacaaguccggaggccucccuggaagaaggggacaaaucacauaaagccucuuggucuugaaaacgagcucuagauggcugcucuugcagaggaccagcauugagcacccgcaugguggcucacaacuaucugcgauuccaauucgagaucagaugccgccuucuggccucugagggcaccagauacacacuguggugcauagacauacaugcaggcuaaacacacuauacacaauaaggauaacccccauccccaacuaaaggcuggacagaaacaccaggacuagaauccagaccugagaaacaagucauaaggccuuuucucucucccucaagagagagagccgaaugcgcuaagaguuaacaccaauguccagggccuaccauguaucaggcauuugaauaagacuuuuacuuacaguggguguaacauacaccccacacuaucacuuacuucccaggugcucgcacaaccuggagcuccugguguucgagccccagggccuggcucagcugcggcagcacagauagcagcgucagcucuccuggucucccugggagggaagaggacaagcugccagcgugccauccaaccaucucuaccccagccuugcccuccucccugcccaugcccauaccugucacaggcagacccuguggcuuguucagugucaccagagguccugaaacaguucauggaugucagcaaaagcagggaagcaugucugcaugcagccucgggggugggguuggggguggggguuauacaauccaaccccacuuuaaauagcacuuccuaaucccuguaccucggagccuucauaccugcaguuccaggcuuccauucccauuggcuccaacauaccucaguauaaugugugccccuccuacaguccuugacuguugcggguggaggggggcucaaacaccaagucagccucaaauucacuacacagcuaagucugguccugaacuccugauucuccuugccucuaccucccaaguucuggaauuacaagugugguuaccacgccagcagcgauugcucaguaauucucacauuaggacgcuggaucucgcaaggcaggggccauauuuaucccagaacugugaagccccucacugcuacaugaacauacagucgugaagcaacaugugggugcugacugcugguccucucugcaagagcagccaucuagcccucuuaugaaaccaagaggcaugccgcuuacagaggccagcuauaacuaaccccaaagcuuuuucugauaguuaacuucuguuacagcugcucucagaacacagggaggagugagguauacaccucuccucgugauggugaggcuaggaagaaugugacugcuggccuggcuccugcagcaacaggggaggcacaggagcagcaggcuccccucaccuuucugauccaccacagcugcccucaggacaugagccagcuccuccaggccgagguucuccguccucagcagccccgggaagggcugguccucgacuagguccuugugcuugcuggagcggugagguugagacggacgccugagaaacaugguagaagccuguaccucccucccuugcucacccugccuaguccagccucuucuuagaacucccgggcucagcagacaggaguccaccuaccccccaagacuuuaccaaagaggcaccaaggcucaaagguccaaugaccuagugccgggucucacaacauaguccggcuuagaaccaaguacugaucugaauuucaugccugcccucuccuugaucuagucucuccccauacacggaaguggaguguuauaaucaccgggccucggugccgaagccggcaucccucugccgugcgcaagaccccagcuccggccgccagaucauagagacauaacgcaaaacucucagggcucccauugccggggaccaagcacaguacgcaugcguguccacggacagcucaaccccaccucccguacauccuccgugcguagauuggucaggcaggcugucaaucaaggcagagggcgcucagacgagcgagaauccgggcuuugccuccccuguagaagaaaaagugccauuuaggguucuggcuuuugggaaaacugaggcacgaggcggguuauuuacucaaaguagaggacgugucuuagaauaaaaagggucgagaagacugucg

SEQ ID NO: 3290 - RNA, 4317 nt, Mus musculus
cgacagucuucucgacccuuuuuauucuaagacacguccucuacuuugaguaaauaacccgccucgugccucaguuuucccaaaagccagaacccuaaauggcacuuuuucuucuacaggggaggcaaagcccggauucucgcucgucugagcgcccucugccuugauugacagccugccugaccaaucuacgcacggaggauguacgggaggugggguugagcuguccguggacacgcaugcguacugugcuugguccccggcaaugggagcccugagaguuuugcguuaugucucuaugaucuggcggccggagcuggggucuugcgcacggcagagggaugccggcuucggcaccgaggcccggugauuauaacacuccacuuccguguauggggagagacuagaucaaggagagggcaggcaugaaauucagaucaguacuugguucuaagccggacuauguugugagacccggcacuaggucauuggaccuuugagccuuggugccucuuugguaaagucuugggggguagguggacuccugucugcugagcccgggaguucuaagaagaggcuggacuaggcagggugagcaagggagggagguacaggcuucuaccauguuucucaggcguccgucucaaccucaccgcuccagcaagcacaaggaccuagucgaggaccagcccuucccggggcugcugaggacggagaaccucggccuggaggagcuggcucauguccugagggcagcugugguggaucagaaaggugaggggagccugcugcuccugugccuccccuguugcugcaggagccaggccagcagucacauucuuccuagccucaccaucacgaggagagguguauaccucacuccucccuguguucugagagcagcuguaacagaaguuaacuaucagaaaaagcuuugggguuaguuauagcuggccucuguaagcggcaugccucuugguuucauaagagggcuagauggcugcucuugcagagaggaccagcagucagcacccacauguugcuucacgacuguauguucauguagcagugaggggcuucacaguucugggauaaauauggccccugccuugcgagauccagcguccuaaugugagaauuacugagcaaucgcugcuggcgugguaaccacacuuguaauuccagaacuugggagguagaggcaaggagaaucaggaguucaggaccagacuuagcuguguagugaauuugaggcugacuugguguuugagccccccuccacccgcaacagucaaggacuguaggaggggcacacauuauacugagguauguuggagccaaugggaauggaagccuggaacugcagguaugaaggcuccgagguacagggauuaggaagugcuauuuaaagugggguuggauuguauaacccccacccccaaccccacccccgaggcugcaugcagacaugcuucccugcuuuugcugacauccaugaacuguuucaggaccucuggugacacugaacaagccacagggucugccugugacagguaugggcaugggcagggaggagggcaaggcugggguagagaugguuggauggcacgcuggcagcuuguccucuucccucccagggagaccaggagagcugacgcugcuaucugugcugccgcagcugagccaggcccuggggcucgaacaccaggagcuccagguugugcgagcaccugggaaguaagugauagugugggguguauguuacacccacuguaaguaaaagucuuauucaaaugccugauacaugguaggcccuggacauugguguuaacucuuagcgcauucggcucucucucuugagggagagagaaaaggccuuaugacuuguuucucaggucuggauucuaguccugguguuucuguccagccuuuaguuggggauggggguuauccuuauuguguauaguguguuuagccugcauguaugucuaugcaccacaguguguaucuggugcccucagaggccagaaggcggcaucugaucucgaauuggaaucgcagauaguugugagccaccaugcgggugcucaaugcugguccucugcaagagcagccaucuagagcucguuuucaagaccaagaggcuuuaugugauuuguccccuucuuccagggaggccuccggacuugugcuccucuccagcuguccccagacagcaagccgccugcagaaguucuuuauccacucaaggagagcacagagacccacagccaccuacuggugagaggugcagggucacucccaggacugagggaaggucccaccaggcugcucugagaccuccuuucccuuucuuagugcugucacugauggcaucccugagccuucagaggggacagucugcaugccucugaagauggaacaaaugaaugacguugaucuuguaagucagagaccaccagggaaguggugucccuucgguuuuugccuuacagaggaguccaggcugugcaccugggguggcuaguuuugcugucuccuaacaggcaaauggcugcugccauuguggaggcccuguccuacaucaacuggcaacuggcagcagggggugggggguggugcucaacaaaguccuagggauguguuaagucauucuugacugguacccuaggcagucccagugauguccccaucucgaaaggacauccaggaaggugucaaaaggacccucagccguuuccaugugauggccacaggccguggcugugcccugguccagcugcagccacugacaggugggucugcugcggguuaugagacccgugaggaagacagugcuugacaacagucagggagcaugugguggaccccagggguaugugaaugggcucagcgggaggcagcaguuuuaggugcacacccacaaucuggcacucagcacacauccuuauugcuucaguugcguaggguugaacccucaggcugggcagguugccagcugccauugcucuuaccuucucaugauccucucuggaggccgaggucauuucaucuuacuucuagggaugggggcaguacugcacagccaggacaagcaacugccucccaaccucccccccacccacccaccuuuucagucuuccccaaucagcugcagguacacauggcucuacagcucuguccaauucuuggggaccacacuuaugcugcucgugugggcaccguucugggccagcgcuuucuguggccagccgagaccaccaagccccagagacagguagguccccugucccauaugccugcucucuguggguuuggggggaacugugucucccagauaucaugcacauuuagacuaggaggcagcuggcuuggugucuagggccaccugugucccugcgguugcugcauggcucaggccucuuguccaugagcuggaggugguggaagcugacauuacagguccucacguuccaccauccuuucgagcguuugugcaucauuucuuccucguguugaguccagugaaugggagugcagcagaagugggccuggcucuaggcagccacuugggacuaagacuauugcuuucuggccagaaggggagacuggagguuuguaugaguuggggcuuugaggaccaggucuguguaccacuucucacaucccauuggccagaggcuuaaucacauggcuucacuaaacacaaaagaagcugaagaaaacucugccugucuguagaaaaaaaaacauuacugcaguuacagaucagggagguccugccggucucccuccguguccaugagagcggaaugcucccucuggcuagaacuuagauggccaccgucuuucccaucccagguccuggaugaagcccugcucagacaccuccgccuaaguccuucccaaguggcccagaugccuuugcaccugcaccuucaccgccuccuccucccaggcaccggauccagggaccccccuagugaacuucuggcaccccugcccccuuacuucucucggacccugcagugccuucggcucucucaacaguagacugugccugaccccagauggaaaauaggaagaauaaggcgaguggaguuggugcugagcacagccaaggccccugggcuccuuggucugacaaacuaagaucaaaucccagagaggccacgugauugcuguguggcacugggcaggugacuucucucuggacuuaauaaaaguucuaccuccuggucugguuuaccagaaaugagaaagcagauguuuaccaaggacugugcucucugcucaagagaacgguggccaggucag

SEQ ID NO: 3291 - RNA, 3397 nt, Mus musculus
gagguugggaggcaguugcuuguccuggcugugcaguacugcccccaucccuagaaguaagaugaaaugaccucggccuccagagaggaucaugagaagguaagagcaauggcagcuggcaaccugcccagccugaggguucaacccuacgcaacugaagcaauaaggaugugugcugagugccagauugugggugugcaccuaaaacugcugccucccgcugagcccauucacauaccccugggguccaccacaugcucccugacuguugucaagcacugucuuccucacgggucucauaacccgcagcagacccaccugucaguggcugcagcuggaccagggcacagccacggccuguggccaucacauggaaacggcugaggguccuuuugacaccuuccuggauguccuuucgagauggggacaucacugggacugccuaggguaccagucaagaaugacuuaacacaucccuaggacuuuguugagcaccaccccccacccccugcugccaguugccaguugauguaggacagggccuccacaauggcagcagccauuugccuguuaggagacagcaaaacuagccaccccaggugcacagccuggacuccucuguaaggcaaaaaccgaagggacaccacuucccugguggucucugacuuacaagaucaacgucauucauuuguuccaucuucagaggcaugcagacuguccccucugaaggcucagggaugccaucagugacagcacuaagaaagggaaaggaggucucagagcagccuggugggaccuucccucaguccugggagugacccugcaccucucaccaguagguggcugugggucucugugcucuccuugaguggauaaagaacuucugcaggcggcuugcugucuggggacagcuggagaggagcacaaguccggaggccucccuggaagaaggggacaaaucacauaaagccucuuggucuugaaaacgagcucuagauggcugcucuugcagaggaccagcauugagcacccgcaugguggcucacaacuaucugcgauuccaauucgagaucagaugccgccuucuggccucugagggcaccagauacacacuguggugcauagacauacaugcaggcuaaacacacuauacacaauaaggauaacccccauccccaacuaaaggcuggacagaaacaccaggacuagaauccagaccugagaaacaagucauaaggccuuuucucucucccucaagagagagagccgaaugcgcuaagaguuaacaccaauguccagggccuaccauguaucaggcauuugaauaagacuuuuacuuacaguggguguaacauacaccccacacuaucacuuacuucccaggugcucgcacaaccuggagcuccugguguucgagccccagggccuggcucagcugcggcagcacagauagcagcgucagcucuccuggucucccugggagggaagaggacaagcugccagcgugccauccaaccaucucuaccccagccuugcccuccucccugcccaugcccauaccugucacaggcagacccuguggcuuguucagugucaccagagguccugaaacaguucauggaugucagcaaaagcagggaagcaugucugcaugcagccucgggggugggguuggggguggggguuauacaauccaaccccacuuuaaauagcacuuccuaaucccuguaccucggagccuucauaccugcaguuccaggcuuccauucccauuggcuccaacauaccucaguauaaugugugccccuccuacaguccuugacuguugcggguggaggggggcucaaacaccaagucagccucaaauucacuacacagcuaagucugguccugaacuccugauucuccuugccucuaccucccaaguucuggaauuacaagugugguuaccacgccagcagcgauugcucaguaauucucacauuaggacgcuggaucucgcaaggcaggggccauauuuaucccagaacugugaagccccucacugcuacaugaacauacagucgugaagcaacaugugggugcugacugcugguccucucugcaagagcagccaucuagcccucuuaugaaaccaagaggcaugccgcuuacagaggccagcuauaacuaaccccaaagcuuuuucugauaguuaacuucuguuacagcugcucucagaacacagggaggagugagguauacaccucuccucgugauggugaggcuaggaagaaugugacugcuggccuggcuccugcagcaacaggggaggcacaggagcagcaggcuccccucaccuuucugauccaccacagcugcccucaggacaugagccagcuccuccaggccgagguucuccguccucagcagccccgggaagggcugguccucgacuagguccuugugcuugcuggagcggugagguugagacggacgccugagaaacaugguagaagccuguaccucccucccuugcucacccugccuaguccagccucuucuuagaacucccgggcucagcagacaggaguccaccuaccccccaagacuuuaccaaagaggcaccaaggcucaaagguccaaugaccuagugccgggucucacaacauaguccggcuuagaaccaaguacugaucugaauuucaugccugcccucuccuugaucuagucucuccccauacacggaaguggaguguuauaaucaccgggccucggugccgaagccggcaucccucugccgugcgcaagaccccagcuccggccgccagaucauagagacauaacgcaaaacucucagggcucccauugccggggaccaagcacaguacgcaugcguguccacggacagcucaaccccaccucccguacauccuccgugcguagauuggucaggcaggcugucaaucaaggcagagggcgcucagacgagcgagaauccgggcuuugccuccccuguagaagaaaaagugccauuuaggguucuggcuuuugggaaaacugaggcacgaggcggguuauuuacucaaaguagaggacgugucuuagaauaaaaagggucgagaagacugucguuucaauuuuggggaaccuuaaucugaaacccucccuuguaaaaccgagggagaagaaaggugaagaccgguaugcagccuuucggucaguacaccugucugaaauuguaacagccugugacauaaaaggucccaaagcuguggcucaggugguagagaggcuacacaagguccuggguucaauucccagcaccguguauguaggucacaaagaacaagaucacagauacuggguuggagaccagccugggagaugcgcaaggccccucuaugaaaagaaaauc

SEQ ID NO: 3292 - RNA, 5715 nt, Mus musculus
cagaaaggccaagaacgcaugcgcgaagaaggaaccacagagucaguccucccaggauagagaggccggaaguucucccggagcuccacgccguguagugaaagccgggccgagguagcagggaagggguucgcagggugcuuggcugggugugugagcagagggucggcguuaggggccuuaguucuguacaauggcgucucgggcaggcccgcgagcggccggcaccgacggcagcgacuuucagcaccgggagcgcgucgccaugcacuaccagaugagguacgaggugagccaggcguaccgaggccuuucccggcggagccugcagauccugggaagaagcgacgccagugguccucacgcugucgccccccagccaguugucguguacccgccagguccccugcucuaacgaccucugcucuguuuccaggccggggaaaccccguggcccaccuugguccgacuuauucuuugaggggauccagccugcacaggcucgugguucggugcuggcccccugggugaccuugggaacgccacugccacuuuucuuuuucaagucuagaucccacgguagcguccaggcugaucucgaacucacagccuucucuuuagucuccugagugcuucuggcuuuucagggaugcacuuggccugagaacuccuuaacauuuuuaaagauuuuuauuuuuaauuucguguguguguguguguguguguguauuugugcacgugagagcaacugcucgcagaauccaguagagggcguuggagcuggaguuacacauggcauuuggagucuacccgagguuggugcugagagccaagcccagaaagguggcaagccaugucucuaaccacacgucagaagugauuuuggaagcuagaguugugguucaugaacccaaaccgccuccacugcagcgagccuacucuccagcuccaacucggguuauuuccaauuggagucucaguuuucacauuuuuagagggagaaaauuucaugauuuuuagguuuuggugaggaauuagcaagucguuuguguaaaggcacagcauaggagugugguggcugcuaaacuuggggcugucuggaugugggugguaaaaggugacccuguccauccugagguuuaggaauacguccauauaaggagaucuuucuacguuccuuuauuuguuugauaaacucuuacaggcuaucuauccauccugucuguauuguguucugcacugagucuuucuuucccucaccugccucuguccuuccuuuagugguuuuucgagaugggguuucuccuuguaauuccaggcuuucuuggaacucacuuuguagaccaggcuggcaucaaacucagagacccaccuaccucugccugauaagauuaaaggcgugugacaccaccuguagacccuaucuuuauggaagaugucacaugaaguuuacaaagaguuucaaugcagucaagucuuuuuuuuuuuuuucuucaauuauaaaguccuuuuuauuagucaaaaucacaaucaccuugauuaaaagggcagaauauuccacccucagcagaaaaacaacacagugauagaaaaccuccccaaacccucccacaccccaauuaaaaacuagaaaaaaugucugcccucugggccugcgaugccaugguagucugacuccuucagggcacugccauggagugggcaggcccccacagcacccuccauuucaccuuggggaaaggaggggugcugacggccauggacguuaggauagagauccagugggaccaguccccaagcaugcacuuccuuccuuucccccagggccugggaccaaagggugcagucaagccuuaagcuuauugugcacaugggauugaauuagcuaucuguugacggccaacucugacaguuguguucagugauccaagguggggaugugggguuggcagugauguaauacaggcacacacacucacacacuugguagaugaugcaaucuccaacaagcuccaacaacuucacauguaugcauacacacacauacauuugguagacgaagcaaagcucgaacagcccuuucaccuacagcuuauguaucccagccaaaucuuugaaucacgaugugguuacauucuauuuuuccuuaagugaaugauuacaaugaaguuucccaauacccuugcacgaucaaguguuuuacauauuaugggugaaaaaaaaauuauucccaagaacccacaugcauucguaacuaagcaaccuguuauagauuaaccaagugugagcaagcaguugucucagccaguuucucuuccuggcaggcugcaguuuguaauuacaaagaaagagucaauuauuauuuaucuuaaaaaaauaaucuuauaaaaaucuuaaaagaaucauaaaucuacaguuuuauauaagaaacaaucagucauuucuacuuuaaauccucagggugcagaucuauucauuaacaaauuuucuuccacaaaaaaaaaauuuuuuuuucuuauuaaauccuaucaggaagcugagggcaaaaauggguacaagaaauuaaucaucuugaucaccaacccagcguuagcaagagaggcaggucagcuagagcuggcuggguugucauuguucuuguucucugaccuuaaaaaacaacccucgcucaauauuuaaaaguguaccuuucuaaguuguaacccaagauuuucuagaucaaagccacuaacuaaaacaucuuaaccuaacuuuacuaacaaccuacaucuccacauucuuucuaagggugguggacgucacucacagucuccaucucuaaguccuuucugagagugauggauggaucauuaauuugcuccagcagcaaauuaaagugccugcuugaaaaagaucaaucgcuauuuguguccugcuaaggacacugccucgugagggccuggaaacccccuuagaguuuucauacaacccauagauuaggggugacgugaugacugaggacucgcagagagaugcugcguaacagcaugaaguccccagggcacaccuuccucagcccuccgccucucgcaggcacacgcauccugguugugcugaccagugggccauauucuauuaguucuaaagccauuuguuguucaucuuuacacaggccucgauagucaucgccaggaaaauuuccaccaaaccaugcugugccuaaauaugccuaaaaagacuccuuggggucagacuccugaaguuugagauaucaccagauacagaguuguuaucucaugaagauuauuaacucuacuugggcggggguggugggggguggggggugguggcgaagagaccccccucccccccuugcaauggcucagcuguaagaguacuugcuguucugucagaggaccuaaauucaguuccuagcacucccaucagaaggcucacaaccaucuguaacuccagguccagggcuuuugaugccuccuucuggccucccacagcagaggcguggauguggugcacacauacacauaagauacauuuuuuaaaagaaaaagccaagccgggcaugguggcgcucgcauuuaaucccagcacuugggaggcaaaggcgggcgaauuucugaguuugaggccagccuggucuacagagugaguuccaggacagucagggcuacacagagaaacccugucucaggaaaaaaaaaaauaauaagaaagaaagaaaaggaaggaaggaaggaaaggaaggaaggaaggaaggaaggaaggaaggaaggaaggaaggaaggaaggaaggaagagugagucaaacuggauccugccuugaaggagcuugagugccagagugauuucuuuucuccuugccucccacguuuccuaaggugaauuacugccuccuuaaguccacugaguuuuucagcuggugcuuuaccucugugcaagaggaugacaagcucucuggacccuuggccccuuccuacuggagaccuuguaacccaaggucuugucuugcacaccuagaggugaaaccuugcucuugagauugaaaaggauacgcuugagaccuagggaauuuagauuaagagagacaugcuuccuucacgugacagcuguagcuggagaaauaggagcuguguuccuuguugcuacaaggccuccuggccuuuguuucugugaugcagagcuaucauuuaaaccacagcccagaauucuugucauggcuuugugagauggugucuugcuaugugguccaggccaaccuccaauuuggaaucuucugucucagccuaccaggggccgcugcugcucuucagucugaaguguccucgccuugucuuugcaguuaucugucacugccucuccugugucuugccacuugauuucuugaaacacagauacauaaaccccuguguuuugugccugcauguuuuugccucugcauagaaugcucucuccacucgucuagaacccaggccgaaaugcuuucuccuguacacagacagccuucccucccuggccuccaccuuaugcuacagugauuacucccaggauagcuuaggcucuguguguuuaccugagcuuuacacuucauuuucuaauuacuuucuucucuaucccuuggacccagccucuguuugaggcuguaucacucacacuguauccauguguccuguacacaugccuggaauacgguugguggucagagcacuuggaaugaaaguugcuucucccuuugcucugucuuacagugugacccucaaguacgaaaucaagaagcugaucuacgugcaucucgucauauggcugcuguugguggccaagaugagcgugggacaccugaggcucuugucacaugaucagguggccaugcccuaucagugggaauauccguauuuguugagcauugugcccucugucuugggccugcucuccuucccucggaacaacauuagcuaccuggugcucuccaugaucagcauggggcucuucuccaucgcuccccucauuuauggcagcauggagauguucccugcggcacagcaacucuaccgccauggcaaggccuaucgcuuccuguuugguuuuucugcugucucugucauguaccugguguugguacuggcaguccaaguucaugccuggcaacuguacuacagcaaaaaacucuuagacucuugguucaccagcacacaggagaagaaacggaaaugaagccugcuugauaaacugcucugagggguaaaaccuaggucucccauugagcagcgugaagggagcuguccagacucuccaucgauuguggcaucugugauguuggcaccuagugcacacuaggcucagauuuuggccuagaguucuguuaccaucugcugagguggcaaagcuguuguauuuaauuuaugcuugacuagcugcagcugggugaccaauggcugugacacacuuuaccugguugaacuugaggcccuuuagaguuuggguuuuccagacugagccuuauccuugccuucucuuggccguacucccuccuuccauucgucaccucuucaccaccaguacuagaagaaauauggaauaaaucaguacaugaaagcagacuucagucugugggucaugggcaagcaacauuugggaaguugcuccccuaugggcuguucuguuuacugcaaaccauuuuaaauaaaaagaaccucaauaaauaaaguuaagacuguccugugc

SEQ ID NO: 3293 - RNA, 3711 nt, Mus musculus
aacagauacacgagugcuacuugguuaggaauacuguaucggcuuuuauucuaguguagugcagggucccaggucccauuccucgcagcagccuggggcuuccgagcuagaaguacagcuguccagggcggaccgcagcgccugggucacucguuccacccgguccgcgggucgccccgcggaaguggagcagccucccugcagugcauccaggaaagccggcagcugcgagggcagggagaagagcggggcgacgcggaacggggagggcacagagucugggugcagcagcccgucgaaguagaccccgacguagcggccggucgcccggccuugcaggaaaucggguagcacgcagcugagccaggcggcgagggcgucaugcggcccgggcuccacugucuggagcugcagccacugcugacacugcgccacggccgcgggcgagaagagaaggauuaccacgccacccuccugcaggauacggcgucgcuggugguggaaccaggcuagggcuccgugcgcgcucagcucgcggcggcuccacagguccacggccacgcgcaguggcaucuggcucaacgcggacgccagugcucccaccagacgcucguagcccgcuccgucggcggaguggaggagcaaggccgugcgggagccacgggccgcuacagggauaguggagccugugagggugagcccggaccugccuucccuccacccaauugagccccagcgccacuguuugagacuguccuugggaaaccaggacaggaaagcacucaccuuuccugcgguccuuuuuuagaaggaggaagaagaaaagcgccgcagccaagaguaggcaggccagccauacuaggacccagcgccuguggaugucuggaauagacaggggaaaauaaugggcuaguaagaaaccuuuaucuuuuacuccaccuuaucggaggagaaaaaaaaugagucuauauacaugaagugaucugccccaaagucgcauuugucagagcccacgcacugaaaaagcuccaugugucucugugaccugccuccguuuccaugccuguaaauauggacaacagcaucaagugcauucagauugcagcugauauugccccugaagccuaggguuacaggcccuuaauuuugcugucuugcaugauugcaauagccccuaucuuuccgcuuacaguccauucacucuauggggaaccaccaagaucuguuuaaaauagguuuauucuagcccuugagggagcugguguugcuggggacauaaaauccuacacccuauugggccucccaucuucuucccaagacccucuaaccacacugacagcuuuggaaacucucaaaaauguacuucacagucuuaaaacugcagcuugacuccucucaacuagcagaggcuucccggugugucuaggaccuuuccccugaacccuucauccaccuaaaccagguccuggcugcgcucauucacugcacugaacccauaacuauuacuguaagaucgcaaacagucaacagcucauacuggcccuguccuuuuagauuucuguugcugugggcaggcuaugucuuuuuagugauucugggaucccuaaaaguguguuuuuaucccugucccuccuccaaccccacccuugaggggcacacaugccauagagcuugugugaaggucagaggacaacucaagagaguccauucauguuggucucagggaacucagguuuuuuuucagauuugguggcaaaugucuuuaccagcugagccaucuuucucccucucugugguuuuugacugguugaaaggaaugcugcugugacuuauuugagccuggcgaagcaucacauguugccucagcacugaggucccugucagagucagcugcuggcacacaagaagaacaguuccccucguacucacacuuguccauggggcaggcccauagcgaucccauguugucaucguuccacagcuguaagacacaaccacagucccuggcuugguguucaacggcgaaucauuucuggccagcuuauucacauuccuagccucagcgaugcauacuuccuugcccagggcaggccccaguggauaccucugcuuuugcucaaacugugcccaagcugaccucugugccaaauggggccuugccagauucuuccucaaagcucuuucuagaaccuagcacugacuggggguguguaucauuuaacugggcucuagucagagugagcaccugugggacaggcaugauaucgccuacccuuuaccuaccuaggcuagucagagagcaagcagacacacgcaggcaccagggcaaguucugucaccaacucaccugcauacacuggugugaucggaagucuugcagcaacuccucucccaggcgagcagcucucugccaaggcaaaggagugggaggggcugucacccggggcagcauguaaggugcugcaguagagcagggcuguuugucaagaggagcuaagagacuuacaaagccacugagaaggaaugugugugcguacacacaagcaagggcacgcgaauacgucgcccccccaaccccccccccccccgcacuguauucccagaagcaguacuggcccuggcagagaaugauagaguaaaguaaggugggauacagugacugagaagagaaguaagaauaugaggccgugcaugagaugcgucuggaagcaucuagcgacgguuccuucguccucaccguggaggccaugcugggcagugguguacagccacuggguuccaaggcacagacugauguguuguugaggccgguuuucaucuccacuaacagcauaucauccuugaagggccccaaggagucugggaggagggagaggccacucuaguaagacccacuugggcuuugccuuccucccaucccccgaccuuuaccccccgggaggcagcuccuccaaggugccccccauggcaguggcccugccccacucaccagcccacaagcacgcuugcagcugaaccuucucccaggugcucaccugcuuagaaggagccagaguuaggagcgcuaggaaaagcaagagccagggucaggaaguccaagagggagggugcaggcaagaggaagaccaucaggccggcucugcacucuggaccugagguucggcagagcugaguucaggcugcaggauuaggagucacccauuucucagaccaggcuuugggagggaggacgccugugcugacugaauuuacaaccuuaagcucugucugcacuuaaaacaucuccacaucugacaccucaaacaggagacucucucccucaccuagucacccacugaggaucacagccuccguuccuucgccucuucccauagcaugugauugcacguuaacaugcguccuuaaagcacacuguucgcuuuccuugaugagaaauagguucugugaggacagggacauuugccagcuuugcucauggacagcucaaucucaaagcgaccggcacauagucgauacucaauauuugucucgaaacaguaucgugcuguagccuaggcuggccugguacucacugacuagcucagaccagguggccucaaacccaggggagcccacauauccuccugccucagucucccaagugcugggaauguaggcaugagccucugugcccaguuaaaucuugaaugaaugcuuuuguuuuugaauuua

SEQ ID NO: 3294 - RNA, 10049 nt, Mus musculus
aaggccccgcccuccggacugcggcguugaagaaggguguacuuuuuacggaggcgguggcuuugaggcgacucggcccacagcgcccggggcggaggcggggacuuuuuuuuuuuuuuuuucccuccuccucuaaggucuagcaggguuuggauccucccaguccuguuucaggcugugccuccaucucccaaagaggcucugaacuugaccccuucucuucauauccggauccgggcuccuccuccaggaccgcccauccgccuuucucucggaauauuuugggauccaacccucucucuaauuuuggccccuaauaacucacugagacccuaaaacaaugggcugacgcuuauucuuuugcccgcgaucccggccaccucccccuacgguaacggagaaauaauuucucugcuggaaucguagauuaggcucuuucaccccuuccagcgccucugcuuccacuaccccaguuuauccucguuuuguaauuacguaggucuggggcucugagccccaaggcgccucgcuuuccucccuuacagccuggcuucuccagugaacccucccccugcccucuaucugcacguccccagccugggaaaagauggcuccacugcccccaaggggccuggucccaucucugcucuggugcuugagccuguuucugagccucccaggaccugucuggcuccaacccucuccuccuccccauccuucuccccgagcugagccccauccgugucauaccugccgggcacugguggacaacuucaacaaggugggugcacuaauagccacgagggaggggcccauuauuggagagcagggagcucucucugcaaaucugcauggugucuagucccaguguggguugcuggcuuuaacuguauggcauuuggguaaggugugucacagugccucaguuuucuggucaauaacauaaaauaaugaaauguuagaauguuaggccgggagugccggcacauuccuuuagucccagcacuggggaggcagaggcagguggaucucugaguuccagggcauccuggucuacagaccaaguuccaggacagccaggacuaugcagagaaaccuuguuucagaaacaacaacaaaacaaaaaacaaacuaauaaaaaauccaaaugaaugugucuagcucuguacuuagauauuccuaauuucuuccauaugcagggccuggagagaaccauccgggacaacuucggggguggaaacacggccugggaggaagagaaguuguccaaauacaaagacagguaagaaggugggggcaggguaucuaccccaacucuggguuucuguugaugauguuggauagauucucugcggaagcauuucgcuccccagauccugaacauuuacaguacagcagauaaggaaaccaagccccaucuucgagaaacuugcuuuuuuaguagaguagacacaaacaguacacacaaccugucaggugaagaacaagaauguggguagaccacaggugggugggauguguucaggaugguccguuugaacaguaggggggccgaccuucuguuucucccaaagguggcuggagcagagugagcagaagguucuagagaggaguuuagauguccugaaugggaggccagaaaggacacuggauuuccuggaacuggaguuagaggaauugggagccacuaugucuguggugggaacugaauaauugcugagccaucucuccaggucuuaagugaagagaucacucacacucacaaaguacaagaagccaggggagcauggagggaguggggagagcagcuagggaguggggagaggggcuucuuuagucuagguauaaaggcagcauggacuagcaagacauucaguggugcauacagagcuaguugaaaucugagcauccuuuggagaucaucaguugacaugauagauuccuuauggagcacgagagagaguacuauugacugggugaggugugcagguguuuucuuuuuuuuuuuuuucuuauuuugguuuuucgagacaggguuucucuguguagcccuggcuguccuggaacucacuauguagaccaggcuggccucgaacucagaaauccgccugccucugccucccaagugcugggauuacaggcgugugcccccacugcucagcugcagguguuuucuaacugcagagaggccaugagcagggguggggucaggccaggucucugaacaugguggggugagaugugcccuggacacccagauagcuuccaucuuauuccaaagcucgagggacagguaggccuagagacagggacugaagaggcccucuagauugucaaggugacacaaaaggaggggucgugaagagucccaguuuaggccgcugguggggucuugcuguuuucacgaaugcuaggguugcucuucucuccacgcuacagcucccucaccugauccuugguacugugguuggaugaugguucccacuagggagaaaaauuuauuuuucugcaacucuggcccuuucuuucccucaauuuccucacuuaggaaggcaguaguaccaagaguacuucugcuguauaauggcuuccggguucuucugucuuuuccuuuaaaaguuuuauucuauuacguauuuuuuuccacuuuugauacuaggucuuacuguaugucauggcuggccuugaacucacagagguccgccucucuuugccuccacagugcugggacuacaagugugugccaccacacuuagcuucuuccuaauguuuuguccuuuguuuccucugugugugugugauuguggacacaugugcacaccucucaggagucacuucuuccuccuccugcuugaauccuggggaucgaacucagguucucaggcucagucuuggugugaaugccuggaucucuugagccaucuuaguaaucccccauuucuuuccuuucuccucuuucuugguuuauuuugcuaaauuggcuccucuaguauuccacugugucagaccauuuuaaauacgugauauguuacaacauguuuguuuuuaauauuuuuaauucuuucauuuuuugagauuguaguauaauuaaacuaauuuuuauguuauauauuuguguguguauacaugugugugugugugcagguacacguguauauauaugcucacaagucuuuucccauuuauuuauuuucaagacaggguuucucuguguaucccuggcuguccuggaacuuacucuguagaccaggcuggccucgaacucagagauccaccugccucugccucccaagugcugggaucaaaggugugcgccaccacgcccagcaaaauucugguuuugagauaugaucuccuacgaacugaccuugaacuccuaaucuucuugccaauacuucccaagugaugagaccacaggugugagcaacuacaucuuguuuauauauuaauuucuuaaauuguaaaauacacauaaaagaauguaacaggcugggaauguagcugaguugcuagaggguuucccucacgugcacaguacccugggcuccuuccccagcaccuaauacaaccaggcucgguggugcacaccugcgauucuaguacuugggagacagaggcagaagcaggagguuaaaguuguacacagcuacauaguacuggcuucuaacucagugauccuccugccuuagccucuggaaugcugggauuacagauauaugccaucacuuuuggcuuuagaacauauucaucacccagaaagaaaucuuauucgcauuaagcugcuugcucgucugcaucauuccuucccacaagcuccuggcaacucuaauaugcucucaucaagcagaaacuuguguggcuuaucugauugcuuugauauccuguggcacgcagccuuuuaugucuggcuuccuucacuuaggguaauguuucccacagcucauccccauugugcgguaugugcugggcuguacgucauuccuuuuaugacuaaauaauuuaccuuugaaugggccugcuacuuuuucuuucguugguuaacgggacaguugaguuguugucugcccuuugcuuguuaugaacuuugcgacugugagcauuugugugcaaggguugaacaccuguuucccauuuguuuggccucugugcccaggagaggaauugcugagucaugguggcuccuuagagcugauugcaccaucucccaugcagugcagucgggaaucugguuuuucuacaucccuugccugcacuugaaagaucauauauuugcaggggguguggggauccuuuuucaaccucugagcuaccccuuccagcccaguggugugauuucaguccugucuucucagcgcgaccaucccugcuagcccaggucagaugcaggaacugaggacucaggauucaccugcagaaguguuaacuguuucugcuugacagaaggaaaacacagaagugugcccaacaugguggugcacagugggauguagcaguaggagaguucuaggccauccuuguugaaguagugagaaccugauuacaaccaaggggucaggggugagaaacgaaaacaagacuucaugacgugcccaaaucacacagacagccucgucucggaccuaggucugucugauuuccagagccauuagccuggcugucacuaaugcuccauggcccuuccuugguagugucacguaugggggucaggggguggagagcgaccugaggagccggugggcagaccauguucuuaucacccuguccuguguacucagugagacccgccugguggaggugcuggagggcgugugcagcaggucagacuucgagugccaccgccugcucgagcugagcgaggagcugguggaaaacuggugguuucacaggugaggagugggagggguuacagauaugccccggugauguggcuuugacuuggccaagaagcaguugcauggcagcuugguuuggagccuucccaauccagaucugaggaguugccccuggguaccaggcccucacacugagccucuuuacuccucugcccaaagggccuuccuuggucaagggguucccaggacacaugcccaaguugagcugaauuccagcuucagggagggcaggagcaggcagccacucccacagcacccucgccuuucagccuuucugccccuuucucacaggcagcaggaagcccccgaccucuuccaguggcucuguuccgauucccugaagcucugcugccccucuggcaccuuugggcccuccugccugcgugagucuuucuugauccucuuugggagugggaggggcuggcggaggccgggaagcuaggccacacugggugaguucagcuugcucccuuaagaucuccagaccccugcucuggccuguccuacagggcuagccugagccaggugcaguguggcuguaguuguuauuaaauaaaugaugccucaccucugcuuccuucauucacaugucuggucagacugggaaggggcaagcacaugccccaaagcccccauuaucccugucugucuauuuccacaauaccuagucaagagcugaacuugguacaguccagucuaauuaauuuaugcccaggcuuugaacuuguaauccuucucaaucagcauucuggguguuggaauugcaggcaugugccaccaugccaagcgccuagccugcauuagagcuauugcuccugugaacaaggugaaggguuaguugcugggaugacggauuuagucuuuagaaaagauguggagguacaggccuguaaugcuaguauuuaggaggcugaggcuagaggauuuucagucuauucagauaaauucucuggacuuccugaagauugugucucaagcacaaacacacacucguguaugugugugucuuugugcgugcaugaaaaauaacugaguaugagaccucucaaaagagaaaaaaaagaaaaaggaggcaaauaagaauaagguuuacccaauuguuuuacaauaggcuauuacauauagcuucugugugaauaauaaaguuacuuuuucuuuuuagaaauauuuagaaccaacauagaaaauagucucuuggaugacaaaguuguguauaagaucucacccaacugaugucugcccacagcauguccugggggcacagagaggcccugcgguggcuacgggcagugugaaggggaagggacucgagggggcagcgggcacugugacugccaagccggcuaugggggcgaggccuguggccaguguggccuuggcuacuuugaggcggagcgcaacagcagccaucugguauguucggguagguagccagaagcugugguguagggcgggaagagccgggauaccugccugcccaucuucacccugucugcuuuuuacccagcguguuuugguccuugugcccgcugcacgggaccugaggaaucccauugucugcagugcaagaaaggcugggcccugcaucaccucaaguguguagguaaguggggggaacauggcgggagggcagguuuuauucccuauguacacauaugccugccuacaccaguacaggcuccuucauaugggacccucagccuggcuggcuggcagcaagcuagauguuuauaaagcagaaagaccugcaugcuguggaagagucauguccacacccagcucagugcagggcacugaugaaccaggaguaccuuagaagaggugcuucuuuggccagaucuuuuguuuugguuucucuauguagcccaggcuguucuggaacuugcucuguaggccuggcuggccuugaaaucagggaucaagcugccucugccacccacgugcugggauuaaagggggacaucaccauguggagcaaaacaaaucuuacaaaaacaaagcaacaacaacaaacaucuagagugggauuuaaagugaugacccggcaguuaaaggcgcuugcugccaaggcugaagcccggaguucagucccugagacacacaugcugaaaggagaaaaccaaccgcagcaaaguuguccccugauuuccacgugugugcuguggcaugagugugcccacacucguacacguacaugcaugcaaauaagaaguaauuuuuuuuuuuucuuaaagaaugacagggccuggcgugguggcacacgccuuuagccccagcacucgggaggcagaggcaggcggauuucugaguucgaggccagccuggucuacagagugaguuccaggacagccagggcuauacagagaaaccuugucuugaaaaaccaaaaaaaaaaaaaaaaaauugacaggaauuuaaagccaggcaugguaaugccugccuaggauuuagcucuggggugguagcgacaggaagaugaggagacaaggucacccuuggggacuguaguuucaugacagccuggacugcaugagacccuacacacccagcaggugguagcacgugcauuuaaucccagcacuugggaggcagaggcagggggaucucaggggaguuugaggccagccugggcuacagagugaguucuaagauagucaagguugcaaagugaaacacuguuucaaacaaacaaacaaacaaaaaccacaccccccuuuucuucugaugugagugguccagcuuagcagugaagcugucuagucaggcccucagggacccagguccccucugccuauggugguccccuuggauggcugaugcugagucacagccaccuccugcuucaggucucagcacucaggaagugagaaggggcugacugguuuuuguuuuuguuuuuuugguuugguuuuucgagacaggguuucucuguguagcccuggcuguccugggacucacucuguagaccaggcuggccucaaacucagaaauccaccugacucugccucccacgugcuggggauuaaaggcgugcgucaccacuguccagcaggguugacuguuuuuuaauuuaauuuuuaaagauuuauuuguuuauuuauuauauguaaguacacuguagcugucuucagacacuccauuacggaugguuuugagccaccaugugguuguugggauuugaacucagggaccuuuggaagaacagucagugcucuuacccgcugagccaucucaccagcccaagggcuguuuuuaaguaacaucuccaucccaggcagagggcugcaccuagccgcagggcucgagugucugacaggauagcgcuaauccagcugcccuuacuuaagaguugguagucggccugcagcaucuaccacauuugcgaucauagacaaguccacuccuggacaguccugccguaauuccucugcaaagggacacucccaaccuuugcccucuccacagacaucgaugagugugguacagagcaagccaccuguggagcugaccaguucugugugaacacagaaggauccuacgagugccgaggucagugucggcugcccaagggagaggcuggaauggaagagagggacaggagguggugcuucaggccuuucccuccgaacuucugcuauucaggcuccagagccugagauuggggcgggggggggggcaccccucacuucugcccucucuuuuucagacugugcaaaggccugccugggcuguaugggagcagggccagggcgcugcaaaaagugcagccguggcuaccagcaggugggcuccaagugccuaggugagucuucugccaaaaggggcuggaguaugggggaggcaagggaaggaaggaugcacacugagaccguggggagcugugcggggagccuguggcagucagcacccugaccuguuccccucccccacccccagauguggaugagugugagacugugguguguccaggagagaaugagaagugugaaaacacggagggaggcuaccgcugugucugugcugagggcuacagacaggaggacggcaucugcgugaaggagcaggucccggguaagcagggugggaggcuggacugcuccugagggagagcagacaagcuccuccuccgggccccaccccacugcuacccagcccccagagaggcugcccugagacucagucccugugcauccucaaggucggcuuuugguggucucaccuccgcguagaaagagaauuagauuuggcagcaaacuccaccuaucccaaguuuucugauguucccagggaccguccuucaaagcuuugagcagucccuucaccucccagcuuccuucgagcuuagugagguagcuccugcaaggcuuucucaguagugaaugcugcuugugcuuggugagcuaggcgggcccgggcagccgugaucaggcgugugggaggugugggcagcuccgggaacugccaggaaggaggcagugacaggcgcaccuccucugcagagucggcgggcuucuuugcggagaugacggaggaugaaauggugguucugcagcagauguucuuugguguaaucaucugugcgcuggccacgcuugcugccaagggugacuugguguucacugccaucuucauuggagcuguggcagccaugacuggguacugguugucagagcggagugaccgugugcuggagggcuucaucaaggguagauaaucccugccgccacucacaggauuuccucccacccaggcugcuccuagagguuauuucucucucccuauggauaccugggacagcauaguuucucuuugagacugggguaaacacccuuuuaccugccuuacugagcagcccaggaccccaguggccccaggggguugaaaaagagguccugaagcagaugccacgagauccuagccuaggacacuggcaggccucaccguguaugaaucccaagacaguuucuccccagggagguugcaggugggcuuuggccccugacccggaugagagguguccccucaggggugggcccccauaggccccuugccaggugcaugcugccagcuccagcuguguauucaccgcccacgcccuagccaucgacuuauuuauucaucucaggaaauaaaggacggucuugaaaaugggaaaag

SEQ ID NO: 3295 - RNA, 10049 nt, Mus musculus
cuuuucccauuuucaagaccguccuuuauuuccugagaugaauaaauaagucgauggcuagggcgugggcggugaauacacagcuggagcuggcagcaugcaccuggcaaggggccuaugggggcccaccccugaggggacaccucucauccgggucaggggccaaagcccaccugcaaccucccuggggagaaacugucuugggauucauacacggugaggccugccaguguccuaggcuaggaucucguggcaucugcuucaggaccucuuuuucaacccccuggggccacugggguccugggcugcucaguaaggcagguaaaaggguguuuaccccagucucaaagagaaacuaugcugucccagguauccauagggagagagaaauaaccucuaggagcagccugggugggaggaaauccugugaguggcggcagggauuaucuacccuugaugaagcccuccagcacacggucacuccgcucugacaaccaguacccagucauggcugccacagcuccaaugaagauggcagugaacaccaagucacccuuggcagcaagcguggccagcgcacagaugauuacaccaaagaacaucugcugcagaaccaccauuucauccuccgucaucuccgcaaagaagcccgccgacucugcagaggaggugcgccugucacugccuccuuccuggcaguucccggagcugcccacaccucccacacgccugaucacggcugcccgggcccgccuagcucaccaagcacaagcagcauucacuacugagaaagccuugcaggagcuaccucacuaagcucgaaggaagcugggaggugaagggacugcucaaagcuuugaaggacggucccugggaacaucagaaaacuugggauagguggaguuugcugccaaaucuaauucucuuucuacgcggaggugagaccaccaaaagccgaccuugaggaugcacagggacugagucucagggcagccucucugggggcuggguagcagugggguggggcccggaggaggagcuugucugcucucccucaggagcaguccagccucccacccugcuuacccgggaccugcuccuucacgcagaugccguccuccugucuguagcccucagcacagacacagcgguagccucccuccguguuuucacacuucucauucucuccuggacacaccacagucucacacucauccacaucugggggugggggaggggaacaggucagggugcugacugccacaggcuccccgcacagcuccccacggucucagugugcauccuuccuucccuugccucccccauacuccagccccuuuuggcagaagacucaccuaggcacuuggagcccaccugcugguagccacggcugcacuuuuugcagcgcccuggcccugcucccauacagcccaggcaggccuuugcacagucugaaaaagagagggcagaagugaggggugcccccccccccgccccaaucucaggcucuggagccugaauagcagaaguucggagggaaaggccugaagcaccaccuccugucccucucuuccauuccagccucucccuugggcagccgacacugaccucggcacucguaggauccuucuguguucacacagaacuggucagcuccacagguggcuugcucuguaccacacucaucgaugucuguggagagggcaaagguugggagugucccuuugcagaggaauuacggcaggacuguccaggaguggacuugucuaugaucgcaaaugugguagaugcugcaggccgacuaccaacucuuaaguaagggcagcuggauuagcgcuauccugucagacacucgagcccugcggcuaggugcagcccucugccugggauggagauguuacuuaaaaacagcccuugggcuggugagauggcucagcggguaagagcacugacuguucuuccaaaggucccugaguucaaaucccaacaaccacaugguggcucaaaaccauccguaauggagugucugaagacagcuacaguguacuuacauauaauaaauaaacaaauaaaucuuuaaaaauuaaauuaaaaaacagucaacccugcuggacaguggugacgcacgccuuuaauccccagcacgugggaggcagagucagguggauuucugaguuugaggccagccuggucuacagagugagucccaggacagccagggcuacacagagaaacccugucucgaaaaaccaaaccaaaaaaacaaaaacaaaaaccagucagccccuucucacuuccugagugcugagaccugaagcaggagguggcugugacucagcaucagccauccaaggggaccaccauaggcagaggggaccugggucccugagggccugacuagacagcuucacugcuaagcuggaccacucacaucagaagaaaaggggggugugguuuuuguuuguuuguuuguuugaaacaguguuucacuuugcaaccuugacuaucuuagaacucacucuguagcccaggcuggccucaaacuccccugagaucccccugccucugccucccaagugcugggauuaaaugcacgugcuaccaccugcuggguguguagggucucaugcaguccaggcugucaugaaacuacaguccccaagggugaccuugucuccucaucuuccugucgcuaccaccccagagcuaaauccuaggcaggcauuaccaugccuggcuuuaaauuccugucaauuuuuuuuuuuuuuuuuugguuuuucaagacaagguuucucuguauagcccuggcuguccuggaacucacucuguagaccaggcuggccucgaacucagaaauccgccugccucugccucccgagugcuggggcuaaaggcgugugccaccacgccaggcccugucauucuuuaagaaaaaaaaaaaauuacuucuuauuugcaugcauguacguguacgagugugggcacacucaugccacagcacacacguggaaaucaggggacaacuuugcugcgguugguuuucuccuuucagcaugugugucucagggacugaacuccgggcuucagccuuggcagcaagcgccuuuaacugccgggucaucacuuuaaaucccacucuagauguuuguuguuguugcuuuguuuuuguaagauuuguuuugcuccacauggugaugucccccuuuaaucccagcacguggguggcagaggcagcuugaucccugauuucaaggccagccaggccuacagagcaaguuccagaacagccugggcuacauagagaaaccaaaacaaaagaucuggccaaagaagcaccucuucuaagguacuccugguucaucagugcccugcacugagcuggguguggacaugacucuuccacagcaugcaggucuuucugcuuuauaaacaucuagcuugcugccagccagccaggcugagggucccauaugaaggagccuguacugguguaggcaggcauauguguacauagggaauaaaaccugcccucccgccauguuccccccacuuaccuacacacuugaggugaugcagggcccagccuuucuugcacugcagacaaugggauuccucaggucccgugcagcgggcacaaggaccaaaacacgcuggguaaaaagcagacagggugaagaugggcaggcagguaucccggcucuucccgcccuacaccacagcuucuggcuaccuacccgaacauaccagauggcugcuguugcgcuccgccucaaaguagccaaggccacacuggccacaggccucgcccccauagccggcuuggcagucacagugcccgcugcccccucgagucccuuccccuucacacugcccguagccaccgcagggccucucugugcccccaggacaugcugugggcagacaucaguugggugagaucuuauacacaacuuugucauccaagagacuauuuucuauguugguucuaaauauuucuaaaaagaaaaaguaacuuuauuauucacacagaagcuauauguaauagccuauuguaaaacaauuggguaaaccuuauucuuauuugccuccuuuuucuuuuuuuucucuuuugagaggucucauacucaguuauuuuucaugcacgcacaaagacacacacauacacgaguguguguuugugcuugagacacaaucuucaggaaguccagagaauuuaucugaauagacugaaaauccucuagccucagccuccuaaauacuagcauuacaggccuguaccuccacaucuuuucuaaagacuaaauccgucaucccagcaacuaacccuucaccuuguucacaggagcaauagcucuaaugcaggcuaggcgcuuggcaugguggcacaugccugcaauuccaacacccagaaugcugauugagaaggauuacaaguucaaagccugggcauaaauuaauuagacuggacuguaccaaguucagcucuugacuagguauuguggaaauagacagacagggauaaugggggcuuuggggcaugugcuugccccuucccagucugaccagacaugugaaugaaggaagcagaggugaggcaucauuuauuuaauaacaacuacagccacacugcaccuggcucaggcuagcccuguaggacaggccagagcaggggucuggagaucuuaagggagcaagcugaacucacccaguguggccuagcuucccggccuccgccagccccucccacucccaaagaggaucaagaaagacucacgcaggcaggagggcccaaaggugccagaggggcagcagagcuucagggaaucggaacagagccacuggaagaggucgggggcuuccugcugccugugagaaaggggcagaaaggcugaaaggcgagggugcugugggaguggcugccugcuccugcccucccugaagcuggaauucagcucaacuugggcauguguccugggaaccccuugaccaaggaaggcccuuugggcagaggaguaaagaggcucagugugagggccugguacccaggggcaacuccucagaucuggauugggaaggcuccaaaccaagcugccaugcaacugcuucuuggccaagucaaagccacaucaccggggcauaucuguaaccccucccacuccucaccugugaaaccaccaguuuuccaccagcuccucgcucagcucgagcaggcgguggcacucgaagucugaccugcugcacacgcccuccagcaccuccaccaggcgggucucacugaguacacaggacagggugauaagaacauggucugcccaccggcuccucaggucgcucuccacccccugacccccauacgugacacuaccaaggaagggccauggagcauuagugacagccaggcuaauggcucuggaaaucagacagaccuagguccgagacgaggcugucugugugauuugggcacgucaugaagucuuguuuucguuucucaccccugaccccuugguuguaaucagguucucacuacuucaacaaggauggccuagaacucuccuacugcuacaucccacugugcaccaccauguugggcacacuucuguguuuuccuucugucaagcagaaacaguuaacacuucugcaggugaauccugaguccucaguuccugcaucugaccugggcuagcagggauggucgcgcugagaagacaggacugaaaucacaccacugggcuggaagggguagcucagagguugaaaaaggauccccacacccccugcaaauauaugaucuuucaagugcaggcaagggauguagaaaaaccagauucccgacugcacugcaugggagauggugcaaucagcucuaaggagccaccaugacucagcaauuccucuccugggcacagaggccaaacaaaugggaaacagguguucaacccuugcacacaaaugcucacagucgcaaaguucauaacaagcaaagggcagacaacaacucaacugucccguuaaccaacgaaagaaaaaguagcaggcccauucaaagguaaauuauuuagucauaaaaggaaugacguacagcccagcacauaccgcacaauggggaugagcugugggaaacauuacccuaagugaaggaagccagacauaaaaggcugcgugccacaggauaucaaagcaaucagauaagccacacaaguuucugcuugaugagagcauauuagaguugccaggagcuugugggaaggaaugaugcagacgagcaagcagcuuaaugcgaauaagauuucuuucugggugaugaauauguucuaaagccaaaagugauggcauauaucuguaaucccagcauuccagaggcuaaggcaggaggaucacugaguuagaagccaguacuauguagcuguguacaacuuuaaccuccugcuucugccucugucucccaaguacuagaaucgcaggugugcaccaccgagccugguuguauuaggugcuggggaaggagcccaggguacugugcacgugagggaaacccucuagcaacucagcuacauucccagccuguuacauucuuuuauguguauuuuacaauuuaagaaauuaauauauaaacaagauguaguugcucacaccuguggucucaucacuugggaaguauuggcaagaagauuaggaguucaaggucaguucguaggagaucauaucucaaaaccagaauuuugcugggcgugguggcgcacaccuuugaucccagcacuugggaggcagaggcagguggaucucugaguucgaggccagccuggucuacagaguaaguuccaggacagccagggauacacagagaaacccugucuugaaaauaaauaaaugggaaaagacuugugagcauauauauacacguguaccugcacacacacacacauguauacacacacaaauauauaacauaaaaauuaguuuaauuauacuacaaucucaaaaaaugaaagaauuaaaaauauuaaaaacaaacauguuguaacauaucacguauuuaaaauggucugacacaguggaauacuagaggagccaauuuagcaaaauaaaccaagaaagaggagaaaggaaagaaaugggggauuacuaagauggcucaagagauccaggcauucacaccaagacugagccugagaaccugaguucgauccccaggauucaagcaggaggaggaagaagugacuccugagaggugugcacauguguccacaaucacacacacacagaggaaacaaaggacaaaacauuaggaagaagcuaagugugguggcacacacuuguagucccagcacuguggaggcaaagagaggcggaccucugugaguucaaggccagccaugacauacaguaagaccuaguaucaaaaguggaaaaaaauacguaauagaauaaaacuuuuaaaggaaaagacagaagaacccggaagccauuauacagcagaaguacucuugguacuacugccuuccuaagugaggaaauugagggaaagaaagggccagaguugcagaaaaauaaauuuuucucccuagugggaaccaucauccaaccacaguaccaaggaucaggugagggagcuguagcguggagagaagagcaacccuagcauucgugaaaacagcaagaccccaccagcggccuaaacugggacucuucacgaccccuccuuuugugucaccuugacaaucuagagggccucuucagucccugucucuaggccuaccugucccucgagcuuuggaauaagauggaagcuaucuggguguccagggcacaucucaccccaccauguucagagaccuggccugaccccaccccugcucauggccucucugcaguuagaaaacaccugcagcugagcagugggggcacacgccuguaaucccagcacuugggaggcagaggcaggcggauuucugaguucgaggccagccuggucuacauagugaguuccaggacagccagggcuacacagagaaacccugucucgaaaaaccaaaauaagaaaaaaaaaaaaaagaaaacaccugcacaccucacccagucaauaguacucucucucgugcuccauaaggaaucuaucaugucaacugaugaucuccaaaggaugcucagauuucaacuagcucuguaugcaccacugaaugucuugcuaguccaugcugccuuuauaccuagacuaaagaagccccucuccccacucccuagcugcucuccccacucccuccaugcuccccuggcuucuuguacuuugugagugugagugaucucuucacuuaagaccuggagagauggcucagcaauuauucaguucccaccacagacauaguggcucccaauuccucuaacuccaguuccaggaaauccaguguccuuucuggccucccauucaggacaucuaaacuccucucuagaaccuucugcucacucugcuccagccaccuuugggagaaacagaaggucggccccccuacuguucaaacggaccauccugaacacaucccacccaccuguggucuacccacauucuuguucuucaccugacagguuguguguacuguuugugucuacucuacuaaaaaagcaaguuucucgaagauggggcuugguuuccuuaucugcuguacuguaaauguucaggaucuggggagcgaaaugcuuccgcagagaaucuauccaacaucaucaacagaaacccagaguugggguagauacccugcccccaccuucuuaccugucuuuguauuuggacaacuucucuuccucccaggccguguuuccacccccgaaguugucccggaugguucucuccaggcccugcauauggaagaaauuaggaauaucuaaguacagagcuagacacauucauuuggauuuuuuauuaguuuguuuuuuguuuuguuguuguuucugaaacaagguuucucugcauaguccuggcuguccuggaacuuggucuguagaccaggaugcccuggaacucagagauccaccugccucugccuccccagugcugggacuaaaggaaugugccggcacucccggccuaacauucuaacauuucauuauuuuauguuauugaccagaaaacugaggcacugugacacaccuuacccaaaugccauacaguuaaagccagcaacccacacugggacuagacaccaugcagauuugcagagagagcucccugcucuccaauaaugggccccucccucguggcuauuagugcacccaccuuguugaaguuguccaccagugcccggcagguaugacacggauggggcucagcucggggagaaggauggggaggaggagaggguuggagccagacagguccugggaggcucagaaacaggcucaagcaccagagcagagaugggaccaggccccuugggggcaguggagccaucuuuucccaggcuggggacgugcagauagagggcagggggaggguucacuggagaagccaggcuguaagggaggaaagcgaggcgccuuggggcucagagccccagaccuacguaauuacaaaacgaggauaaacugggguaguggaagcagaggcgcuggaaggggugaaagagccuaaucuacgauuccagcagagaaauuauuucuccguuaccguagggggagguggccgggaucgcgggcaaaagaauaagcgucagcccauuguuuuagggucucagugaguuauuaggggccaaaauuagagagaggguuggaucccaaaauauuccgagagaaaggcggaugggcgguccuggaggaggagcccggauccggauaugaagagaaggggucaaguucagagccucuuugggagauggaggcacagccugaaacaggacugggaggauccaaacccugcuagaccuuagaggaggagggaaaaaaaaaaaaaaaaaguccccgccuccgccccgggcgcugugggccgagucgccucaaagccaccgccuccguaaaaaguacacccuucuucaacgccgcaguccggagggcggggccuu

SEQ ID NO: 3296 - RNA, 9918 nt, Mus musculus
gaguaugggggaggcaagggaaggaaggaugcacacugagaccguggggagcugugcggggagccuguggcagucagcacccugaccuguuccccucccccacccccagauguggaugagugugagacugugguguguccaggagagaaugagaagugugaaaacacggagggaggcuaccgcugugucugugcugagggcuacagacaggaggacggcaucugcgugaaggagcaggucccggguaagcagggugggaggcuggacugcuccugagggagagcagacaagcuccuccuccgggccccaccccacugcuacccagcccccagagaggcugcccugagacucagucccugugcauccucaaggucggcuuuugguggucucaccuccgcguagaaagagaauuagauuuggcagcaaacuccaccuaucccaaguuuucugauguucccagggaccguccuucaaagcuuugagcagucccuucaccucccagcuuccuucgagcuuagugagguagcuccugcaaggcuuucucaguagugaaugcugcuugugcuuggugagcuaggcgggcccgggcagccgugaucaggcgugugggaggugugggcagcuccgggaacugccaggaaggaggcagugacaggcgcaccuccucugcagagucggcgggcuucuuugcggagaugacggaggaugaaauggugguucugcagcagauguucuuugguguaaucaucugugcgcuggccacgcuugcugccaagggugacuugguguucacugccaucuucauuggagcuguggcagccaugacuggguacugguugucagagcggagugaccgugugcuggagggcuucaucaaggguagauaaucccugccgccacucacaggauuuccucccacccaggcugcuccuagagguuauuucucucucccuauggauaccugggacagcauaguuucucuuugagacugggguaaacacccuuuuaccugccuuacugagcagcccaggaccccaguggccccaggggguugaaaaagagguccugaagcagaugccacgagauccuagccuaggacacuggcaggccucaccguguaugaaucccaagacaguuucuccccagggagguugcaggugggcuuuggccccugacccggaugagagguguccccucaggggugggcccccauaggccccuugccaggugcaugcugccagcuccagcuguguauucaccgcccacgcccuagccaucgacuuauuuauucaucucaggaaauaaaggacggucuugaaaaugggaaaagcuucagucuuaacaacccaccacugccacuaaagugaaguuuucuacagcccuggggaaucaugggcugccauguuagagaagugcuggaaaggggcuggggagacagggaggcuguuaggagcaguugcugcccuugcagagagacuccagguucaauuccccgcacccaugcagugccucacagccauccagccuccaguccuaagggacuggacucagucucugaccuuggguaccaagcacacacauggugcacauagacaugcaggcaaaacauucauacacauaaaauaaaucuacaaaaaacaauguuuuuaaauaaaaaccagcaagaaauggaggaaggggaaagaugacagaggaaccagcuuaggagucggucuuccuggguugaaccccagcuguucucauuuccggaagugggcaggauacuuuccgauuaggccuuauaugggguuugcaggagguggggacuccacaacagacggguuuuuagugagauagggguggcuguaccuaccaaagccagaggucucugcugugaggagagacccuggcuugaccagagcgaggcaugagcccaaucggaaggguuuuuauuucuuuggcacaaagaggacagucagucuggacaagugaggugcaucucuccacacugagagggucagggguaccuggccccuggcccccaugaucaaauccaugcacauccacccuguguuccguguaacucacggccucugugcaaaauaucugcugaaaaaaauagagauauuaaaaaaacaaaaacaaaaaacgaguuggguaaauucaagcccggcuguacccgggagcugcagucugguggaggcccgggagggccaauuuuucaaaugcucaacugucuuggcucagccucuucuuguggacauugaggagaggguacagguucucuccguaggugcuuagagcucuauagugucacuagaggcgcugugagacucgcuggacuugcaacgcgacuggcccucgcccugaggcucccccgcccgggcaggagcagggacugggguaggugguggcagcagcugcacggugcugggcaguucaucuaggggcaggcuguccacggaugacagcccgugacgccacggguuccagcugaucuucagcgagcccuuggagaaacuguccagggagcugcccgaaguccccgcggccgccgcgccgacgggcggcuccaucacgugcugcgggagcgacgugcgcaagcacaccucggugagcgagcggcagcggccucggagcaaugaugugcccgcgccgucgagcucggcaucgggcuggcugccgcggcgaggccgcagggcgcccccugucggcgaggaggccaagccacggagaccacagcguuggaacacacucucucgaaccaagugcucccggaagagcgcggcgucgaugcugcggcucaaauugauaggugacgguggccgcagauccagcucgcucagcgacggugcgggccccacacugccccgggacauccucuggccaccuggacgaccgcgacccagcgaugcagccgaaccccaggguccagaaccaggagugacaggaagcccagcuuccccagcagcguugcggaugagacuuuugcugauguccaggccgccugugcccaggccacugggccccgcauagcaguuauugggucucucgggaacuucgcucuucccuguaggcgcggggcacgccagacgcagcagcuuagcccagcaagcgugcuccgugggcggccugggacgaguggcagccagggcagcuagcgccagggccagugcccaggucaauuccagcaggcgcagccagaagugcacgccccaccaagcccaggagaagcgacccucccggccaggcccuggguacagccagagagaggccgccaacugcagaccacuggccaacagccccagugagcccgccacagccaacagccggggcccuggacuggcaucccagccccgagggccuuccagcaggcgucgacggcacaggcagagugugcccagagccacugaggcgccccaggcgcaagauaagccuuguguuagaagguugagcacagggcugguggagaacaggucuguagccagcaaacaugugccaugcaccggugccacaauucccagcagcagcggcuucugcagaggcuguggcagaccagcacccaagcccagcagggugagugcugccagugcagugaguagcaaggggaagggcaaguuguauagcaccagaccugcacguacucccagucgcgccugagagccauaaggauccgugagcauguaggcagaucgcagcccugaagccaccaauaccagcgcggcagccacuagugcuaaucggggucccgcuagggcggcugccacugugaccaaugccaauaaugcuggaagcaggaaaagcacccccaccccauacacaugaagcucccaggagaaacucagcacccgccgaagggguccccaacgcaggggaggugcgguggcauuggcuggggggcuagaagcugggauggggacuauggagcuggcugagggcuccggagggaguggcuggcccagagcucucuguguggugacucuaacgagaccacgccgagaugucgagggggccuggacagggggugcuggaggguggcuuugugggcgacccggccaauccucggcuucaucugaaauaauaacaacauuaaaagggucccucgggaagugcuguugagagugggggagggguggagguacaugcuuguaauaggaggcagggcaggaggaucaggacuucaaagccaucuccagcaaccacaaugaguucaacaucagucuaggcuaccugagacccccaucucaaacaaacaagaaacaacacaacagaaccccaaacaaacacaaaagugcuuuugauuuuuccauauucaaaaguauaguugguaaauuaauuuuccaagguugucugucaaauggcgauaauagcaccugccacagucauugggucauggugagggcacaugucuaucuugguucccaucaaagacaagacagauguaaauuuccuuuccuuccuuccuuuuuuuuuuuuugugguaguagugauggugccggggauuaaacccaggaucuuucauaugccaggcaauaacucuaccacuaaguugcgucuccaacccuuuguauuuuugauuuugaaacagggucuuaaugagcugcucacacccagccuugaacucaguauguauguaguucaggcaggccucaaacuugugauccucuugucucagcauccagggugcugggguucccgaggggaugggguaugacuguacaagaugggucuacguugcacagaagaacauucgagcucaaaagagccgaugucuuguccuggaguuuccagggaacauugguuugcuuuguucggcgacucagagguccuaaccuauuccuuucagcgggugcuuuucucuauuuagcccuggccccugccccaucacuaagcacagguucuugguuucucuccccucaccccuagccguggccucaccuggcugcagggcccucacagggcucucuguuccauuugcagcuugagcagaauuuggaaggucagggaugaaggacuuggggguuccuggggccuccaucgcuccucucacacguuguggggagauggggucggcuccauucagcgaggauacugcugaaauggcaauagucauuaccuugucugaccuucccauacucccccaaauccugccccucaggaggaaggcuccaucacuccaauuuguccaaaggagggaaaugacaugcagaauuacaucuaucugccuuggaccacugguccucacaaccccacucagcccccucaugcugauaccuaccuggucuuaggugcccaucagaagugucugaggcugaaggugguauaggcuggggugcuggggaaucuuguccuccaaggagaucggucuguucugguuggggucccagagagcugacuucccagguauccccagcuccaguuuugggggguucagcuggcagccccucaggaagaggaaggcuucugaccaaugccaggucgagcugggcuccaggcucugggguggauuccacuuuaacuggggguguugagccgaccccagggacuacuggauccugcugggugaguaggggacccuggacagccuccuggaagcccuguucauguccccccugcuuccccaacaccagcguccucacagcaucugucucggguaccggagugugggaagagcccuggaagucccagggggaagccugugugaugugggucucggcuuugaccauuauuagcuccucguuccuagcuggcugcugcccugcugugccuccaggcuucugggaggcaguggaaaguauggcugccgagaguagggagcugggaguuguagugacaagagugagacgaggugcucgcacagggugggguucuggugccucaggcuccagaagcuccugugagucaggagguccuguccagccuugggaggugaaugcucgggccagcuggaggucaucagcucuuaguagucuuucaccuuggaccccaggggcugccuugggcccaugcagggcugguccuagguaagggucugcgggcuucuugggccccucagcacgggccugagggucaccgcugugccaggaacucucauuucucagcuucucccagaagaggucaaaggucugugacucugaugggaucaugugagguucugaguucuccaggggccugggaaggccucugcccaaggcagggccagcccccaggcauggcagcagcaacagcagaagaggagaugugcaggccugugggcugggggccauggucuaauucaaugccugaguguagagcccuugacuucuaggcuucacuggacccgucuacaaaagcggagaaaggaaagauaaagcagagggagauggcgugaggguugaagggucccaugacuuccuccaggggcuggugggaaagaagagaagcaucaaacaacagugucagcccggcuuuuaaaguuuuaaaaaacugggucucugcucacaucacuuccuuugcuuucaaaacuuucugacuccccacugcucuugggagagaaugcaaguucuauuccuggcuuuccgagacugcggccaggccagcugacucagccucuguccugacaccagguucuguucccucgggauggaaugccuucuauaccugacaauuucauuuauuaaauaacuuauuuagcuuaucuuauaugcacugauuggugugaggguauaggauccccuggaacuggaguuacagacauuugucauuugccauguaggugcugggaauugaaccuggguccucuggaagggcagccagugcuuguaaccacugggcuaucucuccagucccaagauuuuauuuuuugagacagggucuauauagccauggcugaccugaacuauguagaccaagauggcauagaacuaauggagaucuacuugucucugccuucugagugcugugauuaaaggugugugugcuaacaggcccagccuuuuaguuguauauacuaaguauauuuuauauaugauauacauauauauguaccuaugcacauauguguguguguguauauauauauauauauauauguguguauauauauauauauauauauguguguguguguguguguguguguguguguguguguguauacacacacacauaugacaggaguaguuguauauguuaagugcagugccugccauugccaggggagaguguuggauuccccaggggcugaguuacaggcaucugggagacaccuaaccccagugcuggauacucugcaagagcaggaagugcuacuugcucuggcuggcuaagccaucucuccagucccugaaaacagauuuuacguuuuuaaaaucacauuuagguguuuaauuaaggggggauguuugccacagcaagugcuuggagggcaggacaaccugugggagucaguucucuccuuccacgugguucccagggaucaaacucaggccaucgggcuuuguggcaaaccucuuuagcugcuaagccuucuugccugcccucaaauuagauuuaucaacauccagcucucauaaaagcgaaagaggaacaugccccugcauuugcggagggcccugaguuagauuccuggcaucuugucuccugggugaguuacuuugcuucucagcaucgugguuuuaacuuuuaucucuaaaaugaagcuaacaagagugucuaccucaaggggauucauaugacgcauaacuaaugagacacaugaaggucagacccacaggaggaacuugauagcagggcucuaucuccuuagccuuugucuggaaagcuuucuucccucauaagcccuucucuaguucaacacauaaauugaacagaccuugggauauagcgcugagcaagauugagaagacugcccccuccccacuguggagagauauaaguaagauggacaauaaaugauuuuaaccuaacggccagugagaaggcucaguggauaaaggggcuugcugccaagccugaugaccucagaguucaauccuugaucaggacccacaugguggaaagagaaaacugauucccuuggguuguuuucugaucuccaaauaggcaugcauguacacacacagacacucacucagacacauacacacacacacacacgauacauauaauuuuuuaaaaauguuaaaguucagauccuuagcagagucaggaggaucucugugaucuaccuagcaaguugcaggccagccugagaacuaugaaaugagacucccuaaaauuauaaaguuuagcuuugaagaaaauacagugugguuagaugauaacagaggagagucuccacaggggugccaggagagccugucugaggagagagacacuuaagcaaaggcagaaugguaagagagccaagcauuugacgcucugaggggaaagccuuuggcagcggcaauagcauauacaaagacucaggagcaggcgugaacucagugaguucagaacaccucuuuugggguggcugguggucagcaggcaggggcuagucagcaagggcuccugugaaccaucacguggauuggagagcuccgacaggaggcggucugagaagcaguguuuuuuaaagggaaagaggucggcaucauguccagggacaauuggaggguaguucguauuagccuagacacuccucuccagggaugccuucuguuccuggcucucccuauccggagcaaagcucccuuguauaucaucuccugucugccgcuggccuggggcuccugucuuuuuccuuuacaccuccagccccuguacaauccgggcccagguagauauauucccaagaggucccuauuccuaaguccauccuuaaguaggccagggagguaggagggaucagcaguggccagccagcugagggccagcuguguuaggggcaggugcuguguccuuuuccucuuggacacagccaccuuugguggcucagacacuaggagaaguuagagguaaccccagagacucuuccgaggaguaccccuaggcucaucagagguugugggaaguuucaggggauucaaagaccucuuggguccagucacagcguuaauucagacagccuuuaagucuugguaagcccucucucaaacaucuauuaagccccagguucugcucauaggccaggcuggggucuggggacccauaaaguccucaguucugaggcuggggaugaggugugcgaaggaaggacuuggggccccugauauggauauagguuauaauaauacccuguguugagcucuuugcuuaguuaggccucuguucuaaaccuucccauacagcaggugcaaguacccaucacacaggaaaggagagugggcaaccaagagucagagagguugagcaacuuguccaaggucgcacagccagcugaaaacacauacuagagauacugaagcccguacagcucuguagacuuugcagaggaggagauggcugagcugggccuucagugaauaacaugccaucugccuaccacccccgaugcaagagaugugggcacccgcaguccaggcaggagcuugccuagcauuaggguccccauggcuggacaguucugaggggagaugagaucaaucagccgcagagacuaggggguggggggagcagggugagggccucugcaggacagccugcagaagcugguccaucucggguuaccucucuuccuccuucuccagcuucucucucccuggcuccaugccuucccgcagugucccgggugggguuuggcaccgugcaggcccaugcccgcgaaggggcuguaagccuugcuccuugccuucuugggucccgccaucuccccuucccucggccagcuccucaccugcgcgcugcauccgcagccaugcguucaccuugcgcgcgucccugcagccgcucccggaggcgcauccuccgagaugcuca

SEQ ID NO: 3297 - RNA, 9918 nt, Mus musculus
ugagcaucucggaggaugcgccuccgggagcggcugcagggacgcgcgcaaggugaacgcauggcugcggaugcagcgcgcaggugaggagcuggccgagggaaggggagauggcgggacccaagaaggcaaggagcaaggcuuacagccccuucgcgggcaugggccugcacggugccaaaccccacccgggacacugcgggaaggcauggagccagggagagagaagcuggagaaggaggaagagagguaacccgagauggaccagcuucugcaggcuguccugcagaggcccucacccugcuccccccacccccuagucucugcggcugauugaucucaucuccccucagaacuguccagccauggggacccuaaugcuaggcaagcuccugccuggacugcgggugcccacaucucuugcaucgggggugguaggcagauggcauguuauucacugaaggcccagcucagccaucuccuccucugcaaagucuacagagcuguacgggcuucaguaucucuaguauguguuuucagcuggcugugcgaccuuggacaaguugcucaaccucucugacucuugguugcccacucuccuuuccugugugauggguacuugcaccugcuguaugggaagguuuagaacagaggccuaacuaagcaaagagcucaacacaggguauuauuauaaccuauauccauaucaggggccccaaguccuuccuucgcacaccucauccccagccucagaacugaggacuuuauggguccccagaccccagccuggccuaugagcagaaccuggggcuuaauagauguuugagagagggcuuaccaagacuuaaaggcugucugaauuaacgcugugacuggacccaagaggucuuugaauccccugaaacuucccacaaccucugaugagccuagggguacuccucggaagagucucugggguuaccucuaacuucuccuagugucugagccaccaaagguggcuguguccaagaggaaaaggacacagcaccugccccuaacacagcuggcccucagcuggcuggccacugcugaucccuccuaccucccuggccuacuuaaggauggacuuaggaauagggaccucuugggaauauaucuaccugggcccggauuguacaggggcuggagguguaaaggaaaaagacaggagccccaggccagcggcagacaggagaugauauacaagggagcuuugcuccggauagggagagccaggaacagaaggcaucccuggagaggagugucuaggcuaauacgaacuacccuccaauugucccuggacaugaugccgaccucuuucccuuuaaaaaacacugcuucucagaccgccuccugucggagcucuccaauccacgugaugguucacaggagcccuugcugacuagccccugccugcugaccaccagccaccccaaaagagguguucugaacucacugaguucacgccugcuccugagucuuuguauaugcuauugccgcugccaaaggcuuuccccucagagcgucaaaugcuuggcucucuuaccauucugccuuugcuuaagugucucucuccucagacaggcucuccuggcaccccuguggagacucuccucuguuaucaucuaaccacacuguauuuucuucaaagcuaaacuuuauaauuuuagggagucucauuucauaguucucaggcuggccugcaacuugcuagguagaucacagagauccuccugacucugcuaaggaucugaacuuuaacauuuuuaaaaaauuauauguaucguguguguguguguguaugugucugagugagugucuguguguguacaugcaugccuauuuggagaucagaaaacaacccaagggaaucaguuuucucuuuccaccauguggguccugaucaaggauugaacucugaggucaucaggcuuggcagcaagccccuuuauccacugagccuucucacuggccguuagguuaaaaucauuuauuguccaucuuacuuauaucucuccacaguggggagggggcagucuucucaaucuugcucagcgcuauaucccaaggucuguucaauuuauguguugaacuagagaagggcuuaugagggaagaaagcuuuccagacaaaggcuaaggagauagagcccugcuaucaaguuccuccugugggucugaccuucaugugucucauuaguuaugcgucauaugaauccccuugagguagacacucuuguuagcuucauuuuagagauaaaaguuaaaaccacgaugcugagaagcaaaguaacucacccaggagacaagaugccaggaaucuaacucagggcccuccgcaaaugcaggggcauguuccucuuucgcuuuuaugagagcuggauguugauaaaucuaauuugagggcaggcaagaaggcuuagcagcuaaagagguuugccacaaagcccgauggccugaguuugaucccugggaaccacguggaaggagagaacugacucccacagguuguccugcccuccaagcacuugcuguggcaaacauccccccuuaauuaaacaccuaaaugugauuuuaaaaacguaaaaucuguuuucagggacuggagagauggcuuagccagccagagcaaguagcacuuccugcucuugcagaguauccagcacugggguuaggugucucccagaugccuguaacucagccccuggggaauccaacacucuccccuggcaauggcaggcacugcacuuaacauauacaacuacuccugucauauguguguguguauacacacacacacacacacacacacacacacacacacacauauauauauauauauauauacacacauauauauauauauauauauacacacacacacauaugugcauagguacauauauauguauaucauauauaaaauauacuuaguauauacaacuaaaaggcugggccuguuagcacacacaccuuuaaucacagcacucagaaggcagagacaaguagaucuccauuaguucuaugccaucuuggucuacauaguucaggucagccauggcuauauagacccugucucaaaaaauaaaaucuugggacuggagagauagcccagugguuacaagcacuggcugcccuuccagaggacccagguucaauucccagcaccuacauggcaaaugacaaaugucuguaacuccaguuccaggggauccuauacccucacaccaaucagugcauauaagauaagcuaaauaaguuauuuaauaaaugaaauugucagguauagaaggcauuccaucccgagggaacagaaccuggugucaggacagaggcugagucagcuggccuggccgcagucucggaaagccaggaauagaacuugcauucucucccaagagcaguggggagucagaaaguuuugaaagcaaaggaagugaugugagcagagacccaguuuuuuaaaacuuuaaaagccgggcugacacuguuguuugaugcuucucuucuuucccaccagccccuggaggaagucaugggacccuucaacccucacgccaucucccucugcuuuaucuuuccuuucuccgcuuuuguagacggguccagugaagccuagaagucaagggcucuacacucaggcauugaauuagaccauggcccccagcccacaggccugcacaucuccucuucugcuguugcugcugccaugccugggggcuggcccugccuugggcagaggccuucccaggccccuggagaacucagaaccucacaugaucccaucagagucacagaccuuugaccucuucugggagaagcugagaaaugagaguuccuggcacagcggugacccucaggcccgugcugaggggcccaagaagcccgcagacccuuaccuaggaccagcccugcaugggcccaaggcagccccugggguccaaggugaaagacuacuaagagcugaugaccuccagcuggcccgagcauucaccucccaaggcuggacaggaccuccugacucacaggagcuucuggagccugaggcaccagaaccccacccugugcgagcaccucgucucacucuugucacuacaacucccagcucccuacucucggcagccauacuuuccacugccucccagaagccuggaggcacagcagggcagcagccagcuaggaacgaggagcuaauaauggucaaagccgagacccacaucacacaggcuucccccugggacuuccagggcucuucccacacuccgguacccgagacagaugcugugaggacgcugguguuggggaagcaggggggacaugaacagggcuuccaggaggcuguccaggguccccuacucacccagcaggauccaguagucccuggggucggcucaacacccccaguuaaaguggaauccaccccagagccuggagcccagcucgaccuggcauuggucagaagccuuccucuuccugaggggcugccagcugaaccccccaaaacuggagcuggggauaccugggaagucagcucucugggaccccaaccagaacagaccgaucuccuuggaggacaagauuccccagcaccccagccuauaccaccuucagccucagacacuucugaugggcaccuaagaccagguagguaucagcaugagggggcugagugggguugugaggaccagugguccaaggcagauagauguaauucugcaugucauuucccuccuuuggacaaauuggagugauggagccuuccuccugaggggcaggauuugggggaguaugggaaggucagacaagguaaugacuauugccauuucagcaguauccucgcugaauggagccgaccccaucuccccacaacgugugagaggagcgauggaggccccaggaacccccaaguccuucaucccugaccuuccaaauucugcucaagcugcaaauggaacagagagcccugugagggcccugcagccaggugaggccacggcuaggggugaggggagagaaaccaagaaccugugcuuagugauggggcaggggccagggcuaaauagagaaaagcacccgcugaaaggaauagguuaggaccucugagucgccgaacaaagcaaaccaauguucccuggaaacuccaggacaagacaucggcucuuuugagcucgaauguucuucugugcaacguagacccaucuuguacagucauaccccauccccucgggaaccccagcacccuggaugcugagacaagaggaucacaaguuugaggccugccugaacuacauacauacugaguucaaggcugggugugagcagcucauuaagacccuguuucaaaaucaaaaauacaaaggguuggagacgcaacuuagugguagaguuauugccuggcauaugaaagauccuggguuuaauccccggcaccaucacuacuaccacaaaaaaaaaaaaaggaaggaaggaaaggaaauuuacaucugucuugucuuugaugggaaccaagauagacaugugcccucaccaugacccaaugacuguggcaggugcuauuaucgccauuugacagacaaccuuggaaaauuaauuuaccaacuauacuuuugaauauggaaaaaucaaaagcacuuuuguguuuguuugggguucuguuguguuguuucuuguuuguuugagaugggggucucagguagccuagacugauguugaacucauugugguugcuggagauggcuuugaaguccugauccuccugcccugccuccuauuacaagcauguaccuccaccccucccccacucucaacagcacuucccgagggacccuuuuaauguuguuauuauuucagaugaagccgaggauuggccgggucgcccacaaagccacccuccagcacccccuguccaggcccccucgacaucucggcguggucucguuagagucaccacacagagagcucugggccagccacucccuccggagcccucagccagcuccauaguccccaucccagcuucuagccccccagccaaugccaccgcaccuccccugcguuggggaccccuucggcgggugcugaguuucuccugggagcuucauguguauggggugggggugcuuuuccugcuuccagcauuauuggcauuggucacaguggcagccgcccuagcgggaccccgauuagcacuaguggcugccgcgcugguauugguggcuucagggcugcgaucugccuacaugcucacggauccuuauggcucucaggcgcgacugggaguacgugcaggucuggugcuauacaacuugcccuuccccuugcuacucacugcacuggcagcacucacccugcugggcuugggugcuggucugccacagccucugcagaagccgcugcugcugggaauuguggcaccggugcauggcacauguuugcuggcuacagaccuguucuccaccagcccugugcucaaccuucuaacacaaggcuuaucuugcgccuggggcgccucaguggcucugggcacacucugccugugccgucgacgccugcuggaaggcccucggggcugggaugccaguccagggccccggcuguuggcuguggcgggcucacuggggcuguuggccaguggucugcaguuggcggccucucucuggcuguacccagggccuggccgggagggucgcuucuccugggcuugguggggcgugcacuucuggcugcgccugcuggaauugaccugggcacuggcccuggcgcuagcugcccuggcugccacucgucccaggccgcccacggagcacgcuugcugggcuaagcugcugcgucuggcgugccccgcgccuacagggaagagcgaaguucccgagagacccaauaacugcuaugcggggcccaguggccugggcacaggcggccuggacaucagcaaaagucucauccgcaacgcugcuggggaagcugggcuuccugucacuccugguucuggacccugggguucggcugcaucgcugggucgcggucguccagguggccagaggaugucccggggcaguguggggcccgcaccgucgcugagcgagcuggaucugcggccaccgucaccuaucaauuugagccgcagcaucgacgccgcgcucuuccgggagcacuugguucgagagaguguguuccaacgcuguggucuccguggcuuggccuccucgccgacagggggcgcccugcggccucgccgcggcagccagcccgaugccgagcucgacggcgcgggcacaucauugcuccgaggccgcugccgcucgcucaccgaggugugcuugcgcacgucgcucccgcagcacgugauggagccgcccgucggcgcggcggccgcggggacuucgggcagcucccuggacaguuucuccaagggcucgcugaagaucagcuggaacccguggcgucacgggcugucauccguggacagccugccccuagaugaacugcccagcaccgugcagcugcugccaccaccuaccccagucccugcuccugcccgggcgggggagccucagggcgagggccagucgcguugcaaguccagcgagucucacagcgccucuagugacacuauagagcucuaagcaccuacggagagaaccuguacccucuccucaauguccacaagaagaggcugagccaagacaguugagcauuugaaaaauuggcccucccgggccuccaccagacugcagcucccggguacagccgggcuugaauuuacccaacucguuuuuuguuuuuguuuuuuuaauaucucuauuuuuuucagcagauauuuugcacagaggccgugaguuacacggaacacaggguggaugugcauggauuugaucaugggggccaggggccagguaccccugacccucucaguguggagagaugcaccucacuuguccagacugacuguccucuuugugccaaagaaauaaaaacccuuccgauugggcucaugccucgcucuggucaagccagggucucuccucacagcagagaccucuggcuuugguagguacagccaccccuaucucacuaaaaacccgucuguuguggaguccccaccuccugcaaaccccauauaaggccuaaucggaaaguauccugcccacuuccggaaaugagaacagcugggguucaacccaggaagaccgacuccuaagcugguuccucugucaucuuuccccuuccuccauuucuugcugguuuuuauuuaaaaacauuguuuuuuguagauuuauuuuauguguaugaauguuuugccugcaugucuaugugcaccaugugugugcuugguacccaaggucagagacugaguccagucccuuaggacuggaggcuggauggcugugaggcacugcaugggugcggggaauugaaccuggagucucucugcaagggcagcaacugcuccuaacagccucccugucuccccagccccuuuccagcacuucucuaacauggcagcccaugauuccccagggcuguagaaaacuucacuuuaguggcagugguggguuguuaagacugaagcuuuucccauuuucaagaccguccuuuauuuccugagaugaauaaauaagucgauggcuagggcgugggcggugaauacacagcuggagcuggcagcaugcaccuggcaaggggccuaugggggcccaccccugaggggacaccucucauccgggucaggggccaaagcccaccugcaaccucccuggggagaaacugucuugggauucauacacggugaggccugccaguguccuaggcuaggaucucguggcaucugcuucaggaccucuuuuucaacccccuggggccacugggguccugggcugcucaguaaggcagguaaaaggguguuuaccccagucucaaagagaaacuaugcugucccagguauccauagggagagagaaauaaccucuaggagcagccugggugggaggaaauccugugaguggcggcagggauuaucuacccuugaugaagcccuccagcacacggucacuccgcucugacaaccaguacccagucauggcugccacagcuccaaugaagauggcagugaacaccaagucacccuuggcagcaagcguggccagcgcacagaugauuacaccaaagaacaucugcugcagaaccaccauuucauccuccgucaucuccgcaaagaagcccgccgacucugcagaggaggugcgccugucacugccuccuuccuggcaguucccggagcugcccacaccucccacacgccugaucacggcugcccgggcccgccuagcucaccaagcacaagcagcauucacuacugagaaagccuugcaggagcuaccucacuaagcucgaaggaagcugggaggugaagggacugcucaaagcuuugaaggacggucccugggaacaucagaaaacuugggauagguggaguuugcugccaaaucuaauucucuuucuacgcggaggugagaccaccaaaagccgaccuugaggaugcacagggacugagucucagggcagccucucugggggcuggguagcagugggguggggcccggaggaggagcuugucugcucucccucaggagcaguccagccucccacccugcuuacccgggaccugcuccuucacgcagaugccguccuccugucuguagcccucagcacagacacagcgguagccucccuccguguuuucacacuucucauucucuccuggacacaccacagucucacacucauccacaucugggggugggggaggggaacaggucagggugcugacugccacaggcuccccgcacagcuccccacggucucagugugcauccuuccuucccuugccucccccauacuc

SEQ ID NO: 3298 - RNA, 102096 nt, Mus musculus
acaacccaacaaaacauaacuuuaauaccgguaugaguaaaaauauuaacaaaaauuaaauaaucuuaauggcacagcgaggaagagccuggcagcaucucugagacugggcuuccuggcagaagacagaagaauccccuauuuuaacuccugauguucuauuucuaauaaauuacaauuauuuuguaugauuauuacaaauauauuauaggcauaauucaaauuaauguggaaauaaaaacuauauauacauacaaagccagcacauguuugauguugucuuccuuccuuuuauauauuaauaaccaaacauuuuaaaaggguaagguggcugagcaggugaaggucuagaguuugaacccuggaacccacaugguggaaggagagagcucacucccauaagcuauccucugaccuacacauaugcacaguggcacauauaugcccauacacauauguacaaaaauguuuaaaauucaaaaguaauguucaagacccuccuggucaacauaucuaauaccacaacagccaggacuauguaaagagacccugacacagaccaaaccaaacacugaucauugauaagaaaguugggucauuccuccaggaagauaacaguacggaacauacuuuuaggccaccaguacgauugcacaaaccucaacucaauauuaccuaauccuugaauaaugagauccuugaauaaucacaucuaaagugaggaaaaagguagcugaggcaaaacucugaaacagauuuauuuacaaagcuauuauaagccuaaauuuuaguuucaaaaccccaaggcccagcuagggcaccugcacugcacugcacugcagcccagccauguucauccuagucaacgauggaugcuacacuggacuccugaaccagggaccuggagguuagacaaccugugaaacccacuggggaauuaaauaaacaccccuucuugauggacaaacaggaugcuucugacuagaaaaacagacaucugacuucaaaccccaaagagaugagagucugucagaggugagcagggcagccaugccacucggcucuaacuggagcugucgucacuuucaucacuguccugguccuucuguucaucacuugcuucaucuuccccauccuaagggaaaggaagaaaaagguacuuuaggccagugcucgagacacugcucucacagauguacacuauaccacuuuuguucuuacaagcagugaaauuuaaaauguucuaagcuaaagcagaugcccgcuuccuguuuucuuuuuuuuuuuuuuuaagauuuauuuauuauauguaaguacacuguagcuguucucagauacuccaaaagagggcaucagauuucauuacggaugguugugagccaucaugugguugcugggauuugaacucgggaccuucggaagagcagucgggugcucuuacccacugagccaucucaccaguccucuuuuuguuuugagacaagaucucacauagcucaaggccucuuacacuuguguugccaggaaggaccuugaguuugugagcuuucuccaccuccaccuucuagugccuccaagggcugggauuacaggcacauucuaccauacuuagccccccuuuaaaaucuaaagucuaauuuuuuuuuuuuccagacaggguuucucuucucuguauagccuuggcuguccuagaacucacuuuguagaccaggguggccucgaacccagaaaucugccugccucugccuccugaaugcugggauuaaagaugugugccaccacacccaaaaucugauuuuuugagaugggcucucauguggcucuugacuggucucauguggcucucaucuggcucuugaccugccucugccucccuugugcugggacuauaggcaugagccaccaugcauacuuaguccccucauacuccauaguuccugacaugaauuauagcccaacgccauggagaaagguuuugguuuguugaaacagggucucacuguguaacucuaacucaaaauuugcuaagcaggccaggauggccuugaacccaccaagauccaucuaccucugcuucccuagugcugugauuaaagguguaaaccaccacauucagccccaaagauaauuuuaauacuaaacuauuuacaacugaagcaaaucuguauguucuuuaaauaaaccaaagcucucuagcaguucaggcauaaaccauugaaacaaagucacauuaucaauucaauauguagagcaagccuucauaugguacaacucugaaagauugugaguucaaggccagccuugguuacauagcaagauugugcauacauacauaaaaggaguagacaggcaauaugcuuauguguuguguguacgaagcaaagguuaucacgaguucuggcguguaccagcaggagcccagggugaaacugauuugcuccuccacgaggacacauuauuauguaguagaagccuagcacacugaguaccucagaucccuaugagagcaagcagagaggcccauuauaggacgaaaauagagccuuagaggcagacuucagaaugcacagucuuucugugcacagcuucuagcuaaccugccugguaugcaauacuaaugcaaaaccugaugcacacauucucuguagcucacuuuaaaucugcaguagcguauguccacagggggaaaggugcauuuauaugguuuuauuucuguuuuggcagcuuggcucuaggcuucugcuuucauguuucuauuuuauuuauuuuuuuuuuucauuuuuuuuuuuauuagguauuuagcucauuuacauuuccaaugcuucauguuucuauuuuauauguuaagacaaguugaggggcuggagagaugggucaguguuauuaagagcacuggcuauucuuccagaggauguaaguucaacaucuaaaaccacaugguggcuugcagcucuaauuccagucccagggggccuaacaaccuucuucuggcacccacagguacugcaugcacacagugcauagaaaaacacguauaaaaauacucauaaucauucaaaaaacagaaacacacaaagagacacagacaggcagacagacagacagacagacagacagacagacagacacacacacacacccucugaaaugcccuggcaugguaguucaugucuuuaaucucagccuuugggaggcacaggcaggcaggcaggcaggucucugugauuuuaaagcuacucugauuuacacaguuccaggucagccaagacugccaaacuaacaaaaguuaagacgguucaacucauucuuaacagucaacauucucaucacuucuccauucuacaacacuuucauauacaagaucacagaaugcagggugcuagauuguuuguaccacuuugguuuugguacagaggauugaaugcacaagacugcaaaugcuaagcacauacucuaccacugagcuauaacugcccuuagguugcaaauuuucaccauacuuugagaggauguaacugaauuuuauggaucccaaagcauucauguaagcuuuuuuuuuuuuuugguagggaauggagaugggcacagaguuauuuaacaacggauacauagagaaaaauccuguacuuucugcuaacaaagacuacuuaauaaaaugguccaccaaugcuagaccagccuguguagauaccucuguugcucuguuccuggagacgugagaugucacgccauccucacuguccucugcauugcucucugaggaagagggauccugggaaauaauuucuucacccuaaucauagaagaagcaaaacaaacaguggaucguaauaagcaccuuuauggcugggguuggcugaguuucuagguauuagagaagcaauauucuagcccuucaaccucugaccuaucauucagggaagaaccauucaguuccagcuuuuugagaugcccauggaaaugauacauaauucuccguccauuuuuguauucuaguguuacgcuagauuuuauacuacauguuguguuggugacucuguuaaugccaaauaugcaucuaaauugccccaaaggcuaagucagaacuuagaagagaaucaaaguuugugguuaauguggguuacauagcaagaucuuuuugccaaaacuguauuucucagugccucacauaccacacaccaaccacagaagccaggcagagucugaggaguugucuggacucagauccuggcuccacuaacucagugcuaaauggucugugaaaguuacuauccugagcuucaguuuucuccaagaaaacaacagaauugacgucauaaauuugauuugaagaaagaaaaccacucuucuauucuuugucauacaaucaucauacaacucaaagaggcuggagagauggcucggcagcugagcguuaguuacuguuuuacaugagacccagguuuagugguagcucacaacugcuuauaacuccaguuccaaggaacuugacacuuucuuuuggccugcuuuagauccugcauacauggugguacacauaaacucauagaggcacacauacauacacacuuuuaaaaguuaaauuaagccuagcagugguggcacacaacuuuaaucccagcaccugggaggcagaggcaggaggauuucugaguucgaggccacccuggucuacagagagaguuccaggacagccagggcaacacagagaaaaccugccuugaaaaaaacaaaacaaaaaaagaaacguuaaauuaaaaacaacccuuggcuaguauguagaaggacuuggaccuuggaaguuagugguguugaaaucccacagcagugucucauacacacagguccagaugagcuuuuucaguaauaagauagacuccuuuacgagaaaaauucaaaagaaguuuguucauguagguaaauguuauaacucugcucucuguggggcuuacagguguaacccuggcacagagaaagggcugugcugaccugccuccuugguuuugauuuuuugagacagggccucacuauguagcccuuggcuguccuauaacucacucuguagaccaggcugccucugccucccaugugcugggauuagaggcuugugucacgacugcucaguuaaaugguauuuugaaaauuuuuaccuuuauuuuuguguuaugucuauuagcguacugccugcauguguaucuauguaccauaugcaugcaggcccauggaggaguuuggauccccugaacugggguuauauuuguaagccaccauguaagugcugggaauggaaccuaaguucucugaaagaguggcuagugcgcuuauguugugcugucucuccagccuuagagucuuaaacaaccacagauggauaagaguguuuuuccccacuaauaggaauggcaccuaguuccuuacacaaguauucuaccccugaacuguagcuccagccuccucuauuuacuuccaauuuugugacagcuuugcuaaauugcccaggcugaucuugaacucacacuguaguugggcaaaccuugaacuugugaucuuucugcaucagccucaaaaguagcugagauuauaagccugugccaccaggccaagcuaaaagcagucuucuuagaacagugcuuggguagcuucuuguauuucuccugaugcucuuacaaaacccgggacugggagcgcauaacugauuguuuaaacuugaggcuuaccuguaagucucgguuuuugagaguacccaaccagaaagccucucuacaguuguugaggacaagcauggcuuugacucugcaaacuaacaguuccagugacuuuuugaguaaaggcacaugcuuggugagucuuguguccuggcgaaucugaagagaaagaaaucauccagguuuaucaucauguaucuauuucuuguacagaaauguuugaaguucucguaacugaacagaaagaugacaugaccagucaaugaugaacauacauguucaaucaaaaaaguaacaguuugaugaauaugccaaaaagaauguuagauuaaaaacuuaagacuagaagacaaaccaucaacaccucuagugccuccuuuuuuuaaaaaaaauauuuauuuauuuauuauauguaaguacacugucgugugucuucagacacuccagaagagagcaucagauuucguuauggaugguugugagccaccaugugguugcugggauuugaacucaggaccuuuggaagagcagucggcgcucuuaaccacugagccagcucaccaacccucuagugccucuuauaggcucuguugauaaugaucagcaaaucaccccaaggcguuuuaaugauaugaaacaaaaaaauuaggucucaucagcuuuaagccccagaaauuccagcuugguuuuuucuaaacauaaaaccagggaagaaaugaguggcaaaagaauccgguguuuucccagggaccacaagccaguuucuagguuccuucagacaaauguucaagagcuuccaucagagggguucuuguugucauguucucccucggccaccccagucagggucucauugugcaucucugacuacccuggaacucacuguugaccaggcuagccuugaucuacucaccuagacccaccugauucugccucccaagugcugggauuaagggcaugugccaugaugccuggcuuauggaagucuuuuaauaaauacuuagauauucccacaagagacaaccaaguccugaggcugacaagcucucagauggcuggcuaggaacacauccaggcagcaguaguuaccugcuacauaacaguccucccaccacagucugugugugccagcuaauuuuacaucagcuugacacagcuagggucaucugaaaggaggaccucaauugagaaaaugccucuauaagucugagcugcagguaagccauuaggacauuuucuuaauuaguaacugaggugggaggguccagcccauggcugcuggggccacuucugagcugguaguuuuggguucuacaaaaaaggaggcugagcaagcuauaaggaauaaaccaguaagcugcacuccuccauggccucugugucagcuauugcauccagguucccacagggcauuaguuccuaccauggugucucccaaaggauauguaagcuaauaaaacucuuuccucccugaguugcuuuuggucaauguuucaucacaggauuagaaacccuaauagagacugaaggaaaagccauccauccaccuggggauccaucccauauacagucaccaaacccagacacuauuguggaugccaacaaguguuugcugacaggguccugauauagcugucuccugagaguucugccagugccugacaaauacagagguggaugcucucagccauucacuggacagagcacagggucccuguacuggcuaguuuugugucaacuugacaacagucuggaguuaucacagagaaaagaacuucaguuggggaaaugccuccaauagauccagcuguaaggcauuuucucaauuagugaucaaggggggaggucccuuguggguggugcuuucccugggcuaguagucuuggguucuauaagagagcaggcugagcaagucaggggaagcaagccaguaaagaacaucccuccauggccucugcaucagcuccugcuuccugaccuauuugaguuccaguccugacuuccuuggugaugaacagcaauguggaaguguaagcugaauaaacccuuuccuccccaacuugcugcuuggucaugauguuugugcaggaauagaaacccugacuaagacaguccccaauggaggaauuagagaaagaucugaaggagcugaagggguuugcagucccauaggcagaacaacaauaucaaccaaccagacccccagagcucccagggacuaaaccaccaacuaaagaguacacauggagggaucuauggcuccagcugcauauauagcagaggauggccuuuuuggacaucagugggaggagaggccuuuggucuugugaaggcucgaugccccaguguaggggaacgucaggacagggaagugggaaugaguggguuagugagcagggggagggggaugggauagggaguuuucugaggggaaaccaggaaaggggauaacauuugaaagguaaauaaagaaaauaucuaaaaaagaaaaaacaagcaaacaaaaaacaacccaaaaacccuaacucuaggacacuguaacaguaagucaucuaggaguguucuauccucucucuccucucuucccucuucugggcuguccugaaacaguaucaugcauguggccuaggccagccagcuguagugcuaggauuauacaugggcacaaugacacucggguccucagaggcguugcaacaggaaacagcuagaaaauuugagugcaaauauaaagcucuccuuuuugaucccuucuagucucauccagcaacaaaggauuugcuuaaucuaaauaaacuaacugccuuuggacauggaguucaaagcagggagacugaguguaacgaauuucaggccauggcugguuaugcuucauagugagaccuguuccucucuuaccuuggaguguccacaaaggugaugaaguagccucguguucaacugaaggguuugcagcaagcucagaacaucuuccuaaaaauaacagaauucaaaaguggccugguauacuguuauuucaaaugcaagcuguucuugcaaccagggcuccagggagggcaaacucugcagguuccagucugcguuauacucauccuggcccucagauaggagcccugagucagcuacugaucugcagcuucucaaccuggcccuaggaucuauuaacccguuagcuagcaagagcuggacaggcuucucuguggagcacuggcugcccugggacuggcucuccagaccaggcugguaacaaacucuaaguagggagccacgucucaagcuuguauaucaggauacgaugccgccccucucuucuuuuucuaacucauacugccaguguuuuguaaagcucacuuucuagacguguaagaaauucuguaucagggagaucaugggggaugggaaaaggaugagaaggaaauggggugugugugugugaucaaaucaucuuacacacaaacauauaugauguuauaaaauaaauuuacacauaaaccccuuuuuauucucaccaugccaguuccaaguaccacuuggcucuaaaggcauauaucaagcaugauuuagagcccagugguuucuaaaguguuugcagagacacugcugcagaaaagccaagugugcaacagcacaaugaagugccgauuaaauggagcaagcccaaagauugggaagaaggagagggggucugaacagagugaugugagaggcucaguauaccugggcacuucuggcuauagcuggcaugcuguuucuuagaauuggugcucaaagcauagacaacaggacccugaauccccagcccaaucccagcucagaaauacccacagacauccuggcaacggcucuguugucaguucuuacccgaugcuuucuaaagcugaagucgaggaguggcauacauugcuucagaaaugccuccacaaagcgacggccauacugaagggagagacagcggugcugaacuacagcugaggacuuuuacugaaaagcucccagacaaagcagcauaggccaccuagcccaaggguuuauauuaucacugugugcauucaaauaaauuggaagugguccagaaaguuaauuugguggcucuaacuaaaguugaaaagcaaacagaccugcuacuuacauaaauaagcuccagaauuaggcagagucagaaaucuggacagacaacggccagagcccuuguccagcuuagagaacacagugccucaccugcacugaagccucucagcacgacucagucucaaagggagacaugagaggaccaaggcaacacauggccaucuccaaccaaauugcuccuccaagccacucaucuccuaagcuguacaggauagagugaggggaagcgaccaaggacaguaccauacgcuggagggagacaccaggaggacagaagaagcauaacucuuuaguuuuaccaucaaauccagggccagauaggaaauccccauaggagaagggaagggcucugcaauugucagaauaucaaucugacauucauagaccauuccaagguuuuuccauuugucucguggugcaaaggauugaaccugggaaaucccacacacuaagcagguucccauccuggagcaaugcccagcccuggcccugucccaagggaaaccauccaucacuuguccucugcugccuggaaaccugcuagggagugcaggggugacugcugcuauuucuccuuugucugugguagggucuacccuagcagcccuagcugacuguguagaccaggcuggccucaagcucacagauccacuugcuucugacucuaaagguaugcaucaccaugggcuucaugaacauuauucuuaaacucagcugcucuguagcauucaacccaguccuaauauucugaccaaaaauucuacaaagcaugagaaaacugccuccaacuacuguagaaaaugcuagccaccgucuuccuuaccuauuagcauagccucuggcacauaaacgagguaaaaagcaauuccaucuagcugaggccccucggaaaugacccacaggaagaaaacaccucaaacaaagccuaggaaaucuuuuaccuuuaaacacacaugcagaacaggauaacugucaaauaccuggucaggagaaagacaagaaaccagacuuaaggcgguuccuuugaguaccaccuccgccccacugcacacagcauggcugugagggacacagaagacuguaauaugaagaagguacacaacagagcagcagaacgcagcagaacaucaguuacagaagaaggaagcucguaacccaaauccaagacaagccagaaaggagcacaggggaggaagaaauugauuccagcuagggauguggagaagacagcauggcuagaggacugccucucugaucugaaaccuuaggagagacugagauggagaggggagggagugacagcucccugacagcagcuuaagcauaacccagcagcagagaacacagagccucggggacaaugaugacaggcggggauggaagugcucagaccagaggauccgagguaagaugggggcagaaaacggggcugugucagggaguaaauuuuguagugcaggugggaggcaaaaaagaaaaggugaaaccccacaguagccagaagggguuacccaaaaugaacaggggucaugggagggaguuaacagggcccgaggaagggugaggagaacagcaggugggugaguucuggaaaucagaacccuggugucuagguuagcuagcgaggcaggucaggggccccauacuuucaucagauugagaaggaugcugaaaucucggacagccauguuccaauagaggagcuucucuucgugaaccuggggacagucaaacacaggcagaguucugagccacagcccaaugcaaacagaagcugcccucccacuaccacagucuguccacugucucuucugaggagauguggcagcuaguguaugcaucggcaagcucacacacugugggaacaccaguguacacacagggacacaguuacuuccacguagcuacaagccucugcugccaucacaucucugaggcugcugaaucucucaguagcccacgucuaccucagcucugacugggaggcugccaaggcccauagcaucucaaauaagcuugguguucuucaagccagguaguggcaaacugggcagaaacaaggggaaacggcucaguucucaccuccagcuggagggaaaagcaaucaaagcggagcuuucugaaagaacuccuaggucuuggcaauggaaagaaaauagcuuaggagaaacucuagacccaagagacaaaagcaucaaugcccauguaauccaaguguacuuccuuuugaggggacccuugagucaccugcugcgaaucugcugcugugccagccugaagacccuucaccgucuucucgaguucagccaucaucacacggaagaauaugacaaaggugugccuauaagggggaaaggcaugaauacucacaugaugcacagcuuacaaaacacucccagaaaguucccuguaggaagaagccagaagaccaacagucacuucuaccucugucucugaaugauuaaguagggucuacugaaagaagggaguggaaagaagcaagaaaggagcccagaagauaacagugagucccgagcauguacuggguucagcauaaaucagaugagcaucauggugcaugucugcaguccuagcaguaaggaggaagagcacggcuaagagaaguuuaaggucaucuugacuacaaacguaaggcuagccuagacuagaugagaacagggagagagaaagagagagagagagagagagagagagagagagagagagagagagagagagagagagagagagagagagagagagagaacauacacacggaagcccaagcuaaagcaaauggccagucaaacagugaggcuagcuugagaagugguaccacagugcaggaagcagccaugauacaguggggaagccauauuuauauuuaaguucucuucacugauuuuaagugcaaagauucuaaccuucauuuuccucaacaguaaaacagugguaacgauaucucuaccuuacaggaaucaagaucaaggaaaaaguaacuauugauauuguaagauacaaaggcauagagacaaacaucagauacaauaaucaacccuuucaaguuggcuaaaauauuagaaagauggucuuuagcuuuguguguguguguguguugggagaugaacccaggccuuaaauaugcuaagcagucaaacaauaguuccuuaucugugaaaaguguuagugacauuacauuccuacaugagguccuuuuacaccauaugacauaguuugcaucugaaagacucagaggcucaugauuugagcauggcccuuagcuagcuuacagugcuauuuugaaggcuacagagccuuugggaaguaggccaggcuuuugaagguaacaccugccugguucuggguucuggccuguuuacucuaguuccuguucugagucaugugagcaugcugcagccucagacucuugccagugaugguggggcagcuccugacaccauacuuggcugucacacugggcugaaagugcccuaaaaccaguacguccgccucagacugcaucugucagauacuucaucagcgaugagauaaggauugagggcauuuuagaaagagcacacaguacgauuuauacugcaaaggaucggagaguuuucccucaagauggaggacaguggagcaagaaaucccuuaccuggucaacguagggaauguagaggaggcggcgucuuucggagcacugaccaguucugggacaccaacaccagugaucuccucuauggccuucagaacauugucugugugcuccaaguagaugcuuuacaaagugucagaagaauagggacacacauuauaggauuccaaaaucugcccugcuuccuggcuaccaugcaagcaugugugcuuccugacaagcccccucucugacagacaauggaggcgaaugaccaggaagccagacaaaccuccccuccuuaaagcucauuuucucaggaaucuugccaguggaggaaagcugacuaacacaguugccaccuacaagcauauucagcaucucuaguuacccugugggaaucugugaaggaaagagagaaaaagcagccaggagaucaguggugagcggucaauuucucacaaauaccugaccaaguuucgaacguucaagacuuggagccaagccugguagcacaggccuguacucuguccaaacuaccuggaaggguagaggcaaagggaucauagugcaaggccagcuugagacacaggugugugugugugugugugugugugugugugugugugugugugugugagagagagagagagagagagagacagagagacagagagacagagagagagacagagagaaggaaauucaagauaugccguaggaacucagguauagcacuguuaaguauauuagaacacgagugcuaauaaucaccaacaauaauaaauguuucucuuuuaaaaguuuuuuauuuuauguguauuggugucuugccugugugugugugagggcuccagauucccuagaacuggagucacaggcaguugugaccgccaugugggugcuaagaauugaaacccgguccucuggaggagcagccagugcucuuaacugcuuagccaucucucuagacccaagaguaaaucuuucuaaagccaaaaaaaaaaaaaaaaagucuuucaugagaugcuaccauguagcucuggcuauacuagugacauucacuuuuuuguuauuuuuaauuuucaagauagggcuucuggcuguccuggaacucacucuguagaccaggcuggccuugaacucagagaucuuccugccuccaccuccugagcgcugggauuaaaggcgugcacuuuaaucauucacuuuacuaacaacaaagaucccaaaugauugucaagaaauaaguaaauaaaguuaaacacugucaaaggcuggagauggcucagcugcucgcccagaggacuuggagcaauucucagcacuugguggcucaccgacaucugaaacuccaguuccaggggauaugaugcccucuuuuuuuuuuuuuuuuuuuuuuuuuuauagacaggguuucucugugaagcccuggcuguccuggaacucacucuguagaccaggcuggccucgaacucagaaaucugccugccucugccucccaagugcugggauuaaaggcaugcgccaccacgcccagcuugaugcccucuuucaacgugagggcagaguauacgcaugguacauaaacacgcagccaaacacccacauacauaaauuaauaaaauggaaacaccaagagccagguggauggugcacaucuguaacuccagcacucacgagguguaggcagaagaacagaagcucaaggcucuccuuaguaacauggugaguuuaccucaacaagccaaaaauaaacaaaaauaugcuuagguacccugggaguaauggaugugucuuagacacagugggcaguaaguguauuugacucacuauucauauguaggacacaacuguagaccuaauuggauuuucaauaaggaauuaguugacagcagccaacagaaggaaaagcuuucuuaggauccaaacuccaaacugugcuccuuuuagaacaucagcugcuuucacguucuccucucagaggucacggcucagucccuaacuagaugagagaucccagcaacagcaaaaugggaaaaugcaauccggcucccggaagaaaguaaauaacucacuaaagcacaucaugcagguggucauuaaaagugggguucuucucuuuuuccccaugaggccaugcucggcaaagcagcuguuuggccagagaggcuguuggaaaacaaaacaaaaaacauuucacucacgcgaaacugaccccauucuuuuaaaaacugcacuuaagaacacuguuguuaacugagugucguuguucacuuacauugcuagcacuugggagaccgaggcagggaagauuacagugagugcggguuagauggggcuucacagacacugacaacccucuccucccaauucacugucaugaucguauguguuaauaggguguagugugacaugucaguguguagugugagcgaucagagaagcacacucuuauguuucagacgcuggggaaaggaagaguagugaucaaaaggauuauuacuuuacuuuuagaagguuuaaagcauauuuuaaagggaguuuuaagagcuaugugugggugcaaguaucugguauaaccaugugcaucugacuguggggccuucagaggccagcagaggccuggagccucugaagauggaacugcacgcaguuguuaguugucugcaguaauguugggaauugaauucagguccccaaugagagcaguaaacauucuuaaccguugagccaucucagcccuaacaagcacuuuuguuuuuaggacaguguuucaugugggugcuugucuaguuugcagaaaacucuggguucuuugcccagcaccauauaaaaccaggcacggugacccaugccuacaauaccagcacguagaagauagaggagcuuaggaaagggaggcucagaaguuugggugcaucuuuagcacagacagcaaaucugagccaacccaggcuucaagagacuguuacuacaaaaaaacaaaaaugagagcauuucacuggguagcauaggcuagccucaaacucacaauucuccuucagucuccuggguaaugggauuauaggcagacaguaccagcccuggccuagcagucaaucauuuagaaagucaauuuguucuuguuccauuaacucaacugccauaagugaaaccaugugucuaagacuuaaguaaacccuauuuacuuacccuguccugaagguccuguuuaagaccaaaauccuacuuuauuaauauaaauauaggaaagauuucuuucacacauuaaucuugcuuuuuguuguaccaaaacugagaaagauaguuagugauuuugcauuuuaagagcucucacgcuaaaggauaaagaaaaaggucacaaguuccagaucccuagagaagggugacaggugacacaugaucuguacucucagaacuggaaagcccaaggcaggaagauguggaguucaaagccaacuuagcuacauaguaagaugaucucagagauggggagagaaguuuggagagagagagagaauaugaauaucucaguggauaagcaugaaaauggaacaaugcacacaugcuuugaaaaggccagcacucauuuccuugaugcuugugauuucuuuuucuucuacuuuuauccacuucaugguguguguguguguguguguguguguguguguguguguguguguguguauaccuagcauaugagaacagccccccacaggcucauauuauuaaauauuugguucacagcuggugaacuguuugggaaggauuagagaguguggccuuguuggaagaggugugucacuugugggcauggagguuuccaagcccaugccauaugcccagguagcuuucuugguggccuaucuguggaucaaugugugagcucucaacuacugcuccagugugugccacaucugucugcccgcugccgugcuucccauuaugauagccauggaucccaagccucugaaagugcaagccugauaaacucuucuauaagcugucuugguccugcaacccucccagcauuagaaaagugcauaaguagcuaaguagcuaagacaaggaggaagccgauuaggaagacuuaugcaggggaugauucuaguacuugggaguaagaagagguaggauugcuacaaggccaagcuuagccuggucuacacagaguuccacacugaccauaaauagauaagaaaccuuaaaagaaaaaggugaaagauuaaaaaaauauuaaacagaaaauuacuaaggauggagggcagagcucaauaguuuagaauaguuuggguuuaauuccuaguacaaaagaagaaggaggaggaggaggaggaagggggaaggggaaggggagggggagggggaggggguaagaaggaggggaagaaggggaaggggaaggagaaagguggaggaggaggaggaggaggaggaggaggaggaggaggaggagaaggagaaggagaaggagaaggagaaggagaaggagaaggagaaggagaaggagaagaagaagaagaagaagaagaagaagaagaagaagaagaagaagaagaagaagaagacgacaacaacuuggggcuggacagauggcucaaugauuaagagcacuugcugguuuuccagagaacuugguuuuucccagcauucauugggcgacucauaaauguaacuccaguuauaguggaucaaaugccuacuuuuggucuccaacauguauggcauacauauacacaaaacacuuauacacauaaaauaaaaacaaaauauauacaucuuauuaauuaaaaaaaacugaacaaacaaaaacaaaaaacaaacaaacaaaaaaagaaaacuguccagucaauuaaucuaaccacagguacacuaagcugugucauagccugcucuguaaacauggucuccuugguggagcaagaaggcacgcuugugauuuugugggauuuacauguaaaaaugcucaaaauucuaagaaaacacaaauuuugcaaauguaagacaucaauccuauucacauauuccccuucccccgaaaaagggaucaaggcucaucaccaaguuuuucuuucuucugguuagguacugcagacuucuccagaagggccaucagaagucugagaagguagagaccacacuggaaacugggaacacuaugguggaaguucugcaaguaacugaagcucuggcuguaaagaagcaagaaacaaaagaacccgcauagcaucacaugcauuaaagauguuuucacaugcacacaagcugccuaaguugucucuuuauaaagaaagcuggguagacaaaagcuacauggacaaaauuauuugcuauuuugggcuguuaugggguggggugaggaagaccucauaaagaauaagcuggccuggaacucgacaggauaauauggaaugggaugugacaggaugggauaggacuggcaauuagugucaacuaguugcucccuacagagucucccugagagaagacugagagguccucagauaaucuagugucagcugaguuuuagggagugggagugguggcucgugucuggacucauaacaguaaguugaaguaaguaaguugaaggcugaggcaggagaaagcugcauuuggggccagacaaggauauguaccauggccuguuucaaaaaauucaaaaugaggggcuagaaaaauggcugagcaguuaagacacuugcuucuuuuccagaggacauggacacacacacaaauaaaacauaauauaagaaauagggcugaguaugguauuguaugccauuaauuccagcacuuuggagacagaggcagguggaucucugugaguuuaaggacugaggacagccaaguuuacaucaugaguuccaggcuaacaguuacauaaugagacccagucucaaccaccccccccaaaacaaacaaacaaacaaaaaaccuuuaaaacaugaaaaaacaugguaaggggaugucaacauaguauagauuuuuuucugagagagugaauguuuuccaaaaauauucugccaauccaguucgaggauuucuuaaggacauccuaggauguucagacccaccugaccaguuccuccaagggcugguccuguuccaucugcuuuagucgguucgagaggaccucaagggcugagugcaggaggcggugcuuugauuggugaguaaaucccuuccuaaagcaaaguugaaagcagugggucagccugucucaggaggaucacucggguaccaacugaggacaaagcaaauacuaaaaacuaaaaaauaauuuaaaaauguuaaugggggcuggagagauggcucagcaguugagaguacugacugcucuuccagagguccugagcucaauucccagcaacuauauagugacucauaaccaucaguaaugggaucugaugcccucuucuggugugucugaagauaguuagagugugcucacauauacaguuaaaaucuucugccugccuuucaagagucuacauaaucugaccccugcauccuuccuaccaacaucuuccuuuuccuuucauccauucuaugugccugugccugcucguguguguguguguguguguguguguguguaccauuaaagaacacgccuugaugaacugucaaugcaaaucuaucaucaggcauugcuuuuuaaguacugaaaauauaaaaaugacuagcaccugccauguggagaauguuauaagucuaacaaggaagaaaauuuaacgcgcaauuuuaacaaaaugugugaaagcuagaccaggagagaauggcagaguguuagaagggagcugagggccaggaaagaggguuaccuaguaagguuagagaagcugaagagacucaguuggaggguauggaucaaguagccagggguccuguagaaggaugcguguaucugaaggguucuggguuacaguuaaguaggaugcugaauaacucaguccagcugugagacugggugcaagacagacgccagacaacaggaggugggaaaaggcaggccaaagggucagagucaggaaagccuagcagcugucagccaucacaaccgagauggacagagaccaacugugaaacuaggucagauacgguggaaggcuggaaguagacagagaugucuaguuagauaaugcaaucaauagaauuuaggguuacaugugggaaagaguagaaagauggagccaaaagaauaacuccucguuuuggcgaacaagagugaugauggcauuuucaugcgaggcgaagccggaggaacagugagauuaugcgcagaacuggaugugaugagucugaggugucaaucacauccaaggggguguugaguaggcagauggauacaaucuugcucauggcucaaaagagaagauuuagcauaaguuuaagcuugaguaaaauucuccagaaaaccuguuggaagaggacagaugggauaaggcauggcugaggaacagcaauacucagggaaaugccuuuauuucuccuuucacccaugcuaugccuccaacucuuuaugucacuaaacccaacuccugggguucaauggagugcucagcaggugaaggcccuugcugccaagccugacacaacucggcucugaucccuggauccacuugguggaaggagaacauguuaguguucacacacacacacacacacacacacacacuacaauauaaaaacagauuguggcccgguaauggcacacgccuuuaaucccagcacucgggaggcagaggcagggggauuucugaguucaaggccagccuggucuacagagugaauuccaggacagccagggcuauacagagaaacccuaucucgaaaaaaccgaaaaaaaaauaguaauaauaaaaaauuuuaaaaaauaaaaacaaaaacagggcuggugagauggcucaguggguaagagcacccgacugcucuuccgaagguccggaguucaaaucccagcaaccacaugguggcucacaaccauccguaacgagaucugacucccucuucuggagugucugagaacagcuacaguguacuuacauauaaccaauaaauaaaucuuuaaaaaaaaaaaacaaaaaaaacaaaaaaaaacaaaaacagauuguguuauauuucuauccuuauuuuaagaaccagguugaagagaaggcucagcagcuaagagcaugcucugcucuugcagacaaacugaguuugguuccuagcacccucaucaggcuguucacaaccaccugcaacuccagcuccggaagauccaaugcccacuucuaaacucugagggcacagacagagauauacauaauuuuuaaaauguaagaagcaaaauaaaaggaccacugauucuuuaaaggccgaucaagggcguggauguagcucaguugguagagugcuugccuaucccgcaugaagcucuagguuucauccccagaagcaggucuagaggcccaggucuguaaugcuaguacucaggaaguaggggaagggugaugagccacacucgcagcgcguguucaaggcacaucuaugagauccuguuuaaaagccucaccaaaugcuauagcuuccaugguauccccaauauuccaguucacagugugcucacuuuuaaccacauaaagagacuucagauuuguucuguuagcuaaucagugagccccuaauuuuucaaacugcucaguaacaguggcucuguaagagucagugggcuuacaagaaaauagaaaagaagaaagcacccaggaagggcuguauccauuuccuucccuucuucccuucgggaauacucagaagugaaugcaagcacgcacucauugcacacacucccacgacaccaccuccccacacucaccacgcaaagagcgcgugcaagaccugcagcagcuucugguagcagcaggccauggugugcugcuccugagcugucgcucucgccuugucaucugcacugagaugcucagcaccuaagcacuaaauagaaaagcgguuuaguccaguugcugugcaagugcucucacucccccucaguccuccucaguuaagggacucuuggcaguuauugacagacccacaaacacaagccugccuguaaguuaacaauucuuuucuuuuuguccucucucuuccuaaaagucccaaggccugcuuguccagccacccugaagaccacguucaagcuaugaggucguucguacauuuguacuaccccgucugccugcucuccugaccucucacgcagaagguguaauucuccuccucuggccucuucccaugcucugcccaccacagcuugccugcccgugcucacacggucucucagucuucucaccugaaagaaguugugaauguucuccagaugguuacacaucgggguuagcagcugaaccacacagugcacaauguccuggacagaucucugaugaagaugugagaagccaauauucugccuuccuuuauucuacaauaaauuucagaguuauaagagaaaaaaauggauaaauuauuucaauuaaucauuagcuaagaguucaaaguuggggaggggggauggcuggagagaugucucagcgguuaagagcacugaguucaauucucagcaaccacaggguggcucauaaccaccugugaugggaucugauguccucuucuggccugcaggcauacaugcaggcagaacacuguauacauaacaaauaaauaaaucaaaccccacaguugugacucuaggugggagucggcaacagaggugauuuacuuuccuaacuuaguuaagaugauauuauaacaaugaaguaaacacgauagcaaaagaaaaaaaucuuccuuuaguuuuaaauaccugagaggauggauacuguagaguuagaacagggucugauuaaaaaguacagacacagcugggugugguggcgcacgccuuuaaucccagcacucgggaggcagaggcaggcggauuucugaguuugaggccagccuggucuacagagugaguuccaggacagccagggcuacacagagaaacccugucuccaaaaaaaaaaaaaaaaaaguacagacacggggcuggagagaaggcucagcagguaagagcacuugcugcugcugaagaggaccugguuuguuucuuagcacccacagggugcucacaacugucuguaauucuaguuccaggagaucugacacccucuucugaccaggcagagauauaugccuuuaaucucagaagggagacggugauaggaagaucagaacuuuaaggcaauuuucagcugcauagugagcucaagucuagccuuggcucugagagacugucucaaaacgccaaaaguacagaccaucauaacuaaugaauuugggcgcaugcauacagaacaaacaacacacacauacacacacacacacacacacacacacacacacacacacacucgcaugugcuaccaucugcaguguccaaguccuuccccauaugcucagcacuuuuguacuuucuaugucucuauguuuaggacacuuagaaauaaauuuauuguauuaggaucucuucaauuuuuuuuugagaaauacacacagacacacacacacacacacuuggugugagggauccagccuggacuuuuaguauguuaggcuacagcccagucuauacagggcaaggcaacuaugcaggaaugccacuguguuaccuaguaaaucaaacauagcaccacguuacucucagccgacacccgcuuguuuccaaguuuccugggaagccuaggccuaugcucgcgccacuacuuaccuuaaagcagcagauucucuuggcaaaaggagcagucagcauauucucuagcuucugggaaagaucuuccagcaagaagagcagcucagcaggccccagcuguacgaccucuguagccugagguguggaauguggagaacaacuucaaucauguccuacuuauaguuaucuucaguguauuugaugcucgucucucccauugggugaaggacugaauuggacuuuuaauuuaaaaaagaggaaaugagggcuagaacaaagguucaguggacaaagcacuugccacacaggcagaacgugugggguguagaccccagacccauguaaaagguggcagguacucuaagcgcuuccccacccaguccucuccccaguuucugcagggcauauuucguuccaccucuucacuccugcucacuguggcgaaucauucgguaagagcacagcaagagacggaaugggggaaaugucccaccugcacugcucauucaauacacuuuuauggacucuucuaugagcagauugaugaagaaaaacuucaaaaaauuaaagaaaagcacacacacacacacacacauacacacacacucacacacacauacacacacacucacacacacauacacacacacacacacauacauacagacacuacugauuccauucuaaaaaugccuacauuuuuccaacuauuaguuaaaaaaucaauuccauuuuaaauaucuuagucugcggaaauuuccuucucuagugaaaauccuuaucaaaggucaccuucucugugaaaauauucucuauucucaacuuuauuagaaugaacacucuuuuuuuuaaagauuuauuuauuauuauauguaaguacacuguagcugucuucagacacaccagaagagggcgucagaucucauuacagaugguugugagcuaccaugugguuacugggauuugaacucaggaccuucggaagagcagucagugcucuuaaccacugagccaucucgccagcccccaagaaugaacacucuuacugaaguucagauauuaauacaguuuugggcagucaucuccaccuccuguucacuugaccagcugaagggaagcagcaaacugcgcaugcgacugcacggccaggucuaggugaguagucaacacaaacauggcaucuagaauuaucuguucagugcugaacaaaggucaugaaaauggaaagacaauacugacuucucuaugccucaauaguccuccgccaucuaaguucacucagugcuuuuaccugguaaccuguagggaaggaucaugucaccaguacugugauucauaaccugacacacugagaacaccugugaccugugaacaaccagggugauaaggaugacugcucacucagaauucauacggaggccucugcggucagaaaccauccuucccuucacuguggccccuucguccugucugucaucccucucacaaacagcucccacugcucuccacucgacaacaacagucccaucuuucaaauccauucuuuguugaggcaaagucucuguguuagccccgacuguccuugaacuuacucuguagaccaggcuggucuuguaucugcuuuccucugccucccgagugcuggccuuaaagucaccaugacacggggcccaaaggcuugaaauaucuguguucuuggaacaugaacagaacgaggaccuuccuaaaagguuagguucugggaccccagacugucacuuacuucagugugcauuucagugucuaagaugaacuuggucacaaguccagaauguagaauagagaagaccucaauguccagcucucggaaaaaagcgcgguaauucugcagugacacaaacgucuuuccuuccuucccuguggacuccuggaggaagaggacgggcauacaaaagaacaacucaauagaacuaaagucucagauauuagccuaauuaaaaaaauauuuuguugggcuugguggcgcaugccuuuaaucccagcacucgggaggcagaggauuucugaguucgaggccagccuggucuacagagugaguuccaggacagccagggcuacagagaaacccugucucaaaaaaaaaaaaaaaaaaaaaaaaaaaacccaaaauuuuaaucugauauuauuuuaaaacugugugugugcacuugugagugcagaggcacuggauccugcucaagcuggcauuacaggggaguuacuaaacacgggugcuggaaacugaaauccuauccucuggaagagcaguaaguccucuuaaccacauguccucagccccucaaaucuaauuuuaauuaacauucuaaaguccaauacacauucauguuugguaaaaacauucuaauuuccuucuaucaccucauuccuuucacccaauuguccaaucacugccaagccacagcacuagauguaguguagcaguuuacaccaacacuguugggugcuucuacuuacggaugaacuauuagguaaauaaaagcguguggaguguccagaaagcugugaucuuaaaggcuaggacaaucugauuucaagccuuagcucaagugcacauaguaugucugugagcaagucuuucacuuacccucucuguuuauaaacugccuagugaauuaauauagcuaugaacauuagcaccaaccuuggacuuuuaggauguuaguggagcuacacauaacgaauuaaaagaaugcaugguagguguaaaacaaacugacauccacgcauccaggaaacuucucaaacauggcacuuccucugugaaugccacagggcagcaacucaucgacuaccagaaaccauaguaagcgcuucaaaaccauucaccgcguggccacucagucaccgcguggucacucaguugcuaugccuuuguggcuuuauaguuucuguuacauuuuauuuauucucucugugugccccccacagcccacgugggaacuggcucucugucuaccaugugcguucucaacacugaagucaggucucaggccugccagccguugccucugcugcuugaaucaucuugcuaacuauauuuuguuuuguuuugguuuuguuuuguuuugagacaaggucuugcauauagcuuagccagccucaaaugcaugaucaucuuccugccauccucccaaaugcugagauuauaggcaugcacaacaucuaggucacuaaguuuauggucugggguaaaaagggggaaagccaaaagcaguauauauaaaagaaugccacccugggcguggaaguucaugacugcagucccaacacaaaagacacuaagacagaaggaucaugagucugaggucaggcucugcuacccagugagacccugucugaaaaaccuaaggcaggggacaguguauccuaagauucaaugagauaacuauuauaacagaguccaaaguaguacaggggaguaaaacacagggguaaagucuacagaagauagagaaaaagcgccacccacacagcagcaguaaggacuguucuuugacuucuguggcuaugaucaaacacccugaucaaauuaacuuggggagaaaagggcucacuuggcugugggucuccaggccauucuccaucauugagaaaaaucagggcaggaacugaagcagaggccucagaggagcacucuugcuggcuugcucucuggcuugcuuccuaucacacucaacuagcuuccuuaaagggcccagcacacuugccuagggauggugccacucauaguggacccaucagucaucaauuaagacaauuucucacaaaacagcugcaggccaaucugaucugagcaauuugucaaccgagguugccucugccuaagggaccguacuaguuucuagugggaaacaacaaccaagaguuuagagaucaguaagaacuguuacucgagggucauccugaggcccaggagacgucauuugccucccuucccauuuuuuucucuuaaaagcgugcagaguauaaggcuagccucauucucacugagcagucauaaaccuuugucacacacuccaauaccuugucuacguggcuucucccagauggcgccaugucacacucugaagugucuucuguuagaaguguguccgaacaggaugcuuuguugcuaucagcuuuuuguuucuuucccccuauguugcaaagagagaaaugacucaaguaauuaacaagcacauguugccaaauagggcccugcaagaaaggaggaggaaaaguuuuaugauucaagcuacacagcauugcccauaaagaaaccuuucuaaagaaaaguuugacagcagaucuugcuagucaccacucaccaaccaacugugccaccagcccucuaucuuuucaaauacgaaugcuaugauacguauaacccgugagguuaauucaguguggcgcagaugaggacaggaaaggaauauacucacccgucuuucccuuguuucuguuuuuugcugcaacagcagaacugcuccuaggcaucauaucuaaaguguccaagucaacgcuugcgaaaggcggaacauagucugggaugacugaaacagaguaggaggacugaacccaaccacagugauccaaauacccaaacccccagaaacaggucuucaaaaucaccacccgcagcagcgaagccugugaugccuacgcuccagugauucaccugaugugguuugggcacagcaaaaugcagagcuuagagaaauucuauauuauagugacugauaaugauuaauuaauacaaaguuauuuucaauaaggacaugaaauaaccaaccaagcaaaaagaagcugaaauaucacuuaaaaauccaaagauauuggcauauggucacacaucuuucuguuuuauauuccauuauuuaagaugagagccucaggaaagcuucuuauuuucgcuacagaaugaaacuggcauuuuuggcuucuuuguuuuugugucugucuaucugucucucuaggacaggaucucacacugagcccuggcugguagugaacacauagagaucaccugccucugcauacaaugugcugagaugagaaguuuaacacacacucagcccuaagcuagcauuaaaaaaaauuuauuaauguguaugaguauuuugccugagcauauaucugugugccaugugcaugcuugguacuccgagaggccagaaaaugguacugcauacuguggggguggaguugcagacaguugugagcugcuacauggguacuugggaugaaacuccucuagaagagcagccagugcuccuaacugcugagccaccuccucggccccauaaacuagcauuuuguuguuguuguuuuguuuuuuugguuuuuugagacaggguuucucuguauagcacugguuguccuggaacucacucuguagaccaggcuggccuggaacuaagaaauuugccugccucugccucccaagugcuggaauuaaaggcaugcgccaccacugcccggcuaaacaaacauuuuaaaacaaccaguuaaguuaauggucagaggaaugaaaaggccuuuaucuuuacugcugguucauggcuauauuuaagaagaaaaggguaccugguccuggaggcaggcagaucucugugaguuagaggccagccaagucuacaaagugaguucuagacagccagggcuucagagacacccugucuauaaauaaauacauaaauaaauaaacagauagauagauagauagauagauagauagauagauagauagauagauagauagauagguagauagguagauaaauguaugugacugcucaucuccucagcaggacaccgaggcuugcagcauggcccuucuuaccugccaaguacuucucuaggauucccugaaguucuacaagguccuuuagccgacuaagaaccuugcccuucaucucaggagauguuuguuggcagaaggcauucacaaccugcaaagcacaacuucucuucauguguggacacuaaccucacucgcuuuacuuccccagggaugaaagggucuuacgccacacuagguaacuuuuaauauaaagcuuaugagccugguguggugguuucugucuauaaaauuccaauaguggggaugcugaggggcauugccaugaaucugaggccaauccagucuacacagggugauguaggccaaccaaugagacagucucaaagaaacaaagauacagugcagcagcuagaucuguaagugaaaugguagcucauacacagugcuaaucgucacgagaagaacagucucauagaacagacaggcguuaaacuccaugugaggcugaggacgacuccugaccaaccugucucaaccucccaaggugguggagcuagagacagguaugagucaccacacccagguaugugguacggggacagaggcuaaggcuucaugcauuacuguguagcugacaauccgcagcugucuauguccuagcauucucgggaaaagaagaguuacagauggagcacuuguuuaaaaacuaccuaaaaauucaucuaaauucagaaagucaaaguuuaggagaaaaucugaauuuguguguguguauguguguguguguguguguguguguguguguguguguguguguuugcaugugcacaugaacauaggugaccucacagaccaggaaagcaugguguuggagugauugucagcugagccuccaaugccaacaguaggaaccaaacucuggcccagaagagcagcaaagcagccucggccacuggcuaccacucuagucccauaaaguuuaaaggacaaacugacaagaaaacccuguuacaauccugguggaaaguaugacugagugauggagagcuaaugcagacugucauguagcaguguucucccuggcagacguaagacaccugaguuuuaccccucugcuacucaccacucacuaugcacuuaggcagaauaucagagagcgcguauguuagcagaucaagucuuagucuacuauuuauuucucacgaugcuuuggcagggucgguagccuuucuaagcuuuugcgucuuuaccuauaaagugggagcugaauaagugugaaguacaacacagccaaagcgcagggaggcagcaaugaggcgcugccaugaccgacguccucaaaaacacuccgaaggaaggaaacuauacccauuucucccugcgagcaaaaagcaagcaggggccuguagcaacagagugggacucccagcacagaagagaggccacugucugcagaagugggagugcagggggccugacgagucagcucuacagugagggucuaaguacucugacggggacagcagcagguaccaaugggcagcaguggugggaucucugcuucggccagagaagcacaggcauuggugcaucggagagauguuuauggcguuuaugggagccaagaaauaguuuucuuuugagagaaacuacagacauagugaaacauugcaguaacugcucaccucucggaaccaguugaaaguuaggaaugugagcgaacacauaagcgaacggucuuuagcagacauggacuccaguuucucuccagguuccaggucagggaggaacaggggacaaucugagaaagaacaaaugucccacccacauuuagcucaaggcagaagaacacggguccuagcuccucagcuaccgaccugucccuuaagcucuuaugagagucaagcuuuguuuuauuucaaaacgccuuccacuuuggugucaaaagaauacaucuacacucuuuaccccaucuuggcaccuggaagccugauggaacaggacuucuaaaaggcaaguaugucuggaaggcuauggugcaaggcccuuuuugcuggcuaagaccagggucccuggaaccaaagaaagcacauggcucuucuuaagacuaaagguguuuaugcccaagauaaacugaauuccucuaugaccuuauguauacaaaucaaaaacagcacagugacuccuggaggcaagccaaacaaaaccagaguaauucaggaaacagacacacaguucaugccaaauuccuaagcggucuuccugcaaaggccauuggucacaaaauuugugucaugaugcuguaccccucccagauuuaaguaauaaaaaguaaguacauacaaguggguaaaaauaauaaaagaaucugcccauuaaccagcauucaucaacaacuacaaagaagaugcuggcuccacacaagcucacuugacuggcaugccauuauugcuguaauuuucacgugaggugagaaauuccaucuuacacguccaaggugcaggccugguccuugccugcuuuuaccaaaagagcacaaagucucggagaacugugugcauaccuaagagaccaucgaucucauccaaguuuccaucauguugucuugccacgcaaagucucagcagccggaaaugggaagccaggcacaaagaagacauugaucugggaagggagaauccaccucaggaaccacacuuaguaccacagucaaauuaauccaaaacuacaggcacucacucuuguaauuaaagaaaaacagcagggagcucagugcugcccagcagguagagagcaucacaguucaggaaggcagagggugugugcagcuggugugaagcuugagagggaaggagaggaagagaggcagggcagccagggaggcucaggaaaagaacgaaaggacaaauagucuaggguagugugugcugacucucaugggcaaugcaaaucucaaucccagggagcaagagaaagagaggagccugacugcgcccuucuaacagcucuggaugcaaccuuuccugaaagaaucacugugcugcaaagacccuguacauuaaaagaacuaugaaaugcaguuggagagauggcucaggaguaaagagggcuuaccgcucuaaaagagaacccagguucaguuuccaaagccuaugugguggcucacaaaccaccuauaacccuaguuccagggagccaacacauucuucuaaccuucaugagcucuagaaugcauguggugcggauacacgcacuugggugcgcacacacacacauuaaauaaauaguucauucauucauuaauauuaagagauuaaaaaaaauuuccccaugaacauucagaauaccaacagauggaaaacagcucaccucuggcucgauucuugugaugucgcucgacuggcaucuuuugcacauuccugauagaacagcggcaggagguugaugacaaugccgucuugagugcuguacucuuccaguccauagagcgcuuucacaggaaauggaaagucacugugaagagaacccaaaaucugauguccccacucgggggaaaacaaggccaugcuggaaaucacuagaacaaaccaacuucaggcaaaacaaauuuaggaagaagcuauaaacagagagagcagguggggaccuuuauagcaacucuacagcugggauacaggauguuggggcuggggggcgggugagguauggugggcagacuugaggguaaaaguaaugugaaguuuguauccgcuuccuccacaguggagccagcugaggugggcagcacuuaccccucuggagcagcacagaagucuaccacaaaggcaucuuggaaaucauugaagauggucugcccaacccacuccuuccagguacaaacaagaacaggguugugaggggcauauuugcuauauagcccugaauaaacugccccuaaccuuucuaaacuacaggcuucucauuucuaaaacagaaauaguaacagacuuccaaugcugugaagaaagaagauaaugcacaaaaagugccucacucggugcuuggcacagaauagggcugucgaacaaauggugccuaucaccaacaacauucucgccuuuaacauuauaaucauuauuaaguacaggagccucaggagaguccagaaacuagguagggugaaacagccuuccagcuagaauuuggggacacccaggaaggucuguuguacuccacaauagcgagaaagacaaaaugugucccaaggaagcucugaugcuuugucacuuuaauggggcacuuggaaugggguuuuggcagcucacaccagucaucccaaaacuggaauggagaggcaggaggacuacagcuaguucaagggcagacuagucuuuaugaaaguucuagucagacccagcuauacagugagaccugccucaagaacugguucccaccugccacccccgaaacaagacauuguccuuaccaagguuuuuggagccaacuuccuuucuuggaucagguuggcaaauucaucauaauacagagaagaggcccaaggagagugcucagugcaagaaugaacuaguuguagcaaagaagucaccuggaagagauagaaagagcugugaccuuugggcugccaacucuaaauucaucuccacgcucaguaguaguuucuuucucaagucucacugccagaagucaagagaggcauuccagagccucuuuucuagucugucucuuuccaagcauauagaauauccaaagccaaaaaccaaagcuggagugacacccuuggguuuggacauuaagagagaggagagacaagcaaaaugaauaacacugcucuguguccuagaaugaacuucugaggaguuaccaggacaagaugggcauggugucucaugccuauaauccuggcacuugggaggcagagacaggaggaucccagaaaauucauggccagccuggucuacauagucaguuccaggccuggggcuacauagcaagauaguugaagguguuuuugaaacaagauacacaaaauacuccagucacagacguagcucagugguagugcacccaaggccccuguuccauccgagcauugugaaagaaaagaaaacucacaccacugccugggaaaacaacagugagaagcuguaagcccgagcaauggcacacaucuaaccacgcuacagaaaccuaccugugugcgcugcucacugcucacauuggcgcuccucugggaugaguuagaugguacacuucuaugaacaagaaauuuuaguuuaaucuuguaauauuuuauaauaagucuaacagucuucuuucagauagaacuagagguagaguuugaugacggcauggaagaguauuuacguuguucagcauagugagcaugauuagucccucuuuuucugagacagucacacuagguuaccagccuuaugucaaauucuugugugcaagugaucauucugccuuugucccuggaauucugaggcuuuugcaaaucagucagaccacugauacauauuuugaagggcauacuaaaugaguaaugauaggagagucucuuuuguuuuucugagacaauagucugaccaugcuacccaaggcagcuuugaacuccuggcauuaggugagucucuuuccaugugcccagcuaaagaaaacaucaauaaguagaguguucugggcauuguccuagccacugaaugcccuuaauaaaucuacagcguaaguacaauuagcauuuuacaguugcaaaaguacaaaggcagaggcagaguauuagguaaggguauuagguaagaacggagcuaggacuggacuccagacagacaguauggaucgcaaauauauucuuaaccagaacacaaaaggcucuucagauuuccccugauuccuuucuucuagcuauuaugcugacucuaagaauguuuccugagcucuuagaauuccugcaagugauuuccaagaagcagaaacugcacugucaguuuacaauggcuucucauggaaccacugcucugauacuuuuucagaugcuaugacugaggcaggcauccaggaguaagugaggauccacacagaaaauguauugcuacuaaacacgaagcaccagacagaauaagugcagcuacagagagcuuaggucagaagcaaauucuagaaaaauuaauuuccggaggaccaagauuauccucugugaaaaauuuccagcacugucccuccaggcaacauuaugauuaaaaauuauaauguaauucuauaaaaauuguacaugguauauacagucaagaauggaaaagauugaguuggagaaaggacuaaaaguaugcucuugcagaggaccugaguucaauucccgagacccacaucaggcagcugacaucugccugcaacuccagcuccucugaccucuguaaccggcaccucugacuuccacagguacuggcacucaugugcauauaccagcuuacaaaaacauaauuaaaaaugacaaagacaaauccuaaaaaggauuagaagagaacaugggaaagaagcaagauaugcuuacuucuucuccugcaguuuuaaugucguuauuaaaauauaaaguguguaaggugaauggggaucucccaaguugcaaaguagacuuguacccccaaaugaauugaggaaauacaagagaaaaucaagugcaaaaaaauaaauaaauaaauaaaguguguaaggcagcacccugccuagcugacugagacacaggggcagacucugcgugaguaccugucuuccgccaugaugccggccauggugacugcaccaaugaucccaaugagcuuguacuugaacacagugcuagagagcugcuuccggaucaccaggugcaugucguccugcaaugcgauaaugaggugagaacagagagacuguucuggagugacucgaaaggacaaaucacugcuggagccaaaucccauucucuaagucucacgcagaagaugguuguucugaaauccacagaccaauuauacaaagcuccuagaacaaggcacacguuccacaacagcucucaguguugucauggcaacugcucuaggacuugagaaucacuguggaauggugguguagcuagaauaaugagauacaauaaacuauucuuaaauauauugacuuuggggguguaugcuaugugcagggcagagggcaauuuuuaggaguagaugauaucauuucaaaaugaggaagugccgauuaaucucagguuuucacacuggacugcaaguuaccaugcaauuuugacagacccacuaugccacacuaugaaauuuuggcagaccacaauaaaccauuuagaauuaaauuuaaguuggucagugguaguguauaccuuuaaucucagcacuugggaggcagaggcaagcggaucucuguaaguuugaggccaaccuggucuacagagcaaauucaaggacagccaaggcuacacagagaaaucccgucuucaaacaccaaaaaccaaccccuccccccuagaaaaagaaagaagaaagaaagaaaaagaaagauuuauaugguaaaaucuauaaaacacugcaagcuggauauggagcauaacucuauaaacagaacuugaguuugcagccagccucaguuauauacugaaaauacugcugagaagaacuaaguaaugcagauguccuauguucuuggguuggaaacuuaauauugaaagaugauagcauugcucaaggacugaaugcaauccuuaccaaaacugcagcacccggaaaugcccugcuuuccaaguaagaaugaggugccgagcagcuguucugaacaauguugguggcuccucaacuguuaaaccccagaacgucuaauacuucagcaaugccaucucuagcuauaacucuagagcugggagcgaggcucagacaggaccugcacaugaacacucaaacagcaucguccaacagcugaggguaaauaaaaacaacccaccgccauccuuggacagugagagagagauggacaugaaguggucauucagcuacgaugagaaacaaugucugacacacccgugacacugacaauacugacugagaaaagaugacaagcaaucacaacaugagccuacaugucuuuaccuaggaggccccagggaguggguggcguggaauuacugccauauuggguacuuuucuguucagaaugaacaccauucugaaaaagaauggugauuauacuugcaauuuguggauguucuccaugccacugauauacuuaaaaauaauuaaaauaguaaguucuguauauauuuugccacaauucaaaaacaaaauaacgaaguaacuuuguauuauugauacgaaaaaauuugcaaauacucugcuaaaugagaaaacaggguacagccccagaaagaaaagcccaauggauguaacaacaaaucuguaaaugcuccagacuggggcaccgauggccucagaggaggccagccagaugccuagagagcagggacuguucacugcacaccucuccacacaccgaauucuauucaugugugugcaccaccuggcuacgacaacauuuaaauuaaacaaggcccuggauucccaaagccacagcccaguaugaauuagggccacaaggugucccgacagcuacaggaggugauaguuacgaccccaauucaguaagcuuugcucauauuuuauguccuuuguuagcuuucuucagugauuagugacuccaggagaaagcaagacgaggaggaguucagcuuagacauccgcuaucgccauaguacgccaugcagaaucugaaaaccauggcuuauuuagucucgugguuggccuaccacaggcucagacucaucuuuaguccaacagacuaagauuuccuugcuguuuuuauuuugagacagggucucacuggcaggcugggaauugcuguccgacugaacugguucaaacucacagaaacccaccugcuuccggguacugggauuaaagacaugaacauccaugacucugcuguuaauuuuauuauuuagacagggucuuguucaaaaccagguuugacaccacaggguaaaucaaggcagggaggagcaaaggaguauggcguuggcaauuggggucaugcugauagcauccaacugugucaaggcugacagugauggguaauuuacauggucagcacuacugauggaauaaaacuauuuaucugaggcuggcaagaguggccagugaaaaagaaaaggauagggagaaggucaugcaugcacacacacacacacacacacacacacacacacacacacuggccagacccaaccacauguuucaucgaguucacaagugcacacgcauaccuacacauauaccugcauauguauguaugcauacacacacacauacagacagacagcagagccccaacagccacacuuuauuuuuuucucucagccuuuuuauaccuucuuagacaaaagcucuuuauaaaauuaccucacagauaaaauguuacacaaaagggaguuacagaaggaugucaauaauaaguucaaagcagauuccauaagcucacuguaaguucaaagcaacaguuucacauggucuugcuuuagcacagugcacaccugcggcuucacccuugacccugaccuagaaugaauguuuuuucuuuucuuuuuuuuuuuuuuuaaagauuuauuuauuuauuauauguaaguauacuguagcugucuucagacacuccagaagagggcgucagaucuuguuacagaugguugugagccaccaugugguugcugggauuugaacucuggaccuucagaagagcagucgggugcucuuacccacugagccaucucaccagcccgaauguuuuuucuugaucacaaaucugucccaaguuuauuuucuuuuuagugcaauuuaugcaagcuccuuguauugcuuauuauguugucuuuacuuauuauucugaggaaggggcacauucuauucuugauucuaaguuucuuacaucuuucuggcuaaacaacuaacuccuagcuaaacaccaucuccuccuuaaacuuucuuccuaaaauuauuugcgucaaaucaagaaugcuauaaagucauuaauucaucuaaacagcacuaauucaugaaaguucaucuucauauugagcugcagggauuugcccuauaggguaggcugauggccaggaaucauuaggcuaaguuacaguggcaggaaaggcauaucagaagacaagguuucuggggccaugccucucuagaguacaccuauugcaggcaugcgaacagugggccaucuccaggaaacacaccugcuugccauagccuuucuuggauaguuucuguaaacuaccuggaacuauguauguggcuacguagcccaggcuggccuggcacucagcaucauguuaccgauauuuugaguuugagacaggguuucuuuauuuuguagcuguagcuguccuggaacucccuacauugaccagguaguuucuacgacuccacaggcuuagucuggcaaauuucaaaugaagagguuuaaaauauuccuucucaauacauguccucuuaccuggauaugguugcugguuccgggcuguuggcuaaaugcaagagugcugagaauacagaagauuuuucguauuugcugaggggacauauuuuccaaauaaucuaagaugcccuaugaaggggaaaaagguccaaaaaugagguaauuagcuaauauuuuucucuauuuaaauuaaaauacuucuguuuaaauuuaaauuuuucucuauuuaaauuuuaaaacauuuuucauguuuuuaaaauuagauauauucauuuuaugugugaauguuuugccugcauguaugauacgugcugcaugcaugguugguguccaagggguuuagagaagggcaguggguucccuggaacuagaguuauggguaguugugaaccaauaugugggugcugggggucaaaccggauccuuggcaaauguaacaaaugcuuuuaacugcugagccaucucuccagcccuacucucuccugcccccauuuuaaagagaacaauuacccagcuacuucaauuaccaggucaacaucaccgagucacuugcacugcacauacauagcagcuaagucuugcaaacaaccuagaugcucgucaacagugagaaaugugguucacguguaaugaaaaugucucagccauacggaagaacaaagcuaugcuguuugcaggaaaacgaaaaccaauauuaauguugugaaaguggguuaaggcaggucagacaaauacugcaaguucucuuucguuuugguuccuagaguuuccacagcuauguaagccauguauguaagacgacuugcagcuauguaagccauguauguaagacgacuugcucaugcuucuugcucucuuaacgcccaaggccacggccagccccugcccacagcgcguuaacgcugccuggcacgcgcauagagaagugauccugagucaguacagaugugcugcagcuuuccaucacaggcuucucuuuacguuacccaucuucccacacgucccucucacauuuauagugcucaacagcuaaagauacaaaauauguuuuugcuaacuuacagcaguaacacugagauacaugcaacagaaaaaugagucgguauuugucaggacagacaguaccuuaacaaaagcagcauugagccucauagcagaggcguuuagcacaaucagcuccaggaggacauccagugcagugucgacuucagccucagucccacugcagacaugggugacuagggcaccaaccacuuccuauacagggaggcgacaggacaguaugaaacaaaacugacacgcccauucuccgguguucacgcccaaggccuucuuacccuccaccuuacugucuauuagcugccacacacucuggcuuuaggaagccuguaaccacacagcacaaccacaccaucacacaguuauccuggcuccauggaccucacuaucccaugcuggccucaaacuugugacucuccugucucucaaguauugggaugacagggaugaccacuccgucuugaccaucaguaauaggucaguggacaguaucaaaacuucccgauuuuguuccuugguguggucaucugaauauuuauccaugaguuaaauuuuacacaaguugugacuggacuuagugugcacugagauuucuugguuagaccauacuugaggagcuuaagacuuuacagguuuugugaacugagaacagguaagacuagaugauucuaaaaauauauggccuccucaggaacaucacucagguacaaaaccuugcauucauaugcaugcaauaaaaaauaaaaucuaaguccaguuguuugaacugcuacauuugagcaagaucuuaaugauuuuaaagcaacuaucagcucucacaguuggauccucuaaggaaucuuaucacuucaggacagacuagaaaugaguauuuucuuuuuuuuuuuuuuuuuaaagauuuauuuauuagccgggcgugguggcgcacgccuuuaaucccagcacucgggaggcagaggcaggcagauuucugaguucgaggccagccuggucuacaaagugaguuucaggacagccaaggcuauacagagaaacccugucucgaagaaaaaacaaaaaacaacaacaacaaaaagauuuauuuauuauauguaaguacacuguagcugucuucagacacuccagaagaggacaucagaucuaaucaggaugguugugagccaccauguguuugcugggauuugaacucaggaagaacagucaauauucuuaaccacugagccaucucuccagcccagaaaugaguguuuucuuuguuuaugaagcaagauccugcacugaaggccagucaggcuucaaacuuuuguuuauugcccugccuguuucccgaggacugauuaaagaugugcaucucuaugacuggcuuaguacugaguuuuccaagcuauuagccaaaguuauuuccccuucaaugucaucuaaccacccagaauauaccucagaauacauccaauuuauuugaaauuaaaccuuuccauauccuguuucuuccuuauccaaauaaaugucucaacauaccugcuggcaguaaguaucaaaaaacuuaaaagcauauuuguacagaagacugccaaacaaaaugauccucuggucuugagagugaaacaaagucugagccagcaaaagaauagaugggcaaauauccuuaagaaccuggaagaggaaaagagaaaagacuaggaaacgguguuguagaccaaaugugcuaauauccauauccacaacugccaccaaagagaacaaguugucggaccucacaucaucgcguggacacacagcauccugcucucagacgcugcucucuagcuuuuacacuaagcagagcccacagccugguccaugguugacagacacuugaccacugaguuacggcuccaaccccugcucucacuuaauugaaacaacaagacaguuucuuuguuuuuguuucuuucugguggccucuagauggccucaaacuuuguaaucacaagauggccuugggcucugacccuugugcuuccaugucccaaucuagugagggccuaauguacugcuguuuuauaaaaggagucuuaauuauacccaaaauaauccuucaccauuaugauuuuucucaaagaaucauaaacagauuaaaaacuagccucggaguucaaaaaaacguaaaugauaagcuuaacacacaguuccuacauguucaauuaggaacuacaaacuagacugaauagauucuaguuucuucacucagucacauaccucccuggguaggcugcucuguuccaguuaugauuucaguucagucuauaacguucaaugcuacccaaacugaguuugugugcgugugugugcucgcgugcuggugaccauacauaugaccaugcauguggagggcagaggucacccucaggaguuguuuucagaagccauauucacuucuuuuuucuuuuuugagacagggccccucacugggaccuggggcucaacaaaugcuggcugaccagagccccagggaccugcauauuuccaccugcccaguacugugauugcgaaugugugucaccaugcucagcauuuauaugggugcugggaauagaauucaggucuuugugaguguauagcaagcacuuuaacaacugagcuagguccccagacuuccaaacuaaguucguuaaauaauuguuauaaaagaagugaccagguuccacaaauaauguaauauagacaagauguugagggauccaaaauaaauuacauuaguaauuccaucuucauuacuuauauugucauuuucaaaacaaaaccaaaaaacccagcaaauggaccucuaugaguucaacacuagccuagucuacauaccaaguuucaggccagccaagauaacauagugagacucucggaaaaaaaaaaaaaaaaucaaaacacauuuuaaaaaguuauguugcuagagagauaacucagcaguuaagcaugcuugccguuccucuaaaaacucaaguuggguucccagcacccaugucaggugacucacaaccaccuguaacuccagguccaaagaaucuaguccucuuccagccuucaagagcauguacacacauguggcauauacacacagggacauggcacaaacacaaaauaaaugcaaaauaaaucuuuuugaaaaaaaauccaaaaggcaaaagaacuuguguuagagauuucaagauaaacuaacucuguuaacaucuuccugagaggaugaaaggccaucuuaggcuggcucauuaauaucaucauccgaacccaaccaagccauuaaccuacugcucugagacgugcugggcucccugucaaagaucaauaguagacaaagguauugugagauuuccaauggugaagaaaauaucaaucuauuaucuucucggcaugucuccaccugcacccacuacuucccguaccucucacacuuaccagguaauguguagagaacgcacugucaagcagcuguucuugaaugcagucugacugaaucuuguuucucagcagcuucuccacgcccuucuuggucugcgugcuggugcuguagaugaugagcagcaugaccacguccaaagccugucagagagcagcacaccagagcucuuauucucuccuaagacacacgaugacacucgcuggcccacuccacacccacggagcucccaugccauuacaaaacccagaaacacuuaucagagaaauaaagugcaacaacuauuaucauuugguaguuccugaaaaaaaaaucaaaauauugagaaaaaugauauugaaauagaauguugaacauuuuuacauuuguaaaaaaaaagaaauagauggaaucacuugacaacuaaauuguauacuuucaaaauuaggaaaggugcuuuaagaaaaguuacaaagacuauaaauguucaucaauauaagguuaaauaauuuaugauaauuguuuuugaaauauaacagagguacaaaaaaacaguauaagucaacccauuuuugccuguuuguuuguuuguuuguuuguuuguuuguuuugacacaggguuucucuguauagcccuggcugcaccggaacucacuuuguagaccaggcuggucuugaacucagagauccaccugccucugccuccuaagugcugggauuaaggaacaugccaccauuucuggcucagcuaacccgcuuuuaaacagaguaagucauuucugauaccuggugauaauggugaagaaaauaagcaaccugcacuacacuaaccacaguaggauuguacuuccuaaggacagagugaaaaccauacacacaugcguaugcacacgucugcucuuacaggagugcgccugucuuuauacacacacagcuuucacaaaaagaaacaacauuuacaaaggggagauagaggcggcucagugguuacaaggauuugcuacagcucuaggggaccagggcucucgguucacagccccaugugggauggcucacaacaccuaugauaccaucuucgaggagacccacuacaccacgccuuaaaucccagcacugcggagacagaggcagguugaucucugugcgucugaggcaagccuagucuaugaacgaguucuaggacaaccagcgcuguuacacagaaaacugaccuugaaaaaaaaaccaaaaacaaacaaaaaaacuguucaaagaauauauagcuuauguuuauaccauguucuugucugcaagucuauaaaaauuagguauaaaggcaucaaagaguaugaauuuacuuucuguguaaaaacaaacaauuagauuaucauuugcuccaacauuauauucaaguaaucaugguagcaaaugccugacaccauagcccuugggaguagagguaggaggaucaggggcucaaggucaauuucacagcuauccagugagucugaaggcagugggacgagacccugucucaagaaacuuccuuauuuucacuguuuacucuauaucauagaaacuuuuaagacugucaucuaauaacugcacacucaacuaauaaaaaucccacaaaacaaaagauuacaacuaaagcaaagccuucagaagaaacaacugguacacagaaggacagacauccagauuccucacagaagucagacauggugacuccaacacauggaagcugaggcaggagaaucaucuucaguuuaaaacaaccacagugaguucuaagcuauccuggagugcaguguuacaacauacacccacacacaaacuaacacccccacacacgaacacacauauacagacauagacagaccaacagacagacagacacauaucagaaucagagagagacagagaaagucacaguaccacuguuuguccuacaguggaaagacuaaccagcucaggucaggacuacaugggcaaaguaaaaucaaaaagacaauugcaccugaugggaggaaggcuaaccauagacucaggaccugaacucaugaccucgguaggguacugcugcucggacuauaacuucauguggaugaaacaaucuccuagucccuacugaacauuguagacuaaagucauuuccagaauuaguagguaagagcagucacaggcaagucaccccucucggguugccuucuccacacaucuaacauuaucagagcagcuauggaaggacagcugcaggagcacaggaagaaggcaggagagcacaguagccaaggcaaagcacaagagcauuaccuuauguucagccgcggacucaaugcguucaauugccuaggaaaacaagggccacaaugugauagcacaucaauggagcaugcgacacuugcuucaucccacacauccggcucacuggcccagcaucaucauucacacuugaaugacaaucucaccucacacagcagccacugacugacacucaggaaccaccuugacgaucaaaguuaccuuacucaccuuaaaccaggccucugaaaugguuuucucauaucuaauggcugacuuuauuacaucaaagacaagaacaauacagucuuuaucacuguucucuugauuuccugaagagcuacaaacaacaaagcaggaaacauuauuuuugcuauuuaccagaaaaagauccaaguuucugauuaauaaccagagguucuggagcaugucccaacuuauuaugcaaaauauugaaaaacuugcacuauagacuguguggauuugaauggcuaagaaaauguuuacauaacaauacagagccaaaccucaacacacacacacuugaaaaucccuguugugcuguacgugcacauagccuugcuaucagcacuugugguuuauuaugcucucauaacuauccuaccuucaggauaaaaguagacuaugauuaugcaaaaaaagaaauggcaauugcaaacggcuccauaccuugcuaguccuuuacuuuucaauuugcuuugggaagccugaauucgugacggcaaaauaaacugcuggacguucaaguucucccgaagcucggcaaugaccuaugauaaaucacuaucgucauguauucugcucagccucaguggacgggcacaggccacucucucacuggaaccuuaacaacucaaaacacugaggaaaacaccugaccaaacaaaaggcaugucagcagccuggaugagaacaguucgaguuccucagaaugccacacccugaacccuagaaucacuugagacacaaccacagggaaauagaaaaugucagccugcagcagcuucugcugaguacuuaacagaccgagcuguguucucucccaacagcuaucuggaacagucagcacuaucaauucaucuaaggccagaaaacagcaacuugaaguacuuauuuaaaccauuuacccagguaucugaauguagguaggcuugguaggaaauaauagcauaccucaagggaaguggugucuguuacagaaugaagaaggaacuuuacaaucacagggaaauccucuagacggacagaugacagcuugcccaucaccaacuggcggaucuaaauauaaaaagcacaaaguucuucacuacucaaacccaauauagaccuaccagcaaaauuggaagcuucauuuugcucauuugauuuuccuaaugguaguuuaggaaaaaaauucuuuuuuuccccaaauuacaggcguuuacaauuauaaaugucaaagacuuuucuaacauagacaagugaugaaugucaagcaucuuuagucuuacauuucauucagggccugaguucacaauggaaaacaggagcgcucccuccugcuucccucaccacugaccccagggaugaccaacauuggauugugaauguuuauggaccucuuuggauguuacucagucagaaagaacgaugaaaagccagcucuuuuccagaauaaaaguauguuauuuagaagagaaccaaagccaagugaaguuacugccaaauaaaaaccagcuaaauuccagaacgcuuguauguuaaaaguuacaaaagaaguaaaaauauauugcuguuuuccuugaggguuuagcaucccaggcucccuauguggcuuaggauagccuugaacuucuguuccuccagccgcuaccacuuguuuauguguaugccaugauacaaagcuuaggugaugcugggggucaaagccuuguacacccuaggcaaguacuuuaucaaaaacuauauucccagucaucacaugagaccugagcuugaucccuaagcucacauaaaauagccagccauggcucuaaguacuuguaaucccagcaugggugcuuuggagacaaccacaucucugaaggucacuaguaagcuccaagcagugagacauccugucucaaaaaaaaaaauguuuuuuauaaguggacagaccugaagaacaccugagguugucaucuggguuccacgugcacacauacacacaugcaugcagauacacacaaacacagaagcuuaccacuuacgagaugagugugauucaguggugaaaugucugccuaguguuugugggacccuggauuugaucaccagcagagugaaaaauaaaaugaaacccaaauaaauugcauugcuuaagccaggccuggggaugcacauguguuaucccaguacuggggagccuaaggcaggaagaucuugaguuugaggccagucagggccacauggucagaccauaugaauugaaagaaagaaaaggggcugaugagauggcucagcgguuaagagcaccgacugcucuuccaaagguccugaguucaaaucccagcaaccacaugguggcucacaaccauccguaacaaaaaucuaaagcccucuucuggagugucugaagacagcuacaguguacacauauaugauaaauaaauaaauaaauaaauaaaucuuuaaaaaacuauuuaaaaaaaaaagaaagaaaggaaggaaggaagaaagaaaagaaaaaaagaaaaaggaaaagaaggagagagagagguuagguuuuggcuuaguauuuauaaggcccugguuuuugauccccgugaugaugaugccauguuuuugagugugugugugugugugugugugugugcgcgcgcaggauaguaccuuaacauuugugagcauaguuucaaaguggcauuuucuuucauuguauaugauuucuuccuauuucuggaaagcaggcuuuuuccuaccuuggacaggaaguuggggucaagucggagacuggaaaagacauccaaaauuggaacagucagggaaguauucugcaccagcagcucgcuguuaacaaagaaggaaaagcugaguaaugguuugaauagaucggggcaagaaacaaccugaggagcuacucccucgcgugggaggacaggagcagugaugcugucacagucaggguuucuauuccugcacaaacaucaugaccaagaagcaagucggggaggaaaggguuuauuuggcuuacacuuccacauugcuguucaucaccaaaggaagucaggacuggacucaaacaggucaggaagcaggagcugaugcagaggccauggagggauguucuuuacuggcuuguuuccccuggcuugcucagcuugcuuucuuauagaacccaagacuaccagcccagagauggucccacccacaaggggccucucccccuugaucaguaauugagaaaaugccuuacagcuggaucucauggaggcauuuuugcaaccgaaacuccuuucucugugauaacuccagcuugugucaagcugacacaaaaccagucaguacagaugucuuggaccugcaguggaugcucaagucccuucuaggaaauggcauggcuaucagcacacaacucauccaucuucccacauacuccaguuaccucuaggagacuuacaauaccugagacuauguaaaagcuaugcaaguugucaugcuauauugcuugaggaauaauaaccagaaaaucuguauguuauugcaugugcaccucuguguagcucugccuguccagaaacucacucuauauaccaggcuggccucgaacucacagagaccagugccugacauugaccuugaacuccugaccuuuacuuccaaauacugagauuaaaggcauuauugacuagugcccaaauaauuuuuacauuuugaggcaggauuuaguguaucccaggcuggccucaaacucacaauguagacaagaaugagugugacuucuguuccuccugcuuccuaccuucugcccucacaccugguucauguaauguuagggaauuaacauacuugguacaugucagguaaauacucaacugagucauauacccaaccaccuuuugugugugauucugagcuucauguagcccagacuggcuaugaacuuccuacaaaacugaagaggaacuuaaacaccugugucccagccuuuauguuccaaaugcauguguguauauauguauguacaucuguggggguguacacgugugugugagugcguguguguaugucagacauauaccaaugugugccacaguacaaauauggaagucagagaaaaacuuggcaagucaguucucuucuacuauguggguuccaguauaaaacuuacaucaucagagaugaaagaaagguaagccccuuuagccagaguuaccacauuagcccuaagcuuagcucuuuuuacauugcaaugaacaaguuccccugguggaggcuccaugagacagucccacaguguuuacccacccaagcucuuuccccacauuagcaugcugggaauccccuaggauuucaggaaggcucgugaugaagucaugcuguaaguucacgggagcaacacugaucaacugcaucaucugggccgugagguccugcagggagaacauuauuagaacuguaacacauuauucaaaauaaaaacuacuuauucaugaacauacagaccugaaauuaucaugaccauaacagacucaaccucaaaauuuaaagugagaggcuaaagggagcuggggagagagcacgcucaauaauaaagugcuuuucuuccaugagaaccugaguucaauuuccacaaccuagguaaagaagccaggcacaccggcacgcacuugugaccccaggucugaagcaaagacagguagacuccugggaagcacuggcagccagucuauauuaggcuacuuggcaagucccagaacacugaaagacuguuucaaaacaaaaggaguaacauccaagguuguucucugaucuccagauaccagcacacaggcacucaugugagugugaguucaggggcgcgugugcacacacacacacacacacacacacucguaccuacccauaaacauaugcacauaaaagaggccaguaccucuccucgacauucacauaacagaguagacugaauacauuaaaauuuaguccagacuccaaauuccagcccagaugagacucuaaaaacaccuguuuuucuaaaaaagauguaguuugaaaaugucugucaaaaccuaaaagaauggcuguaagaaccucugaagugaagacaggccugguaguguacacugacaauccgagcacuugagaggcagaggcagaaagaucgagcaagauucuaggcagccugaacuacacagcaaguuccaggccugccagagcuagauaguaagggccuguaaaaacaaaaacaaaacaaaacacaaacacaaacaaacaagcaaggcuucuggaaagaagcaagacugcaggcagugccucaaguggacuacucagcacugaaacgggguuuggcuaacggauuaugagaacagcuuuccuguuaucuguggggagccgcccucacauucgccguugcaagauggcgcugacauccuguguucuaagugguaaacaaauaaucugcgcaugugccaaggguaguuuuccaccccaugugcucugccuuccccgugacgacaacucggccaaugggcugcagccaaucagggaguaauacguccuaggcggagaauaauucuccuuaaaaagggacaggguuucgccauucucucucuugcucuugcucucuugcacucuugcgcucuugcucuggcucuugcucucgugcuccuaaagauguaagcaauagagcucuugcucucuugcucucuggcuccugaagauguaagcaauaaagcuuugccgcagaagauucugguuugcugcguucuuccuggccggucgcgagaacgcguguaagaguuaucauaacaagaaaugcucauuccuuguauuucuaaaauucagugagguacaacauauucaauuucuugcccaauaaccaacccuaagaaaaacuugaacuucuauuuauuuaaguguucaacuuuuccaaugcacuuacauaaauuacauacuugcaaaaacuacaaauugaaucauuuauaguaaaauaagauggccugggaucuucccaccuuucagaaauaaaaaguaaucuacagauuguguaacacgaacacccucaccuucuguuuuuguucucauuuuguuguuguggagauaggguuucuggcuguccuggaacuugcucuguagaccagggaguccucagaggucucaaagguccagaacgagagacccaccugccucuuccucucaagugcugagauuaaaagccugugccaccaugcccagcucuuaccaguguuuuaaaaacgauuuauuuauuuuacacuuugugggguauguucucucucucucucucucucucucucucucucucuguguguguaugugugugcaucauguuuauguuugcguuacagauaguugugaacuaccauggagaugcugggaacuaaaccggggucuucuacaggagcaacaaaugcucauagcuucugagccaugucucuagaccagugguucacccuuuaauacaguuccucauguuguggggacccucaaccauaaauuauuuuuauugcuuccucauaucuuccuuuuugcaauuuuccuacuguuaugaacuguaauguaaauaacugauauuuccaauggucuuaggugaccccugagaaagggucauucaacucccaaaggguucacagccacagguuaaaaaccaccgcucagccgggcaugguggugcacgccuuuaaucccagcacuugggaggcagaggcaggcggauuucugaguuccaggccagccuggucuacagagugaguuccaggacagccagggcuacacaaagaaacccugucucgaaaaacaaaaacaaaacaaaaaauuaaguauaguuuauuauauguuaaauauuugggaaggcacuagagcaguguuuuuuuauuuuuuauuuuuauuuuuuacuuuuuugguuauuuugagacaggguuucucuguguagcccuggcuguccuggaacucacucuguagaccaggcuggccuggaacucagaaaucugccugccucugccucccgagugcugggauuguaggcacgcacuaauugagaaaaugccuuacagcugcaucucauggaggcauuuuuuggcaugcacaacucugcccagguguaaaacacuuuguaaauggauaaagcccccaccuaccuugccauccacaauucuauccagccauuuuaguugauugauaaugagucuggccauguugauuccaucucuguucucacugaaaugucagaaugaaaagggguugguuugcuuguccuccccucccucugugccucucucuccccaugucauuuguuuucuuuuugguucuagaggacucacaugauggacaggugcucuacuauaagcuguaucaccaacuccugacuacaagacagaaaacuuuacuguauagaguacuucagccagucaguuaaagccacuaacuauauaguuaguagucauggggcacaaugcuaaacacaaacgugguuauuaaaaacagagaggcugaaaagacagcuugggcaguuaagagcacuggcugcucuuccaaaugauccagauucaauucccagcaauccauguggcgacucacagccaucuguaacuccacucccaagggaucuggcacccucuucuggccuuugcagauaccaggcaugcaugugcaaacgcauaaaauaacugaauaaauaacccagacaugaguauauauuguggaaaagacgacuggaagaaaacacugcuaguucuucugucugccuccagcuuucugagaaggauguaagcucucagcuacugcucuaacaccccgccugccuaccggcugccaugcucccguccaugaugguuauagacgcaucacugucucugaaacuguuaagucacaaauucuucgauaaguugccucaguaauagugcuuugucacgaagaaaaaaacaacccaucacuaaaauaguggcuauauagcuggggagaagggaaaagugacagguuggaauguauggcucaguuguugagagcaccuguugaucuuccagagggccugaguuugauccccaaaaaccacauagaagcuuacaaccaauuacaucuccaguuucaggcaacagaaugcacucuuuuggccuccuugggccccgggaacuuacgcagugcacaggcauauaugaaggcaaaggcaaccauauacauaaaacauagcaaaaauaauuugguuggaggugguggcaugagccuuuaaucccagaaccugagaggcagaagcaaaggcagaacucugugaguucaaggccagccugaaaucuacaaagugaguuccagaacagcuggggcuacaagggagaacccugucuugaaaaaacaaaauaaauaaaugaaguuacuaaaucuaccagccaugauggcacauccguaauggaagcacuugggaggugggagcaggguugagugugagacaagucuuaaccauauggccaccuguaggccagugugggccucaaacaagacagaaacuuuaaaguaaaagaaugagauguggcuuuuauuuuugaaacauagauucauuacguagcucuggccagcuuugaacacacagagauccaccuaccucugccucucaaaugcuggggcugagaaaguuuggguuuuuuauuacuuugcaauagggucucagagcaucgcccacacuggccuggagcucacuauguaucugaggaugacucugaauccuucaucguccugccuccucuuccuaagacuugggauucuaagcacgagccaccaugucuagcaaccagaugcaaaucuaagguuuugagacauacaacuugacugcuucgcacaaugauugauuuaugcucauuuacaacaaauccaguaacuguucuucauauuuaacaaaggcuuuuuggguguagggaaaacacucaauauuuuauccuuuuauuuuuccuauuuucuuuuuggaggcagggucuucugugucuuucguugaacucaaacuuucuguguaacugaggauuucuuugagucucuguuucuccugccuuuaucacuggaguguugaaauuuauguugucauaggaaucaaacucaggucuucagguuagguaaggauucuaccaacugggcuacaacacccagcuugcauugcuuuuuuuuuuuuuuuuuuaguauucauuuauuuauuuauguauaugaguauguaucuacauguacaccugcaugcaagaagagggcaucagccacgaugugguugcugaggauugaacucaggaccucaggaagagcagacaguaacuuaacugcugagccaucucuccagccccaccccaggccauuuuuuuuuagauuuauuugcauugaauuuuuuuauuuaauuaaauuaaauuaaauaaauuaauuuauuuguuuuguuuuuucaagacaggguuucauuguguagcccuggaugucauggaacucacucuauagaccagccuggccuugaacucaaaaauccacaugcuucugccuccuuaguacuggaauuaaaggcaagugcuaccacgcccagaacuauuuuuuauuuuaaguuucugucuuugcuaaugaaacucaaauauuugauguuucuauacuugaggcuuuauaugucauuauuaaucaggcaggucuuuuuccuuucugacacaguuguuguuuuuuuaaaaauauuuauuauuuuauguauauggguguuuuaucuguguuggugucugagaauucaacucuaguauucugaaggagcgagcagccugugcucuuuaccacggagccaucucuccagccccugacacaguaauuuugaaauaaaagcaguggaaacauacuucaaaauaaaaggcaaagacugacaacugccuccguccuaggaaacaggccacugcugccagaguguuauguacucuucuagaauaaccauccuacauacaauaugugugauaguuauuuuaacaaugacuuaguauuuauaaaggaucagaagaaauguuaucccucacucaggacccugacuuguuaaacauggccauaggacauugcagaagugacauuccagagaguccaaaagcauugaaacucaagguuucagagcaauuccacuuaccuuucaaaaagaaacugaggcacuuuuucaaauaacauuuugauaauggcaggcuaaaagauaaaacacucacagucaggagaugguaucaaaauacacaacagaguuacauuaguuaacagguggaaaugaccagcaucaggccaguggcugugugguacucuaaaaagggacuaaagugcugaagagcucaguacacgagguuuaacggagaugacuucacagaaggcuuccagagagguuuauaacaacaguugccucuaaguaagacaguacugcaccuaaccacagagcauuagacugugccugggagggcuggaaaaaauacaaaguggacaaauucuacugucaaucacuucugggggaaaaaaaaagcagagaaagcaaaaagaaguugugauuuuuggauauaccuccucucaauguauuuuuaugaaacuaguuaaaccugagaguuauuugaucuguagauggcuuacuuuaauaucuauaauaauaaucauuaaaugaacauguacaauuagucauaaguuucuuccaccagagcucuugaggaaacaucuuaauauaacugacauccucuaagaauauucacauggauacugccuguauuuuaauauaaaugcuuagauauaaaauacauugauaauuugcauucccaaacauuaaggaagauuaaucagauacuaaaaauacuauuaaacauggugacucuuagucuaugaaaugcagauuuuaaaagauuguuuucaaaagaagucuacucuucagaugaaaaugcaggucucugauaugaguuaacuaaauuauagucaagauuuccaaagaaaaauaagagauuaaaaauuauaugaagaagcuaaggaagaagaaaagggaggaugggugggaaagacauuuuuuacucuacagcuguguucaauugacacaugaaacaugucaauguccuggcuagagagaaggcucggagaccaugauuguguccugaucuccagaggacugaagucugagucccagaagccacguccuacaguuuacaacugccuuuaacuucagauccagugcuccaaggccucugccuccccaggcaccuucaccaccggcgcuuacacaccccacuccugccacacauacaccuuuuuuuuuuugaagugagauagaggagaaugaaguaaagagcaaacucaaguuacuaggugauggugcaggugaaaauucagcaguaaguacaaaauuuucagagcacacagcacggagcuguaaggaagaggacucgggacuggcaggauggcucagcuguuaggaauguguacuguucuuacagagaacccaagucugguuuccagaacucauaucugguaguugaaaacugugacuccagcaccaggggaucugaugccuuuggcccgugcagggaccagaacaccuguaccaauuuacaauguuuuuaaauaaaccagacucauaugcugaagaaaugaauaggacuggcagaucaaccagccuaauaagaagucaaagacagacaugacuuagagacuaaucucaagugcuguacagugcugcugccagcuaaaagucaccccgcucugcuagguaccccacuucacauccaucacacucuggggaaagugcuguggucucaccuguaaaaugucaauccccagaaguagcuugaucagacucuuggaguaaaaugugcccaugcuggaaaacagagagguguuuggaucuuauuuuguucauuuuguuuuaauguuugacuaucuuuucuaccugaaacugauuaaaugcacaauccuuaaagaucaucucaaagcccggcuagaaagcaaaggccuuuagucucugcauucagaggaggaaaaagcaagcagcccgcuaugaguuuaaagauagccuggucugcauaaggaguucuaguauaggcagggcugcauaauugagaacaugauucuauauagacaggcagacaaacagauagacaaaaguuaagucuuauuagaaaaaaacauacagacaugagaagauagcucuugguaagggagacacaggaugucaauucuuauuaguacagguaagacauguuucauaaaacauguuccaguucuuugcaauccagccucacauugaauuaaauaauuuuaaaguuacacuuaaauucugaguaagaaaaaaaaaguuauaaaucaaaagcaaaacuguaaaacaaagacaacugcacuuccuguguccaguccaguuacugccagacugagcuucuagaaggcagcuucuucuccacaccuggcuuccucauccugcaggcgcucacaagacagcaggcaguuccugagacucucacuguccucaguguaggacuccaggccauuaacaaacucuucuauuaccuaaauaguagaaccaagaggagagaagggaagcucuguggcugaacgucuguuagcugccacucagcuguugccagggacucaguccucaggcgaugcacuucuugcagaagcagaagcaccacagagagagaggacuuacuuugggauaagcaggaugcuuccucaaggccugaaagagcuuccuuuggaagauuaccugauccacaccuaugaggaaggaagaaaagccucucaacaugauguguaaugucuacuacagccuccuuccuuaaauacaggcuucacaucugaugacgccacuaagaauaucuucuuucuucuucuucuucuucuuuucuuaaaagucuauuuguuuguuuguuuauauauacuauuuucaugugaaaaucugugcagagggucuggccaggaacuagaguuacagacaccuaguguggcugcugggaaucaaacucugguccucugaaggaacaguauauacucuuaaccacugagucaucucuacaucccuacuaagaauauuuuucgccaaaacuucuaaaucuagaguaaaacacuuaaacuuagauguugacaccaaguguuauacaaaucauccaccuuacuuguagauauaaagauaaccuaucuuacuuaguaaaacaaaauaugaucuaugcuuuagaaacaugucuccagccuuauauggcuugccauauuuucuucugauacagaucuacuugcuuccuggguaucuacacacacacacacacacacacacacacacacacacacacacaccaacuaguaauauacuacuuuuucuagaaaaagaauuagagguaucuaacuugagauguuauuuaucaagccuuaaaacaguaagauuaugaucauaagcaguuucuacagagcggccucacucuucucuugggacagaggccuuccuucccuacucuccgucagccucccuauucuggacccauggucugguccugagcacuuucaccgaacucagaaacauauuuugagcuuuaccuagcugauuuugguucucuccaguuuuaagagugaguccugaagccuuaagaagcuuuacaaagacacugccauuuucuucaacuucaugagaauugugagacuucuuugccagcuuggaaaggggcaugguuucuggaaaaacaaauaaauacacaaacauaaacccuucaagaauaugaucauaaaaacaagaagacgaguacaacagcuaaaacaaaaacccagguccaaauguucugagaggccaucugcuguguuccugaagaaccccacugacucuguagucaaacugucuucagagguggucagcaacaguggcuuacccacaaacaaaacagccaccgaauaagauaacauucauucagugagguuucaguggagaguauauaaugugccacuugagcacaauaaccacggaaacauuucaccuaagucuaaaguaguccccgccucgcagguccucacuguuuuuaaaaauguguauucuugagccgggcgugguggcgcacgccuuuaaucccagcacucgggaggcagaggcaggcggauuucugaguucgaggccagccuggucuacaaagugaauuccaggacagccagggcuacacagagaaacccugucucgaaaaaccaaaaaaaaacaaaacaaaacaaaaaaaacaaaaaaaaaaaaccaaaaacguguauucuuuacugagcuaucucuguguuucuaaaacauguguagacacguacgcuacagcagagaaugaggucggagggcagcuguggaggauguucguucuuuccuaccugaacucaggcugccaagccugcccagcaaguuaccagguuagcaacugcaacagccucaccuugauuucugaaacaaagucucucacuggggcucacagaguacacuaggcugacugaccagcaagccagagaaguccugcugacuccaccuccucaccacuggaacucauauucaccauuuuugcagugguccuggggaugacacucaagucuucacacgucccuggcugagccaucccgcagcccccuuuucagaacucuuaggaccuuuguuaacugaguucucacuauuucuuugcuuguggcuuacuuuucuuucuauaucacuaccauuuauuuacccguuacuuuuuuaggaauaaaaggagacaaguuacuauuuuuuucucuucuguuuuuuguuuuugaaacaaggucucuccuuguaguucugacuauccuggaccucacuauauagaccaggcugacaucaaacccacagcaauccccuccuucugcugggauuaaaggugugucucaccacacccagaccacuuguuguucaaaaggaugaauauuucuuauuuuuguguucuaggaucuagauaauauugauaauguauaagaauuuuuacaaagauuuauuucuggucuagagagauggcucaccgguuaagaguacugacugcucuuccagagguccugaguucaauccccagcaacuacaugguggcucacaaccaucuguaaugggauccaaugcccucuucugguuugugucugaagacagcuaaaguguacucauauaaauaaaauaaguaaaucuuuaaaaaaaaagauuuauuucuauucuguauggauagcuguuugccugccggaaccuaaauguaccacaugaauguaccguguccucugggaccagaagaggacacugaaucccuggaacugaaauuacaggugauugugggugccaugugggagcuggaaaugaaagcagcaaguacucuuaaccacugcaucauccacccagcuuaauaguaauuauuuuuaugaagguggagagugaaguucagaagguauccaaaagcccuaaguggcauuugaggcagacacucaauccuuaagcuccuaggaucucuguauucucuccaguaauccauaacagaugucagcacuugagaagcaagaguucugcaucuuuuccugucucaugcaucugugauucacauauaacaacaaaaggguagauacuuacuggaggcaucuucugucagguuuucuuuauccucagaaucuagccgacgucuuuuggaaaucauuuugacuaacgucuucugccacuuauauuacuuccuuaaaaaaacacccaggaguuggaaauuuagcucagugauauacacacugcuuaccuccaccaccaaaagaaccagcauaaucggagacuaggagucauucuaaaaacuauucucucuacaagcagaggguuugagucuucacauuaacgcuguccaaaccacccaaaugcugagcacauuucaacuccuacaacuggccaaguugcuucuuucaccaggcuacuucucuguugcuaaaggagaaagcccauaacucgucuucugagacucaagaccaucaccuaagcugcucucuaacagguuacuucaguacugugucaugguggugcuaaggacugaagguauaagacaagacaaacaucaaacauugcaaaacaagacagacaucauuccagcgugcaggaggcguacagcauuacaaggucuuaauguauugaacuacgucugugugacugcaaucgaagagaagccagggaauugagugagagcuuaugaggaccguuagucuaccuguagguggagcagugaagaaaagcaggaacaauuuuucugaacacguuuuccguuucaacaucauagcuuugugugugcuaggacagucauuuuuauuuuuaaaauaucuaaaucuuagguguaugaugauuugccugugcauacgacuguggaccauguacacacuggaugccugcauaggccagaagagaguauuagagcccccagaagugaaguuacagauaguuaugagccacuaugugggugcugggaaaggagccgagauucucugcagagcagcaaguguucuuaaccacugagcuauuuuucuaguacguauuuauuuuuaagacaggauuccaccauguaaauuggacuggcuggucuacauaguuaccaguuacauucuaggccagcuucagauauacagugaggcccuaucucaauaaccaacaaacaaacaaccuugucuuauaugcucuaauuauaaucuacauauuucucacaugcuaacuuaagaaagauaccauuacuagucuccuaaucaggggaagggcugagguucuaacucuaaaaagucugguuccagaaucuguacuccuuguuuuguucauuuauuuuugguucuuagacaggccagaaucuguggguuuugucuuacuuucaacuucuagggucuuguguagcuguuuggucuugaacucauacauagccaaaggcaacuucuccugccuccaccuccuaaaagccaagacuaugggcuauuauuauuauuacuguuuuuuauuugguugguuuuguuuuuuuguuuugcuuucuuuuguuugagacaggguuucucucacucugaggacuggcugaccuugaucgaacucagagauccaacuuccucugucucucaagugacaccaccacccagcuucucucucucucucuuuauuuuucuguguauacaauguucugucugcacaucagaaaaggguaucagauuucauuauacaugguuaugagccaccaugugguuaaggggaauugaacucaggaccuuuggagaagcagccagugcucuuaaccuccaaaccaucucuccagacuagggcaaugguuucuauuaaggauuaacguuccugggcuggugagacagcucugggauuaagagcguuuacugcucuugcagaggacccagguucaguucccauucaaacaugcggcucaaaacugccuguaacuccaguucuagggaauccugcgccccuucggguuccuauaugcauguggugcacauaaacacagaaggucaaaucauacauauacauuaaauaagucuugccaaaaaaaaaaaaaaaaaagccucaaaaacuaaaaacagguucaaauuucuuauuauacgagauuucuuauuaugcguuuccuacaauaauauguaaucacugacagccacuuuucagagggaaacacuagaacaagucagggccgucugacuucggagagauaccaucucgcucccaggaaagccuaaaaagccacuaaccuggggacccgccaguugcuucccuucguuuucgacuuucccgcuagaagaacggcgcucugacgccaucaaagccgcgccguggcgugacguuacucgcccgcaccggaaguugacggccuggcggcccagcuggaaacagugcgcggagaaagcuaggcugccccagauuccacgccagccagacugaggggcgggugaaggcccggagccgaaagccgggaggaacccaacuccucccgacccgcagcgaacucucagcgaagauggcggggcccgagcugcugcuugacuccaacauccgccucugggugguccugcccaucguuaucaucacuuucuucgugggcaugauccgccacuacgugucaauccuacugcagagcgacaagaagcucacccaggaacaagugucugacaggucaguacccucacccuauccugcugaccucacucccgggugaccuuggucaagaaagugcagggauugauuguaucacuuuaacugaguuuucaucgcgccccuacggguugaccuuggcgguuagcuguguuucauuuuugucaguaaaaugggaauaaucucaguaccuaccuaauagagagagcaggcauguagauguuagauuggaugauaccuaaaagccuuuagcccagggccuugcauguacuaaguguuuaagaaaacguucuuaauauuguuaggcuaguugccaaccgucagugagguucucucugaacuauccugcuccauuccguuauuaagaguacccacugagagucagaugcaauauucccuugaguccugcuaacauccaggcaagugaauuucauaaucuacacuaccaaagaacuguagugaucugcugagaugcuaagguauaaagugccuccaaagcuuggagacuaccacagagacgugugaggaguugcgauggaccauuccaccugccuccucuccucacuugccuucuuacagugcuuuucugugggagacagaacuuugacauaacuucagccacuucacauuaaaaucaguaacaguuuucaaucacuuauucuagucauuuucagagacuagcugaagacagugcugcugguuccuugacuuguccagaucacauaggaaucacuuuaaugaagagaaacguuucaaacguuucugcagagaacagaaaacaaaaaccaaaacaaaacaaaaaccucauuuugccgggcgugguggcacacaccuuuaaucccagcacuugggaggcagaggcagguggauuucugaguucaaggccagccuggucuacagagugaguuccaggacagccagagcuauacagaggaacccugucucgaaaaaccaaaaaaaaagaagaagaagaaaaaaaaaaaaaaaaccucauuuuaucguauuuaaaaguuacuuucuuuuuguggcaaguaauacuggauuuccauuugcuggugauuuaaagaucaccuuaaauuaaaaacacuuuaaaaaaaaaaagauuuauuuuauguaugugagcacacuguugcuguguucaggcacaccagaagagggcaucagaucucacuauagaugguugcagccaccaugugguugcugggauuugaacucagaaccucuggaagagcagucagugcucuuaauggcugaaccaucucuccagcccuaaaaacacuucuucugcaaugaggcugugauguaacucaguuggguacagugcuuggacagcuggcuuugaagcccuggguuccuuaccccagcauaagccagcuauggcaguguaagccuguaaugccaggacucaaagauggagguaggaagaucagaagcucaagcaagcuaccuauagacuggaggucaggcuggugcacaugagagucugucccccaaaauguccagcuuggguauuuucgauugucuuuuuuuuuuuuuuuuuuuuugucuuuccuuauucugcugcugauaauaauaauaacaacagcaauaauaauaauaagccagcuuuaugaaacauucuaagcagguacaaugauaaggacuuaacauuuguuaauuuauuuaaaaccaaaaagcaacucaaugugguugauacuguccucauuuuauagaaacugagacuuuaacagaguuccguaauaguaauggaugaugacaauucaugacuuuaagcuaaaucucgugguucccaagccuagguucuuucuuuuucccaacagugcccacuaugacuauuuugugugccauuaguuucagagcugacuagagacagcccccugaagcaagccuuaggaaguuagcuuaguacagacuugaaaacuacaagaagauggggaguggagaaaacucaguaauuuaaauuuuauuuaguuuuuuuuuaaguaucuacuuuugcuagcaugguggugcaugccuuucaucccagcacucaggaagcagaagcagguagauaugugagaguuccagggcaaccuggucucuuuagaauguuccagaacagccagagcuacauaacagagagacccugucucaaaaaaaaaauguauuuuuguuuuguucuuugugauugagcguuugccugcauguaugaauuguguauguacuguaugugucgugccugcggaggcuagaggagggggguggauccacuggaguuggaguuauagaaaacuaguugugagcggccaugugggagcuaggaacugaaccaggcuccucuacaagaacaacaaguggguuaacugcucagccauugcuccagccucauucaacaguuucugauuccuguaaaauaauugucauuuuauccucacaacgaagcaugcuauccuaaccccgcuuuuauaacuaaaaggaaaaucagagaaaucaaacagccuuuccaaagucaucaggguaauagagcauugcauuuguacagauugaguguaacuaugugaugcaguuuucugcccugguucaccucacaguuuuagagugaugauucuaaaugacaucagacccucagcucuuuuaguauucuuuuuuuuguuguuguuuguuuuuuuuugguuuuuuguuuuuuuugagacaggguuucucuguguagccuuggcuguccuggaacucacucuguagaccaggcuggccuugaacucagaaauccaccugccucugccucccgagugcugggauuaaaggcgugcgccaccacucccggcucuuuuaguauucuacagaugaauuauacaguuuauauauaagaagguugguugguuuguugguuuguuuuucaagaacuuuuaaaagguaacacaguguccgagguguaauaaucagaaauaaaggaaagagauuuuuaguaugcauuucauacaugcauauuugugcacagcuaucuuacaagaugucauaugcauacaucuagcuauaaaaucacaacuaggacagaucaauugugggcuaaagcagaugaugucacagaggcaguacugucuauaaaugguauacuaagucuacccagaaccuguuuauaaacuuaguagcuagaaagccugugcuccuuccacacuggaguuagguuugcaccuuagauaacuagaauaguugagugagguauacagaaguaguguaggacauaggaccauuccuuguuacauaacuaccuagcauugaggauaucauaacaucucuaaauccaugacaagugacaguuauauggcauuucuccuccacacugucauuacgacaaucaaaaaaguuccagauaugucaaacaggguagcuuacaccuagacuccuagagcaggggaagcuuacguaggaucaccauggguuugagaucagauaggguaagggcuauaguguaagacauugucucacaccaacccuuucccuugaaauagccagggauaaugguacacaacuauaaucccagcacauggaaggaugaggcaggagaauugagacgucauggccagccugggcucagugaaacaccuucucaaaagaaacaaaaaguugcccagauuuccauaaggccucuagagggugguacuaucccuguggagagucaugcuauggggaacaucucuagucguaaucucuccaucucugagugagguguuuaggucaugcccacucugacauggugcaacuuuaccccaccaaaaacuguucuuggggcugcuaauguuaaaaguacuuauugcucuuucagaggaccugaguucaguuccuagcaccuguguuaggcagcucacaucugccaauaaccucaacuccagaggagcugacucucaauuucaaaggcacacaaagcauguauucacagacauacacaaaaauaaaauaauuuuuaaaagauguccuuuauuguaaagcauuuuuuugauacagcacgaauuaacauuagccugaauagucacaaaaauggaaaugugcuauuuuacauuauuuaacuuuuacuggguugaaauuuagcuguggaccagauacaguggcauaugacuuuagucucagcacuugagaggcagaggcagaugggucucuuaaauuugaagcuagccaggucuaaauagugaguucuaauccaaccaggacuauaaagugagaccuucccuuaaaaaugagaaaauuaacuguaacucuuuuguaaaauguauaaaccagaaaugaaauauacaugaauagaauuauccuacagcuggagacuauauguguaugugugugugaguauauauauguguguguguguguguauguauguguguauguguguguauauauauauauauauauauacucacauuucucaaacucagaauauauugauuuguuagagagaaaaaaaaacaaaacagauucuugaggauugggugaaauauacuaaaagcuaagcugugggcgugagaaguacagcugguaccuacccaacacugaguucaauaccuacaaccuaugugguagaaugagaaaaccaacuucugcaggcuguccucugaccuccagauguaccccaugaugugugcaacacccuauccuaaauaaauguauauauguauuuuuuaaaaacuaaaguuuugcuacauauaaugguaugcgcuuuaaucccaguauucagaaggcugaggcauaaagaucauaaauucaagagcaguguggugguucgaauaggcgugacccuaguagacucgugugaaugcuuagcccauagagaguagugcuguuaggaggcguagccuuguuaguguagguaugggcuuguuggaagagguuugucacuggguaauuaggcuuuaagguuuccuaauuucaagcuacaccuaguguggcauacagucuccuucugcugccuuugggucaaaauauagaacuguuugcuucuccaacaccaugccugccuggacaccuccaugguugugaugguaauggacuaaaccgcagaaacucuaagcuagcccucaguaaauguuuuucuuuauaagaguugccucacugggcagugguggugcacaccuuuaaucccagcacuugggaggcagaggcagguggguuucugagcucaaggccaaccugaucuacagaaugaguuucaggucagccugggcuacacagagaaacccugucucaggaaaaaaaaaaaaaaagaguugccucggucaugguaccucaaaaacccuaacuaagacaagcagccuaugaaauuuaaaaacaaaaacaaaaaacaguacagcacuacauaguggguuuuuuuuuuuccuauccuaaaauaaugucuuuuaauuucaaauuaccaagccuacccaguacaaagacuuaguuacucuuagauauuuauaaaaaauaaaaugcaaaacuaguguuuuuguguggaauuuuuacacucaggagaauacagucauggcugucagcuucagaacucaagcaucaggaguacacagcuaagucagccuuccccugaucaccacccucagccucaacucuacagcuccucaguagugucaguguaagagcuuagcuggggucuugccaucugagugucugggaaagcccugacuuaccacgcagugaagaagccuacagguggcuagcgcugugcccuacacucuggggagguacaaaacaaggcaguggcaagccucugcucuaauaagaguuucaguccaagugauaaaacaggcaaaaagaaaaauaauagaugccaccaacccaggaugugcccgguccaacugugaacacuucacaugagaugagaaugccagcaagcuggcucaguguuggguaaauguggucaccaagccuaaccaaugaccugagcuugaucccgaguacacaugguagcaagagagacccgauuccugcgaguuguccucugacaugcacaauagcaugcgugcacguggacacacacauuaaauaaauguuaaaaauaaacucacugagaugguguagacagacucagcuuaaauuccuuuaaacuucuuacaagaucauggccuuauaucaugggucccacauugccuugaauaguucguuuuuguuuguuuuuaaugugccugaguguuuugccuacauguauguaauguguaccacgggugugccuagugcccucagaguucagaagcggaaguugaaacuggaauuacagaugauugaaagacaacauguaggugcuggcaaccaaacccaaauccucuacaagagcaggaaguucucuuaaccacugagccaucucuucagcccucacucugcaucuugcccaccucuucuugcucauuuccucucguguauggccuguccucagccagaguguugauuuuguuacagcgcccauaccugugacaugccguggugcuuuggcaagguaauucccacucauccuuaagauuccuaccuaugggacuggcaagauggcucagugguuaagaacauguguuguucuugcagaggaucaaugcccagcacccacaugguagcacagcauguguuacaaccuuacauacaaggagaucuucuggcuuccaagggcacaaggcacacagguaguauacagauauauagucaaacaaaacaugcauauacguaaaauaaaauaaaaagaaauaaaauaaaacaacaaaagauuccuacuuaauccuacauucuaaguagggauuccucuuguacagcauccucuaucauacacucccauaaugccaccucguucuccaggaugugauggcucaauuucacauuuguuccuauaguuaggaucuucuuuuuuuagguaauaugucauguagcucaagcaguccucaaacuugcuauauacugaaggacgcugccaccucccaggacggggauuauaguggugugcaaucacacuguuuguugaauuucuuccuuuaaacaucaggggaauguacauuuuuaucguuguuuaugguacucacaugguaucggacagaagguuaagaaauuuguaugcaguaaaagccagauuggacagauugugaagggcaguuuagggaauuaacaugacuugcccaagaucacaguuuauaagucacagaaggccaggcacaguggcacacaccuuuacucccaguuuuugaaagguagaagcaggcagauuucugugaguucgagcccagccagggcuccauagugagacuguauaaaaccguauaaaacuagcagagacagaaucugaauaaggacaaaugauuauaaaagucuccaaauuuuuaauauuuuuauuacugguuuauguguguggguauugugcuugcuuguaugucugugugcacgcagugccugaggaguccauaaaagagcacuggacucccuggaacuagaguuagauaguugugugcugccaugugggugcuaggacuucgacucagguccucuggaagaguagucaaagugcuuaacuaugagccaucucuccagccccaagcccauauucuuacucucugucugaacuuagcuuuucacagaauagacuugguccagaguucauucauggacuauuuguagccgacucccaggaaacagaacauaucacaccucuuuccuguaggccuguguaaggcagacagcuguggacaaucacgaggcugagaggagggaacgcagguggaguucuugggaagaguuuguguggaagaugacucaaggaaggaagugagguggguggggugggacuggcaggaaaggcuggcaucugggcauguggaaggugccagccgaccccacuggcucugacgacuuggagcauguggcucgugcugagcaggagcgagaaagcuuagcguggcuuucuuguaugcauuucugccuacaguuuucucacuucucaagacuuuccauugacccaagggcucuuccccucucccuccauuaaauaacuuuugaaaacccaggggaaaguaugguauuuuuauuucuguugcauauuauuuguucuaaaaaaucaccaauaauguauucaguaacuguuaaagagugagaaggaagcuggucugggcccuggguagaauuucucucuguuaucugucagguaacucagaaaugaggccuguccucauuucucugaaugaaugaggaaguuccucuuuuaccuucaccuuccuccuaacccugccuccaaucucagagcacucuccagcuacucuuuccuuacaaggagaguuccuuugugucucccgucaaauccagaaaggccaaguguaauguccccaauugccuuccucagaaaccuuuauuuguucagagcccagucacucuggaagacugccuuugugaaaaccuguguggcaaguugaauauguuucauugauuuuuaggguuuuuggaaaguuuccacacccagcuuuugccaaccagguccucccuuaugucugagugggccuucuacuuuacgcuugcuuucuuugcguuucacauuuuaacaucucuuugucuuguguuuuucagucagguccuaauucgaagcagaguccucagggaaaauggaaaauacauucccaagcagguacucacugauauuuuauuuagaggcuccaccauucaccuguaagggcaguaaaaaccuaaauguuuuuuuauaagaggaugccagagaaaacuggagguggccauccaguuauuaagcugcagccuggugguguuugcugucauuugcccucacccuucuuaggaaauuguuuuuaaaugugacucagcuaaagugucagauuggcugccaaggagccugacagcucagaguguauaaguguauuccaagggccuuuagucaguucccugggggauaauuuggcaauuuacuaugucacaacucucauauuuaaaaaagguuuucuuuuuuuucugcuagucuuucuuaacacgaaaauauuacuucaacaacccagaggauggauuuuucaaaaaaacaaaaaggaagguugugccaccuucccccaugacagguauguuuauucaccaugggugguugaguaugaagucccaggagacagucauguaaaggacuuggaaaccaucuaacuaucucugggcugugagggaguguugauuuuuugaggcuucgugcaguguccaggauggaagccaaggccuaauacaugcaagcacucucccgcuuaggugcauccccagccccuaauauaggaguccuugaaaguggggcucgguuuuuccaaucaauccacaaauccuaguuuaucgaacucuuuguucggugcuguaggaacuugggagcaguuccuacccagugucuagaucguugcuggaagcuugugcccaaaugaagagcaguugccccuugauugcccacaccaacauacaguuugugaccuagcugauauaugacugcugccacccccguuuugugaaaagugacuauguaaaguggacaaaagcaguguuggccuucucucuuuccagucucuuccuucuaggugagauaaucagcccuucugauccuacagaagauacuaguguuaacacuuaggggcaacaaaauguccguguacauaugaaaaagauggucgccucacuaguccaggggugcaaaucaaagcaagauuuaguccuuuuagucuguuaaaccaaagaguaaagcuguucaaagccaugguugucaaggccuuguuaugacuugaaacucuaccccuacuccaaccccccaaaaagaauuacucuuuagaaacacauaaauaagacauuggucuguuaccucuuacaagguagguagcagcagcacucccugguggaaaggcugagaaugaaaauauugagagaucuggggcuggaggggugacucgcacuuaaaagcacuugcuguuuuugcagaggacccagguucaguuccaggcucccauaugacagcucacaacugucuauaacuccagucccagagaaucugaugccuuuucuggccuuugcaagaggccaugaugcacagauagauauauguaggcaaaacaacaacggguauuuuuuuaaucuuuaaaaaauauguauguaucuugagagauugguaccaugacaaugugaaaaugucaucaaaaauuauuuuuucuuuuuugguauugagaacugcucugcacacuccugcaugguaagcagugcucugccccugagcuacaucgucagccuuucuucauaaaauuaauuuucaaaaacagauugaaagguagaaagauauggaacagggcuggagagauggagagagcaguuaagagcacugacuacucuuccgaagguccugaguucaaaucccagcaaccacaugguggcucacaaccaucuguaaugagaucggaugcccucuucuggugugucugaagacagcuacauugcacuccuauacauaaaauaaaucuuuuuuuuaaaaaagaaagaaagaaagauaugcuacagagaacucaaaggauuucaggagaggguagagaggaauugucugcaucuuauguucugagaucauuugaacuuguacaguaaaccugacggcuggcccgcuaugcuggcacaugccucuuucacccuacagucagaaagcagugacaggcaaaccucuguuagucaaggccagcugggcuacacaguaagauccugucuuaaaaacaacugucugccuuaaauuugugaagucucugccaacaaagggaaacgugguguuuucuucuguguuugucucagaccccaccaugcucacagacaugaugaaagggaaugucacaaauguccucccaaugauucuuaucggcggauggaucaacaugacguuuucaggcuuugucacaaguaagucucaggucugggagaccuccuacguccuucacccaggucccuuucucagugcuacugagaaccuaaugucaccucgcggguaguauguuuucuugugaaaauaacaucuuuuugaacaaaaaucuugaguucuaaccugacucagaguucccagggugaugcuuuguaaguagggugacacaggaggcuuuagugcacgcuucucccaaaugucaggucaugcuucauccuggguaccugcuugcuccauggucuagaaacugucaucccucagggaaaucagagcagagugacauuuuagcuguucuggucucccuacgcugcuaccaauuuccuugugaaaaucauuuuccagaagccaguggcacagaguucccaccuccucugggaaagaauguguguucacacuucagcuggcucagguaccuaccaugguuugaggcaaacacuugguguuuuuuucuuugccuacagcuaaggucccguuuccacugacacuucgcuucaagccuaugcuucagcaaggaauagagcugcucacacuagacgcauccugguaagcguggugucuaaagaggccgcuggccccacaguucuaguuuccauuccacuagaaugagguuguuucuguuugagaaaucuugacucuucuuucuucucucccucucucucucucucucucucucucucucucuuucucucucuuaaaugaaagcucuauuugaaaugccacugcuagacuaaaacaguuuuacaggagucuugccaaaagaagguuuguuagccucucuucuuagaucuuaacaauguaggagugaagguauggaaagguuaaguagucuggccaagcagagcuucuuaacaaugcccuacagcuuaugagaauggagccuguguuugucagcucucugucacugaaacacugagagcaucaccuugcgaagaagaguauuuuguauuuuggcucaccguuuuggaggcucgugucacgaaccuguagucucagugcuuuggaucugugaugcagcaggguguggcagugccauauaaugaaggugaaugcuccccauagggucagaacaagagagaaagaugaaguauucagacuccuacaaucuccuccaagaacaccuccaccccugugaccuaaaacugcccaauaggcauccaucuccuaaagguccccccacuguccauuaguaccacagacuggggcccaagccuuuaguacaugagcuuguuuguuugcuuguuuugcuuuuugugagacagacucuacauaguccuggcugucuuggaacucauguggaccaggcuggccuggaaaucacagcaaucuauaugccucuguucugccucccaagugauggaauuaaaggcaugugccaucauaucaggcuaacacaugggcuuuuaaaaagaacauucuagauccaaauuauagaaaaguuuguacugucauuuuccuuaguuccaguuagccucacagcaacccugugaggucugcaaauguaauggugguccacacacaacuuuuccauaaccaguacuugcaccucuuucuacuccagugacuuagagcagaacacccagcuggaaucuaaaagcccucuugagaaacacuggcaugauacccaaaguacaguaacacugacuccugugguccuuccgggcuguucugucuguagcuucucaagaacuggccugaaacaaacucgaacaagaagaagaagaggagggucugguggcaauuuagacuucucugguuugaguagagccaucucugguuguaugaacccagggcaaagaaaaugccucacccugcucugugugagaagaaaagcuaccugugagcuuugugacuccgugaaacuauucccugccaggcucacuggcuaagcauaaaugccagggcuggagaaaagcguaucuuuucucagcauuugcacagguaugcaccucacgucugugggcagacaggggagccaggcaacguuccaguggggcucagugcuugcuucagcagacacgcaguagaguaacuguuguggauagaucacuggcacugcaggaccgaugcacccuuacagucuauggcaguagccagagcagacgcagugaagcgucggucgcucuucccauguggguagcacucuucauugcccuuugguuucuauuacauguaagcacauuuauggcuucccaagucggguggugagauaaaggcuagacgaucaaguuccaaauuuguucagguagccuucacccucaucauugcaaaugcuucccaaaggucaugccugguccucuccacuaaguggggaacacacaaacacaccaacacuccuaggggaugagguucacaguagauggccucuuucagugucacccacugugcagugugucagaagacagccuuacugugcuacugagcagcuguggguagugcagaugugagcgccguucaccucccuaauaacccaccgcacucucccgguugcuuugcuagggugaguucugcauccugguacuuccucaauguguuugggcuccggagcauuuacucucuaauccugggccaagauaacgguaagaagcagaguggguuagugagcagcugcugccugcugggugggguagucaccuguuuccugcuguugguuagcgcagccccacauagugcuuugguuggugaguuucugaggauggucuuaacagaugcaaagcucagacugaacaugggcaucucuccagcagucacugagcaguacuugcucagggucugacaccuuucuguaaagacccagcacuccguuaagccucugacccugaagccuaaggaaggaccuggcuagaucaguuccuguuuugagcagcuuccucagcagugcuaaacuuggcucuuguucagugaugaggaccuuggacacuguuaaccacugauuguuuuucucuacaguaggucuuaauaguuaccuuaugggguuaagugcagauagaggauaaaacagagaaauaccugggcacauagcccugcucaguaauuggugucuagugucauauugacauuuaagauaaaguuuggagcacuuuaguuuugucuguauuccacuuauaaucacccucauuuuccuggacuuucucagaaucacauaccagggugaccaggcuagugaggugucccaauucucaaacccaccaccaagcaucuauaagucaugccuauucucccauaagggugcugggugguuauggagccuugguacucacugggccugucuuaugcugcagccgccgaccagucacgaaugaugcaggagcagaugacaggagcagcgauggccaugccugcagacaccaacaaagcuuucaagguacaugccagagacuguucagaacugcagggguaucucagacuuacaccaguccucccucaaccacagcucacaguugcuucuguucaagugcaauccaaaugaacaguaugaugaaauaugcuguccugccccacccuauccaggacauaaaugaucacuuuguccaguguauccacacuguaugugcuggaugccucaugacagugagagagagaaaccauauucccauuacuuucauuacaguuuacucauguucuaguuuugaaaguuuuuuuuuuuuaauuuuaucugccuguuugugcaccuaagauuauguauaucuguggaccacgugcaugcaggugcuuauagaggucagaagaggcauugcauacccuagaacuugaguuauaggugguuacgagcugccguguaggugcuaggaacugaacccagguccucuacaagagcacuuaacagcagagccaccccuccagccccucuguauaauguuuauacagcaaagucucacuugauuaaaaguaaauuaagggaaguucuucauucugguucacaggaauauagaaagaccucuuagaguuugaggcuagccuauacuacaugagaccuuaccucaaaaaacagcaaaacaacaaaauucuaaaacauggacauaaaauuaaaacacgucuuugugaucuuguacaggacaguuuuguuuuaguuugaggguuguuguuuuuuaauuuauauauguggguauuguauauguuuuaacugcugagcccccucuccaugguuuuugacuuuuugagaccgucuccugccuuugcuucucaagugcugaaauuguagacauguuccaccaugccuggccuuaguaagcuuuuaaagauugcuuuaugaguauuuguauaucugggaggcauauggacaucucugcuucacacgauccaaugagcucauacacagaacagccuugcuuagcugcuggucagagagguggucacuccaugcuguccccagcugucagcucaguggcaagcaucccucuuagcaucccuguguucucuuccugugcagacagagugggaagcuuuggaacugacagaucaccagugggcgcucgaugauguggaagaagaacucauggccagagaccuccacuuugaaggcauguucaaaaaggaacuacagacguccauauucuaaccacaugcggggucagcuguguccggaacuugcaguagcacuuaaccuuguaacuuccguggagcuggagccucugagaauaaaaaggagggugcaggggcuggcgggugcagcaaggcucauucuugucugagcuggguuccccuuuauguuggaaacuagaggaaaaggaguugugggugacugcugucuuaaaguuugugauuguuccuucaggugacucuaguaaggacgucagagaaaggggagaccccaugcuacugagaauagcucaacccuuagcaaaaacuccgugcuuggaaagagcauugucaguuauagcaguuacuauguucggucagccugacuuccagccacaguaaacuccuguuuucuuaggauccaaacacccugcauuuuaccuugaauuucuuguuuguauuuuuaacuuucuuuacacacguaauauacuuuucucuaccacaauuuagaaacuauggcugagcagcacagcgcuccccgcacuguucacuugagccuacaaaggacgcagagaacugguguggcccaacauugcugaaauaaacucuuugcagaguggauccccagggccggggcagacucagcaaacuuuucauaucucuucauacuuaguccagugaaaacaggugacccugaggcacagccagacucucaagugccuuugggcucaucagagacagguuacauauacaaguucuugauuggaacuugaggaaauaucaacucuaucggccagucaauggugcugugcuguaaauggcuacucauuugaacgaaugaccucaucccaguuccucugggcaggagagaacuuaccacuguuggggcaagaggacaguuucugguggauauguagauuaaggugcccaggaguccucugaccagggaaguguuagggugccauuucuguaccaaaagcuggguguguugcauguuaagcacuguagccaagaacaagcgacucuugacucuuaauuaaacagcccuguuuucucuuugccugugaaaguguugcuucuguggguucugaaggggaaagagauaagagccuuugcccucaacaaacucauagaggggggcgggggaucuguggauguagccuagugaugucaguuaagaguacauuauccccagaacacacacaaaagaccucaucugagagaacugcuuauuuucuuuuaucuguaugaguguuuggcuuguaucaggucugugccccacaugugucagcgccugcagaggcuagagaggguggugaguucccuggaacuggaguuaucauggguuguaagcuaccgugagggugcugggaaccaaacccugguccuccacaagagcaaccagugcucuuaagcacgucucugcauccccaagagagaucuauuuugaggucauagaaccucugaaucugaugguccaaagccagggugacuugugagccaucucagaagcaaacuugauccugaaaguggggggagggacuaagggucagggcuugcagcugggguaggcguugguaaguaacugcuguguagaaugcugggggugggacaggguggcagcgcagagcucauggucauggucugguccuguccuguguccucgugccugccucugaaaaggcauuuccccuguccgggccucuuggaaaaguccucagaagguuaaaugcuuuugccgaaugacagagaaaggacacaacccauuagagaauugggaaagaaaagugacacaugcagagcuuagacacagucacagcagcagcauuuagucacagugggaggccacacagcuguccaucaugaauaacugucauauucaugugaaagauuacuaagcaauaaaacgaacgauguacugccacuacagcagagcuggucucucaaacaaagaacccagugucaaugaaucagugcccuucccaguuuugugugugcugaagacagaacccaggaccuuuguacacuagucaaguguucuaccacugagcugcauacccagcccuuccagggucuuuuuuuccccuccuuauuuuggggccuuauuauguagcccuaccuggcuuagaacuuauuauguaauccaaucuggccuuggauucagagauccaccugccucugccucugccuucucagugccaggacuaaagauggcaccaccacagucaacucccaucccaucccaucccauguuuuaaugcaaccuccagaauuaacaaauccauagaaauaaagguagauuagucguuaccagggcuuggggaagcagaacgggaaaugccuccuuaaggguccugugaauuuguucacaggguaaugugauagaugaccuguuaucacugauaaaauaccuaacaauaaucaaggaaacagaaaaucugggcucacaguuucagauguuucgcuccaugguuuguugccucugguuucuagaccuguggggaggagccagaacgcacagaguauaugacagggucuugacaucuugaggggcaugcccugccaaccuaguuugcugcaaugaggccuuucaucugaaaaguuacaucacaguauuugcacaaacuggagacuaagccuuccacaugugaaccuuuagggaaguuccagauccaaacuagagagugauguucuaaagcuggauaugacaggagcuaggaguacccccuuugacuugucuaggaaaugugugacuuuaucccauucaggaagaauggcucccuacagcagggauggucugaaaauggguuaggcacagcacacuuucaggguucccuaugacacauuuagggcuacauacggagcucaguuuauaaagugcuugcuuagcauacaggagggccuuggguucaaugcuagcacucccuaagcccagcaugauggcacucuccuguaauaguagcauucaaggggaaugaaaggugaucugaaguucaaggucauccuuaguuacauacuguguucaaagccagccugggcuuaguaagacccucucuuauguaagcugaguagaugauuuguauggaugaggucucaaccccgcugugcugacuaguuuuauggccacuugauacaagcuacaucugugagaagggaaucucacugaggaaaugccuccauaagucaggcuguaggcaagucuguagagcauuuuuuaaaauauuuuuuaaauuuaauugauguauaugaguacacuguagcugucuucagacacaccagaagaggggaugggaucccauuacagauggcugugagccaccaugugguugcugggaauugaacucagaaccucuggaagaacaaucagugcucuuaaucgcugagccaaucucuccagcccauuguagauggggccacuccugggcugcuagagccauuauggacugagcuggcuagguucuguaaguaggcugagcaagccaguaaguaacaauccucuuauuuccucugcaucagccccugcuuccaaguuccugcccaguuugaguuccugccuuggcuuucuucaguggacugauucaggguauuuaagacaaauaaaccccuuucuccccaaggugcuuuuggucaugguuuuugaccacagcaauaaucacccuaacuaaaacaccugucaagaacauaagaagaagggagaaaggauguuccucuagagaacccugauuaauacaaggagggaaggaacuauuugguuuacaggauacaucacagaggaaagcuaagacaggaucugaagcagagaucaugaaggaaugcugcuuacuggcuugcuuccaauguuggaguucaucaaaagacccucacucacaaagaccacagagacugccaucgcugcaaacugcaaaaauccugcaugaggauuuuuuauuauuccaacauguuggggacuccccucucagcacacaggccagaggagagacccagaacaaagaaagagcacacuuuuuauacuuuuguaaggggcagauaugggcaacaggguagcuggcuuagucucauugguguagcaccaccagcuugcuuucuuauagauagaacccaggcucugcugcccagagacuacacugcccacagugggcugggcccucccacaucaaacagcaaucaaacuguccccacagugauagaggcaacuucucaacugaaauucccucuucuaagguaugccuagguuugugucagauugacaaaaacuaugacuaguccuuaauaaaauguugcauaguuccauucugugugcauacacauacaugcugugagcugaaucuagggccuugaacacacuaagcacauuguacauauaucuccaaccauuguacauauaucuccaacauacaccauuuuuugagggaguugggacuggacuguuuuaaaaguaaaucccaucagaaagauggguaaauccugagcaauuuaguaagacagugucucaaaaauaaauaaagauaugaaaagaggaaggugggguggugggacagcuggcuggcuggaggacaagcaccuguaauccaucacuuuggaagcugaagcaggagggcuagaacaucaaagccagccucugccaugaagugagguugagaccggccaaagcuaccugagaaccugucuuuaaaagguugcugcugaagacaugaggaauagcucaauuguggaacauuugccugugugcaaggcucuagauucaauuuguaguaccaaguaaauagauccugguggaucauuucacacacauucuugugagcaucucuaacagguaaagcuuuguuuguuuaugguuuuugagacaggucuacuuagccaagacaucccuggaacgguccaucuuucucccucuacuucccagugcuagggcugccucaaaagauauccagcuagcauggcucauacgcggaguacgugcuuaagaguccagaaacuuagaauacccaagauauaagauacaauuugcuaaacauaugaaacucaagaagaacgaagaccaaaguguggacacuuugccccuucuuagaauuggaaacaaaacaccauggaaggaguuucagagacacaguuuggagcugagacgaaaggauggaccaucuagagacugccauauccggggauccaucucauuaucagccuccaaacgcugacaccauugcauacacuagcaagauuuugcugaaaggacccagauauagcugucucuugugagacuaugccggggccuagcaaacacagaaguggaugcucacagucagcuauuggauggaucacagggcccccaguggaggagcuagagaaaguaaccaaggagcuaaagggaucugcaacccuauagguggaacaacaauaugaacuacccaguacccucccccccccccccagcucaugucucuagcugcauauguaucagaagauggccuagucggccaucaguggaaagagaggcccauugguuuugcaaacuuuaucugccucaguacaggggaaugccagggccaagaagugggagugauugggugugggagcgggugggggacuuuugggauagcauuggaaauguaaaugaaauaaauaccuaauuuaaaaaaaaacaaaaacacugcuuuagcuaagauuuucuugguagcaauuuagaauaaaauaguaacauauguccuuaaaauuuacucacaguguuagugaaguuagaaaaucugauuuaaaauacuaacaaaucugacaauaacaacuuagguuaacuuaaaaacaggaacacuucauaaaaguauuguugggaaaaaaaagaguucacuaugaggggaaacauuucauucucaaaacaaaaaaauuguuuuuccucuucuuccuguuagcaguaguucugaauguuagauauuuuuuccauggggucaaagguaccuaaguauaugauugcgaguggaaacauaggggacagaaucaaguauuggcauuucuccacguucauuugugugagaauuuuuaauauaaaugcaagauguaaagcauuaaugcaagcaaaauguuucagugaacacauuucaacaguucaacuuuauaacaauuauaaauaaacuuguuaaaauucuccggacaaugccagcauuuggacuuuuuaaaaauaaguaaauuucuuauugacggcaacuaaaugguguuuguagcauuuuuaucacacaguagauuccauccauucacuauacuuuucuaacugaguuguccuacauacaaguacauguuuuuaauguuguccgucuucugugcuguuccuguaaguuugcuauuaaaauacauuaaacuauuaaaaaaaaaaaaagaguaauaggcugggcuguaguggugcacaccuuuagugccgaguacucgggaggcagaggcaggugaaucucugaguucgaggccagccuggucuacagagugaguccagaacagccagggcuacacagagaaacccugucucaaaaaaaacaaccaaaccacaacaaaaaugaguaauaucuaaaaccgaaacaacucacauaagcaaccaaagucuaauacuugugaaagagauacagaugccaaagagucagggagagcggacagcugggaaugguugggucugagaaauggggauuggagagagaaggagcagggcugagaaacuuuggguuuuaaaagcaggacuuaacaacuggcugucuuacaggaucagaguuguuugguugguaccaccaccagggagguugaaaucugagaagcaguucaggcuguagccagguuggugaaugagcagcaugcccucagagcugaggacagcuggcagggcaccgagcagccucuccagcccgccccagcucccaccugcucugccuuucauuuguguugucuugccaaagcggccagccagagucaagaugucagcccauggcucccggcauugucuacucggggaagcuucaucccugccagccacaccucuugggccuucucguucucucuggaaguuuccagugcucggcucccauaggugacagucugcagcccucucuacaguuggagggacuaacuccucccagcagagcccacaugggaggccugcuguguucuuuuccccuccccugcuauggaaggcaggacauuguuaucacuacucagagccuggcccugaacucagucuugugacuugguaguugcugugugaccuuuaacaaguuccuuugccuuucugagacacugguuaccagcuuccagaugaagaccacagcacuacaaagagcugcugugagacucagaaagaauggcacaggcaggugugugguaggcauacuugucacaaaccaagugcagagugacgguagagucccccaacccaagauagccaggaugaugacagauucuggacugagacuauuccagugugcaccuggcagccaguguucccuacuugacagcgcuucugugcccuggucuccucuuucccucccauggucagcuuucauccuggccuccggccaaagggaucaaaacguccugucuuugucuggagucucaagcuuagaaaccucaugggaccaaacuccccacuccaaagagggcagccagugaauagugcuguggagggggcagggugaacacgccuugaggagggaaggcaggccagcgcugaguggugugucugcucaaggggugcuaacauuuuaacaggcccaccggagaguugggaagagaguucagucuguaaaaugcacuccacauaagcacaaggacccaaguuggauccguagagggcauguaaaaauugaggcaugguagcacuuugccugcgauaccaguccugcggaggcagagacagguagauuccugggguucuuggucuauccaguccuguaucaucagcaggucucagagcacuaagagauucugucucgaauaagggagacauugggacuagagagauggcucagcaguuaaagcauuggcugccccugcagagaaccuggguucaauucccaggacacacucggcagcacacagccaucuguaacuccaguuccaggagaccugaugcccucuuccagccucagagggcaugcauauggugcacaaacacacucaggcaaaacacucauacacauaaaauaaaaacaaagagaguggggcagugguggugcacgccuucaaccccauaccuggggaagcacaagcaaaggcaggcagaucucugaguucgaggccaaccuggucuacagagcaagugaauaccugagacugaccucuggcauuuaugugugcaugugugugcacaugcacacccaacacauugcccaucagagauucacuggguagugagagaagaaccaggagcccucagcuacaccuacacccuuaggacugccugccuucccacacucacuguccauaggggucccucaaaggaaacuagcaggaggcaagaaaagggggguagauucuggauggccucuaaauaccaauuacaugcuauauagagaaacaaaaucuagauaguguccugcaagacuagaguagagcagcugucuccaucugacagcaaacuggcauggugugugcauguguguguguguguguguguguguguguguguguguguguaugggucugggugcugugugcauaaguccuguggaaaaccuaggagacccauacugggugucagggaguuauggcagcuggaauuuaagcucaaugugaaaccaaagugacucaccuuuuagccaucaagacaaagaaucacaagauuuaaaucacauuguagggcuggagagauggcucagcgguuaagaguacugacugcucuuccagagguccugaguucaauuucuagcaaccacaugguggcucacaaccaucuguaaugggaucugauacccucuucuggugugucugaagacagugacaguguucuuaucauauauauauauaaaguaaauaauuaaaaucuuaaaaaauaaaauaaaucacauuguaaagaggaaagcuuuaguugggcucacaucucagaguuacacuccaggaccacuuagcccaaugcuuugggucuguggcagugcauacaucaugguagccacaccuggcagaggccuggucaccucagaguggccaggagcaaagagaaagagaaguagcuggagacuuaauauccccuucaaggacagcaccucagugacacaccuuccuucaauugggcccagcuucuaaaagguuuggccaccuccgccacagugccccaggcugaugaacaggccucuaucgcaggcuuuuagaaacuuuucaguucuaacucaugagaggccauauucauagagaguuagagccuaggaaauggaaggcgaaacucagcuuucuacucaacccagcucauuuccaagagucacccugcaaaggacaccuugucagccauaaggugguaacagaagagagccggcaccauaacgaaagcccagaauccucuucucuaggaaaggguggaaagaaauggagagagagaacuccagaggaaagagggcuaucucuccauccaucucugaagagccucacacagcaaggacaggagagcagcccagagccugagguaaaagcgggacacuguccuucagaucgcaaagagcaucagccugcagccccagaugcucaggaggcagcccuggggguggggagagagagagagagagagagacccucucaacaagacaugugccacacacuaugugcaaaaguauuaaccagcuaucgguauccgcacucaauguuuuaaaagcuaaugucaggcacggcaaggggcuauccuucucugucauggccagaggccagagagcauaagaugagcucaacacaugaaagaacuguucuccucagcccucuccccccuucccucccucccuccuucccucccuccccccuucccaguauggaucccccaggcugagacuggagaagcuguugagcuugagcuuggagcccagggcuguggcuucuugcagcagcugcuccaccgcuaagcuauacacccccucugcuguuccucagaucccucaccacccaagccuuuuguugauguugucuugggguuuugggguuuugaaacaaggucuauauaacucugacugaccugacauuugugauguaggccagucuggccuugaacucauaaagaucuuccuaccucugccucccuagcucuuggacuuaaguccuauuuuccacaacuauuuaaaaaugucuauuacuggccgggcgugguggcgcaugccuuuaaucccagcacuugggaggcagaggcaggcggauuucugaguuccaggccagccuggucuacaaagugaguuccaggacagccagggcuauacagagaaacccugucuugaaaaaccaaaaaagaaaaaaaaaaugacuauuacuuuauuuacuuauugggggccaugcucauguggcaaccagaagacaacuucugggaacugguucggaucuuauaccauguggguucccaaggucagacuaagggcaucaggcuggguggcucccuuaugugcugagccaucuggcuggcuggccuuuuucuuuuuuuuaaagugauacccauuauuuuucugguugaaauaaaaaaaaggaguacauaguguguggaauacugguaaaaagaaaaguaaaauugaaugagagucauacccaugcugcugcucagcaucuuccggauugauggauggauggauccugacccaaaguggaucauucaggaucuaucuuugaggacccagagccuccaugaguugggauguucauugucguacuguuugcagaagggacaaugacuguuaagccacgugacuacccgucaaucagcaggggacuauggagaaugacugaauaaauaaauauuagugugcccagaccccgaaacgcugagcagugagcgggaagaggaggaccgaguacauggggauuguguugaaaaugucugcacagccacugcaagacgaacaggacugccgaacaguguacgugcaaccuuagauagaugauagguagguuagauagauagguagauagauagauagauagauagauagauagauagauagauagauagauagauaggaagguagauagauagauaggaagguagauagauagauaggaagguagauagauagauaggaagguagauagauagauacugauagauaguuuuuguuuguuuguagccuugauugucuuggaacugacuauguagaccaggcugcccuugaauucacggagauucaucugccucugccucccgagugcugggauuaaaggcgaucaccaccacaacuguccuuuacaaacucgagaaaggguuucucuguaucccaggcugaccuugaacuugcuauguagcccaggcuaccuuaaacugauuguguuccugcuuccuuuuccuaaguucugagauuacaaacguacaccaucacuccuggccauauaugagcucucugucucucucucucugucucucugucucccuccaacugccccucgugugugugcauauguguguguagaguggcucaggcuggccccgaacaggcaagacugaaguugaauuccugauccuccugccucaaucuccuaagugcugggaauuuaugccuuuaugugcaaaggaagcaguaugguaaugacugugaaugagcggggguggggguguggggagaacucacagguaagaugaccaguuuugggauguuucuuuguuugaaugcagacaaucaguccaucugucauacuggguuuuuuuuguuuguuuuuuuuuuguuuuuuguuuuuuuuuguuuuuuuuuuuuguuuuuuugguuuuucaagacaagguuucucuguguagcccuggcuguccuggaacucaccuuguagaccaggcuggccucgaacucagaaauccaccugucucugccucccaagugcugggauuaaaggcgugugccaccacugcccggcuaguccauacuguuuuuacaguucacaugaccaacaucuuagugaauaacaauccccaggaaaugucuccucaccauuucuggugggcacgggcauucuuuguauggcauucccugggggauucaguguaaugauggccaucugaaggacugggacagaggucaaugguacagugcuugacucacauucucgaggcccugaguccaauuccuagcacugagggagggaaaaaaaagaaaauauccaugaguauuaggaacugugcagagaggccucuggaguacuugauauugucucuguacagaaccucaguuccaaccacgccucugcuagauuaucacaucaguuccauguuggguacaguaagaauucuggaauuuugauuucuuaaaaaaaaaauaacccacaaauauuguaagaaugugcuuuugauuuaaucccagguguagggagguggggcugcuuuggacugucugccacagcugacugugauuugccuagugcucuagcagagacgucauuuugccagcugcauaguuucugugauugugugaccauuggaauucugggaacuuuucagaggguguauaaaugcuauggagaggcaggggugggugguuguugguuggaggggguugugguuuguuaguagcugugcucaaagaacaaacaaaaggaaagaaauuagauucaaggaucucucuuuucucuauccuucuuucugucucuagugauagggggugaaacugggggugggaggauaaagugcgggggaugggggugggagaagaacccagaaaguaccuaaggucagcuacaguucagccuucuccauuucucccgcuaguguuagaggcugaagauaaagaagguauuuguggugauuugaauaacaauggcucccauaagcucauauaguugaauacuuagccaucagggaguggcccuauuuugaaaagauuagaaggauuagaaaguguggccuuaacagaagcugugugucaaauggggaaggcuuugagguuucaaaagcccaugccaggccuagucugucugucugucugucucucuguguguguguguuucuauugaucaguauguagcucucagcuacuguuccagugccugccaacaugaugauaagggacuaaaccacugaaguuguaagcaagcacccaauuaaauacuuucucuuauagcaguugcuuuggucacggugucucuucauaacaauagaacagugacucagguaguauuguauccagucacaaaggccagaagaaauuacaugaucggcuaaccacaugcugaaaaucaccacaucggagaccagaaagaaguagaccuagggcuggcaagcugcuucugcagguaaagaagaucugaguuugguccccaggauacacaaggcagaaggagaaaacugacuccacagacaugaugugguaugccacaggccacacaaauacaaacacacacacacacacacacacaccaaaauaacaacaacaacaauaauagaaaagaaggagggugaggagaaagaagaagaaaagaagaaaaaagaaagaaguagaucuucgaaaaugugucagaauauauuguaaaaugaugaggagaaaggcaaguuacaagagcaauuaagaaagcgugggcucauuuuuauuuaauaugcucugggaaaagccuggaagauaugccaggcuguauguaugaucuaccuaugccuguaugaauccagagaaagugagcucccaguccccgcagguaugcaaauaaagcgggcuguagcuagaaggaacacugcagaaccccacagggcucugacaccaucugggcugugcugcuugugagaaaggggcggugaggagcagcgaacagagaccguucccaaaggaaaggguuaaguaucccgcgcuccugugggcgggcuugacgaggagaucggcagagccgggcucugcuggccaagccugagcaucucggaggaugcgccuccgggagcggcugcagggacgcgcgcaaggugaacgcauggcugcggaugcagcgcgcaggugaggagcuggccgagggaaggggagauggcgggacccaagaaggcaaggagcaaggcuuacagccccuucgcgggcaugggccugcacggugccaaaccccacccgggacacugcgggaaggcauggagccagggagagagaagcuggagaaggaggaagagagguaacccgagauggaccagcuucugcaggcuguccugcagaggcccucacccugcuccccccacccccuagucucugcggcugauugaucucaucuccccucagaacuguccagccauggggacccuaaugcuaggcaagcuccugccuggacugcgggugcccacaucucuugcaucgggggugguaggcagauggcauguuauucacugaaggcccagcucagccaucuccuccucugcaaagucuacagagcuguacgggcuucaguaucucuaguauguguuuucagcuggcugugcgaccuuggacaaguugcucaaccucucugacucuugguugcccacucuccuuuccugugugauggguacuugcaccugcuguaugggaagguuuagaacagaggccuaacuaagcaaagagcucaacacaggguauuauuauaaccuauauccauaucaggggccccaaguccuuccuucgcacaccucauccccagccucagaacugaggacuuuauggguccccagaccccagccuggccuaugagcagaaccuggggcuuaauagauguuugagagagggcuuaccaagacuuaaaggcugucugaauuaacgcugugacuggacccaagaggucuuugaauccccugaaacuucccacaaccucugaugagccuagggguacuccucggaagagucucugggguuaccucuaacuucuccuagugucugagccaccaaagguggcuguguccaagaggaaaaggacacagcaccugccccuaacacagcuggcccucagcuggcuggccacugcugaucccuccuaccucccuggccuacuuaaggauggacuuaggaauagggaccucuugggaauauaucuaccugggcccggauuguacaggggcuggagguguaaaggaaaaagacaggagccccaggccagcggcagacaggagaugauauacaagggagcuuugcuccggauagggagagccaggaacagaaggcaucccuggagaggagugucuaggcuaauacgaacuacccuccaauugucccuggacaugaugccgaccucuuucccuuuaaaaaacacugcuucucagaccgccuccugucggagcucuccaauccacgugaugguucacaggagcccuugcugacuagccccugccugcugaccaccagccaccccaaaagagguguucugaacucacugaguucacgccugcuccugagucuuuguauaugcuauugccgcugccaaaggcuuuccccucagagcgucaaaugcuuggcucucuuaccauucugccuuugcuuaagugucucucuccucagacaggcucuccuggcaccccuguggagacucuccucuguuaucaucuaaccacacuguauuuucuucaaagcuaaacuuuauaauuuuagggagucucauuucauaguucucaggcuggccugcaacuugcuagguagaucacagagauccuccugacucugcuaaggaucugaacuuuaacauuuuuaaaaaauuauauguaucguguguguguguguguaugugucugagugagugucuguguguguacaugcaugccuauuuggagaucagaaaacaacccaagggaaucaguuuucucuuuccaccauguggguccugaucaaggauugaacucugaggucaucaggcuuggcagcaagccccuuuauccacugagccuucucacuggccguuagguuaaaaucauuuauuguccaucuuacuuauaucucuccacaguggggagggggcagucuucucaaucuugcucagcgcuauaucccaaggucuguucaauuuauguguugaacuagagaagggcuuaugagggaagaaagcuuuccagacaaaggcuaaggagauagagcccugcuaucaaguuccuccugugggucugaccuucaugugucucauuaguuaugcgucauaugaauccccuugagguagacacucuuguuagcuucauuuuagagauaaaaguuaaaaccacgaugcugagaagcaaaguaacucacccaggagacaagaugccaggaaucuaacucagggcccuccgcaaaugcaggggcauguuccucuuucgcuuuuaugagagcuggauguugauaaaucuaauuugagggcaggcaagaaggcuuagcagcuaaagagguuugccacaaagcccgauggccugaguuugaucccugggaaccacguggaaggagagaacugacucccacagguuguccugcccuccaagcacuugcuguggcaaacauccccccuuaauuaaacaccuaaaugugauuuuaaaaacguaaaaucuguuuucagggacuggagagauggcuuagccagccagagcaaguagcacuuccugcucuugcagaguauccagcacugggguuaggugucucccagaugccuguaacucagccccuggggaauccaacacucuccccuggcaauggcaggcacugcacuuaacauauacaacuacuccugucauauguguguguguauacacacacacacacacacacacacacacacacacacacauauauauauauauauauauacacacauauauauauauauauauauacacacacacacauaugugcauagguacauauauauguauaucauauauaaaauauacuuaguauauacaacuaaaaggcugggccuguuagcacacacaccuuuaaucacagcacucagaaggcagagacaaguagaucuccauuaguucuaugccaucuuggucuacauaguucaggucagccauggcuauauagacccugucucaaaaaauaaaaucuugggacuggagagauagcccagugguuacaagcacuggcugcccuuccagaggacccagguucaauucccagcaccuacauggcaaaugacaaaugucuguaacuccaguuccaggggauccuauacccucacaccaaucagugcauauaagauaagcuaaauaaguuauuuaauaaaugaaauugucagguauagaaggcauuccaucccgagggaacagaaccuggugucaggacagaggcugagucagcuggccuggccgcagucucggaaagccaggaauagaacuugcauucucucccaagagcaguggggagucagaaaguuuugaaagcaaaggaagugaugugagcagagacccaguuuuuuaaaacuuuaaaagccgggcugacacuguuguuugaugcuucucuucuuucccaccagccccuggaggaagucaugggacccuucaacccucacgccaucucccucugcuuuaucuuuccuuucuccgcuuuuguagacggguccagugaagccuagaagucaagggcucuacacucaggcauugaauuagaccauggcccccagcccacaggccugcacaucuccucuucugcuguugcugcugccaugccugggggcuggcccugccuugggcagaggccuucccaggccccuggagaacucagaaccucacaugaucccaucagagucacagaccuuugaccucuucugggagaagcugagaaaugagaguuccuggcacagcggugacccucaggcccgugcugaggggcccaagaagcccgcagacccuuaccuaggaccagcccugcaugggcccaaggcagccccugggguccaaggugaaagacuacuaagagcugaugaccuccagcuggcccgagcauucaccucccaaggcuggacaggaccuccugacucacaggagcuucuggagccugaggcaccagaaccccacccugugcgagcaccucgucucacucuugucacuacaacucccagcucccuacucucggcagccauacuuuccacugccucccagaagccuggaggcacagcagggcagcagccagcuaggaacgaggagcuaauaauggucaaagccgagacccacaucacacaggcuucccccugggacuuccagggcucuucccacacuccgguacccgagacagaugcugugaggacgcugguguuggggaagcaggggggacaugaacagggcuuccaggaggcuguccaggguccccuacucacccagcaggauccaguagucccuggggucggcucaacacccccaguuaaaguggaauccaccccagagccuggagcccagcucgaccuggcauuggucagaagccuuccucuuccugaggggcugccagcugaaccccccaaaacuggagcuggggauaccugggaagucagcucucugggaccccaaccagaacagaccgaucuccuuggaggacaagauuccccagcaccccagccuauaccaccuucagccucagacacuucugaugggcaccuaagaccagguagguaucagcaugagggggcugagugggguugugaggaccagugguccaaggcagauagauguaauucugcaugucauuucccuccuuuggacaaauuggagugauggagccuuccuccugaggggcaggauuugggggaguaugggaaggucagacaagguaaugacuauugccauuucagcaguauccucgcugaauggagccgaccccaucuccccacaacgugugagaggagcgauggaggccccaggaacccccaaguccuucaucccugaccuuccaaauucugcucaagcugcaaauggaacagagagcccugugagggcccugcagccaggugaggccacggcuaggggugaggggagagaaaccaagaaccugugcuuagugauggggcaggggccagggcuaaauagagaaaagcacccgcugaaaggaauagguuaggaccucugagucgccgaacaaagcaaaccaauguucccuggaaacuccaggacaagacaucggcucuuuugagcucgaauguucuucugugcaacguagacccaucuuguacagucauaccccauccccucgggaaccccagcacccuggaugcugagacaagaggaucacaaguuugaggccugccugaacuacauacauacugaguucaaggcugggugugagcagcucauuaagacccuguuucaaaaucaaaaauacaaaggguuggagacgcaacuuagugguagaguuauugccuggcauaugaaagauccuggguuuaauccccggcaccaucacuacuaccacaaaaaaaaaaaaaggaaggaaggaaaggaaauuuacaucugucuugucuuugaugggaaccaagauagacaugugcccucaccaugacccaaugacuguggcaggugcuauuaucgccauuugacagacaaccuuggaaaauuaauuuaccaacuauacuuuugaauauggaaaaaucaaaagcacuuuuguguuuguuugggguucuguuguguuguuucuuguuuguuugagaugggggucucagguagccuagacugauguugaacucauugugguugcuggagauggcuuugaaguccugauccuccugcccugccuccuauuacaagcauguaccuccaccccucccccacucucaacagcacuucccgagggacccuuuuaauguuguuauuauuucagaugaagccgaggauuggccgggucgcccacaaagccacccuccagcacccccuguccaggcccccucgacaucucggcguggucucguuagagucaccacacagagagcucugggccagccacucccuccggagcccucagccagcuccauaguccccaucccagcuucuagccccccagccaaugccaccgcaccuccccugcguuggggaccccuucggcgggugcugaguuucuccugggagcuucauguguauggggugggggugcuuuuccugcuuccagcauuauuggcauuggucacaguggcagccgcccuagcgggaccccgauuagcacuaguggcugccgcgcugguauugguggcuucagggcugcgaucugccuacaugcucacggauccuuauggcucucaggcgcgacugggaguacgugcaggucuggugcuauacaacuugcccuuccccuugcuacucacugcacuggcagcacucacccugcugggcuugggugcuggucugccacagccucugcagaagccgcugcugcugggaauuguggcaccggugcauggcacauguuugcuggcuacagaccuguucuccaccagcccugugcucaaccuucuaacacaaggcuuaucuugcgccuggggcgccucaguggcucugggcacacucugccugugccgucgacgccugcuggaaggcccucggggcugggaugccaguccagggccccggcuguuggcuguggcgggcucacuggggcuguuggccaguggucugcaguuggcggccucucucuggcuguacccagggccuggccgggagggucgcuucuccugggcuugguggggcgugcacuucuggcugcgccugcuggaauugaccugggcacuggcccuggcgcuagcugcccuggcugccacucgucccaggccgcccacggagcacgcuugcugggcuaagcugcugcgucuggcgugccccgcgccuacagggaagagcgaaguucccgagagacccaauaacugcuaugcggggcccaguggccugggcacaggcggccuggacaucagcaaaagucucauccgcaacgcugcuggggaagcugggcuuccugucacuccugguucu

SEQ ID NO: 3299 - RNA, 16781 nt, Mus musculus
cucgcccgcaccggaaguugacggccuggcggcccagcuggaaacagugcgcggagaaagcuaggcugccccagauuccacgccagccagacugaggggcgggugaaggcccggagccgaaagccgggaggaacccaacuccucccgacccgcagcgaacucucagcgaagauggcggggcccgagcugcugcuugacuccaacauccgccucugggugguccugcccaucguuaucaucacuuucuucgugggcaugauccgccacuacgugucaauccuacugcagagcgacaagaagcucacccaggaacaagugucugacaggucaguacccucacccuauccugcugaccucacucccgggugaccuuggucaagaaagugcagggauugauuguaucacuuuaacugaguuuucaucgcgccccuacggguugaccuuggcgguuagcuguguuucauuuuugucaguaaaaugggaauaaucucaguaccuaccuaauagagagagcaggcauguagauguuagauuggaugauaccuaaaagccuuuagcccagggccuugcauguacuaaguguuuaagaaaacguucuuaauauuguuaggcuaguugccaaccgucagugagguucucucugaacuauccugcuccauuccguuauuaagaguacccacugagagucagaugcaauauucccuugaguccugcuaacauccaggcaagugaauuucauaaucuacacuaccaaagaacuguagugaucugcugagaugcuaagguauaaagugccuccaaagcuuggagacuaccacagagacgugugaggaguugcgauggaccauuccaccugccuccucuccucacuugccuucuuacagugcuuuucugugggagacagaacuuugacauaacuucagccacuucacauuaaaaucaguaacaguuuucaaucacuuauucuagucauuuucagagacuagcugaagacagugcugcugguuccuugacuuguccagaucacauaggaaucacuuuaaugaagagaaacguuucaaacguuucugcagagaacagaaaacaaaaaccaaaacaaaacaaaaaccucauuuugccgggcgugguggcacacaccuuuaaucccagcacuugggaggcagaggcagguggauuucugaguucaaggccagccuggucuacagagugaguuccaggacagccagagcuauacagaggaacccugucucgaaaaaccaaaaaaaaagaagaagaagaaaaaaaaaaaaaaaaccucauuuuaucguauuuaaaaguuacuuucuuuuuguggcaaguaauacuggauuuccauuugcuggugauuuaaagaucaccuuaaauuaaaaacacuuuaaaaaaaaaaagauuuauuuuauguaugugagcacacuguugcuguguucaggcacaccagaagagggcaucagaucucacuauagaugguugcagccaccaugugguugcugggauuugaacucagaaccucuggaagagcagucagugcucuuaauggcugaaccaucucuccagcccuaaaaacacuucuucugcaaugaggcugugauguaacucaguuggguacagugcuuggacagcuggcuuugaagcccuggguuccuuaccccagcauaagccagcuauggcaguguaagccuguaaugccaggacucaaagauggagguaggaagaucagaagcucaagcaagcuaccuauagacuggaggucaggcuggugcacaugagagucugucccccaaaauguccagcuuggguauuuucgauugucuuuuuuuuuuuuuuuuuuuuugucuuuccuuauucugcugcugauaauaauaauaacaacagcaauaauaauaauaagccagcuuuaugaaacauucuaagcagguacaaugauaaggacuuaacauuuguuaauuuauuuaaaaccaaaaagcaacucaaugugguugauacuguccucauuuuauagaaacugagacuuuaacagaguuccguaauaguaauggaugaugacaauucaugacuuuaagcuaaaucucgugguucccaagccuagguucuuucuuuuucccaacagugcccacuaugacuauuuugugugccauuaguuucagagcugacuagagacagcccccugaagcaagccuuaggaaguuagcuuaguacagacuugaaaacuacaagaagauggggaguggagaaaacucaguaauuuaaauuuuauuuaguuuuuuuuuaaguaucuacuuuugcuagcaugguggugcaugccuuucaucccagcacucaggaagcagaagcagguagauaugugagaguuccagggcaaccuggucucuuuagaauguuccagaacagccagagcuacauaacagagagacccugucucaaaaaaaaaauguauuuuuguuuuguucuuugugauugagcguuugccugcauguaugaauuguguauguacuguaugugucgugccugcggaggcuagaggagggggguggauccacuggaguuggaguuauagaaaacuaguugugagcggccaugugggagcuaggaacugaaccaggcuccucuacaagaacaacaaguggguuaacugcucagccauugcuccagccucauucaacaguuucugauuccuguaaaauaauugucauuuuauccucacaacgaagcaugcuauccuaaccccgcuuuuauaacuaaaaggaaaaucagagaaaucaaacagccuuuccaaagucaucaggguaauagagcauugcauuuguacagauugaguguaacuaugugaugcaguuuucugcccugguucaccucacaguuuuagagugaugauucuaaaugacaucagacccucagcucuuuuaguauucuuuuuuuuguuguuguuuguuuuuuuuugguuuuuuguuuuuuuugagacaggguuucucuguguagccuuggcuguccuggaacucacucuguagaccaggcuggccuugaacucagaaauccaccugccucugccucccgagugcugggauuaaaggcgugcgccaccacucccggcucuuuuaguauucuacagaugaauuauacaguuuauauauaagaagguugguugguuuguugguuuguuuuucaagaacuuuuaaaagguaacacaguguccgagguguaauaaucagaaauaaaggaaagagauuuuuaguaugcauuucauacaugcauauuugugcacagcuaucuuacaagaugucauaugcauacaucuagcuauaaaaucacaacuaggacagaucaauugugggcuaaagcagaugaugucacagaggcaguacugucuauaaaugguauacuaagucuacccagaaccuguuuauaaacuuaguagcuagaaagccugugcuccuuccacacuggaguuagguuugcaccuuagauaacuagaauaguugagugagguauacagaaguaguguaggacauaggaccauuccuuguuacauaacuaccuagcauugaggauaucauaacaucucuaaauccaugacaagugacaguuauauggcauuucuccuccacacugucauuacgacaaucaaaaaaguuccagauaugucaaacaggguagcuuacaccuagacuccuagagcaggggaagcuuacguaggaucaccauggguuugagaucagauaggguaagggcuauaguguaagacauugucucacaccaacccuuucccuugaaauagccagggauaaugguacacaacuauaaucccagcacauggaaggaugaggcaggagaauugagacgucauggccagccugggcucagugaaacaccuucucaaaagaaacaaaaaguugcccagauuuccauaaggccucuagagggugguacuaucccuguggagagucaugcuauggggaacaucucuagucguaaucucuccaucucugagugagguguuuaggucaugcccacucugacauggugcaacuuuaccccaccaaaaacuguucuuggggcugcuaauguuaaaaguacuuauugcucuuucagaggaccugaguucaguuccuagcaccuguguuaggcagcucacaucugccaauaaccucaacuccagaggagcugacucucaauuucaaaggcacacaaagcauguauucacagacauacacaaaaauaaaauaauuuuuaaaagauguccuuuauuguaaagcauuuuuuugauacagcacgaauuaacauuagccugaauagucacaaaaauggaaaugugcuauuuuacauuauuuaacuuuuacuggguugaaauuuagcuguggaccagauacaguggcauaugacuuuagucucagcacuugagaggcagaggcagaugggucucuuaaauuugaagcuagccaggucuaaauagugaguucuaauccaaccaggacuauaaagugagaccuucccuuaaaaaugagaaaauuaacuguaacucuuuuguaaaauguauaaaccagaaaugaaauauacaugaauagaauuauccuacagcuggagacuauauguguaugugugugugaguauauauauguguguguguguguguauguauguguguauguguguguauauauauauauauauauauacucacauuucucaaacucagaauauauugauuuguuagagagaaaaaaaaacaaaacagauucuugaggauugggugaaauauacuaaaagcuaagcugugggcgugagaaguacagcugguaccuacccaacacugaguucaauaccuacaaccuaugugguagaaugagaaaaccaacuucugcaggcuguccucugaccuccagauguaccccaugaugugugcaacacccuauccuaaauaaauguauauauguauuuuuuaaaaacuaaaguuuugcuacauauaaugguaugcgcuuuaaucccaguauucagaaggcugaggcauaaagaucauaaauucaagagcaguguggugguucgaauaggcgugacccuaguagacucgugugaaugcuuagcccauagagaguagugcuguuaggaggcguagccuuguuaguguagguaugggcuuguuggaagagguuugucacuggguaauuaggcuuuaagguuuccuaauuucaagcuacaccuaguguggcauacagucuccuucugcugccuuugggucaaaauauagaacuguuugcuucuccaacaccaugccugccuggacaccuccaugguugugaugguaauggacuaaaccgcagaaacucuaagcuagcccucaguaaauguuuuucuuuauaagaguugccucacugggcagugguggugcacaccuuuaaucccagcacuugggaggcagaggcagguggguuucugagcucaaggccaaccugaucuacagaaugaguuucaggucagccugggcuacacagagaaacccugucucaggaaaaaaaaaaaaaaagaguugccucggucaugguaccucaaaaacccuaacuaagacaagcagccuaugaaauuuaaaaacaaaaacaaaaaacaguacagcacuacauaguggguuuuuuuuuuuccuauccuaaaauaaugucuuuuaauuucaaauuaccaagccuacccaguacaaagacuuaguuacucuuagauauuuauaaaaaauaaaaugcaaaacuaguguuuuuguguggaauuuuuacacucaggagaauacagucauggcugucagcuucagaacucaagcaucaggaguacacagcuaagucagccuuccccugaucaccacccucagccucaacucuacagcuccucaguagugucaguguaagagcuuagcuggggucuugccaucugagugucugggaaagcccugacuuaccacgcagugaagaagccuacagguggcuagcgcugugcccuacacucuggggagguacaaaacaaggcaguggcaagccucugcucuaauaagaguuucaguccaagugauaaaacaggcaaaaagaaaaauaauagaugccaccaacccaggaugugcccgguccaacugugaacacuucacaugagaugagaaugccagcaagcuggcucaguguuggguaaauguggucaccaagccuaaccaaugaccugagcuugaucccgaguacacaugguagcaagagagacccgauuccugcgaguuguccucugacaugcacaauagcaugcgugcacguggacacacacauuaaauaaauguuaaaaauaaacucacugagaugguguagacagacucagcuuaaauuccuuuaaacuucuuacaagaucauggccuuauaucaugggucccacauugccuugaauaguucguuuuuguuuguuuuuaaugugccugaguguuuugccuacauguauguaauguguaccacgggugugccuagugcccucagaguucagaagcggaaguugaaacuggaauuacagaugauugaaagacaacauguaggugcuggcaaccaaacccaaauccucuacaagagcaggaaguucucuuaaccacugagccaucucuucagcccucacucugcaucuugcccaccucuucuugcucauuuccucucguguauggccuguccucagccagaguguugauuuuguuacagcgcccauaccugugacaugccguggugcuuuggcaagguaauucccacucauccuuaagauuccuaccuaugggacuggcaagauggcucagugguuaagaacauguguuguucuugcagaggaucaaugcccagcacccacaugguagcacagcauguguuacaaccuuacauacaaggagaucuucuggcuuccaagggcacaaggcacacagguaguauacagauauauagucaaacaaaacaugcauauacguaaaauaaaauaaaaagaaauaaaauaaaacaacaaaagauuccuacuuaauccuacauucuaaguagggauuccucuuguacagcauccucuaucauacacucccauaaugccaccucguucuccaggaugugauggcucaauuucacauuuguuccuauaguuaggaucuucuuuuuuuagguaauaugucauguagcucaagcaguccucaaacuugcuauauacugaaggacgcugccaccucccaggacggggauuauaguggugugcaaucacacuguuuguugaauuucuuccuuuaaacaucaggggaauguacauuuuuaucguuguuuaugguacucacaugguaucggacagaagguuaagaaauuuguaugcaguaaaagccagauuggacagauugugaagggcaguuuagggaauuaacaugacuugcccaagaucacaguuuauaagucacagaaggccaggcacaguggcacacaccuuuacucccaguuuuugaaagguagaagcaggcagauuucugugaguucgagcccagccagggcuccauagugagacuguauaaaaccguauaaaacuagcagagacagaaucugaauaaggacaaaugauuauaaaagucuccaaauuuuuaauauuuuuauuacugguuuauguguguggguauugugcuugcuuguaugucugugugcacgcagugccugaggaguccauaaaagagcacuggacucccuggaacuagaguuagauaguugugugcugccaugugggugcuaggacuucgacucagguccucuggaagaguagucaaagugcuuaacuaugagccaucucuccagccccaagcccauauucuuacucucugucugaacuuagcuuuucacagaauagacuugguccagaguucauucauggacuauuuguagccgacucccaggaaacagaacauaucacaccucuuuccuguaggccuguguaaggcagacagcuguggacaaucacgaggcugagaggagggaacgcagguggaguucuugggaagaguuuguguggaagaugacucaaggaaggaagugagguggguggggugggacuggcaggaaaggcuggcaucugggcauguggaaggugccagccgaccccacuggcucugacgacuuggagcauguggcucgugcugagcaggagcgagaaagcuuagcguggcuuucuuguaugcauuucugccuacaguuuucucacuucucaagacuuuccauugacccaagggcucuuccccucucccuccauuaaauaacuuuugaaaacccaggggaaaguaugguauuuuuauuucuguugcauauuauuuguucuaaaaaaucaccaauaauguauucaguaacuguuaaagagugagaaggaagcuggucugggcccuggguagaauuucucucuguuaucugucagguaacucagaaaugaggccuguccucauuucucugaaugaaugaggaaguuccucuuuuaccuucaccuuccuccuaacccugccuccaaucucagagcacucuccagcuacucuuuccuuacaaggagaguuccuuugugucucccgucaaauccagaaaggccaaguguaauguccccaauugccuuccucagaaaccuuuauuuguucagagcccagucacucuggaagacugccuuugugaaaaccuguguggcaaguugaauauguuucauugauuuuuaggguuuuuggaaaguuuccacacccagcuuuugccaaccagguccucccuuaugucugagugggccuucuacuuuacgcuugcuuucuuugcguuucacauuuuaacaucucuuugucuuguguuuuucagucagguccuaauucgaagcagaguccucagggaaaauggaaaauacauucccaagcagguacucacugauauuuuauuuagaggcuccaccauucaccuguaagggcaguaaaaaccuaaauguuuuuuuauaagaggaugccagagaaaacuggagguggccauccaguuauuaagcugcagccuggugguguuugcugucauuugcccucacccuucuuaggaaauuguuuuuaaaugugacucagcuaaagugucagauuggcugccaaggagccugacagcucagaguguauaaguguauuccaagggccuuuagucaguucccugggggauaauuuggcaauuuacuaugucacaacucucauauuuaaaaaagguuuucuuuuuuuucugcuagucuuucuuaacacgaaaauauuacuucaacaacccagaggauggauuuuucaaaaaaacaaaaaggaagguugugccaccuucccccaugacagguauguuuauucaccaugggugguugaguaugaagucccaggagacagucauguaaaggacuuggaaaccaucuaacuaucucugggcugugagggaguguugauuuuuugaggcuucgugcaguguccaggauggaagccaaggccuaauacaugcaagcacucucccgcuuaggugcauccccagccccuaauauaggaguccuugaaaguggggcucgguuuuuccaaucaauccacaaauccuaguuuaucgaacucuuuguucggugcuguaggaacuugggagcaguuccuacccagugucuagaucguugcuggaagcuugugcccaaaugaagagcaguugccccuugauugcccacaccaacauacaguuugugaccuagcugauauaugacugcugccacccccguuuugugaaaagugacuauguaaaguggacaaaagcaguguuggccuucucucuuuccagucucuuccuucuaggugagauaaucagcccuucugauccuacagaagauacuaguguuaacacuuaggggcaacaaaauguccguguacauaugaaaaagauggucgccucacuaguccaggggugcaaaucaaagcaagauuuaguccuuuuagucuguuaaaccaaagaguaaagcuguucaaagccaugguugucaaggccuuguuaugacuugaaacucuaccccuacuccaaccccccaaaaagaauuacucuuuagaaacacauaaauaagacauuggucuguuaccucuuacaagguagguagcagcagcacucccugguggaaaggcugagaaugaaaauauugagagaucuggggcuggaggggugacucgcacuuaaaagcacuugcuguuuuugcagaggacccagguucaguuccaggcucccauaugacagcucacaacugucuauaacuccagucccagagaaucugaugccuuuucuggccuuugcaagaggccaugaugcacagauagauauauguaggcaaaacaacaacggguauuuuuuuaaucuuuaaaaaauauguauguaucuugagagauugguaccaugacaaugugaaaaugucaucaaaaauuauuuuuucuuuuuugguauugagaacugcucugcacacuccugcaugguaagcagugcucugccccugagcuacaucgucagccuuucuucauaaaauuaauuuucaaaaacagauugaaagguagaaagauauggaacagggcuggagagauggagagagcaguuaagagcacugacuacucuuccgaagguccugaguucaaaucccagcaaccacaugguggcucacaaccaucuguaaugagaucggaugcccucuucuggugugucugaagacagcuacauugcacuccuauacauaaaauaaaucuuuuuuuuaaaaaagaaagaaagaaagauaugcuacagagaacucaaaggauuucaggagaggguagagaggaauugucugcaucuuauguucugagaucauuugaacuuguacaguaaaccugacggcuggcccgcuaugcuggcacaugccucuuucacccuacagucagaaagcagugacaggcaaaccucuguuagucaaggccagcugggcuacacaguaagauccugucuuaaaaacaacugucugccuuaaauuugugaagucucugccaacaaagggaaacgugguguuuucuucuguguuugucucagaccccaccaugcucacagacaugaugaaagggaaugucacaaauguccucccaaugauucuuaucggcggauggaucaacaugacguuuucaggcuuugucacaaguaagucucaggucugggagaccuccuacguccuucacccaggucccuuucucagugcuacugagaaccuaaugucaccucgcggguaguauguuuucuugugaaaauaacaucuuuuugaacaaaaaucuugaguucuaaccugacucagaguucccagggugaugcuuuguaaguagggugacacaggaggcuuuagugcacgcuucucccaaaugucaggucaugcuucauccuggguaccugcuugcuccauggucuagaaacugucaucccucagggaaaucagagcagagugacauuuuagcuguucuggucucccuacgcugcuaccaauuuccuugugaaaaucauuuuccagaagccaguggcacagaguucccaccuccucugggaaagaauguguguucacacuucagcuggcucagguaccuaccaugguuugaggcaaacacuugguguuuuuuucuuugccuacagcuaaggucccguuuccacugacacuucgcuucaagccuaugcuucagcaaggaauagagcugcucacacuagacgcauccugguaagcguggugucuaaagaggccgcuggccccacaguucuaguuuccauuccacuagaaugagguuguuucuguuugagaaaucuugacucuucuuucuucucucccucucucucucucucucucucucucucucucuuucucucucuuaaaugaaagcucuauuugaaaugccacugcuagacuaaaacaguuuuacaggagucuugccaaaagaagguuuguuagccucucuucuuagaucuuaacaauguaggagugaagguauggaaagguuaaguagucuggccaagcagagcuucuuaacaaugcccuacagcuuaugagaauggagccuguguuugucagcucucugucacugaaacacugagagcaucaccuugcgaagaagaguauuuuguauuuuggcucaccguuuuggaggcucgugucacgaaccuguagucucagugcuuuggaucugugaugcagcaggguguggcagugccauauaaugaaggugaaugcuccccauagggucagaacaagagagaaagaugaaguauucagacuccuacaaucuccuccaagaacaccuccaccccugugaccuaaaacugcccaauaggcauccaucuccuaaagguccccccacuguccauuaguaccacagacuggggcccaagccuuuaguacaugagcuuguuuguuugcuuguuuugcuuuuugugagacagacucuacauaguccuggcugucuuggaacucauguggaccaggcuggccuggaaaucacagcaaucuauaugccucuguucugccucccaagugauggaauuaaaggcaugugccaucauaucaggcuaacacaugggcuuuuaaaaagaacauucuagauccaaauuauagaaaaguuuguacugucauuuuccuuaguuccaguuagccucacagcaacccugugaggucugcaaauguaauggugguccacacacaacuuuuccauaaccaguacuugcaccucuuucuacuccagugacuuagagcagaacacccagcuggaaucuaaaagcccucuugagaaacacuggcaugauacccaaaguacaguaacacugacuccugugguccuuccgggcuguucugucuguagcuucucaagaacuggccugaaacaaacucgaacaagaagaagaagaggagggucugguggcaauuuagacuucucugguuugaguagagccaucucugguuguaugaacccagggcaaagaaaaugccucacccugcucugugugagaagaaaagcuaccugugagcuuugugacuccgugaaacuauucccugccaggcucacuggcuaagcauaaaugccagggcuggagaaaagcguaucuuuucucagcauuugcacagguaugcaccucacgucugugggcagacaggggagccaggcaacguuccaguggggcucagugcuugcuucagcagacacgcaguagaguaacuguuguggauagaucacuggcacugcaggaccgaugcacccuuacagucuauggcaguagccagagcagacgcagugaagcgucggucgcucuucccauguggguagcacucuucauugcccuuugguuucuauuacauguaagcacauuuauggcuucccaagucggguggugagauaaaggcuagacgaucaaguuccaaauuuguucagguagccuucacccucaucauugcaaaugcuucccaaaggucaugccugguccucuccacuaaguggggaacacacaaacacaccaacacuccuaggggaugagguucacaguagauggccucuuucagugucacccacugugcagugugucagaagacagccuuacugugcuacugagcagcuguggguagugcagaugugagcgccguucaccucccuaauaacccaccgcacucucccgguugcuuugcuagggugaguucugcauccugguacuuccucaauguguuugggcuccggagcauuuacucucuaauccugggccaagauaacgguaagaagcagaguggguuagugagcagcugcugccugcugggugggguagucaccuguuuccugcuguugguuagcgcagccccacauagugcuuugguuggugaguuucugaggauggucuuaacagaugcaaagcucagacugaacaugggcaucucuccagcagucacugagcaguacuugcucagggucugacaccuuucuguaaagacccagcacuccguuaagccucugacccugaagccuaaggaaggaccuggcuagaucaguuccuguuuugagcagcuuccucagcagugcuaaacuuggcucuuguucagugaugaggaccuuggacacuguuaaccacugauuguuuuucucuacaguaggucuuaauaguuaccuuaugggguuaagugcagauagaggauaaaacagagaaauaccugggcacauagcccugcucaguaauuggugucuagugucauauugacauuuaagauaaaguuuggagcacuuuaguuuugucuguauuccacuuauaaucacccucauuuuccuggacuuucucagaaucacauaccagggugaccaggcuagugaggugucccaauucucaaacccaccaccaagcaucuauaagucaugccuauucucccauaagggugcugggugguuauggagccuugguacucacugggccugucuuaugcugcagccgccgaccagucacgaaugaugcaggagcagaugacaggagcagcgauggccaugccugcagacaccaacaaagcuuucaagguacaugccagagacuguucagaacugcagggguaucucagacuuacaccaguccucccucaaccacagcucacaguugcuucuguucaagugcaauccaaaugaacaguaugaugaaauaugcuguccugccccacccuauccaggacauaaaugaucacuuuguccaguguauccacacuguaugugcuggaugccucaugacagugagagagagaaaccauauucccauuacuuucauuacaguuuacucauguucuaguuuugaaaguuuuuuuuuuuuaauuuuaucugccuguuugugcaccuaagauuauguauaucuguggaccacgugcaugcaggugcuuauagaggucagaagaggcauugcauacccuagaacuugaguuauaggugguuacgagcugccguguaggugcuaggaacugaacccagguccucuacaagagcacuuaacagcagagccaccccuccagccccucuguauaauguuuauacagcaaagucucacuugauuaaaaguaaauuaagggaaguucuucauucugguucacaggaauauagaaagaccucuuagaguuugaggcuagccuauacuacaugagaccuuaccucaaaaaacagcaaaacaacaaaauucuaaaacauggacauaaaauuaaaacacgucuuugugaucuuguacaggacaguuuuguuuuaguuugaggguuguuguuuuuuaauuuauauauguggguauuguauauguuuuaacugcugagcccccucuccaugguuuuugacuuuuugagaccgucuccugccuuugcuucucaagugcugaaauuguagacauguuccaccaugccuggccuuaguaagcuuuuaaagauugcuuuaugaguauuuguauaucugggaggcauauggacaucucugcuucacacgauccaaugagcucauacacagaacagccuugcuuagcugcuggucagagagguggucacuccaugcuguccccagcugucagcucaguggcaagcaucccucuuagcaucccuguguucucuuccugugcagacagagugggaagcuuuggaacugacagaucaccagugggcgcucgaugauguggaagaagaacucauggccagagaccuccacuuugaaggcauguucaaaaaggaacuacagacguccauauucuaaccacaugcggggucagcuguguccggaacuugcaguagcacuuaaccuuguaacuuccguggagcuggagccucugagaauaaaaaggagggugcaggggcuggcgggugcagcaaggcucauucuugucugagcuggguuccccuuuauguuggaaacuagaggaaaaggaguugugggugacugcugucuuaaaguuugugauuguuccuucaggugacucuaguaaggacgucagagaaaggggagaccccaugcuacugagaauagcucaacccuuagcaaaaacuccgugcuuggaaagagcauugucaguuauagcaguuacuauguucggucagccugacuuccagccacaguaaacuccuguuuucuuaggauccaaacacccugcauuuuaccuugaauuucuuguuuguauuuuuaacuuucuuuacacacguaauauacuuuucucuaccacaauuuagaaacuauggcugagcagcacagcgcuccccgcacuguucacuugagccuacaaaggacgcagagaacugguguggcccaacauugcugaaauaaacucuuugcagaguggauccccagggccggggcagacucagcaaacuuuucauaucucuucauacuuaguccagugaaaacaggugacccugaggcacagccagacucucaagugccuuugggcucaucagagacagguuacauauacaaguucuugauuggaacuugaggaaauaucaacucuaucggccagucaauggugcugugcuguaaauggcuacucauuugaacgaaugaccucaucccaguuccucugggcaggagagaacuuaccacuguuggggcaagaggacaguuucugguggauauguagauuaaggugcccaggaguccucugaccagggaaguguuagggugccauuucuguaccaaaagcuggguguguugcauguuaagcacuguagccaagaacaagcgacucuugacucuuaauuaaacagcccuguuuucucuuugccugugaaag

SEQ ID NO: 3300 - RNA, 12420 nt, Mus musculus
uaguggucagcgggugcuuguaaccggggacaggguagcucuuagucuucacaucgcgaguggaggaaucuuguuuaccccagcgugggagccaagcuagagcgcagggauuagagugcgcacgcgcgucgcucugccagcccuuucuggggcucgaacacucggguacuggcuggcggcgcaggcgcgcuggaggccuguagaggucgcggcgccugcgcagucacucuuccucaggcggccgccauggcgggacaagaggauccggugcagcgggagauucaccaggacugggcgaaccgggaguacauugagaucaucaccagcagcaucaagaaaaucucagacuuucucaacucuuucggucagcgggcgagcaggggaggcugggaggagggaggccugggaggcggccggcggcggggaggagaggcgcgccgcccuggcuacucgcuuccucuuuggcugcccgccggccccagugcccucaccccgagccucacugggccguuuccgagggucuacccugcccguugccaugccccacuugcgcucgucagcacgcccacuguccagccucuuaggcccauccaucauccgccccgguuugcgccgcgcuuccgugccagucuucacuuggcaggcagugcgcagccgugucacggucacggucgcgcuuacuguugagagacuccugcucguuguccaucuccuucaggaagaaguccgaaccccuuugaugucaugccuucuauugcucccguuuaaccacucccggcagguucauucauccccggcucgauuuggugcuagugcugaggguuguaagggauggggcccgcucgggccuugggaauggcuuuucuagcccuguaucugcuucaugguaggugcucuggaugcuucugucuggcuccucggauuuuacagggcagaugguuucagcagaguccacuuuuccaaaaaacuauuccuagguguggccggcuagugacagucuugauuucuuucugcgugcguuccuagccuucuggacugaaaaccuguuacagacuucuuauggucuccggaaggguucuuucagggaccuucuuacacaauacaagacgugcagauggcauccagugaucuuuuucacuagagugcuuugguucuacuaauuagcaacuuucagcaucuuggggagaaagugcuguauuuugaaaaaaauuaaagugaaucguauauuuucuagcuaaagacccgaugaguccuaaguaguaugauagaagguaaccgaacaguagcuucaauuacgggguguaguucagggauugggcuccugagugguaagcacaagaccccggcaucccccacuucuuagaguuuucuuucucucucuccuuuuuuuuccuccuuuuuuuguguuuuguuuuguuuuuugguugguuggggguuuuuuguuuuguuuuguuuuuguuuuuugagaaaagagaacaaaaaggaaauuggaaaugcaucauuaaggggcaggggaugccuagucuguagaguauuggccuagcacccacacaccaugccuuuaauagcagcacucaggaugcagaggcaggaggaccaggaggaacucccaagucaucugcuucauagagaguuuugaguccagccugguagagcaaagcaaacaucagcaggcguaauugguucuuacacaggucugcuggcagugaggaacaugguaacccuucccuguuauaugugguggcucauaccuguacucuuagcacuggagagacaagggcuggaagagugcuaugcauuugaggccagccugguccucagaacagccacagaaaugagccauuuucuagggcucgagagauugcucagcuguuaaaagcaguuccaaagaacccagguacaaaucccaggacccacguugcaguucacagugguccauagcucuagucccaggggauaugacacacacacauaaagggagacuaucaguguaaauaauaauacuaauccauuuucuguauguagaguucuuucaggcuguugagauggcuuggcagguaaaggccaccaaccugaauacaauccucaggguccacaaggugaaaggagagaaccagcugucacaaguugucuucuggccccacauagugcaugcccacacccaccuucaaauacaauaaauaagagaucuuaaucuguccauccaugcuccauguccccuacuccauuuugcauuuugguuuugagucuuguaaauugguacaacucaugguucuccuuccucaacuauuuuuucccucccccuccugagauuauuacugucugucgcucugugcuggccugcagcucuacagaucaggauguccucuaguuugugauggcccuuuggcucugcuucccaagugcuggauuagaaguguccuuacgcacccucacgaauucucucucucccccacccuucucucucugccgccaccuuccuugcccccccccccaauaaaccucuuacacguggggaaaaagaaguaugcucacaaaguguguaggauucuguauaaucuuacauggauuuucuuaacagggagcggagguuaaagauaccaacuaaugagaggccagcauaaauguauaugucagugguacagcuucacgcccguaaguuucuguggagguuauaguagagaacuguagucaguaaagaguucauguguccccagaagaauuagauuuaaggaguauuaaaggaaugugauucaaugacaaaggcagguauguucgcagguagaccugauggcuuuagauggcuuuuuacugaauuaaagcauuuuccagaacugaucauuugucuugcuacucauagucaaguuuuccugccgaggguuuugguuuuggcucagaaucuuuugagcacuccaacaauugugcuuauugaguguguaccuuuuguguaaacuauuucaguguugguucacauaguuuucuccuacuuugccagagaacugaaauauuucacuuuuuuuucuuuuuuuuaaacucuuguaaaaaauguuuuuaaagauuuauuuauuuuauguauaugaguacacuguagcuguacagaugguugugagccaucaugugauuguuggaaauugaauuuuaggaccucugcucgcuccagucaaccccucuccagcccaaagauuuauuuauuauuauaaauaaguacacuguagcuucagacacccaagaagagggcgucagauuucauuacagaugguugugagccaccaugugguuguugggauuugaacucaggaccuuuggaagagcagucagugcucuuacccgcugaaccauuucacuaucccccacucuuuuuucuuuaaacaacauucuuuacugaaaaacauccccuccaguaagaauggaacagaagaaauuaaacaagcuuauguggugguuuauaccugugaaccuaccuugcugaggcaagagacuugccaugaguucaggccagucuagcuaaagaauaagacccuggcucagaaaaaaaccaaaaaccuaagugucugugcuggguggggccaggauagacugaauagauccuaggucugagacuuuggccuaggugggagagcagugggaagaagcuggagacaucacucucaaagaauguucuagcaagcaaaauuaccagacuucauuugucugguagccgcuaauaucagagauggcauuucagucggcaaagcaccaaaaaucccguuaauguaacaucucacuguuccaaaucugggucuuagugacagcaacuucauucugacugaacugcaucaggaagcuguucccucagacguugccuaacugccuugagaacaaucaaaaucugaagaguucuagguuuguuucuguuuuuugaggccaggacuugcuauauagguuuggcugaccaggaacucauaauguguacaccaggguugccuuaaacugaggaacacaucagguugguuuguugauaaauccuacucaaucuguacuaccaaccuguacuaauaaacaccauuuugguuuugaguugugguuucucugccacaaguuggcugcuaacuccuggccaggcucaaguccugcgucaucuaugucacagacuauaggccuuugucuuuauacaggccuggcuacauuaaacuuuaguccacauauauuuuaccuuugauauguacagccuagaaaguaugucuuauuacugacaaaauuugucagacagggucucaacuaauuuuccaggaugauggagagcuuugaaucuuccuuagagggcuacauaauagguauuaucacaccuauuucauaauucuaaaucucuuaggaguacuguuuauuuucuccucuuccucaucuuucuauccucacuccucuuucuucucuccuuccuucauccuguccucuuuuguguguguguuuuuugacauagggugccaugguguggccaggcuggugaucgcacauggccucgaccuugcccuccuccaucagcucugcugacuagguugcagacgugcacgugacccugcuuaguuuauuaccuucuuguuuguuuuuguucugggggugagguuugagacaaggucuccauaucuguuaguaagcuuucccguuccuuggauaauuacauaauugcugagggaccgucaucugaaagcugcuguuaggguuuugggagguggagguugagacaagguuuugcugugagaccuuuugauacaaggcuggcuuuggacggcgucgagcuugcuauguaggcuggucuggcccuccgccuccugaguucuggcauuaaagucuugcaccauugcguccugcucuuuuuauuuuuuccuccucuuuuugagaaaacgugucaccuuggugcuuaggauuaggcucuccaacuugaaggaucacacgauucuuccagcucagccuuccaacauuucucuacauauuuuuacaccaucugacacagcuggguuacaacaugcaugcugaauuuguuaauuaaguauaaaaauagaguuuaaaauaacaccucuuccuuuaaacuucuuugcacacauuagcuucagaaucaggacagagucuaaaaaugcagaccaguaaagucugugauaauguuuuuuugaaaguucacccaacccacaauacagagcaguguuaggugugacugugucaucguccaugugguucaggcaguugucugacacugaacuggaaccacagauuguaacuguccucucacaugcuggaauugcaagaguagaaguuguuuauacagcuauuagccaucuagaaagaauacauucucccuuuagagaaucugcuuacguacccugagucaggguagggauuugcauuuguuguaauuuucaaagaacuccaaauaccucuucaaacucaacuauagaaucuuuguaccucugaguuagauauucauaaaucguacaaaccucauagauacauaccagaacuuaggguacacccaauugcauuaaccccaugcaauucuuacuaagucauccaugccacaccaccacacuaguuucuccuuaggacucagggcuucucagccuaaugaugucucugugaguucauguaucaugcaugauugucaaccaggaacuugccuaaaggcucagcuaacaguuaaauugccuuagcuuuuaauuguguaucauaaugagguucugccuucuaauucuuuauuaauuucaacuauuuaaaaaaccaccuaguaaugacuccagacauaggucuuuaauaucuucagggaaaagaagcagccauguuguccauuucuuguugcuccuaaagaauuagaauccugcucauuuccucaaucuaggaugcagcagaaaaccccaaaucaauuuugucuucuguaaaaugugauucguacacaugugauacagacaucuccgcagucuucucccuuguaacgcaggaaaaggaacauuucuccuuugcagaucucggccuuuucccuaccaagaugcauccaggaacuaaaacuugacuucagaaacaagccaaagcuugacagucaccugcaguccuagaacucagaaggcugagauaagaugugaguuccagagcugggcgugguggcacacaccuuuaauccagcacucgggaggcagaggcagguggauuucugaguucaaggccaccuggucuacaaaggacaaccagggauacgcagagaaacccugucucgaaaaaccagaaaaaaagaaaagaaaaaaaaagaugugaguuccagucuagccugaacuacauaaggaaccauugucuggaaauagucuagacacccucacaccccccccacgaaauaagcccagaagauauagcuaguacuaauuuugguugugauaagguaguauaugaaauaauucagagaaagaaagccaaguguagugaaacauuacaguaauccuagcucuugggaagcaacagguaggaggacuguuaaguuuuagucucaggcgaggccaggcuauguagagaagaucuuaccuaaaaaauaaauguaggcgcuggagagaccgcucagcgguuaagagcacugacugcucuuccagaggaccugaguucaauuuccagcaaccacaugguggcucacaaccaucaguaaugggauccgaugccuucuucuggugugucugaggacagcaacagugugcucauauacauaaaauuaaaucuuuaaaaaauaauaauaaauguagagagggacucauguuaguauuguuggcagugaugcuguggcuguacaagcaagcacccugauaggaacugcuuuuauugagugcugacacagugcgcuuuaauguaggguccagaguugcccaguugcuggaugcucuccuguuauuucuauuauagcagguucugguguggccuuaagcaugugagggagguggcauucuacccuugggcuacaccuggccaaugacccaaacauauuuaacuuuaggcacagucuggagccugugucuagaguugggcauuuuugucuuccucagcaguguuaauccauaaagccaguuccagaguaacauucuaggguucugauugguuuacagguagacagguagagcaacacagcucuuuaagaaagagcccucccugguccucucuuccccgugguuucuggguuccugacaaauacaaccguuagagagauugauugcuuuugagcuucaaaauauccuaguaaaugaacccugggcauguuggcuacuccugacagaagugacaguguugagccagugagauggcuccgugggucccugcuguuaagccugaugaccugaguucagucucaggcuuauagucauggcuacaggaaagaaccacucccagaaguuacauuugacuugcacaugugugccagggcaugugucuacacauacacaaaaauguaaaauuaaaaagucagauaguguguuucuaaaguaagguugcuaggguggucaucguaagucagacuuggaaacuagaggaggcagcaauagcagauaguaagauuuaaaaagaagggcccagcauuauguuguacaucuacagauggaugaauguauggcauguuaauuacaugucagugucagugaaacuuaaguuugaaaagcuaaugagaaugggugaaugacuuugugugugugugugugugugugugugugugugugugugugugugugugugaugcacaagagaaucaucauagcucuuccaucguacucacugaggcaggucucuccaucaaacccaaagcucggugaagucuagucuuuguagcuuccuugcucugaggacgaucccaccucagccuuuggagguggaauugcaggcagacugcccugcucacccggugucuacagagcugcuggaugucugaacuccugcccuuaggcagcugcuuuaaccacugaggcgcaugcucagcccagcccaggcccccacugacagccagagacccaaguaacuuaagaacgagaaguucagccuuaggaauucagauauauucagaccaaaaaaaaaaaaaaaaagacuugcauuuuccugguaaagccugucagaggcagaauuuuagccaaguuuuggugacaaagaaugauuagauaagcaagaugaugagaguugaggcuggaucagaguguaggaagaguugucaaagugacugcuuuuguagaagcagccagagaagagaugaaaaggaaaguuguuagcuugcuauugacucaccaugugggagauugagcucgagcuauuuuagacccaagagauaaagguuacugagagagaagcguagguuggaggaggugguagggaguagccaucauuugucuccuuuucuguugcugaggacagcugagaggaaaaaaggucucaugguuucagguaaaggaggcagaaaagguauuuuaagagucuagauugcauucuggaggauguacugaaagauuggaaaaagcagagcaaagaaucaaggcugcuuuucacagauagaaucuugguucuaucaugugcuugauacugauugaauuuucucuaguucaaaaaggucucuauggguauuguugaagcagucuuccagugguaguaacugauuaucuuccaagagcucaaaugaugagacaauguuacuuuucauuacugugauaaaacaccauaccgugaccaguuugaggccagcguggucuacagagugaguuccaggacagccagggcuauacagagaaauuuugucucgaaaaaaacaaaacaaacaaaaagcauuucauuuggagcucguuuggggcucaugguuccaaaggauuagagucgugaccauuaugguggggagcaugguggcaggcaggcauggcacuggagcaguaggugagagcuuacaucuuuuuuuuuuuucugagacaggguuucucuguguagcccuggcuguccuggaacucacuuuguagaccaggcuggccucgaacucagaaauccaccugccucugccucccaagggcugggauuaaaggcaugcgccaccacugccuggcagcagcuuacaucuuaauccacaagcaugaggcauagagagaaagacauaacuaggaauggccugggcuuuagaaaccucaaacuccaguggcaugccucuuccagcaaggccacaccuccuaauccuucccaagcagucccaucaacuggggaccagccauucuagguuuugagcccacaggggccauucucauucaaaucaccacaucccacucagucccugaaccccuaggcuuguggccauaucauaaugcaaaaacugaguuuagucuaacuuuaaaaguuuccauagucagcuguaguggacauaccuuuaaucccaacacucaagaggcagaggcaggcagaucucuuagaucaggugcagccuggucuaauacauagagaauuccaggacagccaugccuaccuacauagacucuugucuccaaaaggaagaagaaagaaaaaugucuccauggucucaauauaauuuaaaaguccaaucucuuaauuguaacccccauaaaaagcaaauuaugaucuuugagcacacaggcacagagugugcauugccguuccaacagggaggaauaguggcauaggaaggaaacacuggaccaagcaagauggaaacccagcagggcaaacuccgaauccuaucucugauauccaaaggucuuacguggcucuuccucacagcucgguaacugcagccuacgccucucuuggguuauuucugcucccugucugcagcucucccuagcagauaucccacagcucuggcacagugggaucgccagugugauccaggcuccacuuucacuguucacacaguggcagcucugggcuacgcagacucccuaccacacaccugaccucagcagcucucaaucccggaggaagauucuacaacccauuuucuuauauaucccucaugauccuauagccagaaccacaagaccaaugcugccaaguuaugcugccuguuggggacggagccuggucccuacauuuuuauaaauuuuguuguuacugccuuuuaggaacagaaaauuucuuaugccuuuuucuuccauaaauugcaggauuagcucagguggggucuugcccugaggguacucaaccccuuauuccauuucucaucagucuucuuauuucuuucagcacaagccuuggcuccaauguugaauuucccagcgaucuuuuucuccucaaauuguguauuaaucauccaaccacagauuugcugucuugaaauuuccucugccaaagaauacagcugagagguuacaacuugaucuaugcgcauguggcauaaagacaggcagacagacagacagacagacagacacuaaaaguagugugggcguuugacacccuucucucuggagcuccucuuccucccuuccuugccuuaauuucggcuguaacccucaggacucccucacugcugcagugcugggcauugaauguggaguccucuaggauaagccuccucugcugaucuguaacccuggccuaaaaccauacucagguuuugaguuuugaucucuuccaaagcuagcgacaugugugguacuuuugaugccagggaacagaggaacacagcucccacucagcccugugggcucaggaaacagcuggugcuccgcaguguagugcaguuagugcgucucccuaguuuaauuuccaggggguuauagggauaugccguagguuauagggauaugccguagguuauagggauaugccguagguuauagggauauaccguagguugaagaucuucugcauuuccuuccucauuaggucccuucucuugaaacucuuaguuugcugcuugacaaagcuaucugcacaucuuuuacauauuaguuguauguuacugcuauaacauuuuuuauaaauuuagcaacuuuuuuaagguucauaaauuuagcuugagacaggaggaucacugcaaguucaagacuagucuuggcuacaagacaagauauagaucucccucuguggugauucuucucugccugccacccugguguuccacagcaucugaguuguugauucuuaaaugcuucuuaccauaccccagcccccacauguucuuggaacaauguuucaucuucagcccagaggguuuguguggguguggguguuuggaguggcauuaauccugaauauuagucuccuuuuaccagauaugucuugucguucaagacucgcaacacuaaaugagaaauugacagcccuugaacggagaauagaguacauugaagcgagggugaguauagucccaggcuaccccagagggaauaucuguguagaaugaacgcggugcagagguuaagugcucugccuggauguagcugucugggacucugaagcugccuuugcuacuguuucucacugugcaggauccaagauaggauuuuuuuuaauggcuuuaguccuuugcguuuuaucuaaaugucaguuuuuccuucacaggugacaaagggugagacucugaccuagaagugcgccgccgcguugcugcugggaaguugcuguacagaacacugccgugugggaaaggcccagcagccuccugcuccuccucucuccuuacagagcaacagggcuuuuucuuguuuuucuuuuuucaaaaguggccuuugggcucugcugugugcccugggguaugacguggcaugggggagcaagcaguccaggggaccucuuggaaacagcauuaggcuuuuucccuuuucaguaacauuguucggaacuacuugucaauguguuugagguguugagaggcaaaggcugggacucuaagguccuccccaccucucaaacucuuucucucagacuuucccuacagcucccauggccucuacacugauuucugucaacagucggccuucucuccaccugugagagguggaggcaguccuggcugagacuugugcccugcagugugguugccagaaaauguuguugcuaacccaccaguuucuuguucugggagcucaaagccaggcccccaguuggcuugaagggacauuuucaguuuucuuugugucacuugggguaucaguagcucucaugcuucccuaauaaacucaacuuugucugacugcugugacugugguggcaagaguggcuggagagggucuccuuguugagagucuggugggcaagagugcucuccagcagaagaaaccugcagcccuagcugguucaaagccuaggcggcucuccagucaguguuccugucuggacacuugaacuaguucagucuggaauuacuuggucuuucagcagauaacuaccaaggacuuuuacuauauagguguguuagacuccaauaaaagauacaguauugaaucagac

SEQ ID NO: 3301 - RNA, 3300 nt, Mus musculus
ucagggaaaagaagcagccauguuguccauuucuuguugcuccuaaagaauuagaauccugcucauuuccucaaucuaggaugcagcagaaaaccccaaaucaauuuugucuucuguaaaaugugauucguacacaugugauacagacaucuccgcagucuucucccuuguaacgcaggaaaaggaacauuucuccuuugcagaucucggccuuuucccuaccaagaugcauccaggaacuaaaacuugacuucagaaacaagccaaagcuugacagucaccugcaguccuagaacucagaaggcugagauaagaugugaguuccagagcugggcgugguggcacacaccuuuaauccagcacucgggaggcagaggcagguggauuucugaguucaaggccaccuggucuacaaaggacaaccagggauacgcagagaaacccugucucgaaaaaccagaaaaaaagaaaagaaaaaaaaagaugugaguuccagucuagccugaacuacauaaggaaccauugucuggaaauagucuagacacccucacaccccccccacgaaauaagcccagaagauauagcuaguacuaauuuugguugugauaagguaguauaugaaauaauucagagaaagaaagccaaguguagugaaacauuacaguaauccuagcucuugggaagcaacagguaggaggacuguuaaguuuuagucucaggcgaggccaggcuauguagagaagaucuuaccuaaaaaauaaauguaggcgcuggagagaccgcucagcgguuaagagcacugacugcucuuccagaggaccugaguucaauuuccagcaaccacaugguggcucacaaccaucaguaaugggauccgaugccuucuucuggugugucugaggacagcaacagugugcucauauacauaaaauuaaaucuuuaaaaaauaauaauaaauguagagagggacucauguuaguauuguuggcagugaugcuguggcuguacaagcaagcacccugauaggaacugcuuuuauugagugcugacacagugcgcuuuaauguaggguccagaguugcccaguugcuggaugcucuccuguuauuucuauuauagcagguucugguguggccuuaagcaugugagggagguggcauucuacccuugggcuacaccuggccaaugacccaaacauauuuaacuuuaggcacagucuggagccugugucuagaguugggcauuuuugucuuccucagcaguguuaauccauaaagccaguuccagaguaacauucuaggguucugauugguuuacagguagacagguagagcaacacagcucuuuaagaaagagcccucccugguccucucuuccccgugguuucuggguuccugacaaauacaaccguuagagagauugauugcuuuugagcuucaaaauauccuaguaaaugaacccugggcauguuggcuacuccugacagaagugacaguguugagccagugagauggcuccgugggucccugcuguuaagccugaugaccugaguucagucucaggcuuauagucauggcuacaggaaagaaccacucccagaaguuacauuugacuugcacaugugugccagggcaugugucuacacauacacaaaaauguaaaauuaaaaagucagauaguguguuucuaaaguaagguugcuaggguggucaucguaagucagacuuggaaacuagaggaggcagcaauagcagauaguaagauuuaaaaagaagggcccagcauuauguuguacaucuacagauggaugaauguauggcauguuaauuacaugucagugucagugaaacuuaaguuugaaaagcuaaugagaaugggugaaugacuuugugugugugugugugugugugugugugugugugugugugugugugugugaugcacaagagaaucaucauagcucuuccaucguacucacugaggcaggucucuccaucaaacccaaagcucggugaagucuagucuuuguagcuuccuugcucugaggacgaucccaccucagccuuuggagguggaauugcaggcagacugcccugcucacccggugucuacagagcugcuggaugucugaacuccugcccuuaggcagcugcuuuaaccacugaggcgcaugcucagcccagcccaggcccccacugacagccagagacccaaguaacuuaagaacgagaaguucagccuuaggaauucagauauauucagaccaaaaaaaaaaaaaaaaagacuugcauuuuccugguaaagccugucagaggcagaauuuuagccaaguuuuggugacaaagaaugauuagauaagcaagaugaugagaguugaggcuggaucagaguguaggaagaguugucaaagugacugcuuuuguagaagcagccagagaagagaugaaaaggaaaguuguuagcuugcuauugacucaccaugugggagauugagcucgagcuauuuuagacccaagagauaaagguuacugagagagaagcguagguuggaggaggugguagggaguagccaucauuugucuccuuuucuguugcugaggacagcugagaggaaaaaaggucucaugguuucagguaaaggaggcagaaaagguauuuuaagagucuagauugcauucuggaggauguacugaaagauuggaaaaagcagagcaaagaaucaaggcugcuuuucacagauagaaucuugguucuaucaugugcuugauacugauugaauuuucucuaguucaaaaaggucucuauggguauuguugaagcagucuuccagugguaguaacugauuaucuuccaagagcucaaaugaugagacaauguuacuuuucauuacugugauaaaacaccauaccgugaccaguuugaggccagcguggucuacagagugaguuccaggacagccagggcuauacagagaaauuuugucucgaaaaaaacaaaacaaacaaaaagcauuucauuuggagcucguuuggggcucaugguuccaaaggauuagagucgugaccauuaugguggggagcaugguggcaggcaggcauggcacuggagcaguaggugagagcuuacaucuuuuuuuuuuuucugagacaggguuucucuguguagcccuggcuguccuggaacucacuuuguagaccaggcuggccucgaacucagaaauccaccugccucugccucccaagggcugggauuaaaggcaugcgccaccacugccuggcagcagcuuacaucuuaauccac

SEQ ID NO: 3302 - RNA, 3300 nt, Mus musculus
guggauuaagauguaagcugcugccaggcagugguggcgcaugccuuuaaucccagcccuugggaggcagaggcagguggauuucugaguucgaggccagccuggucuacaaagugaguuccaggacagccagggcuacacagagaaacccugucucagaaaaaaaaaaaagauguaagcucucaccuacugcuccagugccaugccugccugccaccaugcuccccaccauaauggucacgacucuaauccuuuggaaccaugagccccaaacgagcuccaaaugaaaugcuuuuuguuuguuuuguuuuuuucgagacaaaauuucucuguauagcccuggcuguccuggaacucacucuguagaccacgcuggccucaaacuggucacgguaugguguuuuaucacaguaaugaaaaguaacauugucucaucauuugagcucuuggaagauaaucaguuacuaccacuggaagacugcuucaacaauacccauagagaccuuuuugaacuagagaaaauucaaucaguaucaagcacaugauagaaccaagauucuaucugugaaaagcagccuugauucuuugcucugcuuuuuccaaucuuucaguacauccuccagaaugcaaucuagacucuuaaaauaccuuuucugccuccuuuaccugaaaccaugagaccuuuuuuccucucagcuguccucagcaacagaaaaggagacaaaugauggcuacucccuaccaccuccuccaaccuacgcuucucucucaguaaccuuuaucucuugggucuaaaauagcucgagcucaaucucccacauggugagucaauagcaagcuaacaacuuuccuuuucaucucuucucuggcugcuucuacaaaagcagucacuuugacaacucuuccuacacucugauccagccucaacucucaucaucuugcuuaucuaaucauucuuugucaccaaaacuuggcuaaaauucugccucugacaggcuuuaccaggaaaaugcaagucuuuuuuuuuuuuuuuuuggucugaauauaucugaauuccuaaggcugaacuucucguucuuaaguuacuugggucucuggcugucagugggggccugggcugggcugagcaugcgccucagugguuaaagcagcugccuaagggcaggaguucagacauccagcagcucuguagacaccgggugagcagggcagucugccugcaauuccaccuccaaaggcugaggugggaucguccucagagcaaggaagcuacaaagacuagacuucaccgagcuuuggguuugauggagagaccugccucagugaguacgauggaagagcuaugaugauucucuugugcaucacacacacacacacacacacacacacacacacacacacacacacacacaaagucauucacccauucucauuagcuuuucaaacuuaaguuucacugacacugacauguaauuaacaugccauacauucauccaucuguagauguacaacauaaugcugggcccuucuuuuuaaaucuuacuaucugcuauugcugccuccucuaguuuccaagucugacuuacgaugaccacccuagcaaccuuacuuuagaaacacacuaucugacuuuuuaauuuuacauuuuuguguauguguagacacaugcccuggcacacaugugcaagucaaauguaacuucugggagugguucuuuccuguagccaugacuauaagccugagacugaacucaggucaucaggcuuaacagcagggacccacggagccaucucacuggcucaacacugucacuucugucaggaguagccaacaugcccaggguucauuuacuaggauauuuugaagcucaaaagcaaucaaucucucuaacgguuguauuugucaggaacccagaaaccacggggaagagaggaccagggagggcucuuucuuaaagagcuguguugcucuaccugucuaccuguaaaccaaucagaacccuagaauguuacucuggaacuggcuuuauggauuaacacugcugaggaagacaaaaaugcccaacucuagacacaggcuccagacugugccuaaaguuaaauauguuugggucauuggccagguguagcccaaggguagaaugccaccucccucacaugcuuaaggccacaccagaaccugcuauaauagaaauaacaggagagcauccagcaacugggcaacucuggacccuacauuaaagcgcacugugucagcacucaauaaaagcaguuccuaucagggugcuugcuuguacagccacagcaucacugccaacaauacuaacaugagucccucucuacauuuauuauuauuuuuuaaagauuuaauuuuauguauaugagcacacuguugcuguccucagacacaccagaagaaggcaucggaucccauuacugaugguugugagccaccaugugguugcuggaaauugaacucagguccucuggaagagcagucagugcucuuaaccgcugagcggucucuccagcgccuacauuuauuuuuuagguaagaucuucucuacauagccuggccucgccugagacuaaaacuuaacaguccuccuaccuguugcuucccaagagcuaggauuacuguaauguuucacuacacuuggcuuucuuucucugaauuauuucauauacuaccuuaucacaaccaaaauuaguacuagcuauaucuucugggcuuauuucguggggggggugugagggugucuagacuauuuccagacaaugguuccuuauguaguucaggcuagacuggaacucacaucuuuuuuuuucuuuucuuuuuuucugguuuuucgagacaggguuucucugcguaucccugguuguccuuuguagaccagguggccuugaacucagaaauccaccugccucugccucccgagugcuggauuaaaggugugugccaccacgcccagcucuggaacucacaucuuaucucagccuucugaguucuaggacugcaggugacugucaagcuuuggcuuguuucugaagucaaguuuuaguuccuggaugcaucuugguagggaaaaggccgagaucugcaaaggagaaauguuccuuuuccugcguuacaagggagaagacugcggagaugucuguaucacauguguacgaaucacauuuuacagaagacaaaauugauuugggguuuucugcugcauccuagauugaggaaaugagcaggauucuaauucuuuaggagcaacaagaaauggacaacauggcugcuucuuuucccuga

SEQ ID NO: 3303 - RNA, 7678 nt, Mus musculus
cgccgcggccccuggcuccgugccgccccgccccccaguuugagggcucccggcggccauuuccgccuucaaguugcccggagcgcgucugggaccggcagaccugucccggagcgcguagauccgcacgcacgcacgcgccgcccacguccagcuugcgaauccgagggacccguuccaauaaugccccggaaggcagccaguccagaggaggcggcgggggagcccgguccugaggagauggaggcugggcggccgcggccggugcugcgcucggugaacucgcgcgagcccucucaggucaucuucugcaaccgcagcccgcgcgucgugcugccuuuguggcucaacuucgacggcgagccucagcccuacccgaucuuaccaccgggcaccggccgccgcauccacagcuaccgagguacgagccgcgcgcuaggccgcugcugcuguaacaggcggggcgcuuucucuccgaccccgagcaucuugucccuacccacugcaucuaccccgagaaaaugcccggccccuaccagugauuucggaugcaguguuaacccaguucccggucagguucggcaugcgaaccugccuuggugaugacaacuuggaggguuacagacaaaaaaaauguaugaacagacaagaaccagccugugucauaauugcugcgcuaggcaccgagcuuagagguuugcgaaagcaugggcagagugugggugcguccaggugaagaaagagcacgcagcuuaggagaaccggaguaggauaagucagcugagggaguuaacaguuguaguugggggaucaccuuuaccgauuggcgucuuggccgaaaacaagugaguaugggauaacggguugaacucucgaucuuucugccuucgccacugauuucagguuuguaccaagccugaccacguaagcuuauuaacugugacaagcaucaguggaagucagucaguucuaucagugucaugacuggauggcuaugaaaaacaagugaagccgcucucagguguacaauccccaggacucagaaaaccgaggcaagaugacugcaccaggcuuuuuugguuugccgccaaacagugagagaaaaaguucaaaaguugauuuuagccguagugaauuggggcuguuugacauugccuuauuuauguauugaaaaaaaauguacccagaucugugugugguagcccaggacucaggaggccaagacagaaggauuucacugagugcaaguccagccuuggcuaagccccaagauugugucugaagcaaccagccagacagcugagugaugugggaauuuuguagaucaggcuggccucucacugaaauccaacuuccuucugcccccugaguacugggauuaaagcaaaggccuuugucaccaaggccgguuuauacugcucuuucaggguuagcuucucaguacccaggucaggcagcucacaaguuuccauuacuccagcuccagggauccgaggucccugcucuuacuugggaaaagaaacccuaaccuuggcaguuugaauaagagugacuccuauaggcuaauauaucugaaugcuuaggguguaguccuaaggauuaguuugaaaguggugaaggaugaguagguguggccugguuggaggaagugugccacuagggaugggcuuugagguuucagaagccuaaaccaaacucacaaucucacuggcuacaccuuuggaucuggauguagagaauccuuaguuacuucuccagccccaagucugccuggguaccaccaugcuucccaucaugcugaugauggauggauuaaaaccccugaaacgcucaguaagccucaguuagaugcuuucuuuuauuagaguugccaugguuuuggugucucucagcagcagcagcauugacauaagacaaacaaaccaacuguggcaguccucuugccucagccuccuacaacagacuuccguauuuucauaaccaucccgggaagaucuugguagaacuuuucuccugauggugguacauuuaaugaacucaugugaccagucaggucacaaacuuguagugacuuggggaacagguggaggcaggaugaucaggaguucaagccagucuggacagcaugcuaccuggacguaaugaaaacaguaggauggaauaaacugaugcuucucaaguugucuuuuugauacagagaggagaaaagagcuucucacaucuggagauguagcauuugucucucagugcuagcgaugguucucccucuguguaccugugcuuugccugagggucaaucuguauccuggguauggaggccaagcaagaggcucugucugaccccuggaaacuaguuacaaauguuuguuagaugucacaugggugcugggaaccaaaccuggguccucuucaagagcaacaaaugcucuuaaccacugagcuaucaucucuuuagccccugcccguuuguauguuuauuugaaaaggggcuuagcauguagcagucuguccuuuuguuuuguuuuguuuuguuuuuuuagagacaggguuucucugugcaguccugacuguccugucacucacucuguagaacaggcugacuuuaaacagauccucugucucucaagugcugggauuaaaggcauccuccaccaggcugcagucugccuuuuauaccaaacuuuuaguguuugaugagaaagaacuaaacaggaaucaaaauuucuauaguuucuuauuuuacauagaaauuuggguuaauuuuguauucuccaagauuugucugugccugauuuucuuuuccccccugagacaggguuucucuguguagcccuggcuguccuggaacucacuuuguagaccaggcuggccucgaacucagaaauccaccugccucugccucccaaaugcugggauuaaaggugugcaccaccacagcccgguguaugccugauuuaaaaaaaaaaauuggggcgugggcagggguagggagauggcaccuucuggggauugaauuuaggaccucacucaugccaggcaagcacucugucacuguucaguguccaguagugggcccuaucuuauacaaaaagaauuaaagcaggcaugaugacgaauuccugucuguaacuccagugcuaaugaggccgaggcaguacaauuaccaguuugacaccagccuaagcuacauaaugagauccugucccaaaaaaaguuugugccgggcgugguggcacacgccuuuaaucccagcauuugggaggcagaggcaggcggauuucugaguucgaggacagccuggucuacaaaguguguuccaggacagccagggcuacacagagaaacccugacucgaaaaaacaaaacagaaaaaaccaaaacaacaacaacaaaaaaaguuuguaucaguuuugagcuggacucuacuggcaggcaggaggccugguuuuaguccccagcauaacaaacacccagugagucuucaaguaaauuugugucucaugaaagauugccauauuuugagguauguacucugaaacagacuuaccucugagguuugccgccuuuucuuagcacugucccauuuuuaaaaacgaaggaauaaucuauacuuaaagaugcagagauuaaucuauacuuaaauaaaauuaaauacuuaaagaaauaaucaauacuuaaagaugcagaucugcuuugagaauuuugggcaguugcagcaacacguagugaaguuagacaugagaacuuuacugucacccuacaagaauccccuucccucuaagagucaagcucucguccaccaguuucaugauguauuaaguuuaccuguucuuacccaggaguucuuuuguggccucucaauggccacguggguuccuuucacaucaguaugucacgguaagauuaccagugcucucuugaccuagcugcacuuucccugccuagucccaggagcccgggcuccuugugcuuucugucuccagagugagggcuccuuccagaggagugccguugcccuguuaaggcauuaagcagagggagagcgaagcaaguguuucaugugacuugagguaauaaacaggugccaugcccagacccguguggcuucuuacuauccucugcuuaccuugacaggucaucuuuggcucuucagggaugcggggacccaugauggacuucugguuaaccaaacggagcuguuugugccaucccucaaugucgauggacagccuauuuuugccaacaucacauugccagguuaauagucaaucuuacauguuucuuuuucuuuagaaauaagaucuagccuucuaacccagguuguccuggagcuauguagcccaaacuggccuugaauuuagaaaacuauuccugggcuuuuuaagugcugcgauuauaggccugagucaccacacuggcccagccuuugaaaaagaggggugagcauuguaaugaauguuaaccuuuaccauagaugaaaugaaaguauuuauuucucuguccuguguugaacaaagaugugccucagacguacuuugguuuccuaagaaguuggcuaagccaggcaucuccuguagcacugugaccucugguuccuuggucuuguuacagacuggugcccugggaucccagaacaaagcacaguaggaccacaugaagauaggucuggcugcucagcccugggaucccagcuacucaggagaggaugagagggcagggggaucacaaggucaagacuacagagccacuuucugagacuaugccucuaaauggaaaguaaaaaugaugcuguggccgggcguccuggccaggcccuuaauccuagagagguggguaaagcucgaauccaggccagccugcucuuaaaaaaaaaaaaaaaaaaaaagugaagaaguguauaaucagaaaagaacauugagcaauuaaauuuugucuuugagcucccugguaacuguuaauuuauuacuauuuuggucuugucuuucuuucuuucuuucuuucuuucuuucuuucuuucuuucuuucuuucucucuuuuucucuuucucuuucuucccuugguguuuuuuguuuguuuguuguuuguuguuuuuuuuuuuugagagagagggucuuauguuucccagacugacuucaaacucacagacauucucucucagacagacauugcugggccucccuaaggcuuaggcccugaguuaccagggucacuuuacauuugauuaguugaaaaaaagcccuggccacuaugaugagccaggugugugcacagugagaccugcugaagugacagugucacauguguuccacucauaguuuacccuccagugagagucacaagguaaaugugacuguuguugcuugguggugucugucuugucaugugaccagagucugccucugaggacuugguuuccuacccuuacaguguauacccugaaagagcggugccuucagguugugcggagccuggucaagccugagaacuacaggagacuggacaucgucaggucacucuaugaggauuuggaggacuacccaagugugcggaaggacauacagcgacugagccaagagcaccuugagagucagcaccuggaagaggagccuugaaggaguccauggagauuaaguguuccugaguuucagccuugaugguccgagauugaucuacacauaggacaggucacuuucuuucaguuuuaaaaugguucauucuuggaguaaaacuauccaucacguaaaagaaaguuaacuaacaucccugggcuuuguaguguuuaagaauaaacaugcaaagugccacugcgucugcccuuuguagagcacucacccgagggaggaagacguuuucaguuuugcuuccuggugaggcuggaaguugaguguaaggaugacuguguaauaagcucagcagcaggaguuguacuguguccuuucauuugagcagagggcucuugcuugggaaggcagagaaggcccuucccaaacgcugggacagaccuccuguggaggcccgcugccuaaagcguggagucuucagucaugaauguuggacgaagaaaccauuggaugcuuggugggagaguugggagggccuggcucuuugucugaggagagccuuaaguguucauguaaggaacagcuuagcagcuucugauuucccacgucccagcacuuucucucuguuuuuuauuuuauuuuugagacuuuuguauagcccaggccagccucagucacucagcagaggauuccugacccucugggauuaugucuccugacauugggaacacaugugugcacacagccugcucugcucuuccuuuucccauguugagacgggcuccugcuguaguccugccuggccugagcuggagucgguccugccuccugaccgaccgucuggcugcuuucuaagcuggguagacuucccauacucacuguuacagacaguuacagcagagaagaaccauccuuguguaagucugguuuugagagcuccugucucugaggaagcuguuggcaggagcagggauuucuguuccuucuugucagccccuagcauuccacuuuguuuuggcaggcgcugguucugcuuuguagguggaagugaagcuccacucagccacagacuccagacagugggucacagagcagucuggaauguguagcagucuuauggauggucacagcuuuucuuacauauucauauucuaucaaacguuuuguaaaguauaauuuuuuauuuauuuuuaauccccuuagagaaaaaguaaaaguagagaagccuggguauuguguacacaacagaaaggacagucaaggaaagggaagcagaaaggcucuuauguacucucagcuucaugcaaccccuguaacuggccgcauauguagggcauauuuuaauugguuaaagcaguuuguuguggcugaggucauaagauauauacaguuuuguauccugauuuuucacugaacuucauuguuuuuuguuugcuugcuuuucccuucuucuuuguuuuuugcuuuauugagauaggguuucucuguagcccaggcuguccuagaacucccuuuguagaccaaacaucugauuacuggccucacauggagagaucugucucugcuuuuccagcgcugggauugaaguaggccuaaucuucaucuaacuucuuagcuugucuuuuccauguuacuacacacacuguguaaauaccagugugcuacccuccuucuuugagggugacuguugggaguauuuguccaaauccugggcuccuugagugcagacugaugcucuaagaucagcaaaaugacugaacuacauccuaacacuucccaguguccucucagugucucuucuuaucugcagcauugcaggagugaaguggccacagaccaguguggaggccugugugugggaagucagcaggugccaagcuauugaaacauugguuuuauuuuuuuaaaccgaucucugucucuaaaagaugugauguuuguguuauucagcuggaaguuugaauacuguucucugugcuguccaacaagugaagaguuaugaaaugagccacuuguccugggacauccuguaaugaguuccucgggcuuuucuccugugaguuuucugaaaaaagcugaccuuuuuaguacaauaaacggugcuaauugaaggaagc

SEQ ID NO: 3304 - RNA, 1493 nt, Mus musculus
uuaccuuuuuuauuauuaauuuuuaaaauuaauuauauuuauaucccaaauguugcccccuccucugguccccucucccggaguucuucacccuguucucccuugccuugcccuaugggagguggcugucugcugagugcugcagggguagagcaagaagccaggccucaggcuccuuuacagucucuucagccuuagauucuuuuuuuuuuaauuuaaaauuguuucuuccagcuuuguuuuccuuauaagagugaaguaccuguaaaagcauuucaacacugaaguuaggugugguggcccacucaugugauccagaacucugaaaacuccuccaccuuugggucgggaggugggugagggucauucuaaccugagcucuuugaagaccuugucuaaaagaaacaacugggcuguagagauggcucaacaguugagagcacuuacucuuucaggggacccaaauuugguucuuaacacucaaaucagguggcucacagcucucugggacucagcuccaagggaucugaggucaccuacaguuuuaugugcacacccccacacacgcagacacacacacacaugcauaaucucuuuuuguaaacuuauucuuugugaauuucacacacaccccaauccuaauucaccucccagucccuccuuaucugcccuccacccuuucagccucccccccccccaaagaaacaaaaacaccuugacaucaaaguuguagugggucacagugggucucacagaaugcucuuggccacacaucuuguucauugcagugagucauuggucugguucgaggccucuggcuucugcuauucucucaauacuggauccucaccaggacuccucucggacaucuuguuguugcccugugucauggcgauccuacagcuuuggaucugcaggauugccccuuuauacauuccagcaguucauaguucauagauggggcagauguuggggugggauuugggccuggauguuagcugaguuggucagccugccagcuuucccacacccacaccaccaggguaagcuuuccagcacugccuggagcuagcucacccaaugccauagccaacaaggggcagggucagcucucccacucucauacccucagagcuagcucgucuguacccaugcuuccagagccaguucuacuaugcugcccaggaaaaguacagugcucacuuuucagagugcugcaucugggccaacucucuagccugcaguagugugugugugcauugggggguggggguggggggugguaucucaccuaccgcagguggcagguucagcuguccuguguuuacccucucaggcccagcucacucuuggccccugccaccagggccagcucuacugugcugcccaggugugugggcccacucuccugagugcaggaagccagugagguguggggccagcucuguacagcccuugggcaucaacauggucccaggugguggcagcccaga

SEQ ID NO: 3305 - RNA, 59489 nt, Mus musculus
auucugcuagcaguucaagaugaggauauagaacucucaaguuccuccugcaccaugucugccuggaugcugccauguucccgccuugaugauaauggacugaaccucugaaccuguaagccagccccaauuaaauguuguccuuguaagaguugccuuggucauggugucucuucacugcaguaaaacccuaagacagcaguaaucaccuuuaccugcugggcuaucucccugguucuugaaggugguuuuaaaauuguuuucguuacauuuacuuauuugugugugaguguguguguguguuuguucacacacacauuugugaaugucacaggacauguagagucaaacaacuuuugggaguucucuccuuccaccauguaggucccaaggauuggcagcagcuugucaggacugguggugagcaccuuucucugcugaacuacuuggcccacuacagauaguggauguuaaaagagaaguuaugcugggcgugguggcacacgccuuuaaucccagcacucgggaggcagaggcaggcggauuucugaguucgaggccagccuggucuacagggugaguuccaggacagccagggcuacacagagaaacccugucuugaaaaaccaaaaaaaaaaaaaaaaaaaaaaaaaaaaaaaaaagagagagagagagagaaguuaugcagaauuuucguguguguguguguguguguguguguugggugguuccugggguuugagcccaaggucuuggucaugcuagacaaaugcuaacuugacauaugggcuucagucuuagcccuacuuggcuucaucuugagacaggaucuugccaaguuuccucgaugcuuucaaaccuucaauccuccugucucagccuuccagguaccugggacuguaggugcauuccaaucaugccaggccuggaguacaugucugucaaucucaauuuuuauucuuuucaacuuuaaacagacauugcccaguagacaggguuucucuguauaguccuggcucuccuggaacucccucuguaaaccaggcugaccucacucagagauccaccuaccucugccucccgagggcuggggauuacaggugugugacaccacugccugacuuguuuugcuuuuuuaaacccuggugaacuguggguccugugaaccaaagccacauguaucccaguccauaaacuuuuacuugaauugggaacguaagcaagccuugugcugagcaggcugugaggaggauccaaggcugucacacuugacagaccggagagggugcagcaacauuuaucuuccuggaggguaagauccauccagauguucgguggacuggauuuuacuccacaaaaccuaguuucaggaacuuaggaagauaagcagaacaauagaacacuugccuagcuggcgaaggaccugggcuugauccccgaccuggcagagaaauaaaguucaaaacagugauuggaaugguggcacacgccuuucaucucggcaaucgggaggcagagacaaguggaucucugugaguucaaggucaaccugguccacacccagagcuacacagaaaauaaauuuaaaaugagccuuuuguuuuuguuuuguuuuucaagacagccaccgagggcuaaaaugaacuucuuuaaguuuuuaaauuuauuuuacuuuguguguacaaguguuuugacugcauguaugucuauacaccaugugcaugccugguccccaaggacgucagaagguaucggaucccuuggaacuagagauagggauucuugugagcugccacguugguguuaggaacugcuuuuccaaaaguaguaagggcucucaaccacugaaccacuucuccaccccaccuccucaaauaggaacuuuuuuuaaaaaaaagauuuauuuauuuauuauauacaaguacacuguagcugucuucagacaccccagaagagggcaucagaucucauuacagaugguugugagccaugugguugcugggauuugaacucaggacuucuggaagcacagugcucuuaaaugcugagccaucucuccagcccgaaauaugaauuuuuuuauugacaugaaaacuauuuguuauugccuuuuauuauuguuuuuuuuuuuuuuccgagauagguuucucuguguagcccuggcuguucuggaacucauucuguagaccaggcuggccaccaacucagagauccuacugccucugccuccugaaugcuaggauuaaauauguucaccaccaacugcgaguuuacuuuuuuuuuuuuuuuuuuuugauuuuucgagacaggguuugucuauguagcccuggcuguccuagaacucacuuuguagaccaggcuggccucgaacucagaaauccgccugccucugccuuccgaguguugggauuaaaggcgugcgccaccacgcccggcgcgaguuuacuuuuuaauuuaaaaaagucucacuuuguagucccuuuggccugccuuggaacucagugugugugcaaccagacuggcuucgaacuugugacuguccuccagccuaagagcugagguuacaggugugucaccuacccagaucacuuuuaaauuguucagcacaagguuugauucguuccuucuguccacacugaaggcaaaaucucuugguuuucuccgcuuaagucucuccaguaccuguuauaugagcgcauuuuaggaggcuguggaggucaaguuagccagccucagggagugcuuuggaacucuggauuguaggaugccuuucccaggcccuuggucuacuccugacacugguccaggggucggguggcaugugcuacugaaugccacugggaggcgcucgcuugcccgcucucggccauagcuuggguggagcgugacaccgcgcuuggccgcucgggggagcuugcucgcuuacccaguggggccgcgggcagcgccgcccuuuacuagggaagucgcggcccuccgccacaggcucagucgccaggcagucucgccauggcuugcuacaucuaccagcugccguccugggugcuggacgaccugugccgcaauaucgacacgcucagugagugggacuggaugcaguucggugagugacacuacuuacucugagccaggacccgagauagacagacagauccacgcccccccacccccaccccgccccguguuaccugaggccggggauuccuguguagaacgcugcugcuuugcuuuacuuugcagaacgagcuggagcugccuaugaaguugcuuauagccuaggguggucugcucacuauguagcuucuuggcgaguuuuggcugucuguaugcuuguagagcuguuaccagggcugugaucuaccuugcagccugugguaucuggggccacccuccuaacuucccugaaacuugccuuaaucuauaaacugcagcugacaaggguagauucuuuauacaguuguaaaaauaaaauagugucaaccgggcagugguggcgcacgacuuuaaucccagcacuugggaagcagagacagguggauuucugaguucgaggccagccuggucuacagagugaguuccaggacagccagggcuaaacagagaaacccugucucaaaagaccaaaauaaauaaauaaauaaaauaaaauaaaauaaaauagugucaaagaauguaccuucccuaccuuagugucgucauucuguggcauauuuuccauucuuauuauuuugagacagggucacccaguguagcccugguacuugcuuuguagaucaggcuggccuggaacuaacagagcucuaccugccucuccugcuggaauacugaguuaaagguguaguccaccauuccuggcuagucauuuauuuuucugcagugagggaacuuugauccuagggccucgugccuguuagaaaagucacacuaccacugagccauaguccaggugacguucuuggacuuuugagaccuguuuuucguuuguuuguuuguuuguuguuguguuuuuuaauguagcccauguugccuuggaauuugucauuguccugucucagccuccuaagugugggauuauaaauuugaaucucuuguauuugugggguaggggguggggugggaaggaauaaggggcucauguagcucaggcuagccuuggaugcccuggaacuucugacccucucacuuccauuuuggaauacugggauugcaggcucagcuuauguggugcuggagauggaacccaggaaagcacuauacacuaaguguggaauagccccgcuaccuuauuccuguaggucaaacgcacauaggaacaguggguaaaggcaguguaacuguugccacuuaaucuccuuuuguuuuuucaagacaggguuucuuuguguagcccuagcuguccuacucccucuguagaccaggcuggccucaaacucagagauccaccugccucggcuucccaagagcugggauuaaaggugugcgccaccacugccuggcaaugauuuauguguguguguuuaugaauuuuacuugauuauauuuuugucgugcuuggaauugaguccaaggccuugugccugucaggcaagcauuuugccagugagcuauauaacuucuuaaaugaaauuauguguguguguguuccauuguuguuguuguuguaauacaggaucucauguaguccaggcuggccuagaacucauuaccuagcuaagaaugaccuugaauuucuggucuuccuagugaccucucucgaguugcugggauuaugugucaccaugccugacuucaguaauauauuguuuaauuaagauguuuacgauacuggaggcuggcaagauugcucaauggguggaggcacugaauaucaagcccguggacccguguuuuaucccuggaacccuuguaaagcuagaaggggagagcccacuccacacaguugccccgugacccuacccaggcgcacuuacuacaaugaguaucuauuacacagcuauacuugauacauaaaguggacaugucuuguguuguccugccaguuuggauauauauuaugcaugcgaggaaucggauguuccucagcggcaaagcacucaauuagcguguguuccuggguuccacccccagcccugugaaugaaaagaaaacaagaaaggaaaaauaaguauuuuaagguuaugguucucauucugggauuuuuuuuuuuucugucaguggcaguugccaauguccagagacaucucuaguugucacaccuugauagaugcagaggcugaacacccaacaggacagccccucagcacaaagcacagagcacagcagcccccaaggcucagcgggggggggggggggggaggucagggagccucuuuacccaggaagaaaaggaguugaugugcaaagaaaaguacuguagacaucaggagcagaaagaugaggcccaguucuccacggggaugaauguucuuggcuuccaugagccaguuguaacggccguugcuguucauguuugcuugcuagcuucugaccaugcagccccaccgugcucaggacugcaccuccuggucucuuucccaacugccuuaaguguagacacuuaugucguauuuaagccaucuugugauuucuguacaccagucaugcacgacagacagccugccucuucucucuuaaaauauauccuagguauuuugccuugauaauuuuuuuuuaaucccagcuuucuauuguauagcucaaacuggugauccuccugccucagcuucuccaaagcuaugauuauacauaccuggcauugagcucuuaucucuugaauguauuuucacucuuuaucacuaccagggagcucgagggcugggacgggaacauccgagaugaagggaggugacucuccuuugugcccucagccuuccuauccccuccuugcaggcucuguccuagucucagggugcccaugaagaugucuauuaccacuggauugcccagggaacucuggcugaaguguggcucagugguagagugugugcuuacugugccuaugggccugggcucagcuacuggaaugacauaacaaagagaaggagggaaggaaggagggcggagggaagggagggaggcagggguugguggguaagaaagccuauuacacagauguguaauucccgaauguaggaaguagagguaggaagaucaggauggaauuccacuccggccugggcuacuuuugagggucugucucaaaaagccaaaaaccaaguaagcagcaagcaaucaaaugauaaacaaacaaacccauuaucaaccaucacauaauccacacauuuaaggagcaccucugugagugcucacacacacucacgugcacaccauacaucccgccgccccugcccccuccgcucuagguguuuucuguuguagcauuuuaugugagugggaccauccugcgugcacuguccuuugcgaauggcuucagcauuuagcaagucuuaaagggucauccacguuguagucaaugugaguucuguauccccuuccuuccuuccguccccucccucaugucucucuuccaccccuucaguuucucucauuuacucuccucccuccuuuuccagugaugaaaacagaacccagggucucucacaugcagggcugugcuccuuguucuaguaucucugccucucugucucugucugucucucugucucugucucucugucucucucuaacuuuuggguuuucgagacaggguuucucuguguaguucuggcuguccuggaacucccucuauagaccaggcuggucucgaacucaaagguccaccugccucugccuccuaugggcugggauuaaaggcaugcaccaucacugccuagcuuuccaguuucuuucuuuuuuuuuuuucuuuuuuuuuuuuuuuugguuuuuugagacaggguuucucuguauagcccuggcuguccuggaacucacuuuguagaccgggcuggccucgaacucagaaauccgccugccucugccucccgagugcugggauuaaaggcgugcgccaccacgcccggccaguuucuuuuuuauauucaaguaauacuccaguguauggauguccaaucuuuugcuucuccaugucuccacugagggacauuugggcuccucucguucuugggcagucaugaaaacucugcaggacauuugugucaaagugucaguguggacacaugcuuucauuucccuugggagugaaccuaggcgugcugaggaguacagugcgcacugcacucuuauaggacacggugccacguguuuuccagaggggcuguccugguucccaugcccgaaggacggcuacuauuuaucuuguuaaagcuuggcaguaagacaggcuuucgggcuccugcuuauuggccauuuauauauccuuugcugagaacugcacugaguuugcaagcccuggacauggcagaauuacccagaguccacugaggcuucacgaugguugaggaaaucaaggaaauuccuuaguaggccugccugcucucucuguuucuguuuugcucucucucucucucucucucucucucucucucucucucucucucucucucucucucgucacacauacacacaaacauacacaccuaccucauccucccuggccuccuuugggcuccugcucuuugccugugagucacccuuagguggcugcaguuuucucaguccagaggcugcccugagcccaagccuagccccuccauaugcaguugccagcuggucucaggacucugguuuucggugccccaaaggagggagaaggcgggugauagucccugcucuccaaagucuuggcuguugagcuagucuaaagaaggugaucuugugcuggaauccuggcagagaucaugugggaguauggaaagaucuaaagcgucuaaagugauuguaaaagcccacagccacagcuaugaaucuuccuuuggaucagcagguagacuucugccuuuguuucucugcgcucauuugcuccuggggcaaagacuuguaguaucugucugagucuguguacaaugggguucuuuuuguuuuguuuuguuugauuuuguuuuguuugguuuuugguuuuuuucgagacaggguuucucuguauagcccuggcuauccuggaacucacuuuguagaccaggcuguccucgaacucagaaaucugccugacucugccucccaagugcugggauuaaaggcgugcgcuaccaccgccuggcuacaaugggguucuuaaguuucaucuaccugggagugugcacagacaccccugcaggagccccuuagcuggaccacucucuuucuugcucaccagugcacuccagccuuuguacacugccuagcugugugacuucaggcaagugacugugugucucugagccauucaucuguaagaggcugaaggaacacagugguuucccuugccauacuggaaagaguuuggccagugaggggagaggcagaugacccuuaggagggucauucugggaaggugggcuguccuguucugcaggacuguaaggauagguagacuuuccccacgauucgggaaucagcaugaagcaaugguuucucuguggacauaacacauugccaaacacuagcucaagucucccaguguauagaguucaccuagcccacauagccacccaugagguccaaaaggaaacugaggcucugggagagcugacaggccuuugcuaaaugcacagcaaggaagugccugggaggauuugaaccagggcugcucacaugcugugucugucagcucucaggcacugugacagacacccucaggaaucgauugccuuagcaagaggagagcacaauuggagagauuuuagcguguagucucuugauucugcuuugugucuguggcagugucucauggcaaagccucuuuauggaaggcgcuggacucccauacccacugagggcacgucucugaguacuugggagacucucccugggucucaucucuuaaagcucccaccccuccaggaaccaagcugggaccacgccguuagcauagggccuuuugugggacaccaguuccgaagaguaguguucacaccgguggaaagucuggaagauugacugccuggaugcagucagugguuuccuugagucugcuagguaggacuuugauuuuucucuuuuucaucaugaccagauuaauaagagcuaugcccucaucggagcccuuggcagugacugagucgucucucccuccgucucugcuuguccuacuccugggcgcagugcagaaggaucuguacccuaaaagacaaucggcuuuggcaaacuaaacuauuucuuuucaaaguucacuuccuguuucuccugggaggaaacugaaauucacagaagcucaaagcucuggcuaguacucuugacggagccccacuaacaccaguguccuugcugggcuagcuuugguaugacgucacacguuccucuuugccccuugugaacaauuggaaggggacccugggccugcuuaagucacuuccugcuggcuaggaaucugauguggaguuuccagugacuaaaaccauaacucuggaacuuuccgucccuacaggacgcuucucuggcagcguucucugugggagaaccucauggucuuuccucauuuauccagaggggaccgaccgugcaugggccacuguguuuauccgggcucugagugucuuccauaguucuacagaguucuuagcuuuaucucuggccucccugcucucggcuucguccacccaagcucauauuccaaacagaaaaguucuguggcguucuggauuuggcuguuuugucuagaacucaucuuggucuuguguuuaaugcuuaguggcauuuuccuuugccggugcugggacucgaacccagagccucaugcgugcaugggaggcaagcacgacaccaaccgaguucacuccuagucccucagucacuugacuuuguguuccacauauuccuguucugugauuuuugaauuauuggcaccaaggcuugauuuuuuuuuuaauuccucacuuuuguucgguuuugcuuggcuguacugggaacggggcugagggucuccugcacaagccaacugguguucuaaucauucucucucuuuaaugcuuuccuauguuaauaaacucaguggcaaagcugggugugguggcucauaccuuuaauucuagaacuugggagguagagaaaggcagauucccgagaggucaaggccagcuuguucuacauagugagacccuaucucaaacaaacaaacacaaucaguggaauacuaugucacaaugaaaaaugccauuuaaggguugggaguguugcucagugguuggcuuagugugcaugaggcccugguuuugagcucuaguucugcaaaacacaaaaauccauucacucaaacugacaaauuccuuaugggcucauaagggccuaacugaaguuauguaggaugagucucuggguucaguauccagcaccaugccaauaaaaacaauaauaaaguuaauguuuauauauauauauggggggauugagguugguuuuuuuguuuuuuguuuuuuuguuuuuuuuuuuuuuugagacaggguuucucuguguagcccugaacuguccuggaacucacucuguagaccaggcuggccucgaacucagaaaucugccugccucugccucccaaguacugggauuaaaggugugcgccaccacuuccuggcuugauaaaaaauuuaagacagggucuuacuauguuguccaaguuggccuggaacucacuauguagaccaggcuggccucaaacucaccgaaggccucuugccucugccuccagagugcuaguauuaaaggcauucacuaucaagccuggcgaauaguaaugcaacuaaaaaauagucauuuauaaggagccuggauugacugggagaaggcuugaacuacaacacuaauaaauaggagaggucuuaccuauugucugucaaauucugucuuaaagccagcaccuaugugaaggagagaggaggagaggaaguagccuaguggaguuggccugggagggugggauagagugucuuuuccaugagaacaaccaucaaauauauauauauauauauauauauauauauauauauauauauauauauaugcacacacacccacacacacccacacauauauacauauauauccacacacauauauauauauauaugcacacauacacacauauauacauacauacacauacacacacauauguguguauauacauauauauauauauauauauauauauauauacauacauacauacauauaugccaagguaagccacauguguuggcucacaucaguaauguuagugugugggagacaggggcaggaggauuguugcauuggaggcuggucugaacuacacagcaagaccuuguaucaagaaaaucaaauuaaaaauaaaagaaggaaagcauaauuuaguauuagugccaacacagucccuugcgguucucccuggugcuucagaguuagcacggugccagugagcucucucgguuccugugacagcucuaccauuuuucauucaucagccacagacacacuaauuuuucccaccaggguugagacuuagugagccaagggcucagggaacaacaucuggggacacuuguugggcuccugcaagaacagggcaucucuaaggcugagggcuucccuaccuuacugccuuccucuccucugcauccucccuguagcccugaggcaggcagcucuccccuuuggagauguggcagugauggagacagauggcacucggugccugcagggcucccauucuagauggagugggcucaguucugcuccucauugaggcuggugcuggggaagagaccaucccaagcaaaggaacuacugauguucaaggcucccaagcuccuaagaucuccauccugcugggaugcaguagccacguugauaucuggggggagcagugagguagaugggaacccucccuuggggccagugccuccaguucuaagcggaauccucucuugccuuccagcuuccuacgugaucacagaccugacacagcugaggaagaucaaguccauggagaggguccagggggugagcaucacccgggagcuacugugguggugguccaugcggcaggccacgguccagcagcugguggaccuccugugucaccuggaacucuaccgagcugcccagauugucuugagcugugaguaacuacucuguccccaggggacucucagcaaggguaucuaccagauauuuucugcaggccuacuauguguuauacuuggcacugaguuuaucaggagagacacugacuagacagagaucuaaaacauuuaauuuguaauuaaaaaauauauauauauuggaggccagggaguaagggcacuuguugccaagcauuguaaccuaaguuugaacucugggacccacaugguggaaggagagaugcccaaaaguugaccucuggccucugcacguaugcugcgguaguugugccucuccacacaaacacacaaauuaauuuuaagaacuuaaaaaaaauauuggagagccaguuaggagacgguaagcagcaggaacgaaggaagaauaaccagacugagagauaagagagaugggguagggaagccuccaagcgcugugguccaggacagccaguccuaagagaguauccuggaagggugggaggaaaacuguguuggggcugaggacaucgaccaagggagagcaccaccuagaauguguaagacccuggcuuucaacuccaguucugcaggaaagacagaguaucugaaacucgggaagcccaugcacgcuuugaaauuggccucuguggagauggggauggcugccugccauuccagcagacccagggcacaggacuugccuggaugacccugaagccuuccuuuagagcaaggauagggauuacagagcuccagccucagcgcugcagcccacaugggcuaacagggucacccugggacggcguccacucuucagccacuauguaacucacuaggauuuaaaccugugguuaacacaccauggcuuuccuuuugggguuuaagcaggaggugccuguuccaguaggagagucuccagccaggcuugcuucugcauucccagaaacugucccauaaaccaaaccccuaccugguggucaugacuuuccccuagcuucugucucuguucugauuguauuucccuacccagucuucuuccagcuucuucucucagacuggacaggguagccugcuuggcucacagcucuuuagaacuggcuagcauggaugcuguccuguccugagaugugccagaucacuguuccucaucccuauuccccgagggccagucagagaggccugggucaagauauggcugagagaguccaggccuggccccacgguacagcccugggagaauuuucuuucaagggcucagacccugccauugucuugcgaaggggucagccuggaugccaagcagagcccucucugggauucuuggagccugggucuccaugaucacuggaaccaggaggcauuucauuugaucacugugaccagcccccaagguuugugaccucaauuuugguuacucugucuucuuagaaaccugaaauguggcagaugcugagaaaugauaaggcuuaacuggugugauggcaaaugguugcaauccagcacuugggaggcagagguaggcagaucaggaauucagagccagcuuugggcacauaaugaguucagaacuagcuugggcuacaugagacccugccucaaaaaacuguucuguauuuuaaaugaacuaauuauaaacacuuagagcugccagcucauauguggacacagugugguuacagcuaguccacuuugcagaggcagauggcugggccaggcaaggcaauggugucccaucaggaugugugauaacagaggaagaaccccagaagcuccugaccauacucucugaccacugacagcagagaucauugacuaaucuaggaaacaucuuucuuguggaggucaacaaagaccgaaacaccagauuuaaagaaacauucaugccaggcucaauggugcaacccuguuaauccaagugcuugggaggcagaggcagaggcaagugaacucuguaaacucugggucagccaggucgacacacagagacucugucucaaaaacaaacaacuaaagaauagguauguggcaugccggcgugguggcacacaccuuuaaucccagcacucgggaggcagaggcaggcagauuucugaguucgaggccagccuggucuacagagugaguuccaggacagccagggcuauacagagaaacccugucucaacaaaacaaaacaacaaaaaaaaguauagguauguggcuuguggucccaagguccaugggggucucaucuggauccagagcccacgacuccacucucucaggcaacuggaacugggccuguugccagcaacugugggcucucuggguuggcaggaagugcuaccuccuggcuuuuggucaauuagaacccuucucagacuagacuguccuguuuugcauuuuaugcaucccccaacccccaguuccccaaacacacucuuguuuuguuuaguccugcuggccaaaaccaccggagauggaucccaccaccccuggcuguuuugugccacucuggcugcucaccccugcacuguguccuucggcuacacacuucccuuuucucacccuugcuggguuuuuaauagagggaaaaaaaaguugccugccuggucuaaaggugaccacccagggccugugugcaggcacucaagugccuguguuaaggcgugcccccucuucuaaccaagccuuuaaucuuaguuuccauuuaccugcuuauuauuuacuuggcucugcagcagucaaccugaaaaauugacuucugcccaccauucuuucuuuccuuuuuuuuuuuuuuuuuuuuuuuuuuuuugauucugggaauggaaccucgggcauugugcaugucagcuaacuucuaccacuaaacuacacuuagcccuccuaacguguguguguguguguguguguguguguguguguguguggugggggguuguguauaugugugugucacucuuugucuauguguguaucuguggguguuugggugugugggguuauagaguuuuauuguguugccuagcuggcauggaacucacucuguagaccaggcugaccuugaacucacagagaucugucuuccucugccucccaagugcugggauugaagacaugcacuucuaugcuuggccccuccauauuucuuucucuuguuguuguugguuuuuuuaaaaagagauuuauuuauuuuuauuuuauguguaugaguguucugccugcauuuauauaugugcacuacauguuugcuaugcccaaguaguucagaagaggacaucagauccccuggaacuggagauagggacgguugugagucacugugugggugcugagaaucaaaccccggccagugcucuuaauugcugagccaccccacaccucuaaacacuucuuaaagauccgaagguagccguauuuuacagauguccugcauggguguuaacacauaucaaggcaaagaucuggccucccaucaccaaaaccaaaccgucccagccaaccagcaacuucaauagaguugaauagugucccaguaaacccacacugcagccuugugaccauuauauacgagccaaguucaggcuugaaguagcuggacuugcauggccuggaaacugaugucuggggauggggguuucuguucccucacuuuuccucagcucuacuugccaaggucaucauuuaaccugcuagacauggaauccgacaagaguuagaagaaauuagugcaggucauaggacucgguuuccacagcacaaccuuugccacacuuuccgucguucuucaugcucucccugacagacuccuggcucuguucauacagggugggcuacagggacuuagagagccaagcugggccuggcaugcuagcacaugucuguuagcccuaacacuggacaaggugaggcaggacgguagugacuucugggcuagccugggcuguauaaugagaccuugucucaaauaaucaaacaagcugaacugggaggaggcucaaagaccaaaguucucaggaacagccucugaguagaauauggguguggccaugggcgucugaaaacucaggagccaucuggguggaggcaggcugauuccuggggcuugcuggccuagcucagaaaaccgugaccuucagguucagugagagacucuaagguggaggaacucaaccugggggcccaaccccuuugugggggaucaaaggaucaaaggacacuuucacaggagucaccuaaggccaugggaaaacacauuuacaauuuauugcaguaccaaaauuaccguuauaaaguagcaacaaaaauaauuuuaugguugggggucccagcauccagaagguugaggaccacugcuuuaagaacauagaauagaaagugacacuugaugucuuccucuggccuucccgugugugugugugugugugugugugaacacacugugugaccgcaugcucgcgcucacacacacacacacacacacacacacacacacacacacacacacacacauauacagccaugaacauuucuccaccagugacauccaaggcugucuagggcagguaaagucauuccaagguguccuggugucaggggcuggccagggacacaugcuucugguucuuauguaaggugacaagaagcaaaggugggugugcuccugucugccuagggcucuaccaggaaguugcaugucuaaccuucccuuaaaagcauuggccugaacugcaucucaggaucgaccugguugccagggagacugggaaaugcaggaagagguuuacagagguaaagcaucuuguugcucuggaggagaaguagcuauuccagagacaacuagcaucucacacaccuucccauuuggccaucuggaugucuacacgcaacugucuucccacaugugccccguccccaagagagaaagaccugauagcuaucagucacuuucuuuagguuaguucaccguccgaugccaccaucuguggcucuccucuccagcuucugaugacccaguggaucucaaccagaaagagguuauccgcacucccuugcccaccaguguacccacaauucauugcuaggauggaacaggaagccacaguccaaguagcugcuugcucuagcagucagugauuccagcaggaccuguccauugccugcugcaauagcgguccucaccagccauucugcagucucugggcaucuguuucaccuggaaccuuggcaggguaguuuggauggggcugaggaguagauaugauugcccggguaagccuaggucucauggcgcauuugucuagugggguagauagacaguaaugauugaacacacauaaacacagucaauagcaacacaugcacucgaaggaacaugcacuggguggggaggccggcugagagagggagaugggaagggcagcugaaggaagggccuacuuggucgugucuaggcagagggcacagcauacucacagaggcuggggugggcaggaggcauguaugaagaccaagagaggccuuugacuuucugauccuccugccucaaucucucaauucuggaauuacaggugugcaccgccacacccagaugauggaaugcugggaaucaaacauggggccuauggcuugcugggcaagcaugcuccccauauuauuauuauuauuguuguuguuguuguuacuauuauuauuuuauugguucuucaagacaguuuuuuuuuuuuucuguguaacagagcccuggcuggccuggaacuugauauguagaccagacuggccugaacucacagaaaucugccugccucugccucccuccugagugcugggauuaaagguguguguguauguguguguguguguguguuuauuguuguauuagcaguuuuucucagggcuuuaacaaaaucccaacaaagcagcuggaggaaggaaggaaggaagggcuuuuuuggcuccaaguuugagaccuguaccugggaccugggaugcuggucacacugcauccacagacaugagagcugguguucagcgccuguguguguagucuacgaccccaacguaaggggcggugcugcccgcaugcugaugugucuuuauaccucaauuaaccuaaaucagaaagccccucacacguacacccagagaaagguuugccuccguggugacucuaaaucccaccacguugacaagaccaacuuaucaaaugaaaauguacuggucccauguagcugagggguucugccugucaacugaguagggggagacccgcgggggucugaagggaugugagaggugacuaagcauuucucucccauuggccgcugccaucuuccugucagguuuuuguggauuucuuguuguggguguugaggugggaugcucacacaguagggaagagcagcguggccgagcucuaaccccgucuggaauuuucucgaugagcuuuguuguuuucuggacgacaugcuugugcaacucuaacuguucagacucuggcuuuggcgugugagccagagucacuuccuuccuggaucagggcucuguggacaggggacuuuggguggcuguugagcaaaguagagaagugugaccccuuccucuucauagagcccaggcugcacgcauguaggugagagggcucccauguauagucuaagaguuucuguguuugcccucucuaauguuuucacagccucagggagcaauagaguguggaucaggaucaucucccuguggcaucagggaccuguccuggaagcugucacuguaucaggcugagacaucagggucuaugaacccaaaauaaugggacuuagcacccaguaugucccagcaagcaccuuuccucaugaguuuaguuacucccauuuuauagcuguggaaacugagacuugcccaaagccacuuaccuuguaaauggcuaagauacaaaccgaggucagcuugaccuuaaucuguauuuggguaggucguuagguuaagucucaaguuuccccuuuggggaaucgggcaucuuuagguaugguggcacucaagagguggaggcaggaggaucagaaguucaaagcuggucuuggcuacauugccgucauccuuggguacaagagacccugucccacacuucaaaggaacaagugucucagccucuguuuacucuguuuuuauagcaggaagcuucaaaaagguggccgcuguuuuuuuuuagggugcugaugcuaguguggggcaggucaccugauuuccuuccccgaacugauccuucuacagucgcuguggguuuggagaguggugggagagcacauaggggggcaugugccgcacaauuaaacuggggcacaggggguucaccugucaggcugugacugugaaccaugcuguggucacccggcuccucuaagugagaaggcucagcuguccucaguguuuucgugagucagugccagaugcgucagaggcgugaccuaaucgcgccccccuccccccaagaugagcugcaacaugcgaaaggacagcuccuguguccuugacuuggggucgcugugacaggggaggcaauggaagagacucguuggcuuuuuguuccugguuagcugggaccuugccuucaauggcuucaaucuaauugcaagggagacugggauaugagaggggcaagugggucacagcuccaggugacaucgguucaaggggauuuuggcaagguuccaucuaacccuccaaagccccacacagccucacuccugcccaguuuuuugaccuuaccucuaccaucuaucugccucuuccuucagcccagccacuaaggucuuucuuucuuugaugaaacuuaucaaaaugccccaggaccuuugcacaugcuguucccuggacucuggucuuucccaaacauucuuguauucuuccagaggccaguccccaucaccuuuuggaccuuggccucaaaagaauuuccucccuucgaguuucucauuugcauacgagucuucccacuuugugaauuaguugauucccaccucaucccgagugcuggaaauugacucagccauuucucucaagcagagacccugucuccaaugcuguaagugaaugaaucacagugagucuuugaaacuugggcggggccgggcucucugggcaucuagguaugaagcaguuaggagguaggccaugccugucucugucucuuuuacauuuucuauuuagagucaguuauuauggugcacgccuuuaaucccagcacuugggaagguagaauuaccagaauguguucauagaaugaggacucugaugucaguucuggaauccccucuggcccaaugaacagcgcugggauuugccgcuguguuauauaggcaggcagaucucugaguuugaggccagccuuuuucuacagagauaguucuggaacagccauggcuacuuagagaaacccuaucucaaaaaguaauauuuauuuuuauuuuacuuuauguguaugaguguuuugccuguauguauguauguauguauguauguauguauguguaccaugugugagcaguacccacagaggccaaaagagggcgucagauuuacuggagcugugguuacagacaguugugaacugagaauuaaacccacggccucuggaagaacaacaaguguucuuaacuguucacccaucucucuagccucugcuuacgucucucucugguuuuuuguuuguuuguuuguuuguuuguuuguuuuguuuuuguuuuucaagacaggguuucucuguguagcccuggcuguccuggaacucacucuguagaccaggcuggccucgaacucagaaaugcgccugccucugccucccgagugcugggauuaaaggcgugcaccaccacgccugguucugcuuaagucucuuuugaguuuggaguuuuuacaugcuguguguguguguguguguguguguguguguguguguguguauacacgugugauguuaaaccacaaaugcacaacagacugggccuggggauuaguuggaaaaguaaaagcaagggccuagugaaauguuugucccugaugugagugccuggcuccaggguuccuuggcugccugcggcucaccacuuucgauuguuuagaagggagucauuccagcuacagaucaacuuaagcauuaaaauaaauaccgaaguauugcguuguuguuugccuugaguggguaaagggcaggguuuccagaguguguucauagcaugagggccuugcugucagcucaggaguccccucugccccaguaagcagugcugggauuugcugcggugcuguccucaggcagccaggggaggaguccuaugccugccuggggucagccaaggcaucagcaugguaaccugccuugaauccuuuucacugaaggaaguagagcagaaauaaaagauuccagagaaaacaaguguuucagguuucauuuucgucaaguggaugacgggguuguuguugaauaugugugggagcaugugugggugagcaugugugugggugagcaugugugggugagcaugugugggugagcaugugugugggugagcaugugugugggugagcaugugugggugagcaugugugggugagcaugugugugggugaacauguaugugugagcaugugugggugagcaugugugggugagcaugugugugugggugagcaugugugggugagcaugugugugggugagcaugugugggugagcaugugugugugggugagcgugugugggugagcaugugugggugagcaugugugugugggugagcaugugugugugggugagcaugugugugggugagcaugugugugggugagcauguggggggagagugcucauuugugugugggccugaggucagugucaggugucucucccugaacguggggcucaacauuucagcucugcugacuggccagugaacuguagcaauuggccugucuuggucccuccaguggucuuguuauaggaaguugcccccgccccugguuuuucacaggggggucuggggaucugaacuuggauccuaaugcuugcacuuugccaacagagccaucuccuuagcucuguggcuucuugagaaagggucucacuguguagccuacgcuggccuagaacucauuguguauuucaggcuggucucaaacucaagacagccucccucaaagguuggggguugcaggugaguaaccgcuaaccauaccagguuacguuuggaccugugucccagagccugaguuagauguucccauaguggcaagcgugguucagacagagacaucuggugacagagggaaauaccaauggcuuacaucccuuaauuguuuuuaaaacuuaaccuauggguguggggggggggaugcgcgcacgugugcgugcacgcgcccuuggggccgugaaaggguauguaugauuccuuggcauuacaggcauuugugauccaccugaugcuggugcuggggaugaaacuuaggucuucugggugagucaguucucuuaaccacugagccaucuccucagccacaguggcuuacaucucuccuuagcuggugggaagcuggccagagcauccugucucugggcauucuugcuccgucgagacagcugugcacugcggcaggauacacaacaaagcaaggaggaagucaccuuccccucacacacaggccugcaaagcacaaaggggcuuggacacagcugggccccacccuuugccaucuuauuguccaggacucuauccaggucacucuccuggaaacucacagacucugaggaugcacauguugccagagcuguagagaaaugccucuuuucuuccugggguggaggaauugccgggcaagugaacuccaagcugcucauuccucguaugaugagguaguuagugagcccugagggaggugagagcagguccccauuucucccaccauccaccuccuguguuguuuguuccuguacccacugacuugcucccuacccacauuuacuguccgugaauguuugaaauauggcuauggaagcuguccaguguagcucaguugguaauguuugccuagcacgucggaagccuuugguuugguccucugcacuguccugggauuccgcucucgagagguagaggcgggagaaccaggagguuuuuauuuguuuuuuguuuuguuuuuuuuaauacauaguuuauuguuauuguuauuauuacuauuauuauuauuuuguacauugauguuuuuucugcaucugugccuaugugaggguguccacccuggagugggaauuauagacaggcaugagcugccaugugcuuuaugggacuugaacccugauccucugggaaagcagccagugcucuuaaauaccgagccaucucuccagccccuuguuuuauguuuugagacaaggucucucuauguagccuuggaugucccagaacucacuuuguagaccaggcugacuucaaacucacagaaauccaccugccucugccuuccuuaggcugggauuaaaaguguaugcuacuaagcccagcccaggauccaggaguuuaaaggucaccuuuggcugcuuagugagucucaggccaguccagacuguaugaggcccugugucaaaaaacagaaaacaaaauugggaauaguuuuguaucucaaaggcuuccucauagaccuuccuggaugucaaaggugcuuucaauuuuauuuaguuggauaguuuauuguuuugaaauggagucuugcuuuguugguuaggguggacuagaacuucuggcucuaaugacuguccugccuugggcuccgaaguagcuugaugaccugugagccgugccuggcccagaggucguuuuuuaaaaaguaaugaguuacauuuugacauucauacauauguaucaguaugcuuagcacauauuugcacaucgcccugcccccucuacuggucccuuacugucccuaaauugucccuuuuucuuuuugcuuucucauauauauacguauguguuuaaauauggauucugcauaggggagaaaaacagcuguuauguuuccccauuccccucuugcuccacaucccuguagauuccuuccuuccuuccuuccccuucacagcccccucuauuuuucugccucucuauauuuagcucuagauucugcuucuuagagagaaagcaugugcuauuccugugcggcuccuagagguuuguuuugguuugagacagguucuguuaguuacucuccuguugcugugaucaaacaccgugaccaagacaacuuaaagaaagagagagagagagagagagagagagagagagagagagagagagagauuauucagguguggugaugugugccuuuaaagaguuagucuggccagguggugagugccuuuaauacuagcauuauagaggcagaggcagacggagaucucugugaguucaaggccagucuggucuacagagugaguuccaggacagccaggaccaugcagagaaacccugucucaaaaacaaaacaaaugacuuaggaggaggaggaccaggaagaggagaaggaagaagaggaggaaaaggaggaggaagaagaggaggaagagggagaggaagaggaggaauaauucauguagcaggagaaucugucgugugucaccauggggaggcauggcaucaggcagacauggccggagcaggaagaugagagcuuacacauugaaccacugaaaugaagcacagagaacaaacugaaaggggcaaugagucuuuaaauacucaaagcucaucuuccgugacguacuuccuuuaacaaagcccuuucauaagccucucccaagaguaucaccaacugguuaccaaauauucacaugcucgagauuauuggggcucuuacucugucagagcgccacacaggcuuucacauagcccgggcugaccucucgaacucacuguguagcagaggaaaacagaacaucauauucccgcgagcucggcuccugaugcucgggcauuguaggugugcauugcuguugggucgguccugacuagcugugcuguguuucugaucucauuuugccaagcccagguaagcucccagagcucugggguuaggaugacugucacuccgguggaggugcaagagacuuggaggaccaagacccuccuucccuggcuacaacuggcugaggaagcugugucugccucagcucaggucugccucucugaucgugcucugccuugaaucagacucuggaucagugccugugccugaugcccuugagaauuuaaccccacaaaggaaaaaagaccuguggcccuagcacugggaagcugucuggggaaacucagccaccagcuugcucugcagccauguaggacauucaccccuuugcucuuggucucucagccuguggcgcuccagugucuucugucucccuagugacugaaagagugggugggguuugggugggugggguuugcagccuaagcagcaacagguuccugaaaacagaaacaagaggagccaugcuuuucuccauuugguuuucacagggagagugaacaagacuagcucgcacugcauaguacacaaccuuacuugccaggaggcacaccagcagcuaggguguuuaauaucuuucuuuccuucuccuucuaaacauuucuauuuauuuacuucuuuugguguuggggguguaggaccuggggauucguucaugcuuggcaagcccuggaccucuaagacccguccucaguccgaaaacgguucgaagcucacacaagcuaguuauuguuugcauauggacaucuugaucuaacccaaagcucacucgguuaggggaauucucaggaagcugauggggcgugauguaguagagcuugaccugggucugucagcugacauuugugguugguugggcauggcucugcaagugucauuagguaucccugggugguugaggaaguguuaacucugaaugugcugacagguucccuccgggccuucucaugccccccacccaguaugucuucuucccaccccaguccugaaagugacccugugacacccugccagguguaggcuagggcgugucauuuuagaaaaacaggagagagagagagagagagagagagagagagagagagaggauggacucucccugcaaugaaaacaaaggaagccuuugugugcccucaugggcggagcuugcaaaggucccuugugccacaccacauaucccugcucagagagacacagauuugugcuaaacaaacaaacaaacaaaaaggucacaggggcugggcugugacucaguggcucagugccagguacuggcuccauucccagcagcugggaaagaacagagucagcaggaauaggacccagaggucaggauggagugacccuugacccccauguuaccgaugaagaaacugagucucagccaggcuucacucaagaaaaugccucuagcugaggagauggaucgguguauaaaggcacuucuucacaaacccgagaaccuuaguucaaauccccagagacacagacaccugugucuguacuucuagugucccuaaaggagaugggagauggaggaaggagaauucuugaaaguccucagacuagcuacccugcuauacacagaagauaaacaacaaagcgacugucucaaacucuauccacucucuaugauagucucauuguccauauuuacacacacacacacacacacacacacacacacaaaugcuggcguguacauauuguguacauacacaacgauaaauacaaaauguaaaagaaacauuauaugcuggacccaggagcaaugugggggcaggugggguaucauuuccuacuguugugggcauggcuucaaccugaagucacaguuggggguucucuaccaggaagcgaccucuguccuucugcuucacacaccugucuggaguugcugcuguaugucuggugaggaccaugggauuucuacucuaggcucucuggagagagaggaacaacacaagaaaggcagugccccuggcccaguggaggcuggguaagagauguauggaacagccugccuccuggggacauguuuagcaucugcuuuuggucacucccuguuugggcagcuugguggcagguaugcuuaugaauuggcaguuaccucagcaaaugguuuuuguugacauuuuguuacaaagacugucuguucccuuccagggcuucagagccagccuggucuacaaggcacagacugugugguuuggcugcaguggggaaguggcuggcuuagagacuacauuccagguggcaugaugccaacaaaaaaacaaaaacaagaauuacacggugcugguuagauggcccagggguuaagaauacuucuuggaggaccugaguucaguucccagcacccacauuggguggcucacagcugucugucauuccagcuccaggggaucugaugcccucuucugguuucugugggcauugcauacauguggcaggcucgcgugcgugcgugcgugcgugcuugugugugugugugugugugugugugugugugugugugugugugugugaaaaaaagaaagaauuacagaaucauuagaaacagaggaaaagaaagagaaacugcugagaggaaguggcuuuccaaaagaggaaaauguugugaaacuuccuucucuagaguuuuuuaagaccauugcaggaacuagacaaagggugagguaguugcuagaagccugguuaguucuuuaugcuguaaugggcagagccaacagauuccccgcuugcaccaugaaugcucccuggacugauguucuuguuccuaggcugcccacccagcuugaggugguugaaacuccuuucuguccaucucugacuccaacuuuguuaaauuuuguuuuuuugaggcagguucuugcuauguugucuugacuguccuagaauacacuauguagaccaggauugucucgaacucacagagaucugccugccucugccucccagaugcugggaucaaaggugugcaccacuaucccugcaguuucucuuauuugauggcccagaacucauagagacuccagugcuggcaugaaaggggguugcaaccauggcuggcuuuuuuuuuucccgagacaggguuucucuguguagcccuagcuguccuggaacucacucuguagaccaggcuggccucgaacucagaaauucgccugccucugccucccaagugccagagaagauagaagagggugugggaucccccgugggcuuucauuuucacacguggguccaccccaaaccaaccaagaaccaaggaccuuguuucuuucacacacacacacacacacacacacacacacacacacacacacacacacacaguuagcucuaacaucuuugaguuacauccaccucucuuacgauuuggguuuugcugaagcaggaauauugaagaauccggacuaaggaguuuagacauuauccaggcaacaagaagccauaguguuucccuuuaagcaacagggaugugacaaggccagaacgggcucuugcugccugauggcaaaggaagggagccgagcaggaaggguaagccugggcgcuaguuggaagagaggagaacgcuguuuaaaagaaccucggugaggucuggauaugagcuggcaugcaggugaccucccaccaucauugaggguuccccaaacuauauauacuaugcagaagugaggacauuuccuguaggugacuucuguagccagcccuaucaaccugggcugugugauccucagcaagucccuaaagcuguuuagagaugagcuguacaguuguguguagggcagcaggaccaggccgucucucuagauauggcugcuguguaggauucucacguaugaagcagagaagagaaacugcgggacagucaggacuugggcuccuggaacccagggucuugugcaugcuaugcagaugauccgacacccagcucccaggcggaugucuucagcuuguuugcacauucaguaaacugcacagcccuuuccaaagcccuucugcaccugcgcucccauuucuccacucacagcaguccugacaaagucagcaagcaggcauuacccucguggucuucauuuguuuuaauuuauuuauuuuuaaagauuuguuuauuuguauuuuauguguaugaguguuuugcuuguauauauuauaugaguaccacacacauguguagugccugcagaggucagaagaggguguuggauccccuggaacuacaguuacagauauuuguggaccaccauaugggugcagggaaucaaaccuggguuuucggaaagaucaccagugcuauuaaccacugaggcaucuccccagucccuguuuauuuuguggguaugaguguuuauaugcacauauguguaccaugugcaugccugguagucacggggaucagaaguuccccuggaacuggaguuacagacagcucugaacugcuauuguggauguugggaauggaacccagguccucggcaagagagagcagucagugcucuuaacugccgagcuuucucuccagccccaauggucuccaucuuauaggaggcucauggauggaaagugacuuuuuggaagucacagaacuaccaagucagaagcuagguguguguguguguguguguguauguguuucagaaugucagagccaaaccacguggcacugucauagcccaguggacauaugagcaagucaugacccagagagaacaacucaggaggcacagugagaauuugugcuggaggcaggguuggaccucaagucucugacuugcagaccugccccgccauagcuuccuggucauggaaagugacaccguccucuaugccuuguuccagggaagccgguuccugagagcacaucuccccucccagccuucccagaggcugugaagccaggggcuguggcuacuucuagaagaaaccucaaggaugaacaggagaaaguccggccugugaagccacguucccuucuagacacaggugcucuccuccccuccuuccuccuccucuucugaguuuuagauuuauacauuuuucuuuucuguguaugggugcuuggccugacuauacauaaggacuacuugcauacaguggagucaaaagaggucauuggauucccugggauucccuaguauggugguguaucacuaugugggugcuaggaucacuaugugggugcuaggaucacuaugugggugcuaggaauggugguguaucacuaugugggugcuaggaucacuaugugggugcuagggauggugguguaucaugaugugggugcuaggaucagucccagguccuccuaaagagugaucagugcucuuaauuguugagccaucuuuucagacccauggguauuauuuuuuucuuuugggggcaugggguguguguguguguguguguguacaucaaaucacacugcacagugaguuagauauccagguguggugguguaugcgugcaaucccagcuauuccagccucugaggcaggaggaccuugauuuugacucuauucugggcuacguaacuggguggcugcuaucuggcuuuccucaggaagcugaggucagggaucccuguggcccaugacagagugucugcuugguauacacagaucuggcuucaguccucagcuaaauguuuauguaguggucuuuguuacuuuguggggucuucuuccuacccuuuaugccccacccaucccacuuucacccuaaucacuagauaggagagaaagaaggauauggggggggggggauccaugaaucuaguuucuuuccucuuugagcaugacugcuaacaaacugcaaccaacccuccugagugaccaacagccaccacccccaccucucggggcuguagaauuuauauaccuucugaaaaauucccagaauuccaaacaucacacaauugcagaaaccaucugcagcuggcaaaaccacggcucugcuagagcaugaggcaaaucauagucagcagcuaccacacagcccgauauccuugcaccugggauuaaaacaaaaacauaugugucuguguuuuuuaaagaaaccaaaauuccaaaauucucauuacaguguuaaguuuacaaauaccauuuucagagugggucagggagggagagcugggcauggaacccuggggguuaggcgugcgagauaagugcuuuacccuugagccacucccucucccaucaauuucagcaaaagaaaaaauaaggauuugcucaaggugauuuaaccaugggguuugagcacuucuaccucccccauacagccuacgcugcugucccagagccuugcagagagcacuguauguguguccagccucucaucuccuguaaccucuggccugcaagcucaagaucccagagccauaaaaugcagcucacugaggagcccgaagcuagccaguccugcauggagcagucacuguuaggggcuugggccagagguugacccaccagugcuuacauucccucucagccucaucauuucugaguuccuccaucuguaaauggguaagaacagagcccauugcauccuauugcagagaaucaggcaccuuagcuggguggaugguguguguguguguguguguguguguguguguguguguguguguguguaugugugugaaugaaaauuccaggccaacaugguuucuuuaggcaugugccucugcagauaccagagcugguaaccauauggaucugugugaggggacagggaaauccaguuaaaaacaacuccauagccaguagaaaggugugcaaaacaacugccgauggaagccacagcugggcuggagaauguuucacuucccucagcuguuccuuacuuuccugcuacauaguaauaaaagaccacgccaucccuucccauagugagaagcaggcuuuacagacucagaggcagauagauguuaacaccucacagcccauuguccuauucugaucucccccgcaggcccaggaucuccaggcauuccagagcaacagguccguggccuuuaccggaugccuggcuccauaugauguuucuuuagucauuacaggggaugcgugugaauggucgcucaggucugagugcuuggaagacuggaguagcucauuucugggcaggcaacaccaccgggcaaucaggucagggcuggcuguccuguccucacagauucuagcuggguggugggggauaaugccuuuaaucccagcacuuggaggcagaggaagauaggucuccaaguuugaaaaaagaaagaaaagaaaagagaagaaaaaggaagaaaagaagagaagagaagaaaaaggaagaaaagaagagaagagaaggaaaaaaggaaagaaagaaagaaagaaagaaagaaagaaagaaagaaagaaagaaagaaagaaagaaaaaguauggcuucuauagcucuuaaggggccaggggagaaucuaguguggucuaagucggaccuggagucagacugugaacacaaggaccuugugcucucuacaguuucuauauccaguuccaagccaggguugcauaaugagaccccaucucaaaaaaaaaaaaaaaagaaaaaaaagaaaaaagaaaaaaaaaaggaggaaaaguguguguggagggggcuggcaguuaaugcuaagucaaggacuauuuccuguaacuaaagauaucgaagaaggaaggggaaaaaugugcugaccuaugaaccccaauuccugauagguccucagacccgggccaaacugcuguuccuuugccaaagggagaaagauaaugagaggggaggugggggaggagcgggcgggugccagggccucucuguacuuucaccauuagccuuuguguggcccacauuccugaguggcccuggggagcaggugugccggggccacugggccugucccugcagucccucccacagaagcggaaguucuauuucugaguugaaacaggaggaguuauucuuuccauugauuacugaggccacucagcccugggaaagccccagauuucaggcuuguggucuguccggggaaguugcuguuugagggcguuuuuuauuuuagaggaaaaguuugggcgcuuggagcguuguauuuugaggacuuuuauguugagaugaauggguccugcgguguguccccgaccuuccaugaacccgugcagcgcucagcagacaggaaguuacacacuaggcccucugugauccacuguggcaacaguguauacaguguauguaguguuugcaguacaguguguguguguguguguguguguaugguguauugugugugugguaugguaugaagugugugugugugugugaugcauggaguuugguguguuuaugggugugugugguguauauugugugugugguauauguuguaguauguguaguuucuuauuaagaaucugcaguguccacacagacaacgaaagcagugcauugaaggcucugugcugcuguccaggcugcaagggugguccaugguuacuucaucggcugggcugcucugccuugcccggccauccggggaaaccuuagacaguucuuugaaaacauuuaaaaaauggaaaaucuuggccaggugguggugguggugcaagccuuuaaucccagcucucaugaggcaaaggcaccuuggucuacagagagcuccaggguagccagagcuacacagagaaacccugucucaaaaaacaaaaacaagaacaaacagaccaacccacucgaguagacgguucaugcuuccaucagccggcuucagugaugaucagacuucuggugacccagcggccauugaggaacugguuccagaacuccuuccugcaggguaccagagucuauggauacuugagucccuucugcaaaguagcaugauaggugcuugauucagcccuggcuacugguacccacaggauggaggugccuggguauuuaccaagugagugcugagccuccccucccccuccgugcccuugauuuccccaguccuucaggccaccccagguagaacagcaucugcuguggaaccacacuggagguuucucuguguccucugccaggcaguggcacaggggcagcacaggggcaucccccaucaugugaccccggcugcucaggacaccucccacuuccuggucuccuccugucauucaagaugacaaauugcaccuguugcaagaugucaccaggcuuaaaaggauugacaccauggagcuggccucccccacccccuccgcggugucaggaggugacagcacugacugagggaaaaggucgcuucgggaugcguccccaggcagaguguugacuguguuguccuuucuagggcccaucauggcuggggcccagcggcagcguccgugcgagauggaugccccuuguucccugaaaacugaugcacccgacucuccccagucuaagguaaauccacccugugcuucuaucccaguugugucuuggcucgugguccucucagaaacaguuucuucauucccugagaccagugugggaguggggaggacaagggacccacaaaugucuccccaaacuucugagauuaaggauacucaucagcagaacaaggggugugugcugcacugaguuugcgggucuuggucgguugugucuuuggggcaugauucagggcccagugaaguacccuagcacugagucccagcccgggccaggauucauguuugccacauuggggauugagcccaggguucuuugcauucaaccacugaaccauaacuauagcccccuuuuuucuuuuuuuguuuguugugcuuguuuuguuuuguuuuguuuuugagcaagcuuuuauuaagggucauagacaacaggccuugaacuugugaucccccugucucagccucuaguggagcagcugggaggacaggccuucacuacaaacucaauagaaucuuugcuuucuuucuuucuuucuuccuucuuuuuuuuuuuuuuuccuguuuguuuuugagacaggguuucucuguguagcccuggcuguccuggaacucacucuguagaccagacuagccucgaacucagaaauccuccugcuucugccucacaaguauuggaauuaaaggccaccacugcccagcuaggaccuuuguuuuuaauggcccuggguaagcaagaccugaaccaguaacgccuacacaggcaguuacaggaacuaguuuacaacugcccagcccuccccacuuucuugucagacuugagcaacagucagagugguccugcacuuuaacuuggguuccagaauguucuuugauguuauucuuguggguacuuuugcccucauuuguuaaugcucccagauacuguugugacucuauugguaauaauucacacuggguuagaaaugaaagcaacaguuugcauacagcucagugguacagcccugggucccaccccagccaagggggauggggcgagggaaauagcuuuuuacucuuuugaggcaggguuccauguagcccaggcuggcuucaaacuuguuguauagcugaggauaaccuugaacuacugccuccaccucccaaauuacuggauaacaggcaugcaucaccacacccaguuuauguguguuaaggauggaacucaaggccugugcaugucaggcaagcacuccaccaauugagcugcauccuuacuuauuuuuuugagacaagauuucacuauguagcucaguuuggauuugaauuugugaauccuccuaccuuugaaucccacaugaugucgucaugggcgugaacuagcauacccagccuuuucuucuaguuugaaaagauaaagaccuugccguuaaucccagcacuugggaggcagaggugggcaguucugugugaguuagaggcuagcaugguguguacggugaguuugagaccaaucagagugacauaguaaaucccugguuuuuggguuuauuuuuuauuuuuauuguuuuaaagauaucaaaaguuuguauguuuuugagaaguugaggguuugggcuugucccugggggagaaagcagcaacuccugggcugguuaauaaauaucuccuguaacuuaaucauguucagagaugauugaaucauuaaggaccuuuagggccagcaguuggaggacaggcaggcagguugagguuagccuggucuacaaugugugcuccaggccagccagggguacacagggaaacuaucucaaaaacaaaaacaaaaaccuucaggagccugggagauggcucagcgguuaagaacacuggcugcucuuccagagguccugaguucaauucccagcaaccacaugguggcucacaaccaucuguaaugggaucugaugcccucuucuggccugcagauguaaaugcagauagcacucauaaauacaucuuuaaaaauauuuauuaagaaguuucuauaaaccuuuguuuuccuuuucuuuuuguacauaaucuuuaaaauuuuauacuacauuuauuuauuuuguauguauguauguauguauguauguauguauaugugagggcauguguaugcuguggcacacaugugaaguuagaggacaacuuucaggaguuuauuauuaauguccuggggguugaacucggguggccaggcuuuccgagagccuuuaucuagugagccaucuugccggccccauccucauuuucuauaagccaauucuaguggaucuaacuggcaggaacagacucaucuuuaauugccuguuuuugccuagaauaguuuccuagaacuauuuccuagaaugauuaauaaggguuuaaguaaccuuauaaauaucaauuucugugugccuguguuucagccagcuuucauggucaccauccacucuucucucccaaucuccaguauugcaguacuuccacaucugcccccaagcaagaaaggcuuuuggguuugcccggagacaggcuuuucuggagugaagcagaugucguccaagcaacugaggacuuugaccaaagccaccgaaucagcgagggcaccuuugccgauaucuaccagggucaaaggaacgguguggccuucgccuucaagaagcucagggaggugaggugagggugucugcagggagcagugaggccgggggcugaggguggaugggucuucaggggcuguguauuuucccacagguggccggcuccaguccaggguccauggacagauuccuacaggcagagaugcagcucugccucagguaagcuuccggugcagagccccuggccuaaugaugacggcaggcagugcuuccugugugcaaggcaagugguuagcacugucauuauuguucugggccauuuucugaggcugucacggagagggcgguuucuaaagcacauguuuguuuauuucgugguuuuagaggcugggagcucagagggcauccauugaggccucauguagcagguaccacagcaguggucaucacacagugugacugagggucucuacucuuguauagcccuagcccaugaucucaccuaacccuaagcacccugccuccaaauaccucugacuauaaauuuggggccucaguuuccagcacacaaacucuggggcacaugcucaggucauagcauauacaagcucauuccagcgucaccagaauguugcaacacagaucccagggccacaguugauagguguauacguuggggcccagagaggcucaguguuuggcccaagaccacacagcuaguaaguggcagggccagaguaugagucuucauagacuccagagucugugcucuucuuaugcagcaaaaaauagaauucucaagaaacccuggcuuuuuccagcuccuccuuccauguaugaagaaagagauccucccuaucgcauuuugaaacaggcaaacagacugguggucaauggcaaaccuaucucaacacuagacauguggggacccacggaacuaagucugccucuguguguguuuauacagccaagauugaagaaugguuuauuuuauuuuauuuuauuuuagagacaggguuucucuguguaucccugccuguccuggaaauugcauuguagaccaggcuggccuuaaacucaccaagauuuaccugccucugccuuccaagugcugggauuaaaggugugagcuacuacaccuggcuuauuuuauuuuuuagagacuagguuuuacuauguagccugguuggcuuggaacucucucugucgaccaggcuggccucagacucacagagauccaucugccucugccuucuaagugcuggauuaaaggugugggccacuacaguuggccuggcuuuuauuauauuuuaaaaugguugaaacaaaucuaaaggauagcucaugguccauggauacaagaugacauaaaauaaaguuuuauugguauacggcuguguuuuccaguguucacagugucuaugacuccuucugggcugaacacacaguagggcacuugcuguagucuacaguuuguggagaacacauguuuucuaacucacucuuuauucuacaagcuggcuggagauguagucaagcacagauaaggcccugaguucuaguccuagcaacuccccaucccacugccccaccccccaauauuacagggguaaaguaagaaagccuccaaucuguucacugcugcgagguguggucuugucaccccagcacuugaaaugcugaggcaggaaggcugcacaccaaaggcuucccaucccagagcugacgggagcuuggggagggacgaggacagucagggacugagacauguccuagcuuugucaccauaccuagcuaguuugucauuucuaaaugccuucuucauaggagauaacacacaugaguguaaacauguagacacucauucaauggagaucagacaugugcccuugcuucaacucuguguucucauagauaggcucaguggcuauuccuccacucauuaguuuaguagcccaggcuauaccagguuagagggagagcucacuugaaaccaaguagcuccugccuccuagugcaugcaggacggacaggcgugcaaagcuagugaaugagacaggugugaaguagggcacgggaacgcagcaugaccuggcacaaggccaucuguaguugcccuucgagguagccugggcuguggccacaagaaggagauggaaaacuguguguaacgacugugugauggggcuggagagauggcucagugguuaagagcacugacugugcuucuagagguccugaguucaauucccagcaaccacaugguggcucaucaccaucuguaaugggaucccaugcccucuucuggugugucugaagacagcaacaguguacucacauacaugacacaaauaaauagaucuuaaaaaaaaacaaaacaaaacaaaaacaguggguggugauuaaugaggcaagagguuucugggaggcagaagagaaguguccuuucccagguagacacguggaugguucacauguggagcaugagauguggcuagagucaugaggagagccaagaggagaaaggugacucauaacccugaggcgggugugguggccucuagcagguucuucaucuuucagccuuuucccagaaguggguuggggauggugccagacugcacagcagggaaauagggugaggccaccagggaccagagccuguggcggcugggagguagcggguggucugagccaggaaguggggucugccuguggcucuugcucuuucaugccugacugugcacuugugcuggguucagaugcugccacgcgaacguccuaccucugcuggguuucugcacuggaagacaguuccacagccucaucuaccccuacauggcaaauggcucucugcacgacagacucugggcucagguaaaccaguggcuguagucacaggacggaacagauagcucuugccuaggagucaaguuaaggacuucaaagaguguaaacuuuuuugaaagcuuauaaaagcuucaauauagauaucaauguauccuuuauuucauuuuauuuuuauuuaugauuuuuuuugggggggggaggacaagaucaccaguagccagguuagccucaaacuugcuauaugguagacagugaccuugaaguucugguccuccugucuuuacuuccugagugcuaggaguacaagcaugugcuaccaugccugguuugugcagcgcuggggaaugaaguccaggaccuggauaggagcagacagcuuaaacugaacucuguccccaacugcucuccuagucuuuauaaugcuaagaucaaauccaggacuuccgguccauuucauauccaaggagacaaaagcucagaggcuucaagcgucuucccaaagucacacagcaggagugugucugaucuuggaauuucaaguagcucuguuugauacaaauaauaucaccucagccgggcgugguggcgcacgccuuuaaucccagcacucgggaggcagaggcaggcggauuucugaguuugaggacagccagggcuaaacagagaaacccugucucgaaaaacaaaacaaacaaaauaauaauaauaauaauaauaauaauaauaauaauaauaaucaccucaagguaguacaucacacuggcugagccccgugaccaaggauggguucgaagcaguccgagaacagacuauaaagacuuuaggaugguucaggagugacccuuuuuauaccuucucuuucucuuagggcaacucagacaugcugcccuggccacagcgggccagcaucugcucagggcugcuucuagccguggagcaccugcauagccuggacaucauccacagcaauguuaagaggugagagggcgggcuggagagauggcucagugguuaagagcacugacugcucuuccagagguccugaguucaguucacagcaaccacgugguggcucacaacccaccaugcaauggugggucugaugcccucuucuggggugucugaagagagcaaugguggauacauuaaauaaauaaauaauaaauaaaucuuuuuuuaaaaaagagagaaaagaaaaaagaggugagagggcagcaugagcugggcuugcuccccaggucuggcuuugagaaccaggacagcuccuguucuugcugucugucugucucuccccuccccuucccccuucuucuccucuaucuccccucccuuggggaccuuagcucucucuucauauccucaaaauccaguauuucugagguaugaagcugucacuuuaucuguggccuuucuggauuaguuucccugcaggccacagcacccuaaacauuugaccaucuacucaggagugagccggcuugcacuccaucugggagcugugcccagccuugggauuugagcuccccauuugaacuuugcucagugccugccuugcuugucgguuagcgauagaccuugucagggaguuuuccagguuuccuaucccccgcaucuuagugucagguuuccaagaacuagagaacugccaucacgggagagauuccaagaguccaaggcauuuagcagaaccagcugcacgaccauagaggucuugugguuccucaagguucccucuccugugguacaagccagcucaaaagcccuuucuucuuuccccuccugacuugcauuugauggccccaucacccugggcgugcuccaccauccagcugcgucguccucccacgcaaauccucaccccuaagacuggaugguuucacggcucucaguuccuccucugccuccccauguugcaagguuucacggcuuguugugauuucuuaaccuugcggugaagcggcuugcucacacuuauuuagauacuccuaauaguagauauuggaguugcuggcuauuauuaaaaagauuuuuuaaacuuuuuuuuuguuuguuuauugagacaaagucuugcugucgagcagaacuggccucuaacuuaccaguguagcccaggcugaccugaagcucacuacguagccuacacuggccucgaacuuccagcagcucuaucuuaguuucccaagugcuggggauuauaggugagcugccacugugccuggccuggugucuucuuuuucaaauacugcucgguggaccagugagauggcucagcgggugaaaaugcucgcugccaggccugauggccugaguuugaucccuugaaucuaaaugauggaaggagagagccugcaaaacuucccacugagcuccccuggcaagauguggcaugcauacccccucccccaaggaauucucucucugagaauuuucucucccuccaauuaugacuggaucaaaguauauuuucacuucucccuuuaaaaauuaaaaaaaaaaagcuccccuucccuacaaccugagcaaacugaguuacaaaggauguaacuggguuauaaaggaugccagugucuggguuggccccagagaggccagagcuuguaaugggaacagcuuuagaggagucuaggccagaaugagcagugggcuugaccugaugagcgguggggccggccagggcuggcaucuguggggaguagaagucugcauuuccugcauauuccuggggcaacuaggccaauuuucagcuccauuuccauuuaauggagugaguggguuuccaagguccuacccauuuauggcuggcuauuucauguugagugucuucugugagugccuccacuccaccauucccagggcugacgcuugcccagugcuaaauuguuuggccagugugucuccacggcaaccucuucacuugcuuucccgcagugccaacgucuugcuggaccagcaucuuaaccccaagcuggcucauccuguggcucacccucaucccgacaauaaaaagaccaaauauaccgucaugaggacucaccuguuccaggccucagcugcauaucugccggaacacuucaucagaguggggcagcugaccaagcagguggacaucuucagcuguggaauuguaagcauuuccucgucugcccacaggcuggcuguaagcguggggcuugcguggaguuacagcagaggcugcuggacuguggccuccaggccagauccgagacaaaggcaucuuugaaaaccguuuauuucacuugcucuuagucugugggugugcauuauguguggggugugggauggggguguaguucgagugagacgcucagguaguaucgaccuccuuugggaucggcucucucauggaccugaagcucacgaguuaggcuagacucaccagugaaccccaaggauccuccugucucagucuccccagggcuugaauuacaagugcauaccacaacaucuggcauuuguauaugagaaucucaggaucugagcucucaaguccuauguucacaaggugaccauucacggacugacguaugucccuaauuugccuccccacccccauuuuugguaccggagauaauaccgagacccucagacaugcgagacauguguucuaccacugagccauacuucccaaauuuuugcaauaaggugucacugggucccugugguccagccuagccaccaaccacgauccugccucagcccuuugaguacuggaauugcagcugugugcaaccaggccuaacuucuauggucuauuuuacauggcuucugaguuauaagugauuuucaugguuaaaaagguuuacauagcugggcauggggguagauguuuguaaucccagcacuuggaaagucaaggcaggaagauugcuuuuaguucaggcuagccugggcuacauagcgaguucuaggucaacuuaaccuugugucagaaacucuuaaaaaaugguaaacagguauauacagaaacuguguaugguuggugauucugugggcuguagauguuaucucucgacuuccugcuucccguccauacuguuggccuaccaccuauuucucugucauguuucuucaucacucuuccaucggugaccaucuaccucuccugcauacccugccucaggaccgggugccgggugcucagggcguacuguaaagcgucuguagucugagccugauagucugcucaguucaucuuuaggacacacugaguccuguugaugucugcaggauggguguguuaaaagggcugagaggacggauagguuuggaagauacugucgagcaaagccaagcgggcuuuucauuccagacuuaauagggugcugacccugugaccugguuguugugaacccagcagagaaggugaugcaagccccugcaaccccacuugacagcagagccugguuuucuugcugucugucuguccgacuugguguugcaagaccacagaauguuccacagcauugggaaugugacccgagaugcacaguuuguugccugcagccaaacucagacuguugcgcucagggcuuugcaugugccuuccucccugucuugaacucuguccuuccucucugugaccacagucuucugucuguucacaucugccucuggagcccucaccaggccgccuucugcccucaacuggaccucugugucccagauucaguuuccuucugccccuggcuggccacucugcuggcucccauuuuccccauuugaucccccccuagaguuuccugugagugugucggugaggcuaagcagcccuacuuggagaaccaguggcucucugggagaggaggcagagcgaguucuaggggaaccuaggcaauuuaggaagacuauaucucaaaacaaacagaacagaauaaagcaaaugaaaacaaagauugaaauaagucaaaacaaagcaauagggcagacccuccaacuaccaggcaguauggccuagugcaguccaggcacuuccgccaucuaacaccugcccaccccauguuugggccucaguuuugccuucuggaaagugggguguuaguggugcuuauagaguaguaauggggcuggaugugguggcaaauaccuuuaaugucagcacucagaaagcaaaggcaggugaucucuguggguucaagaccagcuuggucuacaaagugaguuccagggcagugagggcucuauagagagacuugucucaaauaaguaaauaaguaaguaauuaaguaaguaaauaaauaaauaaaauuuaaaaagaguguaauaggauguguauauauggguauuguaguauuagugugagugugugcaugugugcauguuugugccuaugugcaugugugugugcauaugcaugugcaugcgugcaugugugugcaggugugcacaugccauacugcauauggaggucagagaauaacuaucuggaguuguggccuuucuccugccaccuugugggauugaacccuaauagucuggccugcacgccaguaccucaucuugcccgcuguugucucaguguuuuuaugcucacuaagugacccuugucagagacuuguuccuuccggaaucacauggcugagacagaggagaugucuaucuccugauuuguuuuccucuguuccuuccugcaaggaccuugcugacugccucuucucaacugacuguagacccuuuucuauggagugcucugugcugcccccuccuggccacuguugucacgcuccccgugagcaggguaaccucagugccuaaccugugguuuacugcucuaacuuguugcaggagggugugggagagacaccauugcuguucaucuugcagcauagcugcucuaccccacgugacacaugcagauucuggcccaaguuucaguucccaacccugggacucacuucuugugcagagcuggacuuccaguccaggcuucugugucugucucccaugucuguaguuuuauuuuuuguuuguuuguuuguuuguuuguuuuuugagacaagaguuucuuuggguagccuuggcuauccuagaacuagcucuauaggccggacuggccuggagcggguagagauccaccugucucugccuccugaguucugggauuuaaggugugcgucaccaccaccuggcucacuccugaaucuuuuacacugcugagaaucucaugaacaggaauggcaggcuugcucuucgcacagguacaaaucacaguuucccacuuggguguuggcucagggcuguguuccucugugagugaguaaaguagguggggguggggaauccugguaggguggcaagacaaucaggaacucaaggccacccucagcuacagaguaaugucaaaagacccuugucuuaaaaaaaagaaaaacaaaaaaaacaaaaaaacaaaaacaaaccaaaaaaaaccaacccaaaccaaacaaaaacaaacaaacaaacaaaaaaccaagaaaagggcugggcagugguggcgcacuccuuuaauccuagcacuugggaggcagaggcaggcuuauuucugaguuugaggccagccuggucugcagagugaguuccaggacagccaggacuacacagagaaacccugucuugaaacaaucaaucaaucaaucaaacaaccaaaccaaaccaaaccaaaacaagaaaaaggggcugcaacauggcucagugggaaaaggugcuugcugccaagccugacaaccugaguuccaguccggggacccacgcagugggaggugagcuccaguucucacaaguugcucucugaccucugugcaagugccauggcgggugaauaccaacacacacacacacacacacacacacacacacacacacacucaauaaauaaauaaauuauuauuuauuuuauuuacuauuauuauuaaauaauaauaguauuaacaguaauaauaucagaaaagaugaagccuuugucauugucuaagucuuuugcugacugugugugucaacucuguguucucuccuacccagguauuggccgagguccuuaccggcaucccugcgauggacaaggaccgcaguccaguuuaccugguaagagauccagucacuucggguugguuggcugguauccuugggcacacguccaugugggcagggagggccuugcccaccacaugcaaaguucucaggccucagaccagagcucuuggcauccaugacaucuucccacacugccauuuuagaagcacagcaacuggcgcugccguguguaugcaacugcuaagccucauucuagccuuaguuuucuucuucuuuucuuucuuuucuuuucuuuuuuuuuuugugugugggggguauguauaucugugaggggauugaucuuacauuauggucuaggauggcuuugaguucuuggucauccuccugccucugccuauuuuugaguucugggauuacagacuugugccacacagucagcugcagcccucugagugagccuuuuccucuguuucagccugccuuccuuucuuuggugaguccuugcuaaucaagucggggguggggugagggugggguuguccuuaccccuccccucccccuaccuccaauugccuuuuuuuuuuuuugguggguuuuucgagacaggguuucucuguguaucccuggcuguccuggaacuuacuuuguagaccaggcuggccucgaacucagaaauccgccugccucugccucccgagugcugggauuaaaggcaugugccaccacgccccagcucugauugacauuuuguccugugguuucacucacuagucgcucgcucuaauuuuccuucacauuuccuggguccugggaguuggcucuugagccucuccuggguuccugguugaugcuuuugucaaggacacuuuguccuagccuguacacagcccugacaauagagucaagcuccccacacugugaacucacugccaguagcagaugcuguugcuggcuacaaauaagaucuuucuucccuggagggucucaagggcggggcucugggaacugccucuggauccccuuucuuugugguaacuugucucucucugcaaaccacucaugugcuuucgcuguuacaagccuauuucuucuuccucgacugcucgggguuaaggcuaaguuuccccaaagauaaauaguuaaaagcucaugcuuuucuggaccccaagugagugccagaagcgccauggcacccuuagccaucuuuacuucuagguauugaaucucugauggugucaggcauguuguguucccagauucugaaacucccgcugagauaaaauucuauugcccagcuagccuugaacuccugggcucaagcgaucuucgugccuuagcuuccagugaccaggaaccauaggucuaaugacaccacacuugccucauuuuuaucuuuuaaauuguuuuuaauucuucuuuuauauuacauccccaacuguaguucaccucccccaucccuuccagucccaccuaccuccucucucccaaaaccacuuauccucaauuucccuuggaaaaauaaaacaaaaaacgucccagcaggccucccagggauaucaaccgaacaagacuauagcaacaugauuuaauaagacuagaugcaaacuguaauggcaagguuggaugagguaaccuagugggaggaaaaagggucccaagggcaggcaagagagucagagauagcccucacucccacugugaggagacccacaagcacaccaagcuacacaagcaaaagguauauaauaugcagaggaccuagcacagacccaugcaggguccgugaaagugacuucagucuuaguaagcccccugucagcccagcuuaguugauucugugaacccuguuuccauggucuccucaaccccuuugucucccacaauucuucugcccccuucuucugugggguuucccuggcucagccuaguguuaggcaucuguucccaucaguugcuggaugugacucucuggugauuguugggcaggcauuggucuaugacuauagcacaauaucauuaggaaucauuucauugacuuuuuuuuuuagccaguuguguuuggaggcagaugaaggccuuguagaggaaggguuggcugagugggugacuagaguggaccaagggacagagacuagguagggaugcauucuagauggcaaaaccaagccucacuauguaacucaggcuugccuugaauuuacagaccucuuccucagucucuguagagugcugggguuauaggugcguguugucaaaucagcuuuaagaugcugugugucuuauaauauguaauuauaaauauggacauauuuauaugcacauagauauguagcagugaaauauauauauacacacauacacuaaaaacaaauaaguauacagcaauuugauacaacaaauguagggguugacuuugaacuccugauccuccugccucuacuuccuaaguguuaggauugaaggcacacagcaccguugucugucuaccuggcuuugaggcugcuauauaagcagaggaccaacugggcuacagccuugaccucauaaaugaguuacucucucgcuccugacucugcuccugcuuuguguggagguggcaugauuccuggcacucuggggucaguccugagcagcaaucacaugcaugcccuucguuuuguuuugucuuguuuuguuuuguuuguuugcuguccuucuugcuuauuucuugguaagacauuucaaaugcccuuuugaaagagguagcucugacucccuugggauccugcuuugccccuguugaugcuagguccucccgcuagguccccagcucucccccuucacguugccucucuuggagaagcugcuugcaguugguaaugcuugugacuccgauuucugcagaguggguacagucaagggugaccuuuggggaccugcugcuuuuugucccaguucauugcaagacuuaucacacgcauugcuauaucagcagaaacaaaaagggccuguguacauguuaauaagauuaauucaugaggcuguagagaugacuuugcaguuaagggcacuugcagaggaccugaguucagaucccaggaucuaugucagguggcucacaaccuucugugacucuggcuacaggagaucugaugcugccuuuuggcuucugcucacacucacacacaggacaaauacacagcuacacauacauacauacauacauacauacauucauauccuaaaaaaauaagauuaaauugggacuggagagauggcucagugguuaauaaugcauacagccguucuugcagaggaccugaguuuaguucccacaacccauguccagugguuuacuaccuggauccugcaacuccauguccaaagaaucugacacccucuucugaggguaucuguacucacauguccuuaccacgcacacauucauuuauaaaugaauaaaaauaacaauauauauauauguauauauauauauuugguuucucgagacaggguuucucuguagcccuggcuauccuggaacucacuccguagaccaggcuggccucaaacucagaaauccaccugccucugccucugccucugccucccaagugcugggauuaaaggcgugugccaccaccacccggccgacaaucuuuuaaaaaaagauuaaauuauaaguguuaggcacgugguuaagugcuaugcaaaugaugguuauuaguauuugcugugcauauauuuuacaaaugggagacauuuauuggaagugggcuauugaguauuuuucuauuuuugugcuguggguccauuauuggauguguauuugugcuauacccaggaauauacccaggaguuucauguuuccauuuucugauggagccacugaauuggguggaacaggcuaagcuacuccagcugagcugugcuguccuagggagcgcccagugcauucucaagugcuugagugccuuuugcauaccuugccacacccagccucucaccuggacuuccucacucucuucccauagaaggauuugcuucucagugagauucccaacaguacuucuucagucugcuccaggaagaccagcauggggaaggcaguggugaaagagaucugccagagacauguggagaagagggcagggcugcugccugaggccugugaggaagccugggccaccgcugugagugucugccugcggaggcgcaaugccagcguggaggaggugagcucucugcugccugcugccuuaccuagaaggccucacgugcuggggcugcaguaagccaaguuuagccuugaucguucacaguaaaacccacuggggccauugcagcaaucaggguugcaguguggguaaugcgggacccugagggugggugugucuggcugggcugcagggagcacaggauggaaccuagaaaucaggguugcugugugggucaugggggaccccaagguuggguaucuggccggagccucuuguaggagcccaucucuuccugucuuuccuuggccugcuuucucuccuggucuguaacugcccuguggcauuuccuucacccuuuuggagagaauggcuuggaguuacucacgugguccuaagcugagcuggaaugagugccccaaauccucucucuaacuacagaggagcagucugucugagcaagccguucccguccugcuaucuuggaguuccuagucuuugcaugagaguugucugugugguaggcacuggaaugguguaugacaggacucuacaucuaaccuggcagggaacuaagcccagacuuaagagggcucuggaggcccaguaggauuuuccaggucacuaaggauugcaguacacaagcagauacaaucagaugugaucuaaacagcccccacccccaccccccagcuacucacuuucauucagaucuucgguuauucauucauuccaucaaugguuuggugugugaguuagggcuugggugaagggauguaaaugaagagauagcaaaauacauugauuuaagcaagacagaaguuugcugccuuuggcuuaauggcuugggugugcagguaaccagggcugcagagucuaaccaugcuggcuaaaaggcuuccauuucaggauucaaauguugcuccguccauugcaucugccuugcagccagugaaagaagguuaaaagaagaggacacacucuuacauucucucuuacuuuuauugauuauuuucuuuuguucauguguggguaucuugccugcaugugugguugugcaucacuuuugugcacggugcuguguagggcagcagagggugucaaauccucuggaguuaccgacaguugcgagcugccauaugggugcugggaauugaacguuggcccaccggagaagcagccagugcuuuaaccgagucuguuuaguuccucucccuccuccuuuuuaaaagacuguguguguuuucuguguauuuggguaccaaaggaagccagaagaguaugaugguuuuccuggagcugaaguuacagauauuugugagccaucugcucuggguucugggagcugaacucgggucuucugcaggaacagcaaggacucaucaccucuaagccagcccucagcccuaucuccccuccuuuuaaaaacaugacugaggaaugcacacaucaguuuuugcacaccccaugcauuacacagagcuacagaagacugcaaucuuuagcauggcaaaugcuucuuggguaucuaauugaacuuuuaucuggauacuugauauuugaaccagaucuugaaggaugagccauuugccauguauacuaaaggggauaggaccguucagguauagaaagaaagaaagaaagaaagaaagaaagaaagaaagaaagaaagaaagaaagaagaaaagagaagaagaaggaggaagaagaggagaaggaggaggauggagaguaggaggauggagaggaggaggagggagaggaggaggaugaagaggaggagggagaggaggaggaagaggaagagaaagaagaggaggaggaagacggggaguaggagggggaggaggaggagaaggagaagaaggaggaggaggaggaggaggaggaggaggaggaggaggaggaggaggaggaggagaagagaguacuaaccacaguguaguacaaucaggcuugaaagauccauggccugcaaacucuuucagaucuauccacugggcugcucugccgugcaccggcuuauuuaguuuuuguguauuguguguguucuuguacauggaaguuccacagggacuugugagagucaguucuuuccuuccaccgugugcauucuguggauggaaccuagcucccuaggcucagcaggaugcaccuuucuaggguggacucaucuugccucucccugcuucaacuuuuaucuuuuaacaggaucucacacuguagcucaugguggccuugaacuugaggcaguucuccugccuccaucuccuagguucugguauuaugagugugagccgacaccugcuugucuauuuuucagaugauagcucuuggcuggcuuugaacuucauacuuagcaugguggcuaugaauuccugaagcugcacccgcuucucaaauucuaggauuauaggcuucuuuuaucccauuagacucugauacuuuuauauuuauaaaaaaaaguccacagcagcugggugugguggcacacugcuuuaaucuaucagcacuugggaggcagaggcaggcagaugucuguggguucaaagccagccuugucuacagagugaauuucagacagccaggacucuguaggaagauacuauuaaaaaaaaaaaaaggaaagaaagaaagaaaaagaauuauugugauugugugcaaaauaaaugaauucauaugggauuuuaaaauuaaauucagaaguagaauguguguguguguguauguauguauccuuguguacauauauguguacauguacauaugccaugacacagaugucaaggucaaagaauaacuucuccuucuacccuauggguccuggaacucagauugucagucuuggcagcaagcaccuuuaccuacugugcuaucucaccagcccauacacugaguuguuuugcaaggcacagaggaauugaaauguucuuauucagggugagcaguauguauggcgagcaggucaguggccugggaugcugacccagcagcugaagccgcugcuuaaggccagcucgggcuacggagugaguucaaagccuggaugcaguguaaggagcuccuagcucagacgugagacaagggagaaggucccaauguagcuccauguagcacguuugccugguacccccgcccccaaggcucugcaaucaacucaaggucacagacacuugcccacaccuggcccagucuuugccaucagaagucuggggugcagugauuggaccgccugggcucacacauucaucugcagcaggcauuugauuauaauucccaggagaccaugugauggccuucggccuuugaaaggaccggcauggacgcaagacauucccagaccaagcacucagcacaaaugagauuuauuuccccagaccagcaagcagggggugaggggugggagagguuauaaaaguagcagcagcagcaacagaaagaaaaacaagcagacaagagaagcaagagaggguguuucugugggagugggggguuuaagggauguguguggagggaggggggaaaugugucugcuaggguggguugguauauccugacugagcauauuagccacaaaaugaguuuugauaguuggacuuugguguuuugucuuaggaaugaaucagugaccaaauaagggaauagcuugagggccagcuuuaggaauguaaugguuguuaagcaagagagaggaaaccgggguaaaaggucaaaaccugucugcaguguuugcucugcuggggggaggggcuggguuugccuugcgugcuuaucucugcuagagccccuucagcuuuagugucagcgacugauacggcugcuugucugucuccuccuccaaggcacgagucucccuggccgggguggaggagcaacuccgagggcagcugucccuucccuggagcaggguuucugaggccacaggcucaucuuccaauaccccggaggaaacagaugacguugacaauuccagccucagcgucccuucuuugguuaugauggcaucgugcccaggggcugccuccucuccacucuucacgggacauggagcagcacagccauccaccagugggagacaggaggcugacuccucgucagaggcuugcacaggcccacagacaccccagaacgguaagcuugggagggugaggugcccaugcugaaucacuccugugacccuaacuuaggccaucccuccucucuuuuccuaauucaugguuuuuguuaguaauucaggcauucacugcacaguggacacacagagaggaaguucagcacaccagugacuauuguuuccgaccacucuccugccucuuagacuuucacaccuccaucuuuguacugcgccuuggucauaccuacuucccauuugcuaggacagcuguguggcgguccucagcuuuguuccacgcaugucucuggcucacuacuucuuuuuuuuuauuuuauuuugguuuuucaagacaggguuucucuguauagcccuggcuguccuggaacucacuuuguagaccaggcuggccucgaacucagaaauccgccuguuucugccucccaagugcugggauuaaaggugugcgccacuacgccccgcucucacuacuucuucuuccaggauccagagagagagugauauuuacugaauuuuuuuaaguuuaaaaucugauuuuauguguauggguguucugucucuguguauaucuguggaaugcauaugcacaguaccugaagaggcaagacagccugaaacuggaguugcagaugauugugagcuaacaugugggugcugggaaucgaaccugaguucuuuggacgaccaagcaguaaauguucuuaacuacuaagccaucuuuccaguccccagauuuuaauuuuuuugaugcauuuuugcaguacuggacuggauguagggccucauuuuguguguguguguguguauacauauauguauguauguauauauauauauauaauauuauauauuauuuacacacauaauauaggauauauaauauauaauacuucuauauauauauaaguaaucuauuuuuuuuuuuaauuuugagagaucaugugucucguguagccuaaaauaauauggaccuuccuauauagcugaggaugcccuugaacuccugauccuccugccuucaccucccaggugcugggcucacaugacugguaaaauggccagcagguuaaaggugcugacaucaaagccugacaaccugacuauguaugaaccugguuuaucauacgguaaaaggagaagauugaugcccugacuucuacaaacacaccuugucauguaugcacaugcccacguagguauaugugugcaugcacacauauacacacagcaaaggaaaaaaauaauuaaauaguuugagacagaguuucaccugggcuaucucgugaacccuugucuauuuauuuugggauugcagguauaugugccacuaugcccuucuagaguggguuauaaaaacacacugcuuggcacauaccuguuguacuuaaaaccacuucucugggcccagcaggaccuuguguggucccucuugccugccucuuuuuccuugccaauaacuucuaaagacacccuccaucacuggcacuuggguccaaauaugccaggcuuccuagugaaauaaaaguugaggccuuuuugacgaggcaucaccaggccuugugaaugugacucacugguagucuagaccacuccacuggggaggaaggagaauuuagaaacuguuaugaccuaagcgacaggcaccauaaaaucaugccaugugacagaucucacauggcccaaugugccagagcagcuccccagggaugcucuuguccugucucucagacugcuccaacugggcccgcacacuccuuccccuagauggucccacagccuggacagcaguaaagcagccagcccucccaggacuuggccagcaucucaauuuucuuaggguccccuguuaugacauugcucuuggucaacaggaaauaguuaaaagagcacagugccugacuccugcccaaccaucacccuuuucuaguuccucauuuguaaugaaacgaaaaaggagggauguuagcauacaggugauuccaccaggcuccucccagggaccuagcaacaguccucacgugccacugcagccaggugcuucaggugcgggcuguguauacaaggauugcccacuaucuagcucuuucuccuuucucucucuguuaccauguguuucuggacagucucuccccccccccccccguucuacucgucugcuucuaccccuucucuggguccucacuccccuccccucccccaaauaaaucaccuuauaccagauuuguugcuugguguaacuucucaggggugugcuuugucaugaguccaccggguacccccuugacgcauuauauuucauaacagaaauagcuaugauuauuguugauggccacacuucucccaugacugugggaauaugggagccucuuuguggaaaagguguauaugugugguggggauugggggagccggaguguuagagugucuaugggggagggugcagacuucccugcaacggcauaagcuaugacaugcuacuuguauuugggccuguuucacaaacuuggcaugagacucugauaaggucugacucagagaauuuuaacggcaacacuugcugaagguacucucuuucuguuuucugcugaacaucagcuacagagacuucauggaaaauugagaucaaugaagccaaaaggagacugauggagaacaucguacucuacaaagaagagagacuggacagcagcgagcucuuuggacccugaugaccagcgcacagcugaagacccuuauucucaacuggacagacaaacguccaggcagggaagaggucuuuggcugcccaaggucuguugagacccacacaacccaaacaucagccugaacagaaggaaacauggcuucaucagagucgaguugcagggggguggggguaggggaccucagcuuauacagacaccauauccaggaagcacuccuccucucugagucgucuuaguuagagggcugugaaguggaacaccuuguaugugauccaaggauuugggugguuuuugugguuccggggaacccacguuguugaccaccccaagagaugcuguugcccccaaaccucuuaguucuccacaacggacagagcaauccugcagcauccguggcguuuuccagaguuaucaucugucagucauauuuguagacagcuuucugcaaauucccacuucuuaaaagaccuacagccggugucuccgcaaguucucaaguucaggacugcaaaagcaggacgguuggcaaaggacuccguaggcuuucuccuucuucaguuggugauccuguaagccaccgguauuuaggaacugccugcuuuucaccuucgaccucccauugugcccauauuuauuuuaauggagacucagagguuguguguuauuuauagcuaggugaagaagcaugagaaacagucucauguuugauucugcugcuaguuaagucaaucacuuggugggugguagcucaguauccuuguaagauaacccugcucuguucucccuggggaagaacagagcugcucuauucagcucuugggaggaugggugcagcggcugcagaagcacuuugaaaauguaucuguucuguguucucaauggaguaaaagguauguaguucauggcucugccauguagaaaauguuuaugaagugaauauauuuuugaaaagucauguugcaaacauguuuuguaaaacaaagcuauuucuuucuuuuuuuuuuuguuuuuuuuuuguuuuuucgagacaggguuucucuguauagcccuggcuguccgggaccucacuuuguagaccaggcuggccucgaacucagaaauccgccugccucugccucccgagugcugggauuaaaggcgugcgccaccaugcccggcuaacaaagcuauuucuaauucacuauuuaaaaaaagaauuccauuauagugacaaaauaaaaauguuuguaaucuagcagcugucuuauaau

SEQ ID NO: 3306 - RNA, 2490 nt, Mus musculus
uaagagcacugacugcucuuccagagguccugaguucaguucacagcaaccacgugguggcucacaacccaccaugcaauggugggucugaugcccucuucuggggugucugaagagagcaaugguggauacauuaaauaaauaaauaauaaauaaaucuuuuuuuaaaaaagagagaaaagaaaaaagaggugagagggcagcaugagcugggcuugcuccccaggucuggcuuugagaaccaggacagcuccuguucuugcugucugucugucucuccccuccccuucccccuucuucuccucuaucuccccucccuuggggaccuuagcucucucuucauauccucaaaauccaguauuucugagguaugaagcugucacuuuaucuguggccuuucuggauuaguuucccugcaggccacagcacccuaaacauuugaccaucuacucaggagugagccggcuugcacuccaucugggagcugugcccagccuugggauuugagcuccccauuugaacuuugcucagugccugccuugcuugucgguuagcgauagaccuugucagggaguuuuccagguuuccuaucccccgcaucuuagugucagguuuccaagaacuagagaacugccaucacgggagagauuccaagaguccaaggcauuuagcagaaccagcugcacgaccauagaggucuugugguuccucaagguucccucuccugugguacaagccagcucaaaagcccuuucuucuuuccccuccugacuugcauuugauggccccaucacccugggcgugcuccaccauccagcugcgucguccucccacgcaaauccucaccccuaagacuggaugguuucacggcucucaguuccuccucugccuccccauguugcaagguuucacggcuuguugugauuucuuaaccuugcggugaagcggcuugcucacacuuauuuagauacuccuaauaguagauauuggaguugcuggcuauuauuaaaaagauuuuuuaaacuuuuuuuuuguuuguuuauugagacaaagucuugcugucgagcagaacuggccucuaacuuaccaguguagcccaggcugaccugaagcucacuacguagccuacacuggccucgaacuuccagcagcucuaucuuaguuucccaagugcuggggauuauaggugagcugccacugugccuggccuggugucuucuuuuucaaauacugcucgguggaccagugagauggcucagcgggugaaaaugcucgcugccaggccugauggccugaguuugaucccuugaaucuaaaugauggaaggagagagccugcaaaacuucccacugagcuccccuggcaagauguggcaugcauacccccucccccaaggaauucucucucugagaauuuucucucccuccaauuaugacuggaucaaaguauauuuucacuucucccuuuaaaaauuaaaaaaaaaaagcuccccuucccuacaaccugagcaaacugaguuacaaaggauguaacuggguuauaaaggaugccagugucuggguuggccccagagaggccagagcuuguaaugggaacagcuuuagaggagucuaggccagaaugagcagugggcuugaccugaugagcgguggggccggccagggcuggcaucuguggggaguagaagucugcauuuccugcauauuccuggggcaacuaggccaauuuucagcuccauuuccauuuaauggagugaguggguuuccaagguccuacccauuuauggcuggcuauuucauguugagugucuucugugagugccuccacuccaccauucccagggcugacgcuugcccagugcuaaauuguuuggccagugugucuccacggcaaccucuucacuugcuuucccgcagugccaacgucuugcuggaccagcaucuuaaccccaagcuggcucauccuguggcucacccucaucccgacaauaaaaagaccaaauauaccgucaugaggacucaccuguuccaggccucagcugcauaucugccggaacacuucaucagaguggggcagcugaccaagcagguggacaucuucagcuguggaauuguaagcauuuccucgucugcccacaggcuggcuguaagcguggggcuugcguggaguuacagcagaggcugcuggacuguggccuccaggccagauccgagacaaaggcaucuuugaaaaccguuuauuucacuugcucuuagucugugggugugcauuauguguggggugugggauggggguguaguucgagugagacgcucagguaguaucgaccuccuuugggaucggcucucucauggaccugaagcucacgaguuaggcuagacucaccagugaaccccaaggauccuccugucucagucuccccagggcuugaauuacaagugcauaccacaacaucuggcauuuguauaugagaaucucaggaucugagcu

SEQ ID NO: 3307 - RNA, 14029 nt, Mus musculus
acaugugcucagauaaagaggugacuuuauucagacugcugggaaacccaggccaaagggcagggauccagacuggccaucucauuguacacugugucauaauguuuuuuuucuguugcucacugauuacccuagggccuugugaccagcaggcaaaacuacuccucaccccaaauccauuccacaguacccacccacccacccagcaaccagcaagugaagccuugugaugaggguccaagguaacauccuggugcgcugaguuuugacaggaucuccaacacauccuucaccuuggacacagacagacggagcccuccuaugcuaucaggccacuggucauccuagaggguuuaaaagagaaaagaagguuccaaguucaagaccaacaaaccaggcuuaauaccaacccuaaacuuauauucuuuuuuagaaaaacuauuauuacugugauugugcauguuuggggagacauagaugcuauggcaagcauauagcaauucugucgaguucuucccaccuuuauuugggugcuagggaccaaacucaguucaccaggcuugcacagaaagugccuuuacccacuaagccaucuuuacuggccuuugauuuacuuucucuaccaggugaguccuuuaacacuguaauauaacacagucauuuaaauuuccaccaguaagaagcaggcaaucuaauuacaaaauacauaaaucuugaaguuuaagaucuccuauucaacuguauucaaaacuuuccuugggcacaggcugcccaaggcugagacuagacauucgaguuacuaguuuacaccagagaaaaagacucccauuguugacugcuaagaaacaugaggcucuuaugaccuuugccagaagaugacugcucgugcucccugcucaaagacuguagaggcgacaaguauucucucggagaacugacagagugugggaaagugacuccucuuugacccuggcaaucucucgaacugugugcaaggccaagccuggaugagcauacuggcaaagacuucucggcaccuggaagacaucaaacauuuccaucaucgcugugccuucugcacgugucugucacauacagcguccccaucccauccccagcaaggaccucuuuggggcugcccuguagagaccccuuuaccugcaggugcagggagaguccuagucauggggggcucugggugagcagggucccacgcuuccauggacuacccucuacaggguagggcuuuccacugccuggaagagagugguuacccuucagcuucucagcccccaggacuuucaguucuacagaguaacaacagggagacaccuauaucgcacaagguggaccaggaggacacugggacucgggcccagccagccucccacccacucgccucagugccucaggucggucugaagacaguccuaccuggcgagggagaaaguagggugcgucuguuuccacaaugauccucuccaacgggaucugucuaagggcaucccgagccucccaggcggaagaguaggucagcacugcugugaagcccacggacauguuagggaaguacuucaacaagggcucaaugacugaguagcugccagugaagcagugccugugggagaguacaguucagggcuuacucccaggccucagcagcaaccccuagcugccuccaggccugcagcccccauuaguggauacuaaaaaagaaaaauuugcauccaagcagacuccagagcaagcugagaaaggaggcagaccaaacacagcaagaccaagcuggcaugagguucagauacugaacacuaccagucccaccuucaccccacaaugugggcagccaucugacacaacuccagccauggcacagacuggagaagugugggagaggagacagaaagaauaaagaccagcucuccccagguuacaaccacaguauggaaaaacaucaugucucuguugucagaugccaagaaauggcaaagugaaaauaauggugacuaggucacagguggauuuguuuguuucagauagggucucccuacaauaacccuggcuacccuagaacucacuauguagagagagauggccucaaacucacagagauacaccugccucugcuuuucaagagcuaggauuaagaauuuucuucuugaaugugacaguaguucacguucuuaggcaagaaauacugucaacucaucugcaaaucagggcuuugaacagccacaacucuccaucaagagaauuagucuugucucuuagcuuugguccagcugucucuuuaaagacagccauggguuuuuuguuuuguuuuugggggguuuugagacaggguuucucuguguagcucuggcuauccuggaacucacucuguaaaccaggcuggccucgaacucagaaaucccccugccucugccucccaagugcugggauuaaaggcaugugccaccacugcccagcaagacagccauuguuaaaguccugaaaacccaaccauuucuccacugcaccucagacccugcuucaguccccauggguggaagcauaguagaugaaaucccagccccuucugccgcccaacaagaucuagauuuggauccagccucccugaauacuguucauuccuucugcccagcuaaagcgcucacucacaugucaaccccugaccauuuauuucuagccaggcuaaagagccccuaaccuuggcucccucuguaucuaaguccaccucuguccuacacuccgcauacuccauucccaggagcccuuguccgucuuugacagcuccccaguggcauccccagaaauggcucaugccuaguacgugcaguguagggaugcaagggaguuuccuagacuaggacugguugccacugagagguaaaacaaccuggaccuuuaaugccaccugggcaaauggaguuuuuaaucaaguaugguggcacauaucuguaaucucagcagaggggagacaggcaggaggaucaggaauucaaagcaauccucagcuauaaaucugaagucugggggcuaacaugagacccuaucacaaaacaaaaaagagcuuucaaauucgaguaaggaaaagaaauauaagcaguaucuaucuuuucagaaaccuuggaaagcucucuguaugaugagcuacuggacccuacagcagccacucccacaucugaaaacaggaagccucuuacagcucauugguaauuaaaggguauuaauuuaagcuuuuaaaaaauuacuguauaagcagagucaagugccaaaaguuuccugugguucuacuuaauguuuaauucauuuaaaaagauccucuacacguaacaggaagccaggugugcugcacaccuuguaaccccaguauucuggaagcugaagcaauggaugauaucuaugagguccaggcuaaccuaggcuuucaagauccuugucucaaaacugacaaacuuuaauguaauacagagggaagagguagaaaugauauaauaaaguauucauaugugaaaaucuaaaaaaagaaaauaauuucaaguuacuuuuaaaauguaauaaggauugagaucgcaaaaagccucacaaaccacccagauagcaugacugcuuuccuggaguuucugucaucugcagcuagugcaggaaugccaugugcccacugaaacugcagcuccuaaccuauggaucuuguagucagagggcacaaauuuucucaugauauccaacaaaucuucaucagcuucacggcagugaaugaccaagggcuucuucagagacacagccagcuucagcugccucucaaacaccugagagaaaacaaagggacaacagcuaauuaguggcccuucugcugucucuaauucuuugcuucuaaacuguacaauagaauuguaaacaugaucaccaucuacuaguccuuucuacauugccgauuccucaaagcccucaaaucacuaucuugugcugcucaccaaccugcaauccucacugguccccuagggagacacuaugaccaacccagaaagcaguaacccagaacuugaggacccugccccagcaccccgagguuugguucccugagcagcuagcaaagaacacugugcaggcauccaguaaacagcagcuacacaagugugacacuucagugaggagcucucugaacugcuccucuucccucggcacaccuaaccuaugccacuggcacuauccugguuuauggucugucccuaugacacaagcuagaaucauuugagaaaauguccccaccauauggccuugugggggauuuccuugauugaugguugacauggggaggcccagaccucuguggauagcaccaccccuagacugguaguccuaggguagguaagaaagcaggaugagcaagccaugggaguuaagaccgucagcagcauucuucuaaggccuuugcuucaguuccugccuccuaguuccuauucuagaguucuuguaguuauuguguuuauaacuacaacagaaauucucaguaagauagagcccaaguggaaaagcauuaugucucacuauccugacacucuauuuucccccauguguucagauguaguuacuuuauauaugugucacauggcuaauacauuacuaccugaagccagauaugaaaagaaccagaugaaaaccagcaagccaaauucugcagucaggaucccaacacuccagucccaaggccuauacagccugcaggaugcacauucggagauuucaaaggccugcuagcugcucuaccacauacauacauacauacauacauacauacaugcaugcaugcaugcaugcaugcaugcucuaccacaaccaccaccugggagccagaaaaggauggaugaacaauaggaggcagcggcacccccaucagagaaguacacugaaagccucgcaggacucuuccccuaccuaaaugucaaguucaaaaaauacucaggaagaagacaauguuauaacugcuaauagucauuaucucaaauugaaagagaauuagucuucuucguacauuuuuguacuuuuuaaaguauucuguaacaggcauacuucauuuuauaaaaccaaaacaaaccugugagaugguacuauacuuggagagguagacccaacauacagaguuaaaggucguccucagcuagaucgaguucaaggcuaccugagauacaugauaccuaaccucaaacaagaaaaugaacuuuaaaaaagugugcugcugucagacagaaagcaacuaucuuagcacugacacuagccauagaaggauuccuaugugcugggcagcagaccuuuaaucccagagcuuguugagaagcagaggugggagaaucugaguucgaggccagccuggucuauguagugaguuccaggacagccagggcuacacugagaaacccuguuuugaaaaccaaaaaaaaaaaaaaaaaaaaaaaguaguaguaguuucaaaacaggcagcagcaggagagacugcucaacaguuagguauauuuccuguccuucccgaggaccugaguugauuucccagauaccaguaaagaagcucacaaacaccuggaaauccaccagggccuuuacuacccucuuaaggucuucaccagcuccugcacucauguacauauauucacauauggacaccacuaaauuaaauuaaauuaauuaaauuagcuagguuuacaaagggaaacaaacaaaacaaaugaaaugcuauggggugugucucugcagcagagcacacuccuagcauuugcaaaaauccuggauuuaaucuucaacaaugcaaauucccuaaccaaacuaaacuaacaaaaacaaaacccuccacuaauagaguuuguaaauugggcaugguggcaaggguuuauaauccugccauggggaggcugaagcaaaaggaccacaauuucaaggccaguuugauauaauggcaaaaucauacauuaaaaaaaaagaaaaagcaggagguauaucuuuaaucccagcaccugggaggaagaggcagguagaucucuaaauucaaggacagccagggcuacacagagaaacccuaucugggagggggcgggggaaauggcauacuaacagcccuuacugggaaguucaaccacuaaagaaaaugccugaaggaaagcagacuagagccaguaccuggugcuguucaggaacuggaguaguacacuugugagaguaguccagccccauuuccccaaaugccacagccuugggguggcguaaggcaugcaaaagcuuucuuucuugacucucauuauaguaucgugcaaaaugagggugacagccaaaagccccccaaaccagaucuucuuucagaaguuccucccauaggccaucagucaguguccuuggaucacagaagucagagaugcagccuugaaacuccuuagggaaggagcugcuauaaaucuuucugaacuuuguaaagguccccuugaaagacagcuuggaguagagcaugucuagaugacaguggguaucgaugaagcccucuuccaggcucagcucucuguggcuccuuggcaaagagcuggauguguguucucugguguggugaaguggugucuccucuuggaauguccucuuccccuucaccuccuccuccucugugcuucuggagaaccgaagugagugggaauucuggaaccuaccuuccugggcaaugucuaggccuuuggagaugcucugggacuuggaggagugaacacucagaagauccuggcugcucuucccagccugugccgagucaugguugcuggaucccacuaauggauaaccaggugucuuauggcugcuaguccaguagcuggcauagucacaccaugggcuacuauacaaaugaggaggguacauuacacagucaguggggaaggaagaggauucugaaacugcugaguauuucagugggacagguuccucuugggagaaccucacaguggccagcucauccacaucugaccagucacucccugaagagggaugcuccaucaccaccucucugucugugugcugcagagaagaaaagcaacaagucagcucuccuaugggugacccaaccccucccucacccaaugcugugguugcagaauggucucucccccccagaacagacacugaccuuaaucccacucugcgguuacaaaggguguaaacuuagccuaacuuugugauucaaaggccuuugcaaugcaaucaguucagaugaaagccaucaguguggaaccugaugauugaacacugggacucaaggcagaauuucucagacucccuugaagcuagauauuacugccuuuccagaugcuucuaaauaagugugagaagauucaacguguacaauuuuuaaaccaaguucucaagagaaaagaaguauauuauuuccuuuuguuucaucugcuuucuacuggccaaugucuaaguaacaaacucaauucuaucaccauccccaauuuaggcuauaagaucgauacugggcuggugagauggcucaggggguaagaacacugacugcuuuuccgaagguccugaguucgaaucccagcaaccacaugguggcucacaacuacccguaaugagaucugacacccucuucuggugugucuaaagacagcuucaauguacuuauuuauaauaauaaauaaaucuuugggccagaacaagcagggauggagcgagcagggucgacaggagugaaugggguugaccagagugagcagagguccuaaauucaauucccaacaaccacaugagggcucacaaccaucuguacagcuacaguguacucacauaaaauaaauaaaugaaucuuuuaaaaaaaaaucgauacuguauuuagcaggguagagcaucaacacagaagaaggcaccaagaucccugcaguugggaugggacccaucuucuuaagacaaaauuuuauuuuguuuaagccacuaucauguuggucuuuuucaauaaaggcaaaccuacacccuacauuuaauagaauuuuaaagcauuuuuuaaaaagcugauuugaaguuuauuaauaacugaaaggaauggcagaagagagacacuaauuuccuggaguccauguugaauaaagcacugcuuacgauccucagaggagcuaggaguuaagaguucuagccuagaauuccuaaggcccugagucugauccuccuaauggugggaaacagaggucaggacgggggaugaaacuaaaaauaguuucaucuauaucacuuaggaucaaacuagaaagacuaaaugacaaauauauguaacuaagagaauucaaaacccaaaaacuaaaccaaagaaaucugguguguguucauuuaccuuuugaauaucugcaugagagucagaguuaucaaaaaauucuagggcuggagaggguuugucaauaacuguccuucgguccccaagcagcuccucacuacuuuucuucacagaaucuaugaucacucuucugucacugaagcugcuccugucuagcgcagacgcuuccuucuccacacugaccuucguaugugacucuucuuucugagaaacaguaacuguaaccuuugcagcuggucccuccucaacgcucuugaccaguucuucccggcuccuggaccguccuuccccacuccuggacgguccgucccugcuccuggcugguccuuccaccuucuugcuugguccuuccaccuuccugcuugguccuuccugauuaggacagucucccaagcuugccuuccccugagugguggcagcuucucccuucuucuugggcauugacuuccccaggaugcccuggauggccuucagguagaucauucuugagcccuggucuugaggccuguccuucuuccuuuucuggaacuuguuggguuccuccauagcaucacucugacccucagcuucuguugcaaauucagaguucguagagcggcaagaacuaucuuuagaaucaaccuggaauuuaaaagaaacuuucaaagguuuguuccaagagcaauuuucuaccugcuacacuuagucgaugacaagucauuaguggguccaucagcacaagggaaaucaaagugagugugacaagguuaagacucucccagagaggaguuucucccucucuacuguggaaagcucauauaauaaauaagguuucagucacuuaaaauucacuucuaaaaugcagcaugaucuccucuugccagagugagcagggagcauggagauguaacaguagaguugcagugggaagugauuacacacuucacacuagacaaaauaacaguucauuguuuucucacuggaaguggcccaguccuacuacaaaaaucaggaaaccuaagacccugacaaaggauaggacuggcucaaugaacccaagucccccgguccuaaguaaguucuuuugccccuauggccuaaccuuccuucaagucuucucuuuccccaaacuguaaccuuacugcuagaaggguacuuucccaaauaugaccucagcaugcaccaagucauucucacacccacuccccaccuccagaaacacagauaacuccucagcccuauucuaucuucuguaugcacucacuccaagaguccacaggggagccgcacucagccuagcaugguccagcccucccaaaggcaacagaccaugaaaaccuccccagcuguaaaacacagcauacaugaacccagggcauucuacacucucugcagcuugaggauuuauauuaaguuccucacaaaguaaauacacucucucagacagauacaguggcacacgccuauaaucacaacacuaagcuaagguaggaugaccacuguaaaugagucagccugggcuacauauugaguuccauguaagucugaguuauguacuacaacucugguuucagaaaauaaaaauaaaagaagcagaagcagugagaugguucgacaacaagaaguuauuucccuccaggcgugguggcauacgccuuuaauuccaauacuugggaggcagaagcuggaggauuucugaguuugaggccagccuggucuacagagugaguuccaggacagucagggcuauacagagaaacccugucuugaaaaaccaaaaaaaaaaaaaagagagagagagagaaguuacuucccacgaggccuaaugaacaggaagcugcagcaggacaccccucccagcacagacaagaggaucaggauuucaaggccaaauuaagcugugagacccucucaauauaaaccuaagagucaacuucugacuuaagaaauaacaagagacccugucucgaaaaaccaaaaaagaaaaaaaagagauaacaagagggcaaagugagguggaccucaggucugucuauuaacagcagcaggcaauauauaacucagugacagagacuugccuagcauauugaggucccaaggcaaacucagcagggaguaaauaaaauaaaauguuggaacaucuuccuuuugaacacucugugugcugacacugagagcucugagcugaaagcuuggagcacacaaagccaagugugcaccuguugaaguuaaagaaggcagggcuggguaggacaaugaguaagcaaccugaggcggccugggaaaauggucucaucaauguccuucagcugugccagcacacaacaccugagacucaagaccaacacggucacagggaaggaggccuacacuuccuaaggucaaggggaaucuucccaggccucucaucacacagcgccuggcuccgugacccaaaagaauguugggcauacaauaacacucaaguacugacuauaacuaccaaaggagaccccagcggccuucaugaaagauaaaaccaggcuaggauuagacucaaacagaucagaggccauacccucaacuaacuggcaacaggcagcauagccugagccugaaaauuccugucccugacacugggguucugugucaaaaaugcaaucaucuagcaucaauacuguccaaaacccacauggaugaacuaguaacaaacuuaaguuguaugagcaaagguucguauuuaccugacuuaaucugagccacagucaguacuauucugccaaagauaacuuuucaauucgccauuauuugugaacuuagaaaaauuccucuugcccuccagagaucaggcuauaaucucuauuaaugagaaaacaugggacaugggcugaagaugaaacucaguuguagagcaugugauuagaaaacaauauacuuggcguuggagagguggguauggcgcuuucagaggacccaaguucaauucccagcauccacguggcagcucacgacugucuguaacuccaguuccaggcaaccugauacccucacacauucaggcaaaagaccaauacacaugaaauaaaaauaaauaaauuuaaaaagaaaagaagccgggugugguggugcacgccuuuaaucccagcacuugggagguagaggcagguggauuucugaguucgaggccagccuggucuacagagugaguuccaggacagccagagcuauacugagaaacccugucucgaaaaacucaaaaaaaagaaagaaagaaagaaaagggaagaaaaacacuuagacaaagagcuuuccgaguuaaacagccaagacucugcuucaucuaugaacccaccaagaaagucaaaugcagugacacaugccugugccuccagaacucagaagggagagauggaggacugggaguucaagguccuccuuggcuacauauggaguucaaccuagacuaaaugaaccuuucuaaaaaagaaaccaucaggaaagguguuaaacucccuuuccuuagacuaccuuugcuguuuuuccuaggggcagcccaucuucccccaaaaugagacuuucucauuguguuuacacucuucuacauacacacuuuuuaagacuaccagaacucuaaaaucuacauuuuaguaucaguagaagaguagggaccuuuguuuugcaguuacugaagaaccucacacuccuagaacacugccuggcacucaaaaccugaugcaggucugcuuuagaagcaucccccaaucugcuccaagaacuuacaaaucccgguguguuuccccugcggaacuagacuugagcugaucuccaaagauaacuacuaauaaacuaaaaaaguacccaagccagguguagugacauacaccuuuaaagcaggcagggaucugugggauucaggacagcuuggucuauaggagacccugucucaaaaauccaaaacccuguuaaccaaacagagaaugccaacaugcagaaauccacaacuuuggugaaaagccacacuaagaguccauuuccugagcugcaauucagagcgguucuaaguacaaagaccauuuaauuuuauuuuuaauuaagugcacguauguggguuaagugcacaugaagauagauacccaugggagcccgaggaaugggagcuggaauuacaggggcuugugaaccaccugaccugggcucucagaaccuguguccuccuucagcagcuguaugugccuucuucucuccagccccaagggcaaacucuauaaauugaccgaaaucuacaucaucuuuccugggcauuauuccaccuuccauugugcugauccuccaguuccacuguccauuuacaaucacucgaagguugcagagaucccuccaaacuaucuauaaucacucucucugggauggcagaccacaaccauuaucaggcuuuccuaguaguuccaaaugccaccaaguuugaaaacccccuccauacugagcucuaccccucaacacccucccccucgcccccccccacacacacaccaggcccuccacaggaaagaucuaauuuuuauucucuucccaccaaaugucuucucuccaccccucaaaccacgugcaagggacuucacuguuugccagacgucgcugccacguaccuuaacgcuacaagcuuccuuccguagagaagccauuucuucuagagaggagugggcagggugcagaggggaccccuuggacguaaauagucuccgagggcucgcaaucaggaagccaggggaagcggccucacccacaccugagcccgaagagagagaggacgaagaagaggaagaggaggugcgacggcggacugagcuccgaggagcgcgggccacaucguccccgcgccggacuuucagacgcugggggcugcuggccccucgaggacgcgacgcacaccugcgaccuggccggcuggagggggccacauugccgggcucccgggggcggcugcgcuugcugggacacccuuccgacgugcugccccagugauacuugaccuugcgccgcuccgacgccaugggcaccugccagggacagaggaacgacgauuguagcagcagccuuggcggcugcucgccucacaccgccgggaagccgcuagggcaacggcgggaaucggccccacugaccuuucccguuccugucgucugcccauuccagugcuacgggcuucggggacgccacagcgcuccgagaagcguccgcgggccgagcgccgagcccgaacaacgcgcagcccaaguccgcgagcgcggcugucaacagcgcgccacucccgagacgccgaggcgcuuccggcgcggcgcggcgcggugcagcggucugccuuccgaagcccugcgcggggggccgagcgcgugcggagccgccuuuugggccgcacgcgcccgcaggccccggacgccaagggcgggccgcgggcgggguggccgcucgccucccgccgccccgucccgccccgggccugagggagccacuggccuccggagccgcgcgccggaagucaccuccgcuccuccagcugacccggcccagcgccgcaccgcgcccucauccaaggccucggccccgccgccuacuucgcaaccucggcgucagcuccgcggaaccugcccagcggccggcggccggcgugcggcaggggcggagccggcgucagggacggcgccgauugcuccaacg

SEQ ID NO: 3308 - RNA, 646 nt, Mus musculus
caugggcaaaggaaauccuaagaagcugcgaggcaaaauguccucauaugcauucuuugugccaaucugccaggaagagcacaagaagcagcacccggaugcuucugucaacuucucagaguucuccaagaaguccucagaaaggggaaagaccacgucugcuaaagaaaaggggaaacuggaagguauggcaaagguuuucaaggcucauuaugaaagagaaaugaaaaccuacauccgccccccacaaaggggagaccaaaaagaaguucaagggcuccaaugcacccaagaggucuccuuuggccuucuucuuguucuguucuguguaccgccccaaaaucaaagucaagcauccuagcuuaucuauugaugauguugcaaagaaccuaggagagauguggaacaacacugcagcagaugacaagcagcccuaugagaaggcugccaagcugaaggagaaguaugagaaggauauugcugccuacagagcuaaaggaaaaccugaugcagcaaaaaaggggguggucaaggcugaaaagagcaagaaaaggaaggaagaggaagaggaggaagaugaagaagaugaggaagaagaaagaagaagaggaagacaaagaagaagaagaugaugaugaugaauaag

SEQ ID NO: 3309 - RNA, 33710 nt, Mus musculus
ugcuaaaugcuaacugcauuuauucucucaaaaaccuucacuucucacuuuuauuuuauaagaaguucuccaagcaagaugcaucucucacagccaguacuacauaguuuuguguucaaugcaccaaccugucaaauagugaguucacugagaaugcacccgucacucaguauuucaagguuuccaaaccgucaauggguuuccagucacguggguaacugguugaaguccuuggguaagcugagcuacagaguagauuuuuccauuacagcaacagaccacgggguccugugcauccccaaaugugccggugcuccuucggggcaggccgauggcacacagucagagcuguuggugaacuguggacucugggauuggaaggucaaagcucaucuuggucacuucucucucgggaagaaacccaucggcugagaaucaccuccugcaaccgagaaaaagagggcuucagaaauggacaagggaguccaaagcaagugaugucacagcugccugucacagauggcugguuugcagggacucccuucccagucuuggaagaggaagauguggagaaagcgugagguguaaccauaacccuuacacaggaacccuguccccugucaucacugaauuagccucccagcacacagcagcagucaaggccagugcucaacuugagugaggaccugcucugggacacacuggugccugucagucagccacaggaagugacaagcagacacugacguuccaugaaucacaaaccuagcgaagaucagaacaaauggagggaggugccacuggggcccuggaggccgacagaacaucugccugggaccagggugaggcacaggcugcguggguagcuaagguguuguuggaguaggcaguggggaagggcucagagacauuaacacacaguggugacucuacugagaacuuggcagccccagaagaggaaagcagccaggugucugguucaacacaggaacaugggagugacaugugugggugugugacacucagguguguaugguagaauagacgcuuacugugagugaggccuuguguuccauccucaggacugaaggaagucacguaggaaguaugaggagggagugacagcuagucucugggagugagaccuguaggagacccuggccuggcuguugagcuggcccacccacggcuggagauggggaagcaacagauagacuggccgaggcugugaaauguggagucugauagguucagggggaagaaggugagauaggauuacaggucagaaucagcuuuugucacugaggaaagagccauccuugcagaggaugcagugggugcagacucuugggaugauguggagcugucucugcgcuugcucacacaccugaacuugaauccucuucaugcauucuggggucuccaugucuucagcagucaugguagagggcuuaaucaaauaacacagcaucagcuccugccgagaaaagaugacacauuuuccauauucugcaaagagacaucgccugugucagugugugaggagaacaggcacccccgccugucccuguguacaaguacugcagggugcacacucacagggcacacccccugcuucccuggcuuuugcaauggugaagaggauucggggaugugacgaagcagacaagcugcuuacauauccaagauggaaaauacacacugcaauauguauguauguauguauguauguauguauguauguauguguguauauguguguguguguguguguguauguauguauauauaucaccagagaaggggagaccaggcugccucagacucaugauccuccugucuccacuguccaagugcagggguuacagguguauacucagccguacaaauaacuuaagauuuucuauuauuuuauuuuuaguuauguguguuucugcgugucuguguagggaagugcaugugagugcagaugccuguggaaggcagaagugggcccuggcucuccuggagcuggaguugagauggcuggugugggugcucugguccucuggaagaaagagcaaugugagcuuuuagccaccgagccccaaaugacuucaaacaaaccaacaaacaaacaaaguuacuuuugguuauguguguaugugcaccaugugcgugcagugcuaaagaggccagaggagggugucagguccucuggagcuggagauacaggugcuugugagcugucugaugugggugcuggacugaacucagguccucuggaagggccaagugcucuuaaccacagagccacuucucuauccucuacaucuccauuuaaaagacccaacaauucugcugccuuuaagagaaaagcaaaggagccacgugaguggcagcggggcuuagccugguaccuuggagacguuccccgagacucugcucagggcggccagcgacuuccagcugaaaggccggcggagggagcccucauaguugucauccaggagcucaaugaugaccgaguagcuagaagacaagacagacauucuggaaaagccacaccaccaacuuguccagagaacagugaguccuaccaagagcuaggacagaagaacuucacauugccugcugcuaaagccuaguccaccaaagagaauaacuaaugaccaaugggaugagaagcuaccacccuucaggcugaaugcacgccuaccgacaggaaggaacggaccuuaaauucuuguaacucuuuggauacucauacucacugugcucugaggacuguacacagacuaacuugauguuaacacagauccaugauaccaucacucauuguguggacaguguaacaaggccagugugcuaaaguuuccugcagugcugaucauggaacccaguggucuaacaccaagcugcacccuaggccagccuggagccugcagguugguugguuuguuuguuuugagacagggucucacuauguagccuugauuaaaguggaacuugccauguagaccaggcugacuugaaacuuaaaggagcuccaccugccuccucuucagagugcuggguuaaagauacaugcuaccacacuuggccaggaacaugacuuuuugaagagauauauuuuauuuuuauaaguauagguguuugggcuggagagauggcucagugguuaagagcauuggcugcucuuccagaggaccuggguucaauuuucaccacccagauggcaguucauaacuguuuguaacugcugucccaggggaucagacauccucauacagacauacuugcagguaaaacaccagugcacacaaaauuuaagagugauuaagaaauaaguauaggcguuugccugcauauguguuugugcaccauguucaugcuuggugccuguggaugucagaauaagacacuggauccuccuguuguggguaccauguggguaucaggaaccgaacuuggaaccucuggaagagcaaccagugcuccucaccacugagucaucucgucagccccaggaauaugacauuuuggggugggagagggagagguuuggcuuuuuuuuugagacagaaucuaucuguguagcccuggcuguccucgaacucagagaucuaucugccucugccuccugauggcugggucuaaaggcguguaccacugcaccacugccgcucagcuaagaauaugacuuuuaauugccucugagaaacugaaaauuaaaccccaagccagauaucuccuuguguccuuucuauuaauuuauuuaaaaaauuccaaaccuugcaugguaaaauggagggccuuuccgauacagcacugcaaagagagaaggagauguuagcgcaucauaacugcccagcugucuucaugaggugcucuguucucuggucccagccuggcuucagauccccagaagcaacaaaacuagucaaaacaagucgaacccagacacucucguucacccaacaagugacucccagaguuaaguacacgucauugguuuuucuuuuccguugguguuggggacugagcccagugacucacucugcccaggccauacuccuaccuacaagugggccuggucuuucuccgugugugggaaguagcagacagcacauuaaacccauacaauguacagcauuugugacucauuccaaauucaaccggacucagagugagggugguccugccugcuggugccauggcaggggguacacgggaaacacaguuuucagggcagucggggcuacuuccuagccuuuggcugucaguguagaaauucugggccuggcuugguggggagagcauauguuguaaguggggcaggguuacccaugccugaagccccagcaccagggggugguagggagauuaugagagcuugcuggccaguccaccggaaacagugugcuucugcucuggcucccugagggacccugucucuaggcaauaagcuaaagaguaauagagaaagucaccugcccucuuccucuggucuccugaggcaugcuuaccugaagauauuugcaugcaucacacacaacacacugacaugcaggggcuggcaagaagucucagcaaguaaacaaguucgguaucaaugcccauacauacauagcacaguccauacauacacagcacacguccacacauacacagcacacguccacacauacacagcacacguccauacauacacagcacacguccacacauacacagcacaugucaauacauacacagcacauguccacacauauacagcacacguccauacauacacagcacacguccauacauacacagcacacguccacacauacacagcacacguccauacauacacagcacacguccacacauacacagcacaugcccauacauacauagcacaugugucuacgcaugccugaguucacuguacccacaccauagcaugugcucaugugaaccuaagucacaaacacuaaugaaaaaaaaguaaguaaauaaaugagaaacucagccgagaggcuacaaaagacccauaagcacacaguccauccaguuacuagccugccuuucucauggggaucugacacagguaggggugaagccagucucuagagaucaaaaggagccucucauugaaggagccugggccuaaggaugguggcccucugcagggaccccuuggaagcagggacuggccagcugcccaccaugacuaccuggcuuccuucagguucucaguccccaagaagcugggccuggcccugagcugugccacuuguggguugacucacaacccuccuggguccagagcuuagcacucggcuagugacccugagcuccugugcugaaaauggagcccaggaccccgaguaccugucagucaucuggagcuaccuggagacgcucacuggauuucauggaaaauaaaagcgagugcucuggugagccccaggccugacauuuauaaaugaacaaugaaugguauagccaugccccgaaggcugaaaucuaucaguaaccuacagcuuugccauuacugcugccaggugcuagcccugugacacuggcuguccccuuguuccccuugagaaaugaacacaauuuccuuuuuggagacagugauccuggagccggcucgggacuccccaggacauugugggaccccuucacccagcugcuguggucuggucucugcggccauacugccacuugcccauucauuuucuauaugcuguguuucagcucagcucaguucccaugaagugaacauccacacgcauccaaacagcucugugacuugggguucagcgaugggaagaugguggaccaggaccaucucuuccuguccaauaucugucacuccagggugugagacucuaggccaguuacuagccucucugaacuggcuuccaacauucuaaaacgaagguauuacugcacacacauguaguccagcuacguaggaggcugagccaggaggguuguucaacugugagagcagccugggcaauguaguaaaacucuauuucaagauacaaaacaaaacucaaagccuccaaggggaaaugaaggucuucucuacccgcugaauccaugucuggaaccgaauugcaucuuuaccccacauucuggggcaccgcacgcuuugacuaaaucguugagucaugggagcacaacucacccaguccuucucagaagugcucuacaaagauguuuuauaaacaucccaaggugugauaagacagagcucaggcaaauuaagaaaccagcugaggccacacaggugggaaaaggcagagcugucugaccugagagcucucucuguuacccaugaugccucuuaacacaguggacggccucccugacugcuucaacucucauuucccccuuaggacgaggaugauaaagaccuaagagguagguagcgcggcugugaucacgggagugagaacagaggaagucuaaaagaaacaaagugaggccauuccccugcacagacaggagcugggaccaacacagcuaucuuggaauuuaucuccagaacuggagcccaguucacuccaucagccuucuguggguuacuuccaggauggaagaaacaaaagaggccuuuccccugggggaugggcacauagcaaccuacugucagaaaagaccuucagggcugcuggugcucccugaggacuagcccucaauucuggguguugugagugacuguccaccgagccuagcaauuucuugggggaaauucaggcuccuugaaugaggauuauccagccaaucuuguugacacucugaggaggagggguagggagggucaugagacccucaccugagaaucuagcacucccuacaccuguuguaugcaacuuugcuuuaauuacacauggucuagggcagggcuaggccaggggaauggagaggagccaucaaagggucuacagggugagcccucaucccgucaggguaaaggcuuucuagguguguccugcugcggguaaaggaggaucuacaccacuuacacagaagcucaauaaaccgacuggcuccccagaguaaacuggcagaacugugcuucaguuccucacugggccauuggaaggguagauacugccugggucuccucccuggggaagcguuuuaauaacaccagcuuaagcacagccuacuuuagagcauaaaguuuuuauucauuguuuuucuaauugugaguguaugacuaugugugugugagagugugaguguguguguguguucugccugcaugcauuucugugcaccacaugugugcucaguguccaacagaggcuagacaggaauguaacauucccugaaacuggaguuacagacgguuguuauccaccuugugggugcugggaaucaaacucagguccucuggaaguguagcagccagugcccugaaccugaggcaucucuccagccccaguguaggaauuuuaaaaacugcauugacuuucuuuggguuauuuaaaaaggcuuagagacauuuggaacaagcugcaacaagguugcuuaacaccucaaaagccauaacuuuuggaggcucucaaauaccuuaaaauuuuuagcugagccucacaaauacuucugaaaagacccaggaagcacucauucauauggcccauguggacaugggguuuggugauuuauuaaggaaugaccccagagcugaggggaacccaaagguagaugguuacuaacccaggccccugacauuuacagcuccccagaguugccauggugcuucagcuccccagaacugccugucuccuccuucaaucaugaagagcaucacuaaucucugaggcuccaagaucugaauucuuccucguuggggaucaugugcagccucaggcaugcaaggcugaagcucccccucugccccaauccaagcuugcugagugccgauaugucacaguagaaacuuccacaguaugaagauauacuugugcauaaaacaauuaaaaaggugaguauuaagaacaggcuacuaagcugggcagugguggugcacgccuuuaaucccagcacuugggaggcagagauagguggguuucugaguucgaggccagcuuggucuacagagugaguuccaggacagucagggcuauacagagaaacccugucucgaaaaacaaaaacaaaaaacaaaaaaccaggcuacuuuguggguucuuauuuuuucuacccuuuauccccccaauacugguuuuacccccuauuaucaguggauaggagaaaaaggauagagaggagggggagagagagagagauccuugaaucuaauuucuuuccuuuuguuccuucuuugagcaggacuacuaacaaacugcaaccaacccuccccacccacucaacaacaacuaccaaccaccaacuccauuucuugggguucuaguauuuauaugcccaaguucccagaauuccauaugucacacaacugcaaaaacuauauguaguuggcaaaaucacaccucugcuacagcaugaggcaaaucauagucagcugcuguggacagucugaagcagcccuauauccuccuaucugggguuaaaaugaaagcacuauuucagaauucucacugcagaccucauccuauaagugccugaaacccagacugcuucuguggccaagcauuucagauuaguacucucagucuguacuacaucagaugaauucaucaagaaucugaggugacaucagaugccaccugguuccucugugcacaagugccgcauccauucuguugguggguugucaggcccacuucaccagcaaguuucuucuccauuuugguucucuucagucacuuguaagauagcacucugaagacuuuucaucucaaacauccuggaccaggucccagccugaguaccuugggaccagugcucuccauauucuugccucuguguauguccugagaccugcucaguauguccugccccagccucugugcuguuugcucugcccagcaagccuuucacagucugaggggaucacugcaggagccagcaacgcacagaagugccuaagagccuugugcuagaauccaaagccugagagagacuggaagccagugaggguacauggccuuuccucucuacacugcaguaaggaacgagaguggcauacagaauagcaaaaggcugccaugaggagugucacaggaaugaacaacaccaugccggacagcaugagcucaguaaacaacagcugacuaucaucauaacuccaggacuccgagucugaggcaagugaaacugcaagaaaacagaccugacagaaaucacacaagcuuauggcugaugugcagcaggugccauagaacauaggcuaugauuaggaaagucugcaccugccaguaggcuuucccaacacacggcauucucauucucuggauuuaacccaucccauccaaacacccagcaaugguauccaacagaacagaaagcuaccucaaccucccaagcaaacugggcugacccuguccucacaucugccacacacacacacucaagaguuacucacgcagaucuguuccauacuugagccccacuuugggcacccagccuuuacuucggaaguagugguaggccauguagguuguccugaaggugggcuggacugcagugaaggcuugccagaguuucacuauugucagaggcuccuaauguuuuuuaaaaagagaacaguuuacauuuauucacuccugcuuaguaagggaguagacaucuagacuagcauggcacugcagcagcaauggagacgaacaagagggauucauucaggauaccuaacccacacuguuuaugugacagcaaaccacuaaguguggcuguucccaauacaggugcuacugugagguccuucuguccaucucagaaaaaguaacacaagcaaccucaguaauuugggucauuuuaaguuaaucauacucuuuccucuugcagugcuggguaugcaaaacagggccuugugcaugcuuaggcaagugcccucccucugagccacaguucagcccaccugcauaccuugguuagauaaacuauguugguaggacacaccuuuaaucucagcauuuaggaugcagaggcagagaagcaggcuaaucucuaugagauuaaagccacuguugauccaccaagugaguuccaggacagagagggaacaaagaaaaacccugucucaggaagaaaaaaaugguguucuggggggugggggguuacuuuuucuuuugagauagucucacuaauguagccuaggcuggccuugaacuugcagucuucuugccucugcuucucaagugccaccagaaaagucuacagugacccauguggcucccaccugaggcucuuacucauuucuuaugcugcagggaucuaggacucagaaaaggagacacugaggcuggcgugcagcuuguuggugggcucagcauacacaggcccugggcuccauccuugagagaggaugaaauuuagaaaugagaaaaagaaaaggggucggaggccaagagguggggaccuggggaaaaacguuguagauaaaggagccaguggcauguggaguugggucauaugugacaaguccacgggagcuuauaaaaaaaacaugcuuccauaggcccuucagugagcagcuacugcaaugucaggccaggcucagcaaagcaaaaaaucauuuuguaagugaaauuuucauuaaagucccaaaauaauccuugguuccauguagcuuucagauaggagaacagccaccugacaguguccaaagaaggaccuugaagagaacaagaaguuuuccccaggcuucaucagaaaacagucacaaaaauuaaguggguggguuuagaaaauguuucucauucuacuacuuugggaaagaaccaacucuucagcugucugggguuuagcuucucaguucagcucggccgaagcuuuaauucugcaaauacggcguggcugcagcucacugguggagcaugggcuuagugugaacagggcccugggcuccauccccagacaacaguucucaucaacaccuagcaucaggguuuguucauaccuguguggcuucaaccccucacuaagucucccugacagggcggggucccgcauggagccugaggauuccccagaagcagacagagacaccucgggugccgucugucuccuuuccucuucauuacuguauccuaaggcauuacaucagcaaagugccacauucaaaacagacaagaaauguccagagaggcugcccugcucucugccuagaggucaguuaugguaauacccuggcaauggugaaaccagagacauugaagccucacacacauggguuuaccagcugguucuaaccacacuagccagguggccuuggcugcgccacuuauuuucucuaagcucaguuagcuuguuuuuuuuuuuuuuuuuuuuuaaaagauuuauuuauuuauuauuauauguaagcacacuauagcugucuuuagacacaccagaagagggcaucagaucucauuauggauguuugugagccaccaugugguugcugggaccugaacucaggaccuuuggaagagcagucagugcucucaaccgcugagccaucucuccagcccccucaguuagcuuguuaaugcagcuccuaccaagagguggaaaagaucagaacuagcacaggcaagcugggcagcauggaacucagagagcugaaguagggagguuaccucaauauugaguccauccuaggcuacaaacagugaguucuaggcuugccuaggcuauaaaggaagaucuugacuugaaaacaaaaacaaaggucuggagagaugacuuagugguuaagugugaacacugauccuagaauauuucuagcaccuacauggcagcucacaucugucuguacucuaguuuccggggaugcaaugcccucaguggugucuguggacacuaagcaugcaaggggugcacgaauaugcuggcaaaaugccuauacacauuaaaaauaaacaaaacccaaugaauuuaaagggcccggcacucagcacagguauaacuguguguuggugaguuugauuauuuuugcaguguugggguggcuuugugcccaaggccuuaaacaugcagagcaggcacugugcuccugggcggcaccuagccuggaacuuuggguuuuguuggugaugcuaguaccauggugauacagguuuccuucuuacauaacagguuccucagccucugagagagacaccagcuaaaagggucacccugcuccugccugaaccacuccagcugagguuccuuaguuugagccuuacagggaaaagggcaaaucuuuuuuucaaucaaaguugacacauuggcuuuaacucuauaggaaggggcucuaccuaugucaacuggggaacgaccugauuguguguacacaaaaacuuaccuucucauaguaaauacuuaggcaucccagggcguaugccaggaagaaagccugcaacaaagcaggggaguuuucauuagaaacacuguugcucuccuaguguggguguggggcuuaguaggggaacgacugccuagcucacccuuggcucaccccacaucacccaaaggagauaaagccaacaugccuccacacccccaucuaucccaacagccucauguuguggcuuccauccagggcagacagaucuaugauccugaggcacccaggggacaggguggugggcaguacugaaagacgacacuggguuacucuguauuuuauugacuguagugcuggccacggaaggagcgccuccugcaugccugaacuacccugcuaagcuacaucccaaccugacuuuucucauguccaaguauuuuaaaaggcaugagauaugcuacccacaacgaaucacaaauggccccugcuuccaggugcagggcaggaggguccuugaguagaaacaggacuugguuuccuucuucucugucuccuccugucccaaggcugugcacacauggcaacaaggggccagaaagcugaagggugcagaaguguccagggaugagaggagaggugcagggccuagcaccccaguggcuuccuuggaacuucccagagccacugaugcucuccagaguugcgguucuccaagcugucugggaguccugggugccaaacucaaaacuaucugccucacucgagcuccugcuaagugugugucuggggucagggcggggggggaggcacaggcagaggaaaagauagcccaaagccuguggugagaucacagcagaccccaucauagccagaccccacugugaucugcaaaacaggaccaaaacaggacaaaucuuccucagucuugauuuagaaaaguuacuuuucauaaacacacaguuuggagcagggugugguggcccagaccugcuccuggaauaugaccagccccuccaccccugcucggugcuguguuaauggcucuuuccucaccacaggcucaagcaacucuuuugccucucugcuccagagcacuugcuuuugucuggaaacaccuucaguuccuguccucuaaggcagagcagacaccaacacuguugccuccgcccaugagacaggccagcucccuuugugagggcucaaugcuugugcugagagaaugaaaggaaccccaaccccugccuuggcugagacccaggcaccuagguccacugggggcuuuugcaccugccucagcuugcuucuccaggagcuuagauguccccagagaggucacacuucucucagugcugcccaaagccccaccaaaccuccaaugaacuuacuuuggccucauucuugccaccaccauuuucuaacacugaauacugcaguuuauggguggcccagggugacugaaauacuguaggaaagauaaagcugcccuuagguggacaaguucccuacauuuuuuuuuuuuuuuuuuuuugcuuguuuguuuguuuuucgagacaggguuucucuauauagcccuggcugucuuggaacuugcuuuguacaccaggcuggccucaaacucagaaaucugccugccucugccucccgagugcugggauuaaaggcgugugccaccacgcccggcuaguucccuacauuuugacacauuugcaucucuugguucagaauaguacaagacagaaagggaaccugcuucaggggagcauggaaugaggucuagcagaccugaguucaagccuucauugaggugguuuaaauuauuuguauuuaaaauuuuuaucuuaauguauggguguuuugccuacauguauguauguguaccacgcgugugccacagaucuaaggaggcccaaagagggcaucagauccccuggaacuggaguaacagauggcucugagucacugugugggugcugggaucagagcuuugguccuuuugagguuagagucagugcucuuaacuguuaccucuccaaccucacugagguacuuuauuuggaaucaaguccucaggaggcagaggagggaggucugugaagcuggcuucaccagcaagcauucccuuuuggggacagcguauuuagguuagggucuaccacacuggaaaaccauauuuugaagacagaacucucuaaagcuauggaucagccuggcucugugaucacauggcuuccuaaaggagggcacagaauuacaguguggcaucugccauggcaugguucaagaacagauucgcaagaagccagcugugggaaggcacaauaucagcacauuugagugacggcuguuauuguccaacagaggaaaggguaaagucacugugaauucuucuuaauuuaugauggguaucagcaauuuagagagagggcaucuugcuauagggagagauuuaaggcacugcugacuaggcacuguagagucagucaggaacucugccaggagagaagugugcaugugcuauuuguuaagcucuugccaugucugauacugaccaugaacucaaagagaaauguuauacugaauaagcagaagggagcacauuugaaaaacuucuuuuuuuucuuaagaguucccuuagcacccccauccuucaacaagccaugaucaaaccaaauucugguggagcucauuuuaaauuuagaggaaagaacaaacaaacaaacaaacguaccugccguucuguacaucaggacaacagagagaaucgagacuaaaacuggggccauguccacccaggaauggcagcauccuugguuagagauucgcauguaguuaccugcuuccucaagaggcacaugacacaugucacaccucauggggucuucacuauaacccucugagggaaauauccuggcaggucacccaucagaaaaccaaaggaugccaccucucaugugcuauguugaugaggaaaguauuuucucccugcuuuguuuuuguuauguauguauguauguauguauguauguauguauguauguauuaauuauauaggaguacacuguagcugucuggacacaccagaagagggcaucagauccccuuacagaugguugugagccaccaugugguugcuggaaauugaacucaggaccucuggacgagcagucagugcucuuaaccacuuagccacuucuccaguccccuugguuuuuguuuuuguuuuuuuuugagacaggguuuugaaagacccacaacguuuguagaguuuacuuagaacgcagucaugcagugaguggaacaugcuaacugauucugcagaggaaaugccuggaacauacucccucccucugcagucagggcgugaucagagucacacagcacaugaaaaaacaguaggcucugcaauuuaaaaaaaacuugaguuuuuuccuuccuuccuuccuuccuuccuuccuuccuuccuuccuuccuuccuugcuuccuucuuuguauccuggaaagagucuggcugugcuguucuagcuggcuuugaauugcugggcucaaaugaucacuuuucuucagucucccgguaguguucacagcuacguguggccacacaagguggacuguguauuuuucuauuaacuuuuuuauuguuucgcaguacuggggauugacucagaacuuugugaauaucaggcagguaaucugccaaugaccuucaacacagccugaguuacacacuucaaaugaaugaacuggugugcuaauuacaucuuaauaaagauaauuuuuuaaaaaaagcugacaaaaauuagcugagcauggugcugcacaccuugaaucccagcacccaggaugcugucaggaggcucucaguacauuuguggccagcugucuauauagugaguuuuuggguagccagagcuacccugagauacccugccucaaaacaaacaaacaaacaaacaaacaaacaaacaaacaaacacaaacagcagaaaacuugacaauauuuugaaaccuugcugagaaaaggacucaguuugguugugguaguacacaccaaauccaagcacaccugaggcaggggcugugaaauucaggcuagccugguaucccaguaauaagaaccucucuuggaagaaaagaaggaaaaggaagaggaggaggaagaagaggagcaagaggaggaggaagaaaaggaggaagagaaagagaaagaagaaggggaggaggaagaggggagaagggcucagauaaaccucuuaaaugcucaaaauuccuuuuguuuccucgaugaggauuugaacccagagcucucaaacaccauuuuagugagcuccaacacacucucaaauggugaaacaggcugagugaggaugaacauccuaguaggugaugacaccauuuagcauucuauacagaacugucugcaagguggggucaggugcacagugcacaggguuggacuuacccagggcugagagcaagaugcacacauaccucuucuaggcugagcugcagauacucaaagauccuguauggauuucuucugcacacaaguuucuuccuuuucagcaacuagagagagagagagagagagagagagagagagagagagagaaaaugaaugagacuacgaauaaaucagccaccugagacacuccuaucaugagacuuaauucccaaaugagcauuuucuugauaaacucaaugggcuacauaggccaggguaguccaggcugccucagcuguggugggauuugguauguacugccacacccaacuugagacuuucuuuucucaucaagguuucagaauauugucagguuauucuacuggguuuuucacgccguuagauaaaaucuguuaaaauuuuuuuuuuuuuuuuaaauaaccuaugugggugcuggagagauggcucagugguuaagagcacugauuguucuuccagaguuccugaguucaauucccagcagccacaugguggcucacaaccauuaaccauaugguggcucacaaccauuuguaauggggucugaugcccucuucuggugugacauaagauagugacagugugcucauauacauaaaacaaauaaauacuuaagaaacccuacauggaauggaugcucuuguucuucugcugcuaacaccaucuuguggauuuucucugcagaugggacaacuccaccguugaacuuaguguuuuucacuuacaagcugugugccugaacuaaggugucaaaacuucagucaugccugagaucaggcacuuaucaugaguuuuuuccucucccauacaauguacagagaauuacuggucuugcuuuuuuuuuccccccgcccccacuggucuugcuuuaacuuauuuauuuaaaaaaaaaaaagguugaaucuuagcggaaacaggccuuacaacugcugugcaacuggggcugugcuucagcgcuggccucagaaacaccacacaggcccaguguggacaacaggccugcccaggggcaagugaaggacaucugggagggcugacaccucucacuggccagcaggagaugugacugacagucuucuuaucuccaggggacaugcccaagagucccagaagaugccugcgacuguggguggcacugaccccagggguacaguuuuccuauccacacccagucaugguaaagucugcacuagugagagauuagcagcagugacgaguacaggagagggguccuaacacugcaaugagagcaauaaggaaugugggcucucuuuuaaaagccacaaccaacagcaaugcucucagacugucgcugacuguaacugaagcccagauguggggagcagggcacuuugaucuauguaccuucucgucugaugccgccgccgccuccuccuccugggcaccacacagcucuuccucuaugagcacauacucgugagcagcccuuuucucuccugcggccuggcugcuggcuucaggccaaaggccacccuguggaacgaggguuuccugggggagaaccucgggguccucugccacaugcccauuauggcuagauggacuagccgcagcgaguguggcauggccaggccccuccugcaggcagucugagugugugccgagaccggguaggucaucugacuguccagcaccuccaggggucacggggaguucauccuuuuccacucugccuuccagggaggagucggccuuggagcucaguggcucgugcuguggggucucuucuuucuccucucugcaaggaagcuccaguggcucuguguagucuguaaggaucuucugcacagugcucucaucguggcccugccuacgcaggaagucccuggcccauuccacccgaugcugauaccugccaacagaaacaacgucaauaacacacucaagucucaaccccgugacaacaaaguaacccagaaagccuucaagguggcccaccaauaugccgaguucuucucaaggguggacugcaggccgagcuugccgcccucauuccccugcaucuaacuguccagcgacaagcaagcaucaucgacccuuuaacauuauuugcuuauuuugacaaaguuaaccucccuuuaacaaagugugacaaucuaugcuauuuaaaaccaagagaugcugguaaauaaggcagagaaaaaugcugccuuuuacugggguccauuuugucuuauuuuuaaucuugguuaucacacuguuucugacagauacuccagucaugauauaagacccuuucuuuagcacuggaaagugaauuucaauagauacuuuucacaguacccaggaacaucacugauaugggaagaauugauuugccuuauacacuguucaacaacuuguaaggcaaaucaucuguugugaugaaacacucugaccaaaagcaacugguggggaaagggucuaguucaccuuagagcuuacaggcaccaugaagggaagccagggcaggcgcuccagacaggacccagaggcaggaacacaagcaaagaccuuggaggaacuuugcuucuagcucacucucuagcucacaaucaguuagcuugcuugcuuucuuucuugcuuucuuucuugcuugcuuucuuuuccuuucuuucuuucuuucuuucuuucuuucuuucuuucuuucuuucuuucuuucuuucuuguuuugguuuuuuucgagacagguuuucucuguguagcccugguuguccuggaacucacucuguagaccaggcuggccuauaacucagaaaucugccugccucugccucccaagugcugggauuaaaggcgugcgccacuaugccccggcaucaguuagcuuucuuauacagcccagaaccaccugccuagagaugguaccauccacagugcucuagggauuuccuucaucaguuagcaguugagaagaauggcuguguagaccaaucuucaacugacacccaagauuaccaccacacacacauauauguccaaacauuugaaaauaguucccuauaauaauccucagaguguaguaacacauuaaauuucuauccucaaagaguugagcauuugccaagguacaaaggcuauggugaggacaacagggccgugucaggauugcugggauaugucccugugacauaagaacauguuaccaaccaaagaucagcagaaggcugaucuuaguggcaaacaccagugguucugcccauccugaagauacaacugaagauacaagucauuucauuccucuucuuauuucaccugugugcucgauacccagauauauaucagggugcacacacuguccagcaggcaaacuguccuuuguaccuagaaagcuguugucugcuucacuuuggcuuauuggaauuccaagcuguucacauugguuuuccuauacacagaugaacacacaucccuguauacugggaaccgaaucgcugacucauucauauauuaccauucagcaagcaagagcaagggcccuacuacuguccacugugccuuacccugcucuuuuuuuuuuuuuuuuuuuuuucuuuuuugagauagggucucauuuauccagccaagacuugaacuugccaauucuuuugcuucaguuucuugaguagcugguauuauaggccugugcuacgaggccuggcugaaucuguagcugggacuauguuucaaagacugaaacauagcugggaggugguggcgcacgccuuugaucccaacacucuggaagcagaggcaggcggaucucugaguucaaggccagccuggucuacagagugaguuccaggacagccagggugacacagagaaacccugucucaaaaagugcccccucccacacuaaaggacugaaacacggcaaggcugcucugaaaccuguaguauaaaaggugugguuaaucugguauugcacaugucugggguuuaguccgacuuugucauucaccacuguguagcuucugcuuccauuucaucucccacaaaauugggaaugcuaguccuccuggcucacagagaucuuguuacauacagcuucuuaucaucaaggaacaugguggccuggcaaccaguacacacaguugaaaagccagaaagagcuagaaaguuuucuugugcuagcaacugcagcauagacucuagagguuuuguggcucuuugaaccuguucauuugauuuuuuucugacuauguguguggguuuguuguaugugcagcauaugcacguggugcucuuggaggcugaaagagggagcuggacuccccugaugcagguuguugugagucacugugugggugcugggaacugguccuggguccucugcaagaucagugagagcuaauagccacuucuccauccucuggacaucugcuauuugaaccucuugugucgauguaccuuacuguagaagaagggaucuauaagauacaucagaaucccugacuugaaaaugugacuuagccacaguggugcaaguauguucuucucgaaccuacagggauaaaggcaggaugauugcauguuuuaggacagcuauaugguaagaucucuggcauacaaaaaacaaaaaaaguaaaaguauagcaaaacaaaaacaaaaaaccaccaccaccaccaacaacaacacaaaacaaacaaacaaacaaacaaacaaacaaaaagccuaguaaaaacccuaaaagcaaaaacaaauugaaagagccacuuaauugaagauucagccacccgccuccuuugugcugauccagggcaagcacacaagugcccugggcaggacagacggugaacucagaucccugcuacacacaaugucauacuugcugugugaccaucacuucucagacucagagucucaccuaacaugugccaccucauguggagaggauggacgaagaggaggugugugaagugugaagcacagaugugcccaggaaguuacucgucugcucucuuacugugaggcccucugggauaguguaaaacacaacuccauugucucaguacacauugcauuaaaaacuacacauggcucuggaccugacucuucugagucugggcugagccacuggcaccucugccccuccacucuucugucacaugucacagccacugcccuccugccucaucaucucucagaugaccuaauacuucaacaagaguggccaugcgacugugagggagaaaucccaaguaauuggaaauauaagagguagauggcaaauagccuaagacuguaguguguggggcccagagugguggccuccugcugccuggaaacuccuuaaaaagucaaguccuggaagaguguugaagcgaagagccggugccagagagcaaaggggaaaggcagagggaagaggcagcagguaggacuggaagcaaauguacaccucucaggcucccaggcccuguacaugccucucccagaucccuucuucuaucugaugggcccauguccauuuaguaucugggucauccuggagccagccccugaaggcccauucuaacuucaagugaagaacuuaacuuccaugguucaguuccuuacuugcagaacauggauaucaagaagacaggaagucuucauggguaugggguaaggacuuaggagacaagagagaaggcugucacgugcacagcgucucuugcacaacauagccagcaucacuggcauaaauagcugcuuuauuguucucauguguggauuccucucacucuggagaugaacccacuuacucaugggaaagcuacuccaguaguguauuguuucaauuuaagaugaggucauccucacugguauacgucagggacuggccaagaacaccgagggcugcaggcacuaccagaagcugagauuugcaggaaauguccuccugugcccucuagagggagguagccuugcugauaacugcauucuggauguucaguuucuagagcugaagauucauuucagacacugcagugcuaacgaguuaugcucuucagggagcugucuugggacucacaucuuuagacaggugcagccugaucaagaggcuccucacugccucuaucuugucucuaaauccuagcuuugaguacagugaccugagcacuuggccuuccagggaugggauucugccagguucuaaguaagaccuacuccaagcauauccugggaacaugccucccugauacucugcuugccagcagggcacagcuaugagucugccugccaucgugggcuagaaaggugggaacaucacuguggacuuggcauaauaaggcucuacagaggggcugggaucugaacuagagcauacaaacaaugaagucugggaugaauagaugcuuguuuuguuuuaugagaaaggggugugcuggcuaguuuugugucagcuugacacaggcuacaagucguguaagagcaggggaucucaauuaagaugccucuauaagaucaggcuagaggcaaaccuguagggcauuuucuuaauuagugauggaugcgagaggacccagccuauuguggguggugccagccuugggcuggugguccuaggugcuguaagagggcaggcugagugagccaugaggagcaaggcaggaagcagcaccccucuauggccccugcaucagcuccugccuccagguucuugcuacguuugagugccuacccugaccuccuuugaugauaaacugugguguagaagcacuaacagaauuaaacccuuucguccucaaguugcuuuggucaugguuguucaucaugcaagacaagauagccucaagaaaggacuacucuuuagcccaggcuagacuggaacucacuauguagaucacacuggcuuuguacuuacagcaauccuacugucucaguucugauauuacaggcaugagccaccacuuaguccuagucuuaucaaccgcuaaaucccaugcuacagagagauucgaagucuggccuugauauccuggaacugacucugaaccuaagccugugagagauggcacagaggaggccguggucucaguaucuggggcuguacaugggauuguaggggaagaaauucugggagugacauguugagaucaguuaggaaccaugcaggugacuguaaaguuggaggaaugcuuccaggaugccuaagaagaguugacagggacuucugugagaccccuugacucuaguguagagcaagcaaggcugggagaccugcuuagaacaccaagucucaggacuuuauaacacauucuagauaugacagcaguugguguuuugggagggugacugaacaagcaaugcaugcagacgggauuugagccacaucaaguccagucucaguuuccaagcauuaucuacucccaggagaaaacaaaggcacaggguguugccaucgcagaccaccuaacaccagauucaagaagacgcagccacaccgaagcccaggcagcccucacuuacuucucugaggugauuauaggcaugucugucugcacaccuggaacagaaagacguucuauuaguuccagacagacuuccuuagagggaacaaaacccacuaaaacccuaaaaagacagauaauuucaagaucacacagcuaacugucuacuggccacagccagcuucugaccacuguccuuccgugcaaccacaaccucuugcuggcucagguggauccucagagccuuagccccagcucagaagcacagauaugcaagaggucaguucauaagugggaugcuuggggccuguguguaagcuuagcuuucauuuccccucuguggcuggagagacccuugauggugguaugguuuaggguacggaguugggggcuucagcucuaccucugggugucaaguaggauaaggccuuucuucuaaaguguuuuccaagucacucaauggucuagcuuuuacuccugcucuucauucugccuuuaggauaaauugucuccucucccaaauucagccuuguggugguuugaauaagaaugccccccaccccacaagcuccuauuggaacacuuacuuggucacuaaggaguggcacuauuugaaaggauuaguagguguggccuuguuggaggaagugugacacuggggacaggcuuugagguuucaaaaagcccagucucuuucugucuuccugcugucuguggaucugcauguagaacucucagcugucccuccagcaccaugucugccugcaacaugcguccuaccaugaugauaauggauugaaccucugaaccuguaagccagccccaacucuucccaugaacagaacacugacugagacaagccucaccugcacgcuaaggagguuugacucaaggcuccucaguuugaugccuaggaggaggcaacgagucugcugagauggauucuggggugguuuauaaagcagaggcauugugacaggagacaauggacaagucucucucuugaaggcuaaauaguaggugacuauuccucaagacagcuacugccagggucguuauauaaccaacuggauagaccuagccaauugauuaaaaaauauuuauuuaucuugagacagggucacauuauguagcccugacuggccuggaacuugcuauauagaucaggcuagccuugaacucacagacuucugccugccucugccucuagagugcuggaauuaaaggugugcauugcugugacuaucuuuaggacuuuaaaguuuuauuuguguguguguguguguguguguaugugugugagagaguguacggguguuuaucucugugaguguaugagcaugcacguguauguaugugugcaugcauguguggguaaguguguguauguguguacuggaguucagaggguugugauuggggagccaaacucaagucuugggcaaacccaguaagugcucuuaauggcugagccaucauuccaguuggaugcaguauuucuacaaaagaaggauuacuuugaaauacuuacacuuuaucauuggugagccucuaaggcagaucugcaaagccugaccccccuuuugggccccacccauagcucuugcugugugcugggucagaacccaggcuggccacauacuagacaaauccuacaacauucuuuuuuuuuuuucuuccuuuuuaagacagggucuggcuauguaguaggcuagccccaaacucacagcaaucuuccuauuucaguacuucuaaucuacacugcuacgauuucaguguucuucaucaugccugguuuuuacuuucaguauugauugauugauugauguccauuugcagcuagcccaggcugccuugaguucacaagcuuccucucggccuccuaaauaguaggauaucagaacugcacaaccaaguuuggcuuuauucuuucuuuuuaacugguacacaaaaacacaaaaucuguaacaucaagagguaacauggcuuccauccguguacacuuguguaauuuuuaagucaggccuaaaucuaccuccucaaauccuuucaucuucaaaaacaccauggauugccuuuuaaaaaagaaacauuaaaaaaaaaauguguuucagugcuuugccugcauauaugucugugcaccacaugcaugcggaggucagaaaaaggaauuggcuccccagggauguaauggauggcugugagcugccaugugggugcuaagaacugaaccuggguccuaugcaagaguagccaguacucccaaaggcugagccaucucuuuagcccccaaaaugcaucuuucuuaggcuuccauuuugguuuacccacagcucacagcuuuaugcucucauuuaauaucaucacagugaagccacaaccccauccugcuuucugcauuucuaaggccaaggcuagcaggcagccuuccuggagguagcccacugguuuuacaugcucugugaugggugagcucgauggcaaggcaaagagacuucaucucaggaucgcuucuugcagcugauauggcuuuccugucauuauucaauuaauauaacaaucccuggccauuagcccacccuauugagcagauuuccugcagaucaacaucaagaugaacugucaugaauuaaugcuauuuagaugaauuaaugauuuuuauaggauuccugauucaauucaaauaauuugaggaagaaagguuuuguuuuguuuuuuuuuuugagacaggguuucucugcagagcccuuuuguagaccaggcuggccucgaacucagaaauccaccugccucugccucccaagugcuaggauuaaaggugugcaccaccacagcccagcuuacuuuuaaaucuuaaauucuacuuauuuauuuuuuugugugugcacacacacacacacacacacacacgcacgcgcgcgcacgcguggaggucaaaggacagcucagaaaucaguucucucuuuccaccauaugggucugugauaauuugacuacaucugaaauuaacuaaaaaaaggcaaguaguuggaugcagguguaagaaguuuuucuugauugggucauuugagguaggaagacccacucuaaaucugggccauuccuuuugauggcagcccacauaaaaaggacccagaagaaggaagcuuucgcuuuuugccugcuugcccucacuuuccaguucaucuaccccgcugcuguggcauuccuucacuggcguuagagccuacuuccucaggguuccaagguugcuaaagaccagcuaagacauccaguauuguggacugaaggacuauuggauucuuggacuuccuauaaggagacggacagccacuguuggacuacuggaccacagccuguaagccacucuaauaaaucauauaaauauauauauaugaacaaaccccuucaucuauaaauauauaacaauauauguauauauaaauauauguauauuucacacacauacaaacucuuaacacaguucaucugggagaucuaacucaggucauaaggauuggugauaagcacuuuuauccaccaaguugcccaccaccaggcccauguuaauaaaucgguuuaacaaugccaugguuauuguaaauucuaccucugaaccaacgagcuccuuuugacagcagcacaggcagggagaaguuccuacacacagcauccuaccaggcaaaguguaacaaaaagcuugauuaauaguuuuccugucuuugaggggcaaaggauuggaaucaaggcccuauauguguaaaggcuucuaaccauuccagaaggaaggugcaacgcauuuccaagaacuagaaaagauccuuuugccugaucugcuggcagaugggagacucugaguucaaggccagccugggcuaaguagugagacagucaaaaaaaaaaaaaaaaaaagucaagcuaaacagaacaaguagcuguuuugaugcaaauucuuguagcugcucugcucuucauugucaguguugccucucuuucagaacuuaccauguccccaggacucguaagcaccaaaugagagcgacacggcuuaccuuuccaucuggcagccagcgugggguuggcgauugugaaguuuggacggcuucuggaaagaauccccuuuccaaaguaacccuuucaagaagagacacgggcgcugcucagugguuaggcuccagcugcagugggguacacuacucaacagccucacgucuccccgauuuccuagugaucacacccccaccucugcagugcguauaguguguguagguguucaugugcgagugugaacaugugggugugcaggugcacgugugcacaugugggugugcaggugcagugugcacauuugggugugcaggugcacgugugcacaugugggugugcaggugcacgugugcacaugugggugugcaggugcacguguguacaugugggugugcaggugcacguguguacaugugggugugcaggugcacgugugaacaugugggugugcaggugcaguaugcacaugugggugugcaggugcacgugugcacaucugcaugccaucaguguugacuauuucccauagggcuggggucugaacuuaggaccuuguguacucugcccacggauccaucucugcagcccuccagcuuucagcaccagcucgucuuucucaugacaaauuacccuggccugugucuggcaucccugaaggcauuaggacaggcaggggcagcuuuuucucacauguggcccaggaacacaguguaccugggagugagagcuauacccacugcagacauagguauucuuggauucuucuguacucuggagaggaagugucccucucucuccugcuguuuuccccgaaauacauaaucuuccugguuuugauuauaaauaaacagaaaaaaaaucaaauaguaauaagaugaauaaaacuuauucaguauguguaaagccucauuuuaccuuagucacaaacaaaggccucagcagggaacuguaggcacauaggacccaaugaggccuuaaugcaccagguccccagggaccccgaggcugaggccccugacauuacuguaaacucucuagagaagguagaagcgaggcagaaugccugucauaguccugagcugggagcaggagcaggauucacugucauagguggggauggcaguggggauggcagguacaguucagagguggaacacaugauccucagugcaaaccccagcaccaaaccaaacuagcaaacccuaacacuggauucugaugacagaacacugcuccauuaauuuauaaugucacugaauuaaagguaugcuuauaaggagugaacaucauggcuauaaacuacaucucaaucaguuuagguaaaaaaaaaaucaauuacuuuuuaagaccagucauauuuaauuuauguguauggguguuugccugcauguaugucuaucuguauaccauauaugccuggugccuucagaggccagaagaggguauugaaucaucuggaacuagaauuacagauaacugugagcugccauauuggggcugggaucagaucuggaaaagcagucacugcucuuaacugcugagucaucucucuaucaggcuggcuuuuaaaguguccuagcaauaaaaacgagauggagagugggucucaucuguuguccugucuaacaaaugccagcaaggagagagagagagcagagauguuggggaacuuuccacaggcccuggcucaugggucccaugccacuguguagugaccucugggaagggacaggagucaguagggaugacugucaagucuuuacucauuaucuuucuguaaauuacuucucugucuuuacuauacagcgcuucacccuguguuuuugguuugugguugggcaugucuagcucucaggcuuacaguugaaguuucagagcugcugcuuauaguugguucugggaggaaccuggaagaggagguggcugcuugggguguccccaggaaggaaccagaacggccugggcuuaccuucccauacagcugcuccauguccucugugccccucaccaccacauuguugcuaaucauuucagccuggaauauucggaauuccuuccugggaccuugguccugaccaaaggggaugggcaguggugacucguaacucucauagacucuucuuuuccucuuaggagcacggaagacugccucugccauucuucaaggauaacaggucucuagagaacaaaggagaggaaccagucaguaaaaacggaccaucagagccagcacaaucagaaccagguugaccuggucucugggggaaacaaugaacuagaagacaccauguaauaaggacaucagucacggggguaucucagaugcuaagaccucuaagaagccagugccaucaccuuaacugaagcugguaacaccaaggccuuaagaauuccugucuuugagccaggcgugguggugcacaccuuuaaucccugcacucaggaggcagaggcagauggauuucugaguucgaggucagccuggucuacaaagugagcuccaggacagccagggcuacacagagaaacccugucucgggggggggggggguguggggcagggagaaggaaauccacgaaucauagcagagucacugucauuuaggggccaguuauguccuacgaaacgccagugggugugugcagggacugaagccaggcuguccgugcuguauucuacccugugugcuggcuaccgcaguguacacaccaccaucaggaagcugcugcaucuuagcuggaaaaccuuugguaaaagucccaccgacacugggcuuuagcucaucuauaaagggguagaaacccagcuccucacagccaugguucacagaggacagggccuggcagaguggcaucacccagacucugaugaugcugguuaugaagugagcgccagcaaugccauuuuacagucaaggcaacacucaggucagugaggcccguaagggcccugugaaugacaucacuggauuaacaucagggcugugggaaccagagcccaggcccucucuguggcuccugcucagacacagguuugcaucuguuuacuguggucuaggucugagugagaugccacacagcuaccaaccagguagagacuuaccuagaaggauccaaggaagcugaugugaagaccucuuuauucugggucuuacuuauucugacccaaggagacaaaaccaguguggaauacacacaaaagugaguuggaugugacacggagcuggggccggcuaccagcaccgagcauugcugagucacagcccaugcaaguguguacauuccaacugacagacgcuucaccaggccggugggggauuugaaccugcagcugucuagggucaggucuacacaugacuuaaacugggagcuuacugaggaggugggugucaugaccauuaaagaggaaacgauguggcaggagcacugccugcucuuuuagaggauucagguuccacccuccgcauccacaggguaguucaugcccaucaguaacuccagucccaaggauccaaugcccucuuuuggccucuguggguacugcaugcaugauaagcacagacaagacacacaggcaggcaaacaccugcaaaaugacagucgugguggcgguggucauaacagaaacaucaagcccuggccaagguguucacgaaacuucucaugaagccaggaaugucaauaaagacagaaggaaagauggaccaaggaaguuagaacaauggacaagugcgugucaaagauaaccacgcacggggauggagagaggcuugguagguacucauccagaagaaagacccagguucaauucccagcaugcacaugguggcuuaugcccaccugcaacucuagcugcaggggaucagaaagccucuucuggcucccuggggaacaaaguacucgaacguuacaugucauaaagcagauacauacagccagguacauauguauaggguagaccagaccaggacgguggucuggaggacuggauauaaaggcuuuuaguugcuucuuuuccuagugcugggaauugaacucagggccuggaucauucaaagaaaacucucuaucaaaggagccacagucccagcccagccacauucuuuuuuuuguuuguuugcuuuuuuguuuuuucgagacaggguuuuucuguguagcccuggcuguccuggaacucacucuguagaccaggcuggccucaaacucagaaauccgccugccucugccucccaagugcugggauuaaaggcgugcaccacuaucgcccggcugcccagccacauucuuauucccauuguacaagugagaagaauggcuugcagcgugugugugugugugugugugugugugugugugugugugugaauguaucugcaaagacuguuaaggagaaaccugcucaugccugucaccagagcaccacaaagcauauuucuguccaucaaaagcaaggccuguccuucauucuucucuuaaucugcuagccuaauauucauuuaaaaauuucgguuuugcugacacguggccuuguuaugcagcuuuggcuagcuuuaaacuaugaucuuucugccccagccucccauguacuacagcuaaaagcacgaaccaugacacccaauggucagcccaaccccgcucuauaugcuucuaccgucaauccaagcacaaagcauacaguaaaagguggguccauaucacuuuccaacacucuuggaucaggggucaaagaagccucucuuauggcaaacuuacucauggucucuuagcauguauuuuauuuauuuauuuauuuauuuauuuauuuauuuauuuauuauuuugagaugaggccacacguagcccaggcuggcuccaaacgugauauguagcugaggaaacuuaaaaccagcuugaugcucucgcuuccaucucuggaaguugggauuacaggcgggcagcagcuugguuggaugcggugcuaggaguagacaacaggcugccaaccgagucccauccucagccccucgugggcuccucaucauuugcaaacacacuuucaucugugucccccacugcacagcuccugggccgaggugcagggcugagggccaaggcagaccagcuuggggcuggggcagauggcaucugucagcgagagcgaagcgcuccgcagcccucgggacgcugugcccaugcgcgcuugagugacagccacagcucccaccccgcucccgccugaagucgcucgcacgcuggacacagaacgcgagaaacaggacuacucagucuuaccuuucgccgccacgcgcgcccaccguuacccggcaaccggggggcggcgcugcagccgucaagcag

SEQ ID NO: 3310 - RNA, 9042 nt, Mus musculus
gugagugucaagacaggaagggaauuuacuucaguguggccaacaucaagaacacgucuaggaccuuaaguagggaaagaacacagaagcccagaaaccacacagcucugaugugggacagugucccaagggaagggcauucugagacacgggagcucagaaaccacacagcucuugagaggaagccuccucagcggaggcuuugcagcucccaggggagguagccucagcucagcugaggagcucagccgccucagccccacuccuuucuuugucuucaguacuucuuuucuucauggcuucuucugacaagagaguuacaccaagcagccauggcuaagggccagguuagccacuauuaccucagauuguuaucaccugagggggugcaguuggaugcccugugauaaggugucugguguccucugccgugaggcuucgggugucuugucaguggugugguguuggguguccugcuuucaguuuguucucccuagaauuugagaucagcuagggaagggaaaaacccauaagagagagcaagccagagagaaaaugaaguaaguuagaguucuggccucucuguuagaaggcagaggaaggugugugaaggacaguuucaagggcgcuucuguuauacuugagggggaggggguuaauuuugaguuauuauuguuuaauguauacggguauuuugccuuugugugucuccaccaugugccugaugcccacagaggccagaagagggcacucacuguauccucuggaacugaaguugccaugugagagcugggaauugaaccaaguccucugcaagaggaacagaugcucuuaagggcuaagccaucucuccagccucugcgaccuuuguuucuguuuuguuuaguuuaguauucuugacacuccaaagguuagguuuucuacuacuuggcuucguccccagccuucccaugagucuucaggcucagacauaagacauccauauacuuucagaaccugugucugucugucucucugugucucugucucucugucuuugucucucucuuucucuaucccccccuuaacucuccucucucuggucccucccucuuuucauucacaucaaaaaguaagugugcucaguucaaauucauugacacaaaguauuuucuuugaucagugaauacuguucuuccacucugauuauagcagauucucagcuuaaaaacacagcuguugggacuggggagcacugacugcucaagagguccugaguucagaucccagcaaccacgugguggcucacaaccacuuguaacgagaccugacacccucuucuggcgcgucugcagacagauacuuacugucuucagacaguagacuuacuuauaauaaaaaauaaaucuuugggccaaagcaagcagggacugagugagcagggucagccagagugagcgggguuuaccggagugagcagagguccuaaaauucaauucccaacaaccagccacaugaaggcucacaaccaucuguacagcuacaguguacucauauacauaaaauaaauuaauaaaucuuuuuuuuaaaaaacauaacuguugaagaaauuuaguuguaaugauuuuuuuuuuuuggaacccagggaauuuuuuuuuccuuaaauuggggguaugguacaggggacuggaccuaggucucuuacaugauaggcagauaguucucccacugagcuacauuuauaaaucuguacuaccgucuaaaggcaacaaacccaacuguucugucucaacggcccucagaugcagcauuugguccagucugccuaagaggggcuuguccgugggucgggauggucagucacguggaagccgcucucuuggauggcccugaagagcaugauguacuuggaggccaggcgcguccucgggaucacguacuuuucugugaacgcgugcuuguccagcugcucucugccuuccauggcaaggaugcaguuaaugaaggcgagggcaaaggucaggcaguugugcugauucucuucauaccuugaaggaacgagggagacucagugagguaagacagucgucacuggucuccaggcuggccuugaacuccugaccucaaauaguccucccaccucagcgguuacaccugaggcuaccaugcuggccccugagaaugcuaacaguaaaggcugaucuguaggaaagacacccacaccaacgcagacaaucucugggauucacauggcagaagggaagaaccaacucuuugauguuguucucaggccuccacacaugggcuguauaugaugcacacacgcauacauauagagguaaauaaaauacaugaauacaaugucauuuuuaaaaguuuguuuuuaaagagaccaggcauagagcucauaucuuuaaucccagaaccaaggaggcagagguagucagaucucugugaguucaaggccagccaguucaaagugagucacugucuccagaaaaaaagaguggagauggaaaaaaaaaaaaaaagaaauuaaucucaaaucacuaaaauaaacaaaagaugcaacuuaaauauuuuuacacaguaagcaauauuuugaaaguuuuagauaugccaaacauagugguacacaccuuuaagcccaaaacuccagaggcugaggcagguugaucucuaagaguucaauaacugacaagcagcagauucugggaggagggcuuuauuugggcucugagggaccuguccagccuagcauccugugggaaggcugguggcagcaggaguuggggccacugcucacaccuccaaggagcaaagggcacaggugggacaggaaggaauucagacuccaaaccccaaggcccgucccaagacaccugcuucuccagccgggccccuccugcucccgggcucccucccaaaauagcacuggcaucggugccacugaauaucaaaauacaugacucugugagggacauuuucuagcaacuauauuuagcuguucucacagauugacagucaagacaugaacugcauuaaacagcgaugaccguggagugacgaggaugcgugacaaauggguggcaguggcuugcggucuuucuagauaccuaccuaugaggcagccaggccagcgaagcagagaagucuuccaaguacuugucccacugguccagcaguccaaacaugcuaggcuguacuaauggaacacugagacuucgcucccagccugccucgucucgcuguaugccgcgugcacuguaauuauacacgaccccugaaaacacaaagcagucagccacuccguaaaaggugcucagaaaaugacaguagggcuggcgagauggcucaauggguaagagcacugacuacucuuccgaaggucccgaguucaaaucccagcaaccacaugguggcucgcaaccacccauaaugagaucugacgaccucuucuggugugucugaagacagcuacaguguacuuacauaaaacaaaaauaaaucuuuaaaaagaaaagaaaaaaugacaguagccaaauccugugaaucugggucauacuugucugcuacugucagagcagcuguccauccaaagcaguggcucucaaccuuccuaaugcuguccccuuuacuacagcuccucauguagcggugaccccugaccauuaaauuauucuguugcuacugagaugccaaaucuucuaaauucagguuuagaggacuugacauaaguuugaacccagguaaacuaacaggcugguaccuagcauuaguuuccaaguugccccccaacaaaaccugagccuagcuccagucuuuaacuuaaucccccaaaagaccagcauuuccagguuacacccucaacaaaaccaguggcuccagguuauucccccaacaaaccugcaccccggguuacaagcccaaccucugccuaacgaccaccaaugccgaggggagcagaaauugaguuuaugauaggacucccagaccagccaauuauguuaaaggccacaggagcuuuccaauuagaugcuugcacauguacccccugcuugcugcuuacucuaaagccuugccccugcuugcaccagggcuccccaccccccaaaaaagucuugcaugauggcagugcauugaggggggggugggugcauuggagugugcuagcuuaaauagaauaaagaccccaaugugaguugcaucagauuggcuccugucuguuuuuuggggaucagcauuuuccuggcacaacacuacuucagaacuguaauuuugcuacuguuaugaaucauaauguaaauaccugauaugcagcauaugugauaugcaacccccaaagugguaccuggcuggaggaagaguuucuugggauagaccgugggauuugggaccuguuuccuuccugucgcaccugggcccuuugcuccuuggagaugugagcagcggccucacuccugcugccaccaaccuucccacaggacgcuaggcuggacaggucccucagagcccaaaguuggucuugaccccagauuaagaaucauggaucuagugagauuuagaaggggauguuguuguuguuguuguuauggugguggugacggugauaaugaugaugaugaggaggaggaggaggagaaggugguggugguagugguggugguggagguggugguggugguggugguggugguggugguggugguggugguggaggugguggagguggugguggugguggagguggugguggugguggagguggugguggagguggugguggugguggagguggugguggugguggugguggagguggugguggugguggagguggugguggugguggugguggugguggugguagugguaguagugguggugguggugguggagguggugguggagguggugguggugguggugguggugguggucaaacccagggccucaugaauacugggcaaguguccuuccacuaauuugccccagggguagcucaguggccucuaaacuaaauccugccaacagaacauuguggauagucuccugcucuugacuucuguccuugagcugggacugaggcaagacacagccauucccaguccaccuuucuaaagcacaagaccacagaccucagcacaucccauuucauuccucaagcccgguguuggggggagaguggcgacucagaagccaaggguccacaugcugauucauacccaagaacugagaucuugaucgacucauuuuccuucuucuucuucuuuuuuuuuuuuuuuuuuuuuuuugguuuuuuuuuuuuguuuguuuuuguuuuuguuuuguuuugguuuuuuuuuuuuuuuuuuuuuuuugguuuuuuugagacaagguuuacaggguuucgacuguccuggaacucacucuguagaccaggcuggccucaaacucagaaauccaccugccucugccucccaagugccgggauuaaaggcaugcgccacugcugcccggcccguuucuuuuucuuaaaauccaacacagacgugugcagguuuggaaggcucuuuuugaaaaaacaguaagcugguuccagggcuuagggguguguggcucaguguccuuccuggguuccauguaggccucagcacuauuaccaagugguuuaaucuuccaaacccuuagacuguaagucgugcuaacuugccaagucacaugaacugcuucgggcugcggugggagaagcaggguaggagguuugcuuuuguugugaccucauccugccuggaaacccucugugggguuuucuuaggcuggggaaauguaggaaaugcucaccgcguguguuagugauuccaacgugcagaucagacuucccaucguacucccugaaacagagggguauuguuugcauuggguguuauuuugauauguagccuugcugcauagcccaggcuguccugcaacucaggaucuuccugccucaggccccaagacagcugcagcggcaggugugccagcucccccaccaacaagcacuuuauauaaaaagcaugggcguuuaaaugaggagggcauaggccucccccauagccugugcuaggccuugccaucagcuauaggcuggcuaaaggguucagcaaagcagagcucccauaccuccacagucgugugauggaggagcuuucuucucccucugggaguccauucaccaauccaccagcuaauaugagugaagguccuacagguccuccaccuucuuuuucguuugucuaauuuuuuuugcugggugggguuguuuuguuuugaaacgugguuucucugugaggccuuggcucuccuggaacucacucuguagacuagguuggccuugaacucagggagccuucugccucugccucccacacacuaggauaaaaggugugcgccaccaccacccugcuugguucucagccuucuuaaccacagcucaguauaaccuguggccacugcacucccuggauugcuguuucuuaccauuacucuguugguuugagguuuuucugguuuggaucgguuaguucuuggaucaaaccccgagucucacacaugcucagcacaagcuuucuaucccccacacacccuuaaacauauucuuuuguauuuguuugguuuuguuuaagacagaggcucaccauguaggccaaacuggccuugagccuauaagccaacaucauuuuuuuuuuguuauuguacauuaacaaaauaauaggcuucauuaugacacuuucugacaugucuauaaugugcuuugauaugaucugugcaccuugcucggcaggucauuccuaggagggcucaguccuggugucagcucucagguaacugauucuucaguaaagcaagcagccccagcuuucucaccauacuguucccucucgucaaccccaggggcuguucugagcuuacagagaccccaugggcuccgaggcuaggcuugagugaacaagaguccgugcugagggcugguucugccccucucugggugcuccacacuccucauuucccggcuccaucuuagccagaccaccaucccucccauaaauuuucagucguuugacagcucgcuggguguugacucugggccugacaaauaaggcuggugacacaggacagcaugaggcucugcccucuuggcuuccuuccagaaggaucauuucagcuuuaguuuggcaagucuauguuuucuuuaguucaagauaccagagacuggccgggcagugguggcacacgccuuuaaucccagcacucgggaggcagaggcaggcagauuucugaguucgaggccagccugaucuacagaguucuaggacagccaggacuauacagagaaacccugucucgaaaaaaacaaacaaacaaaaaaagauaccagagacugggcuacauagcaaguucaaggccagccugggcuaagugaacaacaacaaaaaguuaaaggaagguuuuuaagcaaaagagagaccauggaagaaaagggucuggaucuacccaaaggaaugaaaagcuccagaaaagaugaauauuugaguaauaucaaauauauguuuuauugaaagauaauuguauagaucuaaaauugauaacucacuuauaugcauauuuuccucauucuuaauauuguacauuuuuuaaauuuaugaguacagguguuuuugccucucucucucuguguguguguguguguguguguguguguguguguguaugcgcaccauguauguguacuacccccagagcccagaggagacaguuggcuucccuagaacuggagugacggauaaucaagagacaccguguagguucugggaaccgaaccuccgucuucugggauugcaaauagcagagcucucccuccagcccuaacacuugccucuuuuuguugaguuuucacauuuaacauuaaguuaaguuugcacuuucagggaaaaaaaaagcgaaugacuuuuuauuggaauuguauuaacuuguauguuuuaagacuggaagaggcucucugcuggcucaugucugugaucuuagcauucaagaggcugaggcaggagauucacauggucaugaccgcucuggucagcauagccaguuccaagccagucuguguuauuuauacagcgagagccuguuucaagggaaaagagaaaggcagcaggcuuaggagugcaguuuagcucugagcacguauccagcccguaugagacuuugaauucuaccucuagcacuguaaaaggaagaggaaaugaaaagaagaaaagggggagaacccucagacuuccuugcuaauuaaauucacccccaucaagaaccaucucuugcggauuguacuuugcucugcacauuguaccugcuugucacauaagcuaugagccgucgcuuacaucucacgccgauaacauucacugccuggcuauucccacccugccgcucagcagcacauccuuuccuccuaaaaucacucagcaggugucuucaugcaacucgaagccuuccacauacuacucaaaugugugcacaaaacccagggccuuacccuaggcaggcaagucccacacccuggccgcauaccaaccacucugauggacaaacaggccugcggaugaagacauaaagacuacagucuacccaaagcaagcccacacacacugcacugcacacauccuucagagaagguuugaugacuggcacacagcagaaacgcaugcaccgggugucauaacccaaaccacuguaccuaaggaacgucccucgcgucgguuugaggaggaaggcgcacuucucuugaugaccguuggagaauggaucugagaugcugauaggugcguccucuauccugguggagcccacgucccccuggcagagagggcagcauugggguacacugaagguguagauggaccucucgcagugccugaauuuaauuagaggcuucccagcuccuucgaagugcaucccgaaugauugccaagccaccaagacagguuucaggagacuuccuuuuccucauuauacagcuggcuaacucacaccaccugaguaaccuaa

SEQ ID NO: 3311 - RNA, 59552 nt, Mus musculus
gugggccauauugucgcaucaauuuuaauuuuuuuuucuuuuuugagacagggucucaugcagcucauaugaccgugaacucccgacccucuugcccucacuuuccaagcgcuggcauuacaggugugcaacaccauacuuuuaguuuuuggucaacuugguguacuacagcgaacacuccaucuacaaaugaggaaccugagguuucacauagcaugagggcuuucccacaaaaccccuaggccgccauucuccacggaugucaacuucggagaggaagcaccagagcuggagcccugugccgugugucaccaggcgcgucuggcccgcugagggccucgcggguggccggaccgcggcugcagcccaauaccacuggccuccaaccagaaacagucacucugcuaccacggagucaaccccgaaauggcggccgcaggaccgcgaggccacgcccccggaggcggggccacauuccaggcucgagcgauagauccccgagccgaguuuuaagcggacugccgagcccaggagcucgcgcagaggcagugagcccggcggcgccgcaggucguggagacgagugucgagcgcagggcuagcucgcccgggauagccugagagcgucuucuucgcgggugcuggugccgccaucuuggauggcgggaguuagagccgagcggacuugaggcgggaaggcuucucuguuguucuccgcaggcccucggacgggccagcuggccgagcuuuggggcgcgugcccugaggcgcggggcgcuagugcagcgaugcggggccuccccggggccccgucccccgggcuggggacacgccgaaugugaccgcaaccaacgcguucucucaaccaccgcugccgcugcacgacgggacccggcacugcccggcucccucagguaggccacagggcugacggugcgaccguggggcgcagggucggccaggccgcugucauccugguggcgggccgggcgcgggccgggugucauggccggcgagccaguuuccacaccccugcucagauuucccaguguuucucggaaacgugccagcgccacuccggugcccagcgagcauuccucauauuuuggcaaugggggaaaaaaaauccucccagagcugcccagugacuguguugucacugggaugggcucguucuuuuuucucucgggcugcagaaguggggggagcccggccuugcaccuccucucgggcugcuucgcuuaagugacacccuuuuagggaagacaagaggaaucggggaaggcagcgagagaaaccggucagggucccgccucaaaggcuugcgaccucgccuggggcuuccaaauggguggcccgggaugcucgcgaucgggagccaggcugccuuuugugugaagcgacaaccucccaggcuuuugcagagccggugcauggaugcagaguugggacacaaacgaggugaccguguucauucauuguucucucuccagggcccagggugugccucugguuuucauucuuuguuaggagggacagucgaaucucuucuuucccgguugagacguaacuggguccuggggaaugggccaggucuguguauagaaguggggaaugaauucagggcacgucugaaugccugcaaugcguccuguggggucguuggagacucagcuccuggggcgugaaaacaaccggaggugauaaggcuuguuuucccaaguguucuugggauuuagaacaguuaggugcagagucgagaagcccugagguuccuugcuugcuucugcgcggaguuugaaggacuguuccgccaggugaggcagaggggaggacauugucggcggagggaacagcuggcaccaaggcucagaggcauagccugcgggaguugggaugauuugggggagcagcuaguaaauguggggugcaggaagacagacgucaggguucaaaaggaaaaauugaucgcuugugaagggucugugugauggauaguaaugaacuaguucauuuauuaauuaacuucauguugugaauguuuaguucuugcugguuacugcuuugcuccccucccgcuaugguagugaacaaaauuuaccuuguuaagucuugcuaaccaguuuugguaauugauagaaaauguuuugugcuugcuugaucacugguuccuauuuggagauacucuugcagcuauuucuaagguuaacacauuccccaaacagacagaaauuggcagauuauagaaagcaccugaagaaguguagcaugaaaguauuuuuaauuaacccuauuuauguaguagacucuuuucuuuggacagaguccccagguugcagcuuuguuaagacgucugcagcccugugaacauucuucuucuaaaauagcuccuucgauuaaggcuuaugcugaaguggcuauuuggaagugaagacaucaggagcaguguccaaaucuuuggugcugugaaccacugaaaaccacugagguucuuuugguuugguuuuacucuuaucacuucaagggcuaaguaagcuguuuaaaauccagcagcaacauuugaccuagccgagacuggagacuuggaaaaauaaaccugcugauguuucuguucugaaggcuuaucuucaggucugcaaggcugugauugugcccucaagugcgaucaggcagcuuggugaaggucuuguccauaguugaaaagaccuugugugccugugaaguagagggcuugacugaagggcauuugaaugcauuuuaagggauuuggcccaguaguaaaaagacugagaaccuuuuacuuauuuaugacaaaaaguauccaaagauuaacaaugaccugcaucacaacugcucggaacccagcugcuuuuggcuucaagucaauuaugcucugaugauuaagcuacaugacaguuuuggaaguuaauuugauauuugcagaaggacuaaauauuuuuaauggaaauacaaugacuaacuucaaauugcucuuuuaggaagucuauuaaugaauguuugauuauuuaauguuaaaauucagacagaagguuguuacucaccugcuaccuaaaaacaugaaagaaugcuuugguuugccuguuagguuuacuaguaaugagccugaucuugggaggagcuuguuaacuaaacagcaugccuuaauguugacuugcagaucagaauuuaaauauugucucugccagacagugaacaaauguaccagugaggggcuuuaugaaaccuuaaaagucaagcuucaacuuaaaauuuuguuguguuauuuuucuaaaguuguaaguagaccauaaaaaaucagaaauguuuuuuuuuuuccuuucuugauuuuuuuuuuccuggaucucacuguguaguccuuggaugaccuagaacucacuacguagaccagguuauccuugaacucauagagaucccccugccucugccucccaacuguugggauuaaaaguguagauucuuuaggagguuguugaguuuuuguuuuguuuguuuguuuguuuuuauauguguacacauggaugggugaacuugcuaauuguucauccaguggguucaaaauauacuaauauaacuaaauauuuauguuaagauuccucuguuaugggguaggucuaaacccuugucugcaauccuaggauaguaaugucagauuguuuuauuuugaccuucaaaguugugaguaaaaagucuuuaguuagucauuaaaauugacacuuaaguuuuguagugucugagucauucuguuacuucuuugcucccaggauuauuuguauagcucuuagugauuuuaguuuuuaaaauuuuaauuauccauguauggguauuuugccugcacauaugucugagaaccacaccugugccuauugccuuggagguuagaagcgggcaucaucuggagcugaggucacagacaguugugagcuagcuuggggguggguccuggaaacugaacccaggucuuuuaauugcugagccaucucucuagucccuuagugguuuuuguuguggugauuguuuucauuuuauuuuauguuauuuauuuauguauuuauuuuacuuuuauuguacauguguguauguuugugugucugaguguauaugcaccaaugucugcaguguuaguggaggucggaagagggcaucagauccucuagaguuggaauuacagguggcugugagcuguguggguucuggaaacugaaccagauuuucugcaagagcauuaaguacucuaauugaugggccauuguuccaguccaacuguuguuuuuaaguacauagucucagggcuggagaggugguucaguagguaagaggacuuguugguuuugcagagaaccugggugugggugacuaagcacccacauggggguuuacaacugucuguauauaacuccaguuccuaaagaucuggcacccucuucuguccucaugggacacaaggaaucacaugauacauagacauauaugcaggccaaacacccauauacauaaaauaaaaaaaugcaugcuuuauuaaauauauauauguagacaaggcuagccucaaauuugugaugcuucuguuucaguuauccugagauuugggauuacaggugugugcuacaacacuuagugauuguagacgcucgaguucugaaauuguacugagaaucucaguuuaacugaaggaaauuucaaguggaugguauuucuuuguuauuuauuuagcuuggugcaggcuauuugaauuuucuuuuuuuaauugcucaguguguuaauuggcauuucauuucagucaguguacauaguauauuuugaaaaacacuugacacaguucacaguuuuauuuuuagaccagguucuaaaggauuuaguuggguguugaugaagaauucuaaaagagcuauuuuagaauuugcaaacccuugcgauuuagcuguauuuacauuuuugguuaaagaauggaaaacagccggcaaugagaguuuuuuuuuuuuuuuuuuuucucgagacaggguuucucuguauagcccuggcuguccuggaacucacucuguagaccaggcuggccucgaacucagaaguccgccugccucugccucccgagugcugggacuaaaggugugcaccaccacccccggcucaaugagaguuuuaaguaaacucuuguauggcacauuccuucagugaagugguguggucuguguuguguagaauuacuguccucugucugucugucucugucugagacaggguuccuuugugguccuggcuguccuagaacuuucauacaauguagacgaggcugaccugagcacacagagauucaucugcuucugccucccgagugcugggauuaaaggugugggcaaccaugccuugcuucuugcccugcuucaucuuccuuugucuaacuauuguuucuaauuuauugucauccagcagcaagaguaaucacacugacugcuugaaucaaguucuccccucuuuauuuccuuccauccuauuaugaaguaaaaguucucucugauuuuuuccuugacucuguaaugagacaugauguuugggcaaaacaucucccuuuucuguuuuuauggauacaguccuggggauuaaaccuagggcuuuaaguggaccaggcagacauugccauuaacaccgccagccuguuugccuuucuucagcccagcacaucaauguagaagaaucagagugggcugggauugugugcucaucucccuccuccaugcugggauuuggucuggugugcuuugcaaagguuuuguacauauugucccaauugcugagaguugauauaugcagcugcucuguuguguccagagguguuuccuuguagucaccacugccucuggcacuuagauguucuccugccuucuguuccucaguggauccugaaucuuuugagauguagugugucuuuucccuucaaggcugaacaugcugcagucucuuauuuucugccucuuggccaguugugggcacagcacaguuaucuacugcaaauagaagcuucccagaugaagguagagagauacacugcacuauguaucucuauguaacaagaagucuuuuaaagagucaguuuaauacugugcucuuuuagcagccuaauaguaguaaauuuuccccuagggccuaugaccuauguagucauaggguuuuuagcauaauaauguuaccagguauuggguucuuacuguggagugggacuuaaaauccaaucagaaaugauugguugcucacaugcuguuugugccaccauuguaccaguggguauguccugccaggcuagucauuauuguagcuugcuuuucuccuuuagcacugugcauagcacucuccagcccuuugaaagcuagccaauaaaggugaaucuuccagguccauaccagcuuaauuucaccauguccuaugacucaaggauguggugucuucagcaauggaggauauccaagaacagugacaauauccuguaaugcugggagggugguguccgugagaccucacuaaaguaguaagccauuucuggcaugggucuuuuuauuaguaagcuucugaugucuacuacuuguaacucagcuccagggggggugcuucugcgcucacaugcauguaccccucccaugcauguacauaacauuuuaacguguguguguguguguguguguguguguguguguguguguguguuuagauauagauauuuuccaugugucuuuuuugaaaggucuuucucaugcucccuccuguacccuacuuucuguucccaccccaguuuaacccuuccuguuccaguauucuccuuuaaaucuuuuuuuuuuuuuuugguuuuucgagacaggguuucucuguauagcucuggcuguccuggaccucacuuuguagaccaggcuggccucgaacucagaaauccgccugccucugccucccgagugcugggauuaaaggcgugcgccaccacgcccggcuccuuuaaaucuugauuccuuuauguaguuggucuugaacuugcuaugcuuccaagaauggccuugaacuugugauuuuccugccucuacuucucaguugcugggauuauagacuugaguccucacauccaauuuaugugaugcuaaguaucaaacccaggaccuccugccccagauuuaaaagugauuucuaauuuauuuacuuuacauauaugaauguucuaccugcaugcauguaugugcauccugcauuugucuguuggauucccuggaacuagaauuauggauggaugaugcauacucauaaucacccagccaugugggugcugcuggcaauugagucuggggccucuguaagagcaagaaauggagccaucucuucagcuacuaaauuucuaaauuuuugagauaggguuucauguagucuacacuggcuuugaauucauuauauagccaacucuagccuugaucuaauccuguuucagucucccauaugcuaggauuacagguguuuguuauagccuacgaaaaauuauuaagauuaugugcaugcaugugccuguugggguacaugcaugugaguguagaagccuaagguauacgagaggcacuagaucucccuggagcugaguuacaaguagauguuggucacccgacacagaugcugagacugacucaggucuucugcaagaauaguaaauacucuuaauuacuuacccaucuaucuguccagcgcacgaaugaaggucagaggaagcagucuauucuuucccucuaugcaaguccugggaauugaaucgagaucaucagguaagcauuuaaccacugaaccacuugccagccuuaaaagcgguuuuuaaaaguacuaguagagggggcuggugagauggcucaguggguaagagcacccgacugcucuucugaagguccggaguucaaaucccagcaaccacaugguggcucacaaccaucuguaacaagaucugacucccucuucuggagugucugaagacagcuacaguguacuuacauauaauaaauaaguaaaucuuuaaaaaaaaauacuaguagaugcaagcacucuuugugaaugguacaggguaaugagugcaaguuguuacugugaaggauuuugucugauagaggagcuucgccaagcuuacugcuuguuguucuugcuccucggagagucacucccugaccuuuugcuuuauggccuuuauuguacaguuauuugugagcuccuaucuagguagauaauaaacuccaaugauugauuucuucuuuaugcuuauuuauugauauuuguggggaaauuucauuggagagguugagggaccaggcuguuugagaaugaauugaaaucccaacacuacuuguuuuauacuucucucugucugucugucuaucugucucugugugcagacauguguacauggucagaggacaguuugcaggaguauauuuuccuaccaaguggguccucaagaucaaacugagguuaucagacacuguggcaagugucauugucugcuaagccaucuuacugguccuauucuaugcuggguaaucacaggcuggcccugaguccauauucaucuuucugcuuuagucuccugagugcugggauuccagguauuguguuaucauguccaccaacacuaagcuuauguguggauuuuuugagcagagaucuuuuguaguugacguuguccuguagcucuagcugaggaugaccuugaacucccaaacguuugccuucaucucgggagugcugagauuccccauguucuccaucaucguucuguugauucuguacugagugaugaggaagaauaucaugugguggaggcuacuugccucacgguaaacaggaagcagaaacaggggcccugggacaagcuagagccccuaagaacaugcccuuggugaccuacucccuaaaauuuucagaauuucccaagagcaccccacuagcugugaacuaaaccuuacuguaagagccuuucagcagagauggaagcauacuucauauccaaaccauuacagcugcuuccauuuuccuuuaaauugauauaaaguucuggcuaaguggugugggcuggcuucaaacucucauuuuugagcucuuguuccucuugccucaacuuucuaaguucuaggguuacagguguaaugugauagcauuugcaugagaaacaauuuuuuaaaaaucauuauuguauagggcaacuuuuaggagucaguuuucuuauuuuaugauguuagaccuggggauugaacuuggguagucaggcuuggcagcaaguuccuuuaccuguggaucugucuugcugguaugagaacgguuacuuuuucauucauucacuuauuuauuuagaaauaggaucucacuguguaucccuugcuggcucaaaucuugcaguuuagaacagacugucuuugaacucagagauccaccugccuuugccuccugagugcugggacuaaaggugugcauuaccauucugcaaaagacuaguuuuuaaaacuacuuguuguguauguaagguuugccacaaaaaugucugauuuuaaugugaaaugaagucauuaguguuucugucuggugagccugagugagauaacauuggcuuuugcugcuccuguucuccucagacugucacuuuagcuucuuauugugggcaucagacuuugcacauuguauauuuagguauuugugcuaauguucgacuuuguaauuuguucauuuaaaaauuauuagcuacuaccuaaaugaagaaguaguuacugauuuggagaugaaaagaaaagcugaguuuaaaaacaguucaaagccacaguuuuggcuguaccguugacaaucacucugagcagucagacucugagauagaaggaccacaaaagugcaagaccagccuaaucuacacagugaaacucaagaucagucaacuaaccagccagccagccagccacuggcuauccaaaacaguucaaaagauuuaaagaggauaaugaaaaaacucauuuuguggugagguaaaaaugaaauuggucccaggcaccuuucacuguggacugauuguuucugaacuaccucauacucaguuugcauuuuagaaucaguuacacuucaaaacaacaaaaucugcuucucauacuuggguaucgaaucuucgcuugcuaacauuuagaaggguagacugguccauuucuuuauguaagccugugucggccagucaucugaugaagucaccaguuuguggccagaaauugagaaagaguugaugaggaaacucaaaauauugacacauccugaccagcuugcagugcaugagacugcccuuuuggacugguugagaaaugguagcauaagccuugugcaaacgagaccauugcuguuuucuagcugggaugagaugagaaucagaacagcucauguuugcucagcagaaacuuugugaggccccuccccccagaauguaugcucaauugcagugguaucuucaaacugauuacuagaguuuuggcuucguagguguacauguccagaacauuuuauuuuuuuaaaugugauuuuauuuaguuaggcuccuuuaaaaacuguuuuuauaauuguguucauguggguucaggugccugcauaucucucucucucugucgcucucucucugucucugugaaaucacucuguagaccaggcuggccuugaaauaagaggucugucuaccucugccuccugaguccugggauuaaaggcguguucaccacuguuccgcaguguuuguuauuuuaaaauuaugugucucuguguagguuguuagugcaggugcuggugggugccuugaggacauuugaucuucuggagcuggaguuacaagugguggugagcuaccuaccuaacaggggugcucgggcuaagcucuaguccuuugcaagagcagcagcaaaugaucuuaaccacugaaccagcucuucaguucccagagccuuuuaaaaauuuugagaagcggagagauggcucaacaguuaaagaacauuaaccaaccuuccauaggaugagguuugacucccagcucccacccggugucucacaaccaugggaauccagacauacauucagccaaaacaccauacacuuaaaaauaauuaagaaaagaauuuggagauaaucugcaaacaagaauggacaugaugauguauaauugauacagaggagauucagaauucuccagguaaugugagcagaugguuuauaggcucacaguuggucagcccuuauuucagaaccuggagcucuuuuggaauagguaacauuguuagguagcuaacucaggaaaucuacucaggaguaguuucugaucaauagagccaucacugcuucuauaacaaagaacaacggcauaucauuugguagcuuaugcuaauaguuugcuuucucuguaaucuuaaaagacuaagaaacaugucaggcugcguagauauucauacuguaaucccagcagugaauaugaaggaaggaggguugguauuucaaggccgaccugggcuagacaaucaggcccuguguuaacagagcaagggcuggggauauagcucuguaguagagcacucacccugagcuuuauuuuccagcuccuggguuguggggcacagcauggugacacuagacauguacaugucaaguagaagagaaagcaacacagguauccugccagaaguucacuuagcucuuauuaccuuauuuugucuucugcuuucaagucaacuagaaacuggccacagcauguaacauuguagcacaauuguaacuuuaggacggugcccaguuuuuccaacaaguaggaauuucuuugucuugacuaaucuuuagaacuagucaugguuuguaguugagcagucuugugauuacauggggauuuauuuuacccaaccuacauuuauuaccaccuaugaggaaauuuuuucuguaauaaagauaaaaaagaaugauaacacaaaguuuucauguaugcauguacacaaugacuuaauagacauuuuaaucucuacaauauauuugcagauuguuagcugcauaaauagaaguucauaauuuuaauguaucuucuuucauuuaauggcuaagaagaaggaagggccaaauuggaaagcuugggaggaugacugcuaagagaacuacagauugcuaaugacgugucagcuauagucuguauuuucuguucugucacacguccuauaaauuacuccaaaguaguagaauacuagcaucauuacauaauaauuaccucaaguccagauguauauaaaauuuauaucauuuaagucaauacuacaguagaucaguaauguaaagccugaggacccgauuauuauuuuucauauauccguugugcauaguccugggucucaccaauuuguuuguuuaacucuuaaguuguucccuguuuuuuuaaagcuugacuuuuucuuuguauucuuuuucagguguagguaauuaaacuucaggccuuaucugugcuaggcaagauuuugaccauggaguuauuuccuagccccaaauuuuacuuuuucuucgucuaaagaagagauaagaaaaauacuugcuugauggugguggugguggugacgaugacuugaagcaggucucacuauguaguuaugucugcucuguaacuuaucaucguagaccagucugguccugaaucagggccacaugucaccaugcuuggcccugacuugauuaauucuaacaguacugugagacaauggagagaacuaaauaaacugucuucuacaguucugaguuucucuuuauugaugaagacuuucuacagucaauacuaaccacauaguauauuguuauauuuucagaaacuagagguuuuuuguuguuguuguuuuguuucccaagacaggguuugcccuaguuguccugaaacucgauuuguagaggcuguccucaauagagagaucuaugugggugcuggaauucaaggcuuacuaguuuuuuuuuuauaaaugcagaugaaauuuuauguauguauuuauuuauguaugugaguacacugcagcuguuuucagacacgccagaagagggcaucggaucccacuacagaugguugugaccaccaugugguugcugggauuugaacucaggaucucuggaagagcagucagugcucuuaacugcugagccaucucuccagccccagcuugcuauuuuuuaacuguagugauuagaccuggggcuaugugcgugggacauaagcguuugucacuuaccaccgagcucuaugauuuuaaaucgucuuacaucucccaggucagggacuggaauguuggcccagcaguucagagcacucacuguucuuacagaggaucuggguuugguucccagccucuacaugauagcaugcacugucuucaaguucaguuacaggagauaugguaccuuuuagccucugcagacacugcacacagaugguacacauacauacaugcaggugaaacacuuguauacauaaaauaaaauuauuuagaaguuuuucaggcuggcggugguggugcacucccagcacuugggaggcagaggcaggcagauuucugaguucgaggccagccuggucuacaaagugaguuccaggacagccagggcuacacagagaaacccugucucgaaaaaacaaaaaagaaguuuuucaggucagccuugaacuuacucuguuguccaaauagaccuuacacuugagacucuucugccuuuccuccuccucuucucuuuuucccuugugcuagggauugaaguggcuugggcaagugcuguagcuuugugucaucuuaguuugcuuucuuuuuauaaaauggauguuauuuauguauuuugugugugcgugcaugaaugcuguaguauguauagguaggucagaggacaacuuucaggagucauuuccaccaaguggaugcuggagauggaauucagguugucagguugguggcagccacuuuuaccaguugagccaucucaccagccuuguuucuuuguauuaaaaacuuauuuauuuuucauucauuugagugcgaguaccuuuguuacuguauaauacauacaugugaucagaagaaaaaguguagaaccuccuagagcuauaggugccuguaaguggccagaugugggugcuaggaauugcacuuggguccuuuggaagaguaguaacucgcaauugcugagcuagcucuccccccccacccccaauuuuauuuuuaagaugugaucucauaguauagcucaagcuggcauagaacuuacuauguagaacccaccccuuucaguuucauacuuuuaaaugaaagaauauuugaagaaaaacuccagaccuuagucucauguaugcaggcauaacuagaacuucaugucuagcugaguaugacuuugagccuucuucuggagugcuggccucuccacuccuggugcuaagacuuagguagguuucuuagugugaauguaauaacucauuugcugaagcauuuuuggagaaaguuuaaaaaugggcuuguauauacaguauuuagugcuuguagauguguccuuacuugggaaggacaauuaauaagauuuggcugguuuacuuaagcagagucaaggaauagugcagaacaaaucugacgucgagcuuuucaguugcuucuaaaucccuacccccuuucuuuuuugacagacugcccugccugggcugggacucuguagccuccaacucacagagauccgccugcuucugcuucugcuucuuuuguuuuguuuuguuuuguuuuguuuuguuucuuuuugagacaggguuucucuguguagcccuggcuguccuggaacucacuuuguagaccaggcuggccucgaacucagaaauccgccugccccugccucugccuccugacugcugggauuaaaggcuuacaccaccacgcccggcucugcuucugcuucuugauugcuggguuuagagguauguacacuaggccugccuuggacucuuuucagcagaaaaauuuaaacuuuugguucuuauagauuuaauucuggaaaagccucuggaauuagugagggucauuagcauuaguuauuuuuacuacaaugaaaaggaauuugcuuugacuuuuuaggagaggaccuauucaaaagcacccauaagaaaggcugugcgugcuucagggaggcucuucucugcagguaguguagaauagccuugcuggacugaaagaaggcauucuuucagucucuaauaugagccauguaccuuaagaugucaggacuugccuggcagugguggcacacuccuuuaaucccagcacuugggaggcagaggcaggcggauuucugaguucuaggccagcuuggucuacagagugaguuccaggauagccagggcuacacagagaaacccaguugucaggacucaaacuacuuaaaacaauacuguaaauucugguaaauguuacauuuaguaauuguaauuguagucucccuagauuuguuuuccuugaagguauuugaaguauaugcuuuucuugguuaaucuuacaccuuggauauggccuugcuuucuuauguucucuagcgucauguaauaaacucaaaagaaagccaacaagauccucccaggaccuuuaauaguuuguuuuuuaaauuaugcuuuauuaauuugauacuguuuauucuuacuccuuuuuuuuuuuuuuuuuuuaaaguugagauacuuguguagcccaagguggccucaaauucacuaugggaaaggaccaaccccugacccugggauuaacaaugcuaccaugcccaacuuuacuuauuuuuacaaaagguuuauuuacuauguguaugagugugcgcuugugugagucuuuuugcaccacaugcaugcaagugccuguggaagucagaagucaucaaauccccuggcaccggaauuacaggugguucugaguugccauuuaggugcugggaaccaagccuagguccucuucaacagcaggaaguaccuaaccucugaacucucucuccagcuccuuacucauuuuucuaaugcuauggauugagcugagggcaugcuuaacacauggucuaccauugagccacaccccaucccuauuuacucugcuuuagagaugccucuaggugcagaaauucacagaaacucauuauagagcagaaugaauguuaucauuaggcugaccagauggcucagugggcaaacugccugucacuggaaccucacaauugaucuuagauacauagugauaaucugucaaaaaagaaaaggggaguguggguggggaggggguucagaagccacacccauguagaacccauguagguagaacauauuucugaaagcuauccuaugauuuauacagauaugcaauccccucaccccaaugauaauagauaaaauaaauucaugaaaaaaguugaucugaauguuucuauguuuuagccuuaguaucagugugaaaaaucccugauguaagcagucugcaggaggaauuacuuauuuugguucaauuuaaaucaucauaacagggaaggcaugcuugaacaaaacagcucacauggugauggcuaggcaggagaaaggcgagagggagaaggagggggaggggcugaggugcucuuguccuuucccugguauucuacccgugucucccagcguauguauaggaaccauguggacuacacccaguaggggcccucuuccugugcucgguccuuuuugugaaacacuccuuccaggugcuucuccaccuagucacauuaauagccaucacaacucuuauuuuucaaaaccugguauuuuccuggguuuuggaugucagaauaaauuauacugguauccuuuggagagcucuucuuagaauuuacuaggaguuauacucagaaauaaauuugcuuucuugaauucauucgauuacccuaucuguguguauaugucucucuguguguguaacugagugcugauguccacagaagccagaggcaucaagucucucaggaacugaaguuauaggugaucaugagccucccaccaugggugcuaggaaaugaaguggguggaguucucugugauuaaaugaacauuguuucucuugcagauuuuuuggaaggguguagcucagugauagaguauuugccuaacauacagaggaccaaugcuugaauuugaaauuucuuguugccaacugauuuauuuuuauuuaucuauuuuuauuuuuuauuuuuuugacuuuugagauagcauuucucugugcagcacuggcuguccuagaacucucucuguagaccagguuggccucauauucacagaucugccugucucuguugggagguacuggaguacugggauuaaaggugugugcuaccaccaccaagguagccaacuguuuuuugacaaguaaaaccuucuucccucccucccucccucccucccucccucccucccucccuuccuucucucucucucuuuuuaauaguagagcagugcuggggauugaauucaggugcuugguuuuauuuguaauuugagaaccuaugaagggaugugucaagcauuuguagaaaaucagacuuuggaauucuuuugcacaguagagcuuccuaauggcuucaguuggaugguguguguuuuuguguguguguauguguguacacuguauguauggugaacguuuucaccagagauugcuguccggugucuugcucagcuacuagucaccuuauuuuuugagaccaagucuuuugcugaucuuagagccgcauugauuuggcuaugugaguuucagggaucuguauguugcugucucuuuagugguaggauuguagauaaaugcuacacccaaccuugauuuggcuaugugaguuucagggaucuguauguugcugucucuuuagugguaggauuguagauaaaugcuacacccaaucuuuuacuggugcugaaaauccagacugauguccugaugcuugagugacaagugcuuuaucaacugaaccaucucuccagucuuucaguuggguacugguuaauaaaauucacagaagaccauuguuuuggacugccuucuugcacaagaccacagaagauagcuugugccagaugcugcuaaucagcugaacuccuuaaugggccaguuaaaagacaaagauaucagccagucagagaggacaguuuaucuaagccagcaaaaggaagacucccuguauuaauuauuucccucccucccucccucccucucucccucccucuaguccugucugucuuggaacucaguauguggagcaggcuacuugaauucacagauuugcuugucucugccucccaagugcuugucuguauuacugaucuuauaaggaaaauaaacuuaagacagcuguccacuuuuuuguuucuuccuucuuuagguuucauuuuucuguguaugugugcgcauguaagugauggcgugggauuguauguuguucucaguugcuuucuacuuuuuauuuuuugauuuuugagacaaggucucacuguguaucccuggucucaaagagacccuuuuugccucugccuucugaguguugccauugaagauaugguccaacacacccaguuccaccuuagucaacuuauaacaguucuugggccacaugggauccagagauggaacucaggucauuagguuugguggcgugugcuuuuacuuagcuguguugccagucucacuuuauucuuuuagacaggccucucauugaacuggagcuugcaagguuagauuggcuggucagcuagccucagacaucuccuggauuaaaggugcaugcagaaagcacacgggugcuaagaagacucagauacuaaaucaugugguggagccccuagauuucuucuuauauuaccuuuuaauaucuuuaaaacuaaucuuugcuuagcugauuaaaacauguguccugucuuguagagugagauguuaccaaauuuuagaacuauaguuuaaaagccuuuuaauuacugggugugguaguuugaaugacccauaggcuuauauauuagaauuuuugguuccuaauuggacuaggaacuagguggacuguuuaagaagaauuagcugggcagugguggcacuugccuuuaauccuagcacccggguggcagaggccagugauauaugugaguucuagucuagccuggucuacagagcuaguuccaggacaucuagggauacacaaagaaaccaucuuuaaaaacaaaaccccaaaagcccaaguaaugcaguaacaacccaaaacuccagaaggauuaagagguaugcccuuguagaggagguaugucauggggggugggcuuuuaggguuuaaagcaggacagcaggcccauacucucccugucuacugccuguggaccaggauguuaauaaguaagcucuuagccacuucuccagagccaugccugccugccugccaccauucuuucauggugguuaucaacugacccuuugaagcugaaagcaaguccccaauuaagugcuuucuuuuuauaaguauccuuggucaugguaucucauuauagaaauagaacaauaacuaaaacacugggucuuagcugcagugccacuuggaguuggcacauacuuguaaucccagcacuugggaggcugagugauugcucaaaggucagggccagucuggacuacauugaauucaagaccaggcaaggguacauagacucuuucucaaacaaaacaaaaacccuaaaacugaaauuacaaccuauaacaaaccaaaaugaaaguuacuuguaauccucugcauugaaguagauuauauggauacaugaaaauaccaccaugaaaccuauuauuuuguccaauugaauuaacaaaaguaauaaagccaguuaagauccuuaaacuaacuguaauucugucuuauugcaguauuagcuguuaacaguagcuucuguuugcagcuuguuugauaaacuggacucgaguuaacugccagucaacaguuuacucugcugguucuguaguuucuucauaguuguuagaguuccaggucugagcauaacuucauuacacggauggcacaucaaugaauaguggaucugaugauugcugaauugcccagauggccacauuuguuauucaggaaauagaucuuagaggccuguuauaaguuuaacacccuuaaauacagaggguagaugggugacaugaaaagaaauagggagcuaagagugauggcucagggguugagagcacuugcuaugcuuuuagaggaccuggauucauuucccagcauccacaucacagcucuaaacugcuuguaacuccaguuccagggcauccgaugccauucuugucauuguugugguucauaggugucauagcugggcaggacugcugguugcuucccaccuuugaaagcuugcauggugccuucugguaccaugccucagguaggaagcauuuaggucaguuucagcucagaggucuuugggcccuguaucaugcauaaugucuucagcaguagcaacuuaauuuucaccccugggguaggaguguguagccaagggcaguagcuucuaauaucuugggagucuauuggacagccuugaccaacaacucaaaagauggcuucucacaccugccuuggggguuuuuguuugauggucuuugauucuuggagggaguagcaucagcccagaugcaaaauuuucacacgcagacgcaugcaugcacuacaauaauucaccacuguuuucuugcugaacugcaaacaacugucacugggaaccaugaaaauaaagauaaaaaauucugggauugggaaagcaauagagaagggaauaguggaguacagugauuuuaucagggaaaugggaagagggggcugcaugugugugugacauguguucacuuggcauguuugcauggcauguucaggugcaugcacagguuuguggguauuaagugugauaucaaguccuccuugaucauucuucaccuuauauauugaagcaagaguuucuaacucaaccuggagcuggcauauuuggccaaucuagcuagucagcuuguucuccugggaucccuuugcucuaucccgagugcucagauuacagaugugcugccacaccugucuggccuuaauaugggugcugggaauucuaacucagguucucauacauguguuaaaacacuauccacugaaccuuuucucagcccuccaaugaugccuguccccuccuuguguuuuagaauauuacacucuucaagggucuucugaguguucagauucaagccauagcuccuuguaauacucauuuaagauuauugauacauaggauuccuuuacuuauugagacagaguuuugugugucugaggcuggcuugaauuuacuguguagucuuaguauaacauugaacuucugauugucuugcuuccacuguuagcugggauuagagguauguaccauugugcauaguuuguaauacauagacuuuaauauacuuucacuuuaacagaaauuuuaaaaguacuuuuuaaaauuuaaaauuuuaaaauuuaaaaguguguguguguguuucuguuguguacaguuguuuuccgaguccagaagauggaauaagaucuggaacuggcaguugugagcugucuggcaaaggcuggaacugaccuugauucuucccgaugagaagggaucuuaacccuuagccauuguuccagcucucacuuagugaauuguaaaauguuuuuaucacccccaaaauaaaacuuauuagggaaccacuaaucugccuuuuacuuguucuuuguuucuguucccccauuccuuauacuuuuuuguuguuguuguuuuuuucgagacacgguuucucuguauagcccuggcuguccuggaacuuacucuguauaccaggcuggacucaaacucagaaaucugccugccucugccuccaaagugcugggauuaaaggcgugugccaccaccucccagcuccuucuuuccuuauaguucucuuucuuucucuuaucuuuaucuugcuguaucuagcuggccucacacuuauagcuuccagguagucgucuguccuuagcuuucugagaagcagggacuaugggcacauuaucauauuauuuauaugaauuugccaauuugagacuuuuguaugaauagagucaguauuuggacuuugccuuggcccaaugucuaacauugcuguguuuucacaugugcggugcugucucccucacugugcucuggacaaccaaaacucaagcugaaagguaauuguugaauaggagucaucuuuugcuggucuggguucauugccaugagagacuuuuaaaaauuacuauuuauuuuuuauuuuuuauuuauauguguguuuugccuguaugugugucugugcaccauguacuugccuggugcccaugggagccagaagaaggcaccagauccccuagaacuagagauacagaugguugcucacugccauugggugcuaacgacugaacccagguccucuagaagagcacccugaggcuugagcccucucuccagcuccucaagagugacugcugaaagcaugaagguccagagcuuugucucuggcauauacugcuucccuucugccuuuggcuuugagcugcagcagaggcccugagcagaagucaagcagacacugugacauacuguugccuuucuagccuccagaccaugagccaaaauaacuguacaaaugcugucucauguucuguuggaacaacugaaaauggacugacacucuuguccucaguucugcuuuucccaguauuuuccuauuauuaagaacauaccuguguuagaugaguucuuaaaauauuagcuggacaguuagaaaugaacaauucuugaguuuuaaauugugugccauuugggguagcaugaggaaaucuuacaucaucuuuucuguccugccugggacacgagucaucuucugguucagcaugcuuguguagaucuauaugcuucccuccagucacauaguugcugucuugcuaucagauccucugugugguauugcagacugguacucacacuaaccccugccccccccccccguuuuuuuuuuuuuuuuuuuuacuugauaauggcucauuuugcaagaggauaaacugaagagaagcaauaagaaaccuaagaaaagaagugugcaaacuguagacaucugugcugcgaaggaauaagagauuuguuccagcuuugcuguugugccucacaguuguggccauccugcaugacaagcugggcauuggggaguuugacuagaacuuauuaaguacuagcuaugggcccuggccuuacugaggucugaaauauacaccugcagcaugagggacuucucuacuagaauuuaauuccuuuuuuuuguuuguuucuuuuaaaaaaaauacuuuuauuuaaucuuuggcaguaucaugcauguguguauauuuugauccuaccuuccaacuccucauuacuuuuuauaaucaaguacuacuaaucuuuuguuuagauaaugucuccuugucacuuaauggacuuugggucccugccccccuuggcuauuuggaauaaugcugauagggaaucugauguuuuaagguuaguaacaccacuugggcuggagccguggcucagcacuucagaaggcugcuuguucuugcagagcaucugguucaguucccagcacccacaguaguugacucccaaccacuuguaacuccagcuccagggcaucuacagcucuggccuccauagacaccuguauucacaugcaaauauccugcccuccauacacaaaaaugauaacaguuuuuaaaauuacuuggaaguccuauaauuuuaguugauaaaaaaauuguucuggacagacuuuuggaaggcaaaaggauaauuuuauuaggcuuuauguuguacauugaagauaggauuuuuuuuuuaauuuguaaauugaugucuccagaucuugagacuucaugcugggaguaggacuugaugcaguguuacccauucuugcugucacaaggaagaaaccacuaagaaagauacugaggguuagguagcuguccuaggaacuucagauuuaguaauuuuaguaauguuccacuuuuaaugaucagcaugcuuuuuuuuuaaaugacauaauaaauucaguuaacuguaacuaaagaaauggcaaaauauauguacaauaaaguuuccuggguauacuggugcauauccuuacucccacccagcacuuggcagguggaggcaggcagcccgccuggucuccuacauugcaaguuacaggccagccaggguuacauagcgagaccuugucuuaaaaaaagagguuauggcuguagagagggcucagcaauuaagaacguuggcugcucuucuagaggaccuggguuugguucccaguacucacacuggcugacauauagccaccuguaacuccaguuccaggagauuugauguccucuucuggccucuauaggcaccaggcauguacaugaugcacagacauacauucagacaaaacaccaauacauauaucuauaucuauaucacccauauauauauuuauauauaucacauaugugauauuuaucuuuaauuauauauauaauaaggauauauauauauauacacauauaaauuaaagauaaauaaaauaacuuuuuaaaaguuaaccacuuuuaaagauuuauuauucuaugaguauguguguguguuucuguguaccacaugaauacaaaugcucucaggccagaagaggauucuggguuccucuggaguuacaggugguucaagguuagcuuguguuaaucuaaaaauuccagucuagucuauagucuagauccugagucaaaacaacaaugacaaaaaacccgaaccaaaaguugagacuguuuuggcuucucugugucauuuguguuuccauaugaguuuuaggaucagcuugucaucuucuacaaaaauguuugauuuuuaaaaaaaauuaaaaaaauuuuuugucaccuugacacaagcuagaauaauuugagaagagggggccacaguugaaaaaugcuuccauaacauuggucuaccugugggucauuuucuuaaucaguaacugauuaugggggagcccaguccacugugggugguccugggaguauaagaaagcaagccaggaggagcaagccagcaaauagcacucuuuuuauggccucagcuuuuuuuguuccugccucagguuucugucucaaguuccuaccuugacuucucuggaugauggaauacagcuguaaaaugaaauaaacccuuuucuccccaaguuuuuuuuggucaugauauuuuaucacaggauugaaaccauaaauagggauugauugaaaccccuagaugaauguggagauuauugccccuuuaacagugaccuguguauugauacgcauggcccaacaugcucaugaguuugucuguuuucaguuuuuuuaauuuaauuuaauuaaaaaauuuuuuuuucuguuuucaguuuuaagaaccccaugcccagugucuccauuuaagaucaaguuccagcuuugauucugcuguaauuuuucaagguuggggcuagagugugagggagauggcuguuaaaugaacauaaguguuccuuuaaagggaaguguagguugugcaucucacuuugcugaaagagaacucuguagacugcuugugaacagucagcugugcugguacacuugugugaucccugaacuuaggagguggaggcuagagaggcuaggcugggcuacaaugagguccccugucuaggaaaacagggugggcaggggaagccacgcagcuuuugaaaugacccuugauguuugcuuugaggcaggagagaugacagaggacaggcuuuguuuagcaagagacugcuggagguacaggagaguggaagugaacugacagacuuuaggucaggucuagaauuuuauggugauuagguuuguuuaaaagccugggguggggcuggaguucuggcucagagguugagagguuaaguguacuggcuggucuugcaaaggacugggguguggucccaguccucuuguggcagcucacaacucaauuaucaguaacuccaguuccaggggcuccagugccaucuuuuagccucccugggcucuaggaacuguuaaguacaaggucauauuauguaaaggacaucuuuucugcuagcauaguguuccacuaaaggccuuugccuuucucaccuaacagaagagcagugagcugcuguacuuaaaauguacugcauugcacccaacauguauuccuucauuuugugcaugcaugagugugaguguguguuugugccauggggcacauguggagaucagagggcagcuugaugcugguucuuaucguccaccgugugaguagaggugaucaaacucaggacaggguugaugucaagccgucuacacgcccagcaucucucuggcccucccuaccuuuuacauuuuuauuuauuuaugauuauuguguguuuauggcaugugacugcauaugugcuugcuaugguucaaauguggagaacagaggacaacuuaauaagagucaugugucacuuugcacuauggcuucuggauauugaacucaggcuugaaugacaagugcuuuuacccaagagagccacuucguuggcucugguucacuauuuauauuuauuauuuuaccucaaaucaaggaacagcaguguuauauaagaacuuguaagaauguggagauuaagcagagcuccuaggagaguugcauauaauauuauacuuucuauacuauuuugguaaaaggaagucagcaguguuacuuuaguuaacuaucugguuucuccagggcuuugagcuagauagaaauuaggaaguauuagagaaaugcaaacaaagcccuucuagcaccagcugaggcuuucucccccucaaaccccuguuagggucauugguuguagucagugccuugccccauauuccuuaaagucauccaggagggauguguccuguguuuugugaagugcugcccuguuggauuaugucagucauguucagccaccaggaaguucucagaacccagcacaagccuuacugcuuccuccauggggaagauaauaagcuuacggggcuaaguucccagaaaacaaaaguaaaacaaaaagcauaucuguguagaagguuucuagaagacugaauuagaacuucuuuaauuguggagaguuagaauguucugagugaauuaucuugggcuaccuuuaguccucuuaauagucauucauuguccaagcaucuauuuggucaaacacuuggauaucaagcaaaaccucugaacuguccucugaacagaccuuuagguuccacccauccccagucucacuguggcuuggguggaucuggagccuggaguagaacgccccgcuccccuugcauccucuugcucuguuccugcuggugaacucaguuaguacguugacauaugacuucuuucccuuguagccacuucuaugaugaggcuugucauuugaggccacauaaguccucguuccuaggcugcugccacucauuuuuggcuuagaauaaauucucucucauuccuuugaggugagcugugcugugcuguguccugucagcaggaccauaggugcaugggaacuuaauuguggguuaucugcuguuucuucuuuuccuuagaagaaaagaaaagaaaaacauuuguguauguaaacauugcuagugggaguuugauguuucuagacucaggucauuagggguuccuaugucuggcacauguaugccucuucuggccugcuggcaauuuccuuugcuucuuuccuauauucagugucccauugcuuccugugucuuaaguucuuuucucucuugacuuaugugaauaaugaggcccuucagaaagcgacauggacagccaagcucaugaaucaugaauguuaaaaagcucucucuuuuacccuuccuuagaguuuucuuucauauuguacugacauuucuuccaauguugagacuugaagccauucugauuccugauccuuuggcgaaaacuucugaagucuuguuuucuugucauuauaaaauaagugugaugcauucuuaaucugauagaguucagguccccauccaugugcuuuggucucugguccuuuauuuuauauuggaaguucucugcuaaucucuuuuguuaacaggacaagauuaagaacugacuguggucuuagagcacaggugagcuuuacugaacauugugguaugauggggaagcucagcauguucuuugagucugguugcugagcuggggaggaggcugccgguuuuugcagucagauguugaguuaguuuaggcucaaguguugggccuguugaaguagcaucuggucugucuuuacaguccauguuggucuauaaucagagcucugugugccuccgcccagcugauggccugggucuuuugguuuguuuugagucuugcuuuguauaucaggcuggccuugaacucuacaucuuccugcucuguugggagugcugggcauauacagacuuguaccuguacuaccuggccugcuguggucugucucuuucuuucuuccuuucugucugucugucugucucucucucugucugucugucucuuucuuugcugagucaccucuccaguucuguuuuucaaaggcauauauauaaacauaaguuuaugauuaaauacuagaaagaaucaugcgauucuuaggcauguuacaggacuggggauguggcuuggugguagagugcuuuccuaccuggaagugugcuguguggguagaaggaaagaaagaaaguuacacccgguaguguuggcuucuuuugucugucugugucuuuauccucuguaaauuugaaaaguguuugguacuucugagagaugaagcaguggcacaccgccugccccccagaacgggaugacaaaaaguagaugccuauugacuagucauuuaaacaaacugaaaggccuuucuuaacauaaaaaucauccaaaaucuaauuuuaaaauguaagaaaagacaguauaaauuuuuauucacccaguuuuagugagaauuguauaugagauuacucuuuucaacaucucauuugucuauucccuagguguuugucuuucuguuucagccgcgccacccccccaccccccuuuguucgacuuuagccugugcuaaucacuuuucuggggugagugcucacauggcaguguaccacagucuuuccccacugcacauauucagaguacauggcaucauuuuucuuucuuuuuuuuuuuuuuuacuguaaaccugaacuacuguaccaucugcugacuucuauagcguccguguauacucugaacgucaucgucuuuuaggguggguguauuucuaaugcuaggcuuuugucucugcucuuuggaaaaaggaaaagauaaaauguucuugaguuugagaaggugcagucugugguucugcuuuggucagaaguuacaaagaauuaaacuccagcaaugacugaaaaagggaaaagcuauauacaauuguauugauguaauaaucccugccgcagacaucagcagacuacuauguacuucauggcgugggguucucuccaagggcagugcuuacccugacuuccaacugcugagccaucucaguccacccaauaguucuguuuuaaauggaaccugcuugugacuauaauuuuauguuguaucuuauagcauuuucuuaguacauuuuaauauuuaguguuauagacuuagaaccacugcuguucaguuuuuccuuuccuuuucuugcuucuguuccuccuccugucucuucuccuccucuuuucuucuuccuuuuuucuucugcuuuuuugagucagggucucuguacagagccugacuguccuggaacuucuauguagaucagacuggcuuacuuacagagaucugccugccgcugccuccuuguguugggauuaaugcuugauuuugacuaguuuuuuuaaaauuucaguugauagcuaacuuugguugauucaaaauaaucauaggaauuauaguuaucaugauuggugaguagacuucugccacuguaaaaucaaaccacaaugauaaauaaggucauccaauaacuaauaguuacugugaaaagaauaaaaauuuagcagccgggugugguggggcaugccuuuaaucccagcacuugggaggcagaggcaggcggauuucugaguuugaggccagccuggucuacagaguaaguuccaggacagccagggcuacacagagaaaagaaagccugucucgaaaaacaaaacaaaacaaaaguuuuagugugccaccaauggaaugccugaaaacucaauaggauuacacaaagcucuggguuaggugccuuuguugcagguacugguccaaguauuaagaauauaccagugaguucugcucacagagcaaacauuuauaaacaguuuugguaaauaauaaaugucgcacugagaauuaaucaaguuuguuugcuggggggaaggggaauagacaguuuuggcuggagugucagguaaggacucuuuaaaaggcugucuugguugagacagauagugaaaaggcuauuugauuguuuuugggguuuucauccuuuugggugaagggaauaagaaauucugagguaugaaaauuggccuguucugguggguuugucuguuuucuuuucuuucuuuucuuuuuuguuuuuguuuuuguuuuugagacaggguuucucuguauagcccuggcuguccuggaacucacucuguagaccaggcuggccucgaauucagaaauccaccugccucugccuuccgagugcgccacuaccgccuggcugucuguuuucuuuuuaagacaagguuucacuauguagcccuggcugucugggaacugaguauuuagaccaggauggccucacauaccugucucugccuuccaaguguuaggauuaaaaguguguccaucauuacugguaugauggguauguucugaaagcagucuuaggggcuugauuaaggaguuuagauuuuauucugaguuuucagcaagagggugacaugaugagcugcuguuuaaagauuguuuuggugauaaaaaacagccccuacgaugucagauuuuuaguagguaguacauucugauucuucuccagaaaguugaccgagauuuaaaauaccacauagugaucuugauuaacuuuccaaaccgacucugcuuuccugacuuuaagguuacagauguuccauuaugugugcugggcuuuguuccugcaccccuauaacacagucugcauuugcucaggccccucauauagaggacauaguauuuacaugggcucugcauaugucucugauguuuaaguccacuucacccagagaacucaggcuuguuaaucucucucucucucucucucucucucucucucucucucucucucucacacacacacacacauacacuuuuugauuuacaauugguugagucuauggcuguggaccuacagguguggcacaggaguaugguugcagucaauccuuaauucauuuccugggcugagagucagcacauaguggggagucagguagaaaguucugguugaaaauggaguauagguuacauuuucuuuaauucuaggacauuuuaucccugacuaagugauuugugugucaggacuguaugugagacaguaagagcuguagagucagagcuccucauguguguaucuuagccuguacacucagaaguauguuguaagaauuuucugugcuuuagaugggauaucacuucuacuuaguaucuaacuguacguauuaagguggauaauaggaaugaggcauguauauacauaaauuugcguaugugcuauguaugcacgcacauaugcucuguaucccaccccauaauagaggcuccuggugaguucuagcuccugcuggauaagacaaaagaagugucugacauaaggcucaaagggagauucucacaguuuucuaaaggaggagagccauuacuuugucuccuugcugacuugcaagugucugggcguuagucuuauaccugaggcgcguuccauaguuaacacauauguguuccauaguuaacacaucagauuaagcugguuagauggccagucugcugcuuugguucugcacucaaacuaaacccugaauauuacaauggaaaacucagacuuuguaaguagauauggaaucugggaguuugggggcagcagcuaggaugauuucuuacaaagaguagaaggaagaaauaaaucacuauauuucuuuccugacuaacuugcucacagauuacaaaaaaagccauaaaccacuguuuucacaacuuucuauauuguguucuuggguuaaguacuuuucuucuagaauuauaauuauuugucuuucagguauaaguauuguuuaaacugcaucaauggagcacauacagggagcuuggaagacgaucagcaauggcuuuggacucaaagaugcgguguuugauggcuccagcugcaucuccccuaccauuguucagcaguuuggcuaucagcgccgggccucagaugauggcaagcucacggauucuucuaagacaagcaauacuauccggguuuucuugccgaauaagcaaaggacugugguaugugacccuagaaaauguaguucucuuaccuuuggagacugugcuaugcuguccaguuuauagaugggagaaucuccuugucacuugggaucucuguuaaucguuuuuuuuuuuuuaacucccccaagugaagauuuauuuuuauuuuuaaaaagacuuauuugggguuugagauggcucagugguuaagagaacugacugcuuuuccagaggucacgaggucaaaucccagcaaccaaccacaaugguggcuuacaaccaucuguaaugagaagcaaauaauaaaaaccuaugggcuggaugugggggagggggagguggaaagagcugggccggagcaagagggagaaggaaauggggggaaaaaagaaaaaaaaaagaccuauuuguuuuaugucucucucucuauauauaaguguucugucuucaugcauaccaaaagagggaaucaaauccuauuacaggugguugggagccagcaugggugcuggagaucaaacucaggaccuguagaagaacagucagccgcucagauuuacuuuaugaaaucacuguucugcucacucucuacugccuucaaacguggcccacaaaagccuuuuucugcaucuuuauuuuugggugaggaggagaggcuauuucugauacuuuuuuuucuuuugaaauauuuuuaaaauuguauuuauuaauuuuguguguguucauguguguguggugcuugcauauguguacugcuacaguaugacauggaggccagagcacagcuuguaugaggagauuuccucuuccauuaccacauggucccuggugcugagcucagacgguccagguguggcagcagcuguuugccuccagagcaucuuguuagccuuuuuuuuuuuuuuuuuugggagaaguuuuuuuuucuucuucuuuuaguuuccaagcuaauuaaaacuaauuaaagaaaguggggaaagagacauuuauucuucugugaaugcaaaguauugacuuaauuuuugagauugcauuaaauaugaggaaaauacaauuuucuggguuauuuuacuuuaggaaaaaagucuagauuuuuaauuuugaaaaaaauuuaguuuuuguuuuaugugaguggguguuugcuaccugccauguaugucugugugccaguguguucagagcgcauagaggcugggagaggacacuggauucccuggaacuggaguuacaaacuguuaugagcugcuacguggugcugggaauuaaauguggcugcucugcaagaaaagccagugcuuuuaacuacuaggcugucucuccaucuccuaggaaaagauauuuuauuauuuuauaggcccaagauagauuuuuagguugcuuaagaagaaacuccugccuugucucuucucagggcacaaaauauuuuugcauuuuuccauggaaucaaugacagguccauguuggaaccagauguugucaacaggauuuucugacaggaaaccccauuauuuucuaaggacccacugcucaaaacccuuuacuguucugaacuuuaaaagcaaaaaaccaguuugacugaaacagaaaagugaaguuauauugguuuuuguuugucaggucuuguuuaaccuaaauuuaaaacuuguccauccuuguggagcacaguaugagacauuuguuuguuccuaagguugggaggccagccagagcuuucuugguuuucuucugacaguccccucugguucuucuuuucuuuucuuuucuuuucuuuucuuuucuuuucuuuucuuuucuuuucuuuccucuuccucuuccucuuccucuuccucuuccucuuccucuuccucuuccucuuccuccuccuccuccuccuccuccuccuccuccuccuccuccuccuucucuucucuucucuucucuucucuucucuucucuucucuucucuucucuucucuucucuucucuucucuuuuucuguuuuuuugagacaggguuucucuguguagcccuggcuguccuggaacucacucuguagaccaggcuggccuguaacucggaaaucugccugccuccgccucccaagugcugagauuaaagaugugugccaccacugccuggcccccucugguuuuucuaguugauuccuucauccuuauuuauuuuguuugugugguuuguaccugaguguaugucaguguaccauguauacacagcauccauagaagccagaagaggacauuaaauucucuagaucugaaguuugggcuacccagugcuuucaggguucauaggcagcuuaguaugagauucaaaagaaauuaauuuuuuaauuaauuaauucauuuuauuuauuuuuuaaagaagaagguugcugaguagcuaccuuaagauuagggacacgguauuugugccaguuaguugugcuggcugcugcuucuccuuucacuauuucuccacuuacuuuuccacucuggaguccagauucacagaugagguauuuuaggaacaaaucugaagugccaacauuagaucauagaccuucuagcuugugcucccuucccuggauccagaacuuugaguuguagguugucuagggcauuccuccaagacaggaccauguuggcuaggucauauggaaccucccacuuccccuaagccuguaagaaccugagaaccuggccuuuguucuucuugacugaagauacccuuucugucucccuuguugcacuucuguaguacaauaacuauuccaacucuccuaauaccgucauccuucuuuagggcuacaauggcugguuaugccugugagcucauaacugguggauaaaauucuuucaaaugugucaugucuccaccaaccugcaguaauuucgaauagccagcagaucuuuuuagcuuauuucuccagggauaaaaaagaaaaucuucacuuguuaguauugcuuuguacaagcaaagccauuuuaauauuaaaagaguaaaaaggguuauuucaagaugagaauggauucuguucgaauggauuguguaucacaugacagauaauucagcauuucauagauggaguuacucuucauggugcugaacacugcaauuuagaaccagauuuaauacuuguuucggguccauuuguagauguuaaaaacuaagagccauugaggcugcagagauggcucuacaguuaagaggguccuggaguucaacuagaagcaccccaguuaagcagcccacacucuccugcuccagggaauauuacauguauagccucuguuacagugcacaugcauuuauguacaccuuucucugggaaaaccagugguggaaagugucuucuggcagccaguacccucaggcagccagcacuccccauccuagaguggcuucccaggauuucucuucuuacagcucagugagacaccauugaccaaaucacagugugaaucugguggcaggagagacagacugaggauguguuuaaccgaaacgauuuuagaaggauacuugucuuuagaagaauaauagucuuuuaauguuucuugacauuuuguuuucuaaacaugcacgucucucugacugcugcuucucauuguuacuggacaagugaguuacuagaguugagaacugcugcccuuacaaccaaccaccuggcagucaggaauagacacagguucuuggaagcagacuccuuggauguguuguacaggaggcuagggagacucuuuuacaaaccccuuggcugcuucccaugcugucuacaucuggggacauuaguggaguagagaauagauuaagagcuguucagcucuuagaaucuguugugacuucuauuggaaauauuaaaauaaccacauaucacuuuacaguuuugaaagcuaugcucugcaguauaggugcaugagucugucaaugugugaguuuagcacucuuuguuuuagcacuuucuuuucucaugucuuuauagcucagaucucuagugcaggcaugucugccucguuuugcuacacacuaguaagauguuauaaggguaaauaccuaugaaaguaaagagcuuacaguaacaguucugguauguuuaucaccuggcuuacccuuggcugaucauagcaguucuuuuugucuguuuccacccacaccuuuucauuuguuuugauacaaauccuagauagcguuugucugaacuaguuugguauguccaaggaacuuuuuucuuuagacagagucuaacucuguagucuauacuggacuuaaacucaaagcagccaucuguuugaaacucuuaaauguugggaauagaugcaaaccaccaugaagcuauuagaaacuuacauaauguuaauuguuuaaauaggcaacaugauuuacaaguaugggugacuucugccccugucuaguuccccaguucuuucccuuaguaugccugugauaaaaaagguuuaucaacuugaagaaucagauggccucauccacaccaaaggaggaguuugcuuauuuauuuauuuauuuauuuauuuacaucagaucucauuacggaugguugugagccaccauguaguugcugggauuugaacuugggaccuucgaaagagcaguuugcgcucuuaaccacugagccaccucgccagcccaaggaggagcuuuuaaagcuuagaaaacccuuuucuuuuuucugucacuaaaguggaggaacucugaucccccgcuuccuacucacccucacugcuuugacauuuguuaggaagaucaucucuccauuuuguugaaagugggcucaucucauguguguuucaccuucuguccaugcuucugugcacuuaugugcacucuugcaaggccagauaacuaaaugugcuaaguaucccuccauaccacuuaaaauuauuuuaaaaacguauuuguguguguguguguguguguguguguguguguguguguguguguguguauguauguauacauacguguguauacacucgugcaugugugcuccauggugcauuuguggagaucagagaauagauaacuucugggaguuagugucugcuuccaccauauuugucucagggauugaacuuaaguugucaggcuuggcgggaagcaccugcccucuaauuuuaauagcaagguguaugucuuucuaacccacacagcauacauaaacauauacugguuuccccaccuuuaaaauagucuuacucuugagcggaggcuuuggcugcgggggaaggaggacuaugaagcuuccgaauauccugcucaccgguacaccagggguuggaaaaaccacucuaggcaaagaacuugcaucaagaucaggccugaaguauguuaacguggagaucuagcucgagaagucugauuagcggauaucauggagucuggcaagauggcgucucccaagagcaugcugaaagaugcacagaugauggcacaaauccugaaggauauggggauuacagaauaugagccaagaguuauaaaucaggugcuggaguuugccuuccgauaugugaccacaauucuagaugaugcuaaaaucuauuccagccaugcuaagaaagcuacuguugaugcagaugacguacgacuggcaauccagugccgugcugaccagucuuucacuucuccguccccgagagauuucuuguuagauauugcacgacaaagaaaucaaacuccuuugccacugaucaagccauauucagguccuagauugccaccugauagauauugcuuaacugccccaaacuguaggcuuaagucuuuacagaaaaaggcaccugcuccugcaggaagaauaacaguuccaagguuaaguguugguucaguuucuaguagaccaaguacucccacccuaaguacaccgacuccacaaaccaugucuguuucaacuaaaguaggcaccccaaugucccucacaggacagagguuuacaguacagauggcugcgucucaguccccugcuguaaaagguucuauaccugcaacaucaacaguucagaauguucuuauuaauccauuguuaauuggguccaaaaacauucuuauuacuacuaauaugguaucacaaaauacagccgagucagcaaaugcacugaaaugaaaacgugaagacgacgaugaugaugaagaugaagaugaagaugaugaugaugaugaugaugacuaugauaauauguagucuaaccacgaugcauguaaccuguguucuuggacuuggauccauuguacuacaaauuaaaaagcauguuagauguuuuaaagcuguacuuuagaaagugguauuucauaauuauacuuugcuuuuugauuaaaauguucaguuuuacuagaacuagugaugguuuuucaucaaccuuuauguacaaaaaauaaaaugucauuuaucaguuugaaaaaaaauagucuuacucuuuauauuguucuaaugaaaguauuuucccuaguaaacgugccguagacuacuguccccuuaguaacuaauuaaggguaguuaguuaguacaggagaugcauaauguuccaaugcugauucaggccuaugugcaucugcuuauacuuaacucuggauauugagguguuuuucucuguguguucacuauugcaaacaguaugucauaagucuauaccauuuuauaugucgugcguguauuucaguguuuaucuuugcgaguggugcuguagccuacacugguacuaaaggggaucauuuguuugcaggucaaugugcggaauggaaugagcuuacaugacugccuuaugaaagcucugaaggugagaggccugcagccagagugcugugcaguguucagacuucuccaggaacacaaaggguaagagcaaagccagccagcaccuuuuaggauucuaagcguuuccuagccacaaauaacuugguauauuacaaugcuuuguauuagccuccuagggauuagugcauguggauauacucuguuuucaaaguaucaauucagaaaaauugccucugagaacuugaaauuauugccuggacauugucuuaaaagcuauaauaaaugggaggugcuaauagcauuguccagggauggaggcagcauuguuagaaggccuguuuuugagugcaaagacuuuuccugguguuugccaugcagaguggguacucugaacaugacugcacucuuuuuuaugguuaagaaugcuaggggcuaaagagauggcucauuaauggcauuugcugcuccucagagaacucaaguucaguucccagcacucacaucaggugguucacagcuaaugguagcucccgcuccaggagauuguaugccgccuucuggccuccaaggggaccuuuacacacaugacauacauaccacuuagagacauucagaaaaaccuuucuucccucuccucuuuuuuuuuuuuuuuuuuuuuacauaauuuuaaaagauuuauuuauuuauuuuaugcauauaaaauaaauggcuucauguacuuccagaagagggcauuagauccuauuacagaagguuguaagccuccauguaauugcugggauuugaacucaggaccucuggaagauuagccugugcucuccuccccucuucuccgcucuucuucuuuucucucccuuacccuuugccuccaaucccuugucccuuuucaucuugggccugaagaaauacacuagucaguauagugcuuccauacucucugauugcccaacugccauaacaccccguguguggcugugcccuuggaaccucagcaccuggaugucuccagagacauccagagacaggcaggucccugaagcuugcuggccugcuuaccuaauugcugugcuccagaucagugagagaacuugucucaaaggcaagauagauggcgcccggagaacaccacuucauguuucauuuugucuugcuacauuuacacauuuauugcaguucuaaagagagauucuugccauucauucauucauucauucauucauucauucaugcuuuccucaucuaucucguuguuguuguugcugcugcugcugcuguuguugcaguacuggagacagaaccucgggccuggaauaugcuaaguauucaguucuaugaguauuaaaucuuggcucucugauagccacagggcugaaagagacagggaauuucuacuuccaggaaaauacacuguauuuccagucgugguagcaagauagagaugguuuucccgucuucaaagacugaaaucauggcccauagccacagagcaccauauccguacuguuauuuacuauggcagcccagccuuugacuuugcccucuuugggaagcagugcuucugcugcuaaccucuugcuuguucucugugguugaguucccuggcuggagagaacaucucaggagagugucuccucagaguuuacccuccgagugucuguucuucuguuuauuuagcuaguuugcugaucaucaaugugucaccacuucuggcuagauugauuuuugugucuguccccaaacugauacauagacuuccuucaggacuagggagauucuaagauggguucacucuucuucaagcuguacugauuuggaacuggucucuguccucuccuaccuauucaggagugagguuuccuuccuggucuucauuaggacacaauaguacuuuagacagauagauaccauuucccuaccuuaaauagggaauuaucuuaaagaaugaauuauugcucauggauagccagaagaguggcuuguugguuccuggcaggugauaagagggaucugagugaugucauaugugcguuacauuucuuaacauuucuuaaucggaaauauucauccucggcaaauggggcagaucugaaucagcuuuugcuuaaaucacuugguuaccugucuuccuuuuucugggcacagaaagaauggugucagucagguuuaaagacuguuguguuccuauagacuuguauuuauuuuuauaacuucuacaaacaacuuuaagucuguaacuaguguacagcacauuuguguuuguauuauauguauuauuuuagauugaaguagcuauugaacacuaaccuguagugacuugguaggauuuuaauauuaugcaguccccuuauagacaguuacucuugucaugagauuguuguauuacauuuuuaaagaacacuuuguucuaggagcauacauuuuggaguccaacaggcuuggguuucaacaggccacacagugagcaguguuggcuuaucuuuauggugggaccagaacaccugugaggugugcuuagacagcaugcaguagguaguagaacugcucuaugucuugagccuuguccaauguucccuuauguuaugcuuuggauaauuuuuaguaagaaagcacgcuuagauuggaacaccgaugccgccucucugauuggagaagaacugcaaguggauuuuuuggaucauguuccacucacaacucacaacuuuguaaguuucagcuucucccuuucuuugccauuuugggcucucuacaguggauggcugaccuuucagagaagcucugggugcacauuguuaguugcuuucagcucucccuaugcugucauguauuaccagaggccccucuacccugucucugaaucugacagucuugcaacuaugauucuucccuguggguacucugguaaggacggggagggcagugcuguguuugcuugucacucgaguucucacaaucccgcuuucuugucacaggcucggaaaacguuccugaagcuugcauucugugacaucugucagaaguuccugcuaaauggauuucgaugucagacuuguggcuacaaguuucaugagcacuguagcaccaaaguaccuacuauguguguggacuggaguaauaucagacagcucuuguaaggcacugugguuuuuuuuuccuuguaaaaaaugccagggucagguccagaagcauuuuugaggaugcucauuauacauuuucaauguaaagucugagcuuuagguuugcuaaauaaaugauugcugcgagucagaaacuauugacuuuagaagcauaauaguucugagauuaguuaguuuuagugugguggucaucuagcuguaaaauaaacagguagggagcuggggaugacucaguugguaaagugcuaacugugcaaacaugagagcugaguuugauuaccggcgcugacauaaaagcugggccuacaguguguaaucucagaguuggggauguggagacagggcuguccuuggguuugcuggccagcuacucuagcugagucauugagcucaaguuucagugagagaucuugucucaaaaaauaagguggagagugauugaggaagacuccuagcauugaccuuugguauucacuccagucauaugaacucagacacacaugcacaaacaauaccaaaagcaggcaggacccauugucugucaaauuguuacugacacugauuugucaaggaaaagaacagggacauggaaauugaagggcuaggcuuucuuuuuucaucuggccagugcuguggguugucccaagaaagcagaaagcagagcuuguccuguuuccuuccucucacaucagggagcaauguguuugggccucagacaguuugcauauaaaagauugaggcucucuguuaggagauaagccagauacaaaaauauauuucacagagagaaaauaauuuaaauaauugcauauuuuaaauuacacuucuuagagucuuuuaaaaacuuguauugagauuaugaaaagucagcuuuacccuuauugaaacauauuaggaaaaugaaaggaauauuaucuucauucacaaugggagagaaccuuguagcucccacagaaguuacuuguugguucucagagcacuugaguagcagaaaggcauguguuuguggccagugaacaccucacagccucagacugucacuagcaccuccagggcucagcucccucauuucagaaggguuggcuagguaacuaagacugcucugcaguaggacucggcgggcgaguuaaagugccuacuaaauaguaaucccacugugcuucuguguuacugcuggugcugaauaucaugaauggaauugauucucucucuguguguguguguguguuucaaaaaacaauuccagaaaagcuguggguaguauggauuaugaaauguuguacuaucacuuaagacccaugugguauagcuggacaggaccacuuuucuagugauguauccuggcaggaugugaauuuaucagcaaguugcuguuacucagucuauaacccagcccuuuagauugauggucuucauagcaggugacuaaagcacuugaggagaaugaaucaaggacaguuggguuuuugcuuuggguuuagaggcaagcugggaugguuucucugugagaggacugaauccauaaacuagucuuuccauguuucauuuaggcuguuuccaaauuccacuguuggugacaguggagucccagcaccaccuucuuucccaaugcgucggaugcgagaaucuguuucccggaugccugcuagguaauguuguacuuugaacucuuuuagaaaguuacaguggguuggguggguuggcagccugaauacaaagaagucccucuucauguccugcuuuguggagcaccaagugggaucuuucucucuguggucccagcguacuuauauucuggaaagugauuuugacugcaggucuuucuguuacaaugcaacucucagucucacauuacacuuauaaaaagcuugagguucugccuucuuccagacguggugaauuaggugucuguggaaaggcucccccaagugacgguagcaacuaagaagaaaaucagaccuuaacuuguaaauguuuaucccagccuuaaaauccagguaguuggcgauagaucugcuaugcucugaguuugccuuuaacuugucugugcuguuuucugguuuuaaaacuugaguuuacaucuuggucagugacacauaaguauuuagaacccaagauaaaaaucugcauuuuugucuaaaaugucugauagcuaaucagcuaccacuuaaugaccccuauagaauuaguuaaaggcagcauuuuagaacaaggaauuuguacugauaccuguguuuaugccugacuugaauaaauccuuuuugguaauuuaaaaaccacauuugagcaaaaaauaacuugccuugaggauaagaaacuagacuuugagaaccuaaauguagaauuccuaguacaagguggcauuucagugagggaacagccaggccuguucaggguggugugggaauaggcagaacauuaucccuuagaaaagcuggucuuuaucccuugaauguauaugagugugaccugaacaaaccuuaaauuucaucuacauaacaaauaugcucuccguugguuuuuggaguugggguggaaucuagggccucaccuaggcuaugcuggugacaugccauggagucauaccuuuagucacaggaguuacugguuucaggauguggggcucagacccaggagcuuauccgggcuggguaaaccuccuguugcugagcugcagcugccucagucuauccuugauaaugugugucccuaggcugaaacagucuccucauaggucagugucccagauguucuaacaguagaacacauacuuugcugugugcuggcuacagggaaagauuuuuaguuuuucuucaaauuaaacugggcagauuccaguuaggugguacuuauagcaaauacugaucuauucuuaaagauguuguaaaacucugaaguauucuggacagugauuuauuaccgaggagaaaauguguaauggacucuccuuuucagagggauggcaagcacaucuguuuuucauuuucaaaacuuugcaugaaaaggaacacagaagaguuuuuaaauagugcauauugagagagugaaauauugugucaagaguuguaugggucagguuugcccuaagugucuuaaugagcuaagcaguugaaaagacuuugccaauguggaggccugagugccaaucaugggacuuuuuuucuccuccgugcccaguucccagcacagauacucuacaccccaugccuucacuuucaacaccuccagcccuuccucagaagguucccugucccagaggcagaggucaacguccacucccaauguccacauggucagcaccacccugcauguggacagcaggaugauugagguaauagggccccuuggggguggugaugagcagcaguaguuaauauugggaagcagagaauguggauuucaaagcugcucaggaguguugcaguacuuucucaggcccuuggacuuugaaauguucuuuuuaacucucuuaauguguauagacuggcuuaauaacuaggccagugugucauuccaguaggaaacagaacuccucucuagccacugugcucugugucccagcuuuggaugugauuucuuugggcugguacagauacugcagagcagugagggcuguagugugaagaccucagaugcucuagagacuuguaaaguaggagcucugggaucugcugugcauugaggcaaaugugucagugccagucaguguuugcaaacugccuuucuuuucuugaauguucuguuccuuugguuugcuuucuagcucaucuuuaaagucaacugaauacccuucaaaugcuuccuuuguucuuuauucuucuuuauuucucauugcuuuggacuagaguaacagccugaaugcuucucccagggcgugcuccagacgauuuugucugaggggaagaguagguauuuucuucaugccuuugcuuucuuggguuuaacaggagagacuauugagacaacuauacauucauuuauacuucuagccagacuuguugccauaauuuuuuuuuuuuccuuuucuagaguucugaguuaaacaaacccucuggguuaccacugauagguaaauuucucaagguaaauucaggaagacaaggggauugaaauaaguuuuaaaaacucaguucucucaaaaaguggacugauauagugacacagcaucuguacugaguucagacauuagaaaccaaaacaguuaauccaucuaaguuaauaugacuuagaaagguuuaucaggaagucuggcauacuagcacaugacuggagucccagcacucuggaggacuguauucaagaccagccugggauacauggucaaauaaaaauaaaauaaaaaagacucaaaaucaaauaaaaaagacucaagagacguggccaaguaacugcuuucuccacacuaugaacugaccuuuguaaaaccuuguuccuugccgggcgugguggcacacgccuuuaaucccagcacucgggaggcagaggcaggcggauuucugaguucgaggccagccuggucuacagagugaguuccaggccagucagcgcuauacagagaaacccugucucgaaaaaaccaaaaaaaaaaaaaaaaaaaaaaaccuuguuccuugacaccugugaugucagaugcaguuucgcucuggcaguacaucacuuuuaaccacuuggccuacccuguguaaucuacaggcuuauuaguccuaguaauauaaucauaaaguagcuauuuucuucccauguccagcuuguuccuguuuaaacuguucguacauucaaagugaacauccuucaggucuaacaugagcagcacagcauugauccuguuugugccucagaagacaauuuuguuugugggucccccgccuuuugggggugguauuguguuuuuugagacagggucucucuauaguucuaacuguccugggacucacuuuguagaccaagguagccucuaacacucagagaucugccugccucugccucucaagugcuaggcuuaaaggcgugcacuuuuuucuuuuugucuuuaauaacacgugauucacucagcauuuuggacuguauguuguuguuugccuuaacaccagucauguucuucuaaacuaauacuuaagaguauuuaaauuuuuuuccugggauaaugugauccaauuauaguaauuacuaacaaauaaaauaaugggcagaggaaggaaaaaguaggagacauuaaaaacuauccugcuguacuguggaccagaaaucuaaucaaugaaaauaacagaagagauugggugagugaccggcauuucucccacuuggcugccuugguguucuacuuaaaacuauacaggcgccacuuuucuaccuuucccacacagacacacaucaucagaccuaguuugaguuguagagugaagaucuauauuucaugugugugcaggcauguagaggcuagagacugaggucacgugucuuccucaauugcccuuccaucuguguuuugaaauagggucucauugaacccggagcuuuugguuaggcuaggcuggguagccagugagccuccaggauccuccugucaccaucuaugguauauggaucauaggcaugugccaccacagggggauuaaacucugggcuucuugcuuacauggcaagcccuucagcaaccaaaucuucuccccgguccuacggaccuggauucuuacuuaucucuguggaugguuuacauauggcuugggacucaggcuuuacucuaugcuguuaagauaccuggacaggguggcugaaacuguaugugugugugugagagagagggggggggugggagagagagagagagagagagagagagagagagagagagagggagggaggaagagugugugugugugugugugugugugugugagagagagagaaagagagagagagagaggggaagagugugugugugugagagagagagagagagugugaaggagagugugagggagagggcagagcuugguuugugguucuuuuacuuuuguaaagauaucuuuggaagcuaaucaugguggcacauaucuguaaucauagcacuacaaggcuguggcaggagaauggcaaguucaaagccagccugggcuacacagugagacccuauauuuaaaaaacaaccagccagccaaccaaccaaaaucaugucuggagugauggcccagcaguuaagagcacuuuuuuuuguagaggacccuaguucaggucccagcaucuacauacaagcuaacuacuguuuauaacuucaguucuugagaauguaguauccucuucuggccuccagggcacuacacaaauguggugcacacacauauauacaggcaaaacacccuuacauauaaaaugaaaaauaagccuuaaaauauugagugggaacauccuaguaauaguguuguagagcaaauaucuuguuugcugugguuauacaaagaaaaguaacagaugacuuucuagaaaaacauuuucugaaguuaugagggucaagugguuuuauauuauugccuauaaauucuacccucgaggaagaauuuuaaaauguagaguuuagaacucucucauggaaggggagggcuguauggagagcugagcaguuaagagugcuuguugcucuuguagggcaugaguucaggcccagguacccaugugaggaggcacacaucuguccguaacuccagcuucaggcaugaguucaggcccagguacccauguggggaggcacacaacuguccguaacuucagaggucucacagugucuuuugacuucuuugggcaccuacauuuuccuguguguggugcaccacaaacaaaucaaagauaaaaucuugaaaaaaauguccuguugagguaggucucuaugauuugaauuauucuuugaaacagugucuaguagaguuggcuugucacaaaggagaauguagccugcuugagaacaucacuaagguuuaaaguagugucucagugcuaaugaagcugagaucaauaugugaagucuauauguuucuaccaccuacuguucuaugaaccugacugagucuccccuucugucuauuugaauuuaaaaaauguaaacacaggauucaggcucuggaguucgucaucuuuccauuucccugugacuuaggccucaagcagugcuuaccugugucaaacccaacuuuaggucucuauuuguccuuauuccuaaugaaguaaaaaugaggcugucaguggaucucugucuccgguuaagucucaguagagcagggucccgagucuuuggaggagauccccacugauaacuuugccagcuuuuacugaaggcuuguuuguuucuguugcuuuuuucugagaaauauugugguuaccaugaaaagguuacacucacuuaauguaauauuuaauagaaaucaaucuuggaaaaauuugcuuuuaacauuagguaaacuaggaauuuagaguauggaaguauacuuucuauuuuagugaguuaacaauuguuuuguuccuacaaccuuuccccugcaagagaaagcuguuucuagcuugucugaucaacuuuuguucuuuguuucaggaugcaauucgaagucacagugaaucagguacuuuacuuagugaucaguaaugggcuuuuuucucucuaugcugugaucuucuguuggcuuaucuacgugcggauucuguuugucuugucuauuaagccucaccuucagcccuguccagcagcccaaacaaccugaguccaacaggcuggucacagcccaaaaccccugugccagcacaaagagagcgggcaccaggaucugggacccaggaaaaaaacaaaauugugaguaugacuaguaauacuuuauugagucacucagggaucaaucaagauaaacucuugcaaauuaaauauuugggggugggaaccuaguaaaauauauuacagggaaaugaaugccagugcucccuggcaccuucguauccuauacguugccauucggcuacagcucaguaaacuggcaccucaaagacagaaaguguagcugcagugacagugccaucuuuaaaggaagcaggaacagauggggcuaggaugagccucucuuugaaagcauggcuuaugaaugaucuccacuuguuucagaggccucgugggcagagagacucgaguuauuacugggaaauagaagccagugaggugaugcugucuacucggaucgggucagguuccuuuggcacuguguacaagggcaaguggcauggugaguuuggggccugguuccagcugcagggcccuggugguuagguuccagcagagaagguuucuugguuuaugguggccuucuggauggguucuugaucauaccuggcaaucaaaucaauuuugaaauuucacagcauuuuaaccuuacguuauuuuaauugguauaauaaaauccccguggugcuuagaaaccaguaaacaaguauuagcccuggagugaaauauuaguggugcucauggaacaugcuucuucaugagcagaugucugcugcuuugggugaaguguacucuugacaccaacagcuggaagggaccuuauaacagguacaaggaggagcugucugcuccugaucaucuuagugcaggaaaacuggacacuuccugaccagugucucucuuugggccccagauuuaauuguagcuaucucuuccugugccagggggaauacuugaucucucagaaggaagauuugagcuuaaacucuguaguuguagcuugaaucauuuggcaacauacuuaaccauuuccauaccagguuuuuaacaccuggauuuaggauguuagcaguaaaaguagggguuucuuguaugugcuuauaaaguuucuugauguugcaccccccaguucagacauggugcugauaaccuuuauagauaauggggcagagauggagacaaguucugagcauaaagugugcagacauccaaauuccucuggaaacaacagcaucuacuucucucggugcacaucauuauauggguuuuugcuuugccugagucgucguaugaacaguugauuucuuaacagcauagaucagagaguugguuagugacucuuagagugacugagaacuguuaaguaaugcccugcuggccugucucuuggucugcagaggaaugcugucacugcagugggccgugaacagagccuguucuugaaggguugcuuaguaucaccuccagccucccuccugcuaucauagcccgccuguaaguuuugccuuugcaggcaccuggcgaccaaccauuuuccuggccucaccacuuaaguugaccugacccccucacccaucucucaccucgaccccaagcccucccaguuuguuugccauuguaacuccaagccugcccucaccugggcuauugcaccaaauucuucucuagcucuucuguucuacgagugcucaguuacauguccacaagacuccuuacuuuuguuucugaugcagucuagacuauccuuucuaauauuccuccuagugcuuacaguccacuaccuccauacacuccucacuucucaguagucuuugagcccagcuacuaucuugucucagacuucacagccgugcagcaaucuuccuuccuuggccagugcagccccuggggcacacaugguuucuggccacugugcuggacugguggcuucagcacugcuucucuuucacucagaugagcugcauucucuccagcagccugugccuuccuucggugcugggacaugucagcugucaggucagguacagaugauaaucuggagcucacaggggucaagacagggaccuccugggaacccugccuuuaccauuguucacaacugacucagacuuugaucauugcugccauggguaaccgacugguuuuuuuagacaagguguugguauguagccuaggcuggcccccgccucuguuucuagccagccuuaugaaaauuuaaaguccuugcagggaagugguggcauacuugggaggcagagaugaguucucugagaguucaaggucagccugguuuaggguucuaggacuacaggaugaaacauugucucaacgccuuucccuaaccuuguccccaaacugggaucuuuacaagguuccaaguuuauuauuguuaauacuucuauauaaaacauauuugaaugagacuucuaacuaucucugaaagcaagcugacuccuggguguuucugaggauauagagagguugcuuggauugcugccacuacuaaaagacaggauugugggucuacuuaccucccuguucuaguucucuauuuagaagauaggaccucuauuucuacuuccucucugcagaauaaguucaguaguuguacguacacgcugcaacgcagcaagguuucaguaucccuauugcucccacugguaaagaaccccuuucaacuugagaagggccugccuccucaucacuuuguauuuggugggcuacccauggccucggcacuacuuuuaucuucacaggguaaagcuguagagcuagcucauaugaccuaccuugacgcucaaguggauaugcgcuuguugaaggccuccauggguaugaguagcauugaagcgucucacccacuugauguauauuaguuggcauauuuguucuaccugcauauauguucuuugaaaagugacucccuaucuuccuuagaauuaggguuuuuugaaaagcugggagguggcuuaguugguaaaaagagcuuuccauccaaacaugaggaucugaauucaagccccagcaguuacauaaacauucagcugugguuguacugacuugcauucucaguacuggggagguagaaaggggcucacugguuaacccuagucaaugaguccugggucccagugagaaccugccucaaacaaaacaaaagaaaacaagguaagaugcacauagauccuaagguauuugagaaacaaagacuauauaacaaguaugacuacaaauuaauuugcaggagauguugcaguaaagauccuaaaggugguugacccaacuccagagcaacuucaggccuucaggaacgagguggcuguuuugcggugagccuagucccuggacagcaggguuagcuagggccaggcugugcaggucagcaccugcuguggguuuuaagguuuuaagggacgguccuccuccaguguauauaugugcuggaagccagaagagcccuuuucauggacacaccccuucucuguacagcucuaugggguuugguuugugguagugagauuguuuugaaccuuuauuucuuuuuauagcuaauagcaucuuuuauagcuaaucugcuuugcucuggagcucaaacccucaguguagucacggaaucacucuuagauuaguagggaugagcuggacagacugugcaaagugcauucucuguaagcaaggcuagcuagcguggagguggacaaaggauggucucacagcugugcuccccuccuccccuuagcaaaacacggcauguuaacauccugcuguucaugggguacaugacaaaggacaaccuggcgauugugacucaguggugugaaggcagcagucucuacaaacaccugcauguccaggagaccaaauuccagauguuccagcuaauugacauugcccgacagacagcucagggaauggaguaaguacacgguuuggugaguccuuguggcuugaacccuugagcugcuuuugugggacuggaucgaguggcucuuugacagcagauauucauggaugggaaguccggaguucccguuucucaucagccugaccguccacucagccauggccuacagggagauacccuuuccucaccggcacuuuucucaauuacaauucaaaaaauuuuuuuaaaauuauguauauuuauguggaucuuuguguagguaugagugccaguauucaggagucccccuggggcuggaaucaguuguaagcugccugacacccaaacugucucuuuugauuauccauuuucuuucaaaggucaucucuagggucucugcucccaugguguggagugaccaggugaccaccaggcagugcucuuuagcuuuguuucccaagugcccuuauggugagggugcagagcuccuuagugcuuacagccaggugacuguaguugguguguuacaaaauaagugcuucguucugucuuaaagucaugcagaagccagauagguggugcauaucuuuaaucccagcauucaagaggcaaguugcaucucugaguuuaaggccaguauagucuauagagcaaguucuaggacaggcaggacuaaauagaaaccuugucucgaaaaacuaaagaacaaaaaaauucauacagaacucuaaaucauaagcagcacagguacaauucaaauaccauacaaauuauuuuggaaguguauggcuugggggcuuuucuguauccuauuacuacauucuguguucuuaccgcccagaaaaaaauccagcucacagccauccccggccucugacaaucugccuucccacuucuggguuugucuuggauaggcagaaugugaggugaaaugccuggcuugguuugcagagcaaauccaaguuucaauaugcagagcacagugcuacccaccaguuagcugaagggcagugaggugguuaacugagugauuuuucuccuucacagcuauuugcaugcaaagaacaucauccacagagacaugaaauccaacaguauccuuugguauugaguucucagcuuaaggacccaaaagggccuuuuugcacacaugguucauggugccagaauggggagaaggggacuuuuaaaggaaaauagaaauauaguugagaagccaaacauggugaucaugagaguuccuuaagguuuuauuauuauuuuuuuuaaccaacagugaucuggaaauaauuccuucugaggcgauacacacuugaaauagacuugaacucagccugguuagauuauccagaauauagcuugagaagguuauugcaucuauuucuauugagccuauggaagguguaagccugcauacagaugggaaaguaucugaugcauguaucuaauaccaacaagucauaagugauugcugccuccugcucacuuuucagaccagcauaaugucagccauauaguagaccaaugugauauuuuguagaagagacaugaacaagaucccuucaaacuaaguuaugacacaaggcuggagaguuaaagguuuacuguugaucuuucuaaucaaaagcaauugcuucuggugguccuuauggacagauaccaaagaaaaaggcauuugcuaggucaguagcuacacaucguauaucaggaaguaugcuaauugcucaaguaaggacaccacaucugguauagccugucacuuuuuacaguccaucugucuucuguacuggccaugaaucaccaccccugcaucuuucaagucuuugaugguagcacugauugcugcaauucugccagggaugugacacuuuugguucccaucccuggcagagacccugcuaaaggcuuccauuuagcuuuucccaggggaaacaguuugaaggcccacuguaacuauugugagucagacuucaaccaaaauuccacuaaucaccugaccuccuauuuuuaacucaaaggacacaauauuucuuaaggucuccuggaauuagcaucuuagaaccaguaucccagaauuccagaaauuucaaaauggcuacuuucuguuaaauguacagaagucagccuagaggccacuguuagaaauagcaucuccuuaccaacugcaccuuucaugcuguaagauggcacauggcagggugguuaaacucagcuguucugcauggccaaugagcuaugcuuauucgguggccaugaccuccuuucuugaggucauucuuuuucggcagcuaagcacugggccaagauuuaaggcuugaauuccaauaaaucagcaggucacaaaucagaccaaaauugccuguuaccuagcaguaagcugacagaagucacaauguagaccaguugggugguaaaccugaguaccaaauguaggcagaggggauaagcaguguggggcccuguaauugagugugcgcaugccaucguucccugucuccugaaagauuuaguagugaagugaaggaggccagaagcacuguuauaaacaguauaaacugucagucuccuuaacaagcaucgagauauauuucuccaugaaggccucacggugaaaauuggagauuuugguuuggcaacagugaagucacgcuggagugguucucagcagguugaacagcccacuggcucugugcuguggauggugaggaagcuggccccacacaacaugauggaauuacugggccagaguagggugcaaaauuugacagcauuucugcacagccaugggggucugguugaucuguggugucaguuagcuuaaggcaaaaccgcauauccuggcaaagcaacagaggccagcgccugugggguuuugugggaggagcuacccugggcuaaggacuugaacuuccuuccugacuaguuaaaauagccugguuccucaaugucucuggaggucauucccuagggauuaacacacuucauccuuacaggccccagaaguaauccggaugcaggaugacaacccguucagcuuccaguccgacguguacucguacggcaucgugcuguacgagcugauggcuggggagcuucccuacgcccacaucaacaaccgagaccaggugaucugcauggccgggcgacacagugaggggcuacuuaguccugggacucuccuucacagacuccuuuguucaacuguuucuucuuuagaucaucuucaugguaggccguggguaugcauccccugaucucagcaggcucuacaagaacugccccaaggcaaugaagagguugguggcugacugugugaagaaagucaaagaagagagaccuuuguuuccccagguuagagagcucaguugaaauauaacauucuaaggauguaaaugugggccaggauugggucgguggagagaggaccuccacaagcucuugguaugguuggggagauaccaaguuuccaacuaaugagaccacguggggccuuguuucagauccugucuuccaucgagcugcuucagcacucucugccgaaaaucaacaggagcgccucugagccuucccugcaucgggcagcucacacugaggacaucaaugcuugcacgcugacuacauccccaaggcuaccagucuucuagcugaugauguagcuguucuuaggccaccaggggacgaagaagagucagcaggcaccacuuucuguuuccuugggggcagaaugcauguuuuuggaaaagcugcugcugcuaaggaccuagacuacucacagggccuuaacuucauauugccuucuuuucuaccccuccugcccuggaaauggaagcuguccaccaagaaagccugcucagcuccagagguauacaagucagcugaguauuuguagggcaaguggccuuggagaagguagggcacuccggcugcugcagggacaugcaauugggaacuuggcuccuugagccuauauggacaguggugcagugccaguuuugcacauggaguccuggccaccugggggagccugcuuugguacuacagaacuuuguggacaaacugugucuaagguguccuguguggauggcuuuccaagcgcggugcuccaccuuuggcagccucccacgugcugaaucugucuuccaggagcugccccuauggggugggccgcggcccaacccuaucuguagccacauccuugucuguaagaaagccaggaauacagguuuucuuaaugauuuuggguuuuaauuuuguuuuuauugagccaauacaguugguuccuuauguuauuuuaauaaaauaaauuaaauuuagguuuaauggcuacugacuccuucaaaacuugcagugcaguuucuugugcagacagaacucaaggagcccccucugcaguucaugaacaaccaagugaaaagcacacagguaauaacagguuuucuuauaaaaauaaauucagguucaggacaaauuugcucuuucuugcccccaguucuuagacagaggagugacugcuccuguuuaccacaaaaacaaguguggagccuacuacuuuauaggggagaacaagcaaucugugaguccugugucuugugcucuuaguacaaggggaggguaagauggagucucccuggagaucuucacaacugcacacaccugugacuugagacacuggaaggaacucaauagccacccucacagcuguaaaagucuacacuaugguacagcagcaccaauauggccaaauguguucucacuacacagcugcaucaauuccaaggcucgacaacucuauuagagaugaucacugcagaggagccuucuacagggcuggcgaugucuuggcaaggaaaaaaaaaaaaaaccagaucugcugcaaguuuacuguugcuuaaggaagaaagucacaaaagaaagauggcagucagguuucauuuaaaagcacucaauuaaaacagcuggaccacauagcuggucccggagaaagggguuggagguacaacugagagcucaacucuaaauguagugauucuguggacguggugaucucccuucccuucccagggggacucacuacugcacucacaucccaguaccacgucaccucgggucggugacagaugcguccacaccgugccuuggaaaguugacugcagagccaaaugaaggcgucagcacugacuaggguucugaugauucuacuccagaaaggugcaugaagaggucuccuagcucugucacauccacaucgucagugcuggggacuugccggguuucucgguucucgauaaaaucccaaagccgaacugaguuaaa

SEQ ID NO: 3312 - RNA, 31919 nt, Mus musculus
gggggcgugguggaggggaggggaggccgcgccgccauauucgauucgacccgcaaccccgcggcgcagccagcaugaguaccggugccuucuacaucuccagccugcuggagaagaugacguccagcgacaaagacuucaggugcgcccugugggggcucgggacucguuuucaggggucucagccugucccggccgccccucugcuccccugcccccccccugcggaccccugugggagcccccggccucuucgccugggccuggcugggccugcagccccgcccccagccucuucccgccuuugcugugcuggccucucaaguccccaacacugggcgccccccaggcucuccagugaaguccccgucggccucucuuuggaacccagugcaguccucuucugacccucauugaaacaggccgcuucccugcacaaccuccauccaaggcuaucuuccgagacccacacuucugcccggucucuagguuaccccaucccccgcacccuguaccccuaccgggucuccuaacccuaacaaacuuuacuuuucuuucaucucuuucuuuucaucccgugccuuuucucccuggccccucaucaccaccccaucuuccuuauuccccuccucucccaagaugguuuagagcaggaagcaaagguuggggugagggcuaucucucucccccauucuuuuucuccuauccuccucuccaaacaccacagaaacacaggaacagaguuggcaagaggaaugggaauaucugaugcagccccucuugcaggggaaacugagguucagugauaaaaagggguuguuggucaguuguggacccucaagucaacaggacagugcaccauucugagucuucugucacaguaguuaucccuccgauuacaaacagggaaaauuagguucagggacaugaagggccuggauacaaugcuaacgguagggccaagcagaguuggaggugucagugggauucccaaucuagccaguccggaggggccagaagccuauuuguguggucugaccuuuuccguguccuguaaauacaguccucaaaaaucucugugcagcccuaagccccacagugguaguagggcuugggauccuuugcccuggcuucagaucucggcaaccaucacuaacuagaucuguaagugaugggcaaaguacuccaugcccucugagccuuagcuuagcuguuugugcuuuagguagcagguaagugcuuugugaaugguuguccugacucugugcagggaaacggggcagguccugguagacuguucuuuguucuuugggcccaaguucuuucuguucuccagaagucuggagggggcuuugacuuacucaaagucacauggccugccagaguugagggaaugacuccugggccuaucagggaguuggcucuaucacucagggccugagaagcccuuuaaaucugucccugccagcagcguugaggacaccuaaaaccacccugagcauaugagaaugguuucuauuuuuaaaagucugaauaccaagagccugagccuccucccaacccccgccccccaccagcuguccaggcaccaugugucccaguguccuauggugcugccucucaacauggcaggagaccauggcuuaugguucccagcggggaaugucugacugggguuccaggcaagggacagccagccuugguucucaguuuuauuuggggaucagacucuugacagagaaaaccaagaacuugagaggucugacagggauguccaaauccuuuuucacugaggcagugcuguuugaggauucaggugaccuaccucacgcuggugcuucguaaccucucugagccugcuugcucagauugaccuauuaaaacccucaaggaugcugugggagaggggcaaagacaauuuccguuuuauucauggaaaaaccgaggcuugggguuaaggaggcagcuggccaaauuuuaccucacugauaagacaaguauguuuacuuaaagccucgcucugcuuuggagcucuugcuugucaaauuauuauccccaccaccccagcaccaugacauuuccucugagagugaugucugcagaccugagguguuugaaaugcugcgguauauuugugaauguugauuucuggguucggguuuccacgaggccgcuuggcucuaagccagugguucucaaccuuccuaacacugcacaccuuuaauacaguuccuuguguuguggugaccuccaaccauaauaugaauugguugcuacucauaacuauaauuuugcuauuguucggaaugguaauguaaauacuugaugcaggauaucuaauaugucucacacacacacacacacacacacacacacacacacuccaaaaaggggccucgauccacaccucugcucaaggucuguugagcacaaacucuccugcccucacccugcucccuugucagaccuguuccuugcugagcuuggaguauuagaugugagccugcugagcaagaguaugugugcacgcacauguguuuaugugugugcaagauaugugcauauauuuauguauguauguuuguuuguguguacaugugugaaaguauauguauucauauauguguguguaugugcaugguauggggguuauuauguguauguguauauauguggggauauuauaugucuuucugugugugugugugugggugugugugcaugaaguguucucauacauucgcuguaugggagaaaagugcugucaaggaggggugcaaaguccugaagugacuaucuagggagacuguaaugcuuagguguguguuggucagggugaucaggaucaccccugaagcaggaacauuugcaucaaacucuuuuuuuuuuuaauuuauuuauuuauuauauguaaguacacuguagcuguccccagauacuccagaagagggcaucagauuucguuagggaugguugugagccaccaugugguugcugggacuugaacucgggaccuucggaagagcagucggcgcucuuaaccacugaaccaucucaccagcccugcaucaaacucuugaugggugcgcuaguugguuuuccaagucagguugacacaagcuagagucaccuaagaagagggaaccauaauugagaaaaugccuccauaagauugaucuagagauagacugugguccauuuuuuaaaauuagugauugacuggggagggugcauccuguugugagugaugagggcccugggcagauagacuuggggauauaaggaagcaaguuggaagagucauucgugccuguaugucaguaagcagcgcuccucuauggccucucugggcguaguggcacaugcuuuuaaaccuccacggccucugucucaguuccaggcuuucagugauagugucuuagucaggguuucuauuccugcauaaacaucaugaccaaaaagcaaguuggggaggaaaggguuuauucggcuuacacuuccacauugcuguucaucaccaaggaagucaggacuggaacucaagcaggucaggaagcaggagcugaugcagaggccauggagggaugauucuuacuggcuugcuuccccuggcuugcucagccuccucucuuauagaacccaagacuaccagcccagagauggucccacccacaagaggccuuucccccuugaucacuaauugagaaaaugccuuacaguuggaucucauggaggcauuuccucaacugaagcuccuuucucuguaauaacuccagccugugucaaguugacacaaaacuagccaguacagacugugauguggaaguguaagcugacauaaacccuuuccuaccuaaguugcuuuggucaugaucuuuaucauagcagaagaaaccuuaacugagacagugagagcaugggaguuuggcaggcccauuggggccacaugcagcagaaguucagcaagguccaaaagcaaacaaacuuuauccuaaagugccugggugguagaugggauagcaauaguaccuuccucucuaucagcucagcuuccugccuuuucucagcagcuucaggcugauccagcuguuaaaauuaagaaaugguggcauggacagggucccuccagguucugugggcggccaugauaucaaacagcagaccugggccagcaauguaagggcugggaccccacucuaguggugacagacgggaagcaggcuuugucuggacuccucuuuguagcaucucuccugcucuggcucauuuccacucaaguccccguuccugugugagcaggagcuagcaagcaugguggccugugggagcaggugucccgagaagucuucugcaguuagugcacuagguagagacccaagucauauuuagaucuucuguuucugggaguuagaagaauacuuuaaugcucuucagauauuggugaguaauuuacccaggggaaaacauguuuguaagccucacacagcugagggcagccagcuagguccucugcucugcccucuucauuucagcaggaaugaugccucaugaggcccuuucauuccauucucuguugccuucugacuuggacucccaggguaagccagaugcucaggacagcagcaggccuuuuuaagaaggccucgaggccucaucugccugggauaggugaagcccaguccuauaacuaagagaguauuggucaacuguuagcucuggucuccaaaauaugcauguuuuaaaaaguguucaugaccagccaggcauagugaccugugacucuuaauuccagcacgucggaggcagaggcaaggggauuucuuuuuuuuuuuuuuuuuugguuuuucgagacaggguuucucuguguagcccuggcuguccuggaccucacuuuguagaccaggcuggccuggaacucagaaauccgccugccucugccucccaagugcugggauuaaaggcgugcgccaccacugcccggcggcaaggggcuuucuaugaguuugagucuagccuggcuugcagagugaguuccaggccagccuacauaaugaaaccugucucaaaaacaaaacaaaugaaaacucaaacaaauaaauaaccagauuugugucccugaacaccaccuaaggacuuggaaauauguguuccuagaucaaagccucuauucguggucugagaagcugggcugguccuaguugugaugaacaagucccuuggaugaggggcacaaauucagauacuugcuaagggcagguaucugaacaaggugcaucucugcaucuagaggugcuucugcuccacaucugacucugccaggaagcuguuacugugaaaugugaaugacacaugacaauaacuggguauguguuguggaucucacaacccuauaaucaaagccuaauucaguuucccccucaauuuaaaaagauauuuuaagaagauuuauuuauuuuuauuuucuguguaguagugccuauaauguacauccaguguuccuggaggccagaagagaaggucgggacccuggaacuagaguuacaggugguugcgggugaugagcaccaaacccagguucucugcaagagcauuaugugucugguuucuguuugguuuuggcuuuugaaauaggauuccucuguguagcccuggcuguccuagaacucaguguguagaccaggcuggccuugaaccuggagaucugccugccucugccucccaaaugcugggauuaaaggugugcaccaccacugccuggcuggcaagugcucuuaaaugcugaacuaccauuuuucaaacagguaaaccaaggauuagggagaguaaagcaagugacuuacacaaauuccagcuuuugaaguggcaguggcaggagccuccaguccccagaccaugggcuucuagcccagugguucucaaagugggucgugaucccuuugggggucacuaucagguauccugcaugucagauauuacauuacgauucauaauaguagcaacauuacaguuauuaaguuaugaaauaguuuuaugguuggaaggucacuacaacuugacgaaccuauuauauuaaaggguugcagcacuaggaagguuagagacugauuuagccaguccuccuguuucagugucccaccuuguggcagcugacauaguugagguggcucagccuugcccacaguacugauuacccaccugccuuugaacccuugcacugagauuuacuucuggggaaucugagagaguacaccaaauuaucagggccuugaagcugcuggacagcccucuuuucccccugccccuacaccagguucauggcuaccagugaccugaugucagaguugcagaaagacuccauccagcuggaugaggacagcgagcguaagguggugaggacgcuccugcggcuccuggaggacaggaguggugaggugcagaaccuggcugucaaguggugaguggagcaggggugacuugggggagggccacugccccuaggaugcagccugugagaaucaucaggccguucuugggcccauagcagggucagauggugccuuaggcaucauuccucagagguugacccuaugccaagaguucaaaucuaaguucugugggagaugaucuagggaauaggacgggaaauagggaagaggagaugggagggaguuaguucuguaacccugagaggucccugaguaaugaucuggaccaggcuuugagaaaggaggcuccagaucucagguugaugaccagcaucagaaagugcacuggaaggccccaccuagacccucugggguggcucagcaacuguuuaguaguccccugggagaugugacaccagcucgggugugaggacccuugcuuuggggcucugugggaccccaggauaagaugcaauucauagacuugggggugaaccacauuccuagcaagaaaggguuuccuguugagcugaggucuuuccucaguauguuuguccccaaaagauugagaggaacgaagcagguagccuggcuuaaggcaugcccgcaguguuuggacccuuuucccuuccucugucugucucagccuggguccccuggugggcaaggugaaggaguaccaaguggagaacauuguggacacccucugugccaacaugcggucagacaaggagcagcuccgggacaucgcuggcauuggccugaagaccgugcuuucagagcugccucccgccgccacagguacccaggcccggugcugcuccucagcccgcugacgucucagauacugaggccaggcgacuccucucugggaugcccacaccacaucacagcgugccuucuguguguuuccccucacccagugcuuaugccuauauuaaguaucuuuaguaaguagugcguagcauccuggagguagaggcaaugcaucaguaugaguuugaggucagccugaucuacauugauccaggacagccagggcuaaauagugagaccuugucucaaauuuaaaaagagagagggcucagcaaaauaaaaagaccuacuugggucccucgguaguaaagauuucagacacacggaucaguuuacauuuguggcugccuguuugucaggaaugcuuccagccacaaggaaagagcucgaaggcauggcagcuuaaagaccugcugugaucucucuggagggaugacugcagcugccgaucuucuccuccaccgauccucccauucuuccuccucuuccccucuccuuuuuuucugguggugcuggagacuaaaugcaggggcuuaggugggcuaggccaagcuacuccugcccauccugguagugguuccguaacucagucugacagggucacauucuucauccauguucucuccucuuuguaagaaaagaugcauuuucccaguggauugcacaggccagagcggggcaccuggccauugcuaguagcaagggacugggaaaagaaguguuuaucucccucccuggugugugagccagccagcagcucagccauugguuugucaccuuccuuagagcugaucccuguaguuguucuuuaagacuugggucagccuuggaccacugaagcccaggcuucccuaaaccacagauauauggggcauauggcuccagaagcacaagcaggccagaguugggagcuguuuucccaacccagggccuuacccuucuacuugcacccugcauaggcucagggcuggcuaucaaugugugucgaaagaucacaggccaacucaccagugccaucgcccagcaggaggauguggcugugcagcuggaagcccuggacauccucucugacaugcugagcaggugagcaaguccacuuuaggcaagaaagauggggacaggcaagauugagaugaguggccugcaugccagguccugugcuuagucacccagcagccuugcaaagaaagcagugucauacuauggaacuggcucugggaggucauuagcuccaaggucacacagucaguaaguuuccggugacuugugcauuuguucuaggggcaggaaagguuaggugcuagcauauuggugcaacugcauuguucccggggaggaauucacaggcagguuggccaacuauaguagagugauuaggucagguauaggucccaagcugaaaaggcccagccccgcugccaggcaggggaaucuuacuggagcugagucuucaugggcccaucagaucuaggucaucacagagggcagaggcaggagaggauugugaaaggguucagguuugggggucaaggggacacugaugcagauugccuuuuugauuaaaagauuaaaagggccaggugugguggugcacaucuuuagucccaguacuccggaggcagaggcaggcagaucucuaugaguucaaggccagccuguucaacaaagaaaguucuaggacagacagggcuguuacacaaagagacccuaucuugggagugggggggacccaacauggugagcucuaagcagaguuuaggccuauauggcagagugaggucccuuaaagguuucagaguugagaggcaugugggugacagcuguccuuaauugguguuuguaaucaggccaucucugauccaggauggcagggguggggggaggauucuuguauuuggaggaaggagugaccuucaggggaagaggggcccauugaugaauauguaugcaacauucagggguuagucugggaccuaauacagugucagcagcaugugaucgugaccuaagcagucucugcucuggguccuaacagacuugagccgaggcuugugcauggugagcugauugugggagcuggugugcagcagugaggcuggagggcugggcagggcccaggacacagcccugucuuccuuugcucuuuccuucuguagucuggacaagcagggcuggauaggagugucuuuguuuuuacauuugcgguaggauuguacaauccuagguuuuauucauacuggggaggaacucuaccacugaucuaugucucuagcccuuguccuauuuuauuuuugagacuccaucucucagaguugcucaggcaggccuugaacucacucuguaacccagauuggccuuaaaccugcaauccuuccaccuuagcccuccuagcaggugagauuauaggccugugccccuaagccuggcuuggcuuccaugagcugucugaagagguggacuccgcaggaugggguggugagacuagaggaugaccggaaccaggagaugagagaauugggguggggugcuccgggagcagaagggugcaguaggagauuauguguugaguuuguggagcuuggaaggcacuccucaaucacgggcuucaagggccagagucuguccuuauggcccgacuucuagcauagaaccugugacacggcagaugaauuaguagguaaaggcugcagcagagugaccugggccagacacaggagagugaggucguggagggcagcagagcaggaagagaacagccuuaggacacuggggucagagucacugagagcuauuugacugugggagaggagcugaggccaccgagagcugguuccacccaugggaagacuauaugagggcuggcgcuugucuugcguucagagcucaguuuauccagaggacacuggggagccauggcaggauuaagccuagugaucaaguuuauuggguuuuauuccccucgagucucaguaaggaggauagacuugcagggaugggcauagaggcaaaccucaggcucccaagaguucggagcauccucccuggagcccacaugcccacugcacuccucccugagcugagaggauggacaccugggcucaggucauggacuuagacuauugacuucagagccuucagaaggcagucucgugccacuggcugcccuauaauaagcaguugagucaccccccacaguuggagagguaccuuuucacuuuccaagggucuuugaauaucauugguaagagguacagagaggauggggaugcagauccugacugccugaaugcaaugccuggccugacauucccucccauccuguccccaggcuaggugccccguugggcaccuuccaugcaagccugcugcacugccuauugccccagcugagcagcccacgccuggcugugcgcaagcgcacuguugucgcacuuggucaucuggcagccgccugcagcacugaccucuucguggagcuugcugaccaccugguggaccggcugccugggccacgggcacccgccagcccugcagccauucgaacccugauccagugcuugggcagcgugggccgucaggcaggccaucgccugggugagagggcagggccaaagcguugauggguggagguaggggauaugcuccuagcaggagcauaaacuggcuuuccuuuucugagucuucugccucuuggguggucuccugggacugacuucuguggccuagaggcuuagggauaguccuugcaagucaugauaugaaacccuuauucagaauguguuccagccuucuacuuugacaggcacaccuuaaccugggagccagguuuggaaucuuucaucuuuuauugaaaauaauaggucuacagaagccauacuauuuaaaguacacaccagcauacaguugugagcucacaucauagucaaaacacucaucauuaggcuggagagauggcucagugguugggaacaucgccuguucuuccagaggacccaaguucaauuuccagcaacuacauggcagcucacagcugucuguaauuucaguuccaggggaccugacacccucacacagacauacaggcaggcaaaauaccaauggacauaaaauuuaaaagaaagaaaaagaaacccacucagcauucccaccauucccauuuccaucucugccucuccucagaucaccaccgcaggcuucaucagguaaacuguuagccacagacaccuuagguguugcaaauuagaacaagacagugugcguggagguagcauaaaucagcccuccuaaauccuggugagccaguggucuuuagcagcuacuccuggcuacccucuaggguucauguuugguugggcaggaaacugaguucccaaggauccaaaaaaguuuauaaaggacugucuagggcuggagagaugggucagugguuaagugcauuugcugcacaugaggaccagaguucagauucuaacaccaguaucaggcugccaacaaaugccuguaauuucaguuccaacagaucugacacccucuuuuggucucugcaggcaacguguguguguguguguguuugugugugugugugugugugugcgcuaaagggguugagaccccuuuggggaucaaaugacucuuucauaggugucaccuaagaucauuggaaaacaaauauuuacauuaugauucauaucuagcaagauuacaguuaugaaguagcaaugaaaauaauuguauggcuggcagucacuacaagguaguggguggggaccaggcauaggacccucuuguucucacaucugcagcucacacccuaguguaggaauaaggcacauuccugacuaugccucaaccacauuugcccaaccugcagggcccagagcuuagcucuaccugcauuguucauugguucccaugccaucaccaucaguagacugagucaggacgucuuugcaaguggcccacagccccauaacauagcaaccaggcuacaccccagccagcuucuaaguugaaccugcccugcaaaggcaaggcugggcugaggcgaagcuggugacugaggaaggcuggcugcuucagugacucuuuggcucugcaggggcccaccuggaccgccuggugcccaugguggaggaguucugcaaccuggaugacgaugagcuaagagaguccugccuccaggccuuugaggccuuccuaagaaaguaaguguggcaguugcgccagacaaaaggcaggggagcuccacgggaaguuagcggggauggggugacagcucuugacuuguuuuggggccccaccccugcucuuccacgcugaguuccagugaggccuccccuccuugucccucaggugccccaaggagauggacccucacguacccaaugugaccagccucugccugcaguacaugaagcaugaccccaacuaugaccaugacagugaugacgaagagcagauggagaccgaggacagugaauucagugagcaagguagguggacagccuguuugagggagagcagggcacagcagccaaagcaggggcuacauggccugccuggcuggaugcugcucuucucuagcuguagggaaggcagugcagucauccuccugcugcccuguuaaacagcccacaccaaaaauaccugggaaagaaguuagucuguauuccucacauagacagugaggugacagcugguguugggaugugugugcuguaucagguguuauaaauauuuaguggugacuuaaggcugggagugggguguguaggguauaugugacuacucucagauauugucauccaggcucccacaagucccaagggacaacucuuaauugucacuuccugauuauccacugguauucuaagcucuucccucauauuccucauagugacccuaagaccuagggggaaucauacucguauuucagacaaggaaucaaggaaacacccagaagugaccuagcuaggacuugggugagcucugauaaacaccaccuuuaagcuaccuuuguuguuguuguuguuuucuguuuuguuuuuuuugagacaggguuucucuguauaguccuggcuauccuggaacucacucuguagaccaggcuggccuugaacucagaaauucugccucugccucccgagugcugggauuaaaggcgugcgccaccaugcccaagcuuaccuuuuuuuuuuuuaaaaaaaagauuuauuuauuauauauguaaguacauuguagcuguccucagacacuccagaagagggagucagaccucauuacagaugguugugagccaccaugugguugcugggaauugaacucaggaccuucaguagagcagugagugcucuuaaccgcugagccaucucuccagccccuaagcuaccuuuuuuauaaaugguuuucaagauaaugcuucuagcccagcaccaaagcucgagggagaauggugggcacuuggaggagacaaguccagacgggggcucaguggcuucuucccuuguggcuugagggccucuccaucacucagauuccuacaaguggggugcacauggagacuagggaccugaaacaaaaucagacaggcauccuggggccuugaaugcugagcuaagaguaggucauuuucuugccagugauagagagcuagggauauuucuggagggguggcacaggguccauuaaaggagauguguacugagcugcccaguggccauggcccguuguagcugguccggaucucuuugccauucaagccuuaguugucagcagagugguucagaaggaacaccuggucucagauacagagugcagagcugcuucuugucaccucuggcuugcuccuugucaccucuggcucuuacguucucucauaguaagauagauggagugaaucucugcauugcauuuuccuaacuauguucccugaggcggucucucacgcucucugaaccuuggccuugacgacaucuguacagugggccaguagucccuuuguucugguggaguuguuuaucugcugacucuccugccugucagcagagagccucacacaccuauuuuuuucuuugguguuugucucucugaacaccuuugagaucugacuggggcuggguuagcacugagggcacaagaaguccgccuuucucuuuggaaaucccaguacauaaaagggccagaccugacccagaggaugugccugagccccagaaagcuccguguguccacugcaaacuugaaugccgugucauucuauuuuggaagagggcaguguuucauuaaguauuccaggccucuccaggacugggauuuacaggccugugucagcauaccagcccacuucauccuugaugcagucagacaaggaucugacuacaggcuguggcucaauagcagacaauuguacaguggaucaagccacuuauugucucuuggucccaguuuucuucucugcgauagggaaugguccuugcccacaggagagaguguggaucaaagccguggguaccauccugcgcgugccacagguguucacuagggugguggcguacccagugggcugaauacugaucaucaggaugugaagcccagggcggggcuuccacuaucuccuuuccugagcggagagacacagcucuguaugucuuccucuuccccagagagugaggacgaguacagugaugaugacgacaugagcuggaagguacgccgagcugcggccaagugcauggcagcccucaucagcucucggcccgaccuccugcccgacuuccacugcacucuggcaccugcgcucauccgccgcuucaaggagcgggaggagaacgucaaggcagacaucuucggggcuuacaucauguugcugcgacauacacggcccccuaaaggcugguuggaggcuguggaggagcccacccagacuggcagaaaccucaauaugcugcgagcacagguagacuguguccuuacccacucccuccuuccguucuuccuuucuguccccaucucuucacuugcugagggauguggugugagcaccucucugugcccagccuggguguucagauggagcccugccucuccuuggucugcauggugcaaguucggacaugggcagcagcaacacgggcuugcaggagugaggagaccuugcuugcuuaguuuaaaucacuucuggcugguggguggggaauggauugugacaggacaagagucauggcuggggaccaacaggaggacauugcaucugugucaggugacaagagaugguaccuuugacucagagaaagcagagggauugaaagggauagucguugagaagugggcuggauugaacugugggaucuugcugguaauagguugcuugugucugggagaggcagggaucaguugacuucuuggcuuccugagauaggggacacugaggaggagggaacaucuacaucuuuguacauuuaugguugaaguccucauuggcuguaaguagugaauuuucuguuaguauaauaaauaaacugggugugguggcacacaccuuuaaucccagcacuugggaggcagaggcaggcagauuucugaguuugaggccagccuggucuacaaagugaguuccaggacaaccaggaguacacagagaaacccugucuuggaaaaaaaaaagccaaacaaaccuaaauaaauaaaacaccagaggccuggucccuacuaagaaaagagguuuaauuagcucagguuugaaacacagaguccaaaaaucauggucugugcccugauguggcuugcccuagcugugugacaucuuugcagauagcaugaauauacaaaagagagagcccaugguaugacacaaagccagaauuaugaggacuaggcccccauuuuauaguuaaccuguccaauagaaccaguucaugcuuuuuagugacuuccagauaacgccaccuuuuaaagggcccucucuucugaguuccaccaccacacuggggaccaagcuuccaauauguaaguucuugugggacacaaacuuuauguagacuguagcagaugccuagguugagccacuugggugggcaggaaaugcucaagcuggaucagagacacagaucaggguggaacccaugccacuggauucaggaccaucuggggagaguauagguaaagaaggggccaugcgcugaagacacuaagcuucugcuuucccuucauagagauagaggugacagccaggcugcugggucaccuugagccaguuccuugugcacauguauaagauggagguagcugucacugugucugcagagucugaaucaggugacuaguagggacugaugggcacuaaggcgaccugucuguguuggaacccucccugggguggcuuccuugcugguuccugaucuccccgccugcucacaggugccccuagugauaaaggcccugcagcgacaacuuaaagaccggaauguucggacccgccaaggcugcuucaaccucuucaccgagcuggcaggcguccucccuggcagccuggcagagcacauggcuguguuggugucagguacgcugggcuucggcuggcucucuucucuuugggcuucuucuagaauacagaccccuaccuuauauugagcccucaauucuugagagcccagcaauauuccugggcuugcccugugcgaagauggcucauggugguuguguauugugcuccccaccucuuggccacagggagaacaaggcugcuuuuaacuuaagaugaguucuggccuuguuuuccucagcucugguggcuucuaggagcuuuggaugcuugguucaggacagacacauuggucacuacagccccagacugagccgggcugaagagccccuaaccuugguucccaccugcaggcauugucuuuucacuggccgacuacucaagcuccuccaccauucggauggaugcccuggccuuccugcagggacuucuggguacagagccggcugaggccuuccauccccacuugccuacccuccuaccaccugugauggccuguguggcugacccuuucuacaagguggcagcugaggccuuacuggugcuccaggagcuggugcggacccuguggccacuggauaggccucggcugcuggacccugaaccauaugucggagagauguccacagcuacccuggcacgacuccgagccacugaccuggaccaggaggugaaggaacgggccaucucuugugugggccaccuugugggucaccuuggugaucgacuuggggacgaccuagaacccacacuuaugcuucuccuggaucgccuacggaaugagaucacccgguugccugcugucaaggcacugacccugguggccauguccccauugcgacuugaccugcagcccauccuggcugaggcccugcccauccuggcuucauuucugcgcaagaaucagcgggcccugcggcuggccacacuggcugcucuggaugcccuggcucagagccagggccucggccugcccccgccugccgugcggacugugcuaaccgagcugccugcucuggucagcgagaaugacaugcauguggcccagcuggcugucgacuuccucaccacagugacccagacgcagcccagcucucugguugaggucaguggccccguucugggggagcugcugcagcugcugcacucacccuugcugccugccgggguguuggcagccacugaaggcuuccugcaggcgcuggugggaacccgcccuccguguguggaguacucggagcucauuagccugcucacugcaccuguuuacaaccagguuggggacgggggacccggccugcacaagcagguguuccacucgcuggcccgguguguagcugcccucucagcugccugcccccaggaggccgcagguacugccagccgccugguuugugaugccaagucgccccacucaagcacgggggucaaagucuuggcauuccugucacuggcugaggugggccagguggcagggccaggcccccagagggagcugaagaccgugcuucuggaagcccuggggucucccagugaggacgugagggcugcagccgcauaugcccugggccgugugggugcuggcaaccugccugacuuccugcccuuccugcuggcacaaauugaggcccagccccggcgacaguaccugcugcuacaugcacucagggaggcccugggggcugcgcagccugacaaucugaagcccuauguugaggaugugugggcgcugcucuuccagcgcugugagagccccgaggaaggcacucggugugugguggcggagugcaucgggaagcuaguguuugugaacccucccuaccuccugccucgauuccggaagcagcucgcugcagguaagaguacaguggcccgggcuggccaagcacaaggcggguacuugguccccaagcauccacacaacuuacgcagaucacuggagaugagaguuguguguguguguguguguguguguguguguguuagucaaggagaagaagccaguguguauguaugugaguuugugugugugugagagagugugugcauguuagucaaggagaagaagccaguguguauguauguguguguguguaggugugugagugugugugugugugugugagagagagagagagagagagugugugugugagagaguguguguguguguuagucaagaagaagccaaucagacgaacggcgcgucgcagauguacaggcuucuaguggucucugggguggaggggcaaggucuuuuuggcuuuguugguuuguuuguuuuuugagggguucuucaauuuuuacuuuauuuuauguauauugguguuuuaccugcauagauguauguguacuguauacagacagugcccucggaggccagaaaaaggcaucagaugcccuggaacugggguuacagacagcugugagcugccauguggguacuuguaaguaagccuaggucuacugcaagaguggccagugcuuuuaauugcuuagccaucucuccaauccaagaggacaggguuuuugaugugucccuauuucaaucagaccuuucacugaaggggacugcaucauagguucgacucacuuggaucaaaaauaacccaagaaaauauugugucuguacuuaacaugugaaaacuuuucuugucuuuauuuccuuuuguuguguguuugccauggcaugcauauagagacaacuuagggaugucaggucucuccuucugucauguagauuccaaggacuugcauucaggucaccaggcuuggugauagcuacuuuuauagcaagaaccaucuugcaagccuuuuucucccuaaacaauauagauguaacuacugaugacauguuuaauguaaauaacaugaagaagauugaaaauacauguguagguucuguguaaacaccaugcuguuuuguggaagggcuuaguauacaaagagcuccugaauccuguccucugaagauacuaagggguaaaaauacaacuuaaagauggcauuaggcauacaggauuagaaaucuauaacuaggaggcagaaggcagaaggauuacuucaaagucuaccugcuuagagauauugaaggccuuccugugcaauuuagugagacgauagauagauagauagauagauagauagauagauagauagauagauagauagauagauagauagauaaguagguagguagguagguagguagguagguggguagguagguagauaagagccuggggcuggggcuggggcuguugcuuggugguagaauguuugcuucugacacacgaggcccuggguucuauuccuaccgucucacacaaaucagaggugaccuagagcuggcuguggugguguacaucuuagucgcggcacucaggaggaacucugaaauagaccaaccugggcuacauauugaguuccauggcaacauagagaaacccugcuuuuaaaaacauuaucauagaaauaaagccauaugaugucauuuucauaaucugcuacggucaugacugcugugacaaaauacccgauagaagcaacuuuaacgaggacccugcuuagagggagcagucagccauagaugggaaggcuucgugugagcagucauggcagcagcaaccugcgcagcggcuaguucacaccuugguggaucaggacacaguucaggcuggaaucaaaggcaaacguaaccaucaaggcucaccuucugcagccuacuucugucugcugggccccagucccaaagaugcacaaccaguuucuaggugaggaccauguccuggcaugaccccuccauccuuagggaucugggugagcccccccccccuuucuccagcuucuauaaagucaguaacaaggugaaaugaagugcguccuucaugaccucgugcucggggaccugaguucuggggaucccauugaccgccagccagccaaaagccccccuggccucuucucuguggccugaaaugugaaccuggccuugcugagucccccuuuccuguguaaagugcaggccaauagucguucacaguuuuguuuguuuuugagacagguacucacucuguagcccaggcugacuuccaacuccugaagauacuccugggacuuugggaugacaggguugcacuaccacaccagcuucauuauuuuaacuaacauuuuguuauuauggaguuugaauggagaggaugucugaaaaugcaguguaguggcagaacuuucucugagguccuaguguucuguuuggaccugccaagacccagccacuuaacucuucuagcagcaggaggaagaacugggcagauucaaggcugccaugggaaauaaccacauaauuauaauaauacuuccugugaggggguuguuucucaaguagggagaggguguacuauguuuugcugggucuacgggugguccccugccccacacuaucgccucuugucuugcaggucagccauacacccggagcacggucaucacugcagucaaguuccucaucucagaccagccucacuccaucgacccucuccugaagagcuucauugguaggugcaacuaguaccucucacccugggucugaagcauggcuagcacaucuuacacauuaaccaagggagucagacucuugagugaggagaugugccuucaaaccccuaugucaccaccaaggcucuggugggcuucccgugcccccuuacugaugaguuuugcuuccuuaucugucaaaugguuuugaggcacuucuggagaacguucucuuggaaacagcuaauugggugggaaaugcucuuuaaaaguacaggcucugaggaugaaagcaaacuggcaagcaccaacuugaccaagucugagggggucuuagcuggaggagccuucaugggguaggcuaggcccucccuucaagccuccugcaggaccagacuuccugccuucaaagcccagugccagcaucuucucaggggccacaccagaaucucagcccucuucucagcgaaggcggcccuacggauguagagggaggcuggacuucuccagccuuuggcuuugaauacugacuuagaagugugggcaggccauuucaaucucaacuauaaaauggggugcugaugcaugcaaaggcacugugccagaccaaagagcagugaauuggaaacuguauccuugucgcagucuggacuggcccugauggccauaggcagauuucuagcuuugaugaguuguuguaguugcauguccaggggcucaacaguggugucuugguuuuacuucagaguuuaguauuuuuguucuuugauuuuuuuuuuauuaguugguguguguguguguauguguguguuaguguuucacuugaacauguuugugcacucuaugugcuccuggugccuauagagaucagaagaagacauugaauccccugggacuggaguuauggaugauuuugagcuaccacguggguucugggaaccaaacucgggucgucugcaagagcagucagugcucuuaacuacugguccaucucuccaguccccaaagcugguuuguuuuuagagauagaaucuauguagcccaggcuggacucaaacucuauauagccgaggaugacucugaauuccugaucuugccuuuaucucccaaguacugggauuauaggcuuauacuaccaccuuuagcaugcuugauccucaguucugagcucccuaggguggauaccaugagaugcccuuugauaaaacucaucaguuaauucuaauagucccagccugguaaagaacacuggucccauuuuacaaauggggaaacugagucccaagagaggguucagacucguccuauuccuagguuauguccuuacagaagcaggacucuaagagccagcauacauugugggaagggcucuacguccuagugugguugaguccugaucugcuugaagacugcaguucuucccagugcagagaaauagauaucaugugacaguagcauacccuguggugcugauggccacucuggucaugugguugcgguggagacucaaguuucuguguccuacucuucuagcugaagacguuacucagugguagcacggaugcucagcauaugcgagacccuggguuccguccucagcacuaauccuuggagcaaccauguuggguuggcguuucagaccuggugcuguggguggccuucacuuguuaaccugcguacaagaggcuagggcaggaagagcccagaccugguguagucagcgaggcccugucugagagcagagccauccucugugccagcucucagcccugggcuucacagcugcugucaugucucacuccuaaagacuggaggaggucacggcugccagaacccaaaguccgugggaagcuaggcauucuuauuugggcugugacggcauugugucuggcuuaagguagauguucgggucaugucugcccuucguucuauauaacucucggugcccaggucaccaggaacagcauagaggugacuuuauguccugcuucuauguccuuugucuugucacucugcagcggaguucauggaaagccugcaggacccagaccugaacgugcgccgggccacacucaccuucuucaacucagcugugcacaacaaaccaucacugguccgggaccuguuggaugacauccugccccuccucuaccaggagaccaagauccgccgggaccucauccgagagguaugagguagcauggacaccuaguauggcuggcccuuguugagccuucugugccucacagucaagacucauugaaaacuaggagugaggcccacacaggcaccagggucacauggcccuagccaugccaugccucuccacuccccagugggaggcccagacugggcaauccagugccccauuagcuucaguuuucccuagagcuaagugaggacagucaccgugccuguaccacaaggcugugcccuaagcacugggaggcagcccugaugcuuagugacucauguucagcaugagcauccuaguccccaaaugugacauccccucugacaggcucuauuuaaaaugcaggcacccuacaaauacuaccugaaacuaccuucaggcauaugaaaaggaaugcuuauucaacauacauggacucuguauuuagacuuggguuccuuccccaauacaucucuuugaauaaugcaagcauuuuaaaauccacaguccaaacacugaaccucaaggugucaggcauguggcauuggacuacagugucagcaacucuugucacuuggccagagucuaaagucccaggacucauagcuacaccauacuuggcuucugccacuaagaugcucagccugaccuccaggagagcggugguugggagagucagguuggagagagagcugaaggggcagagggggcugagauugacagccaagucgcccuacagcaccucaugaaggucugaggaggaagcagugcucuugagagggguugaaaaaguuuucugaaagaaggacauuugaagguuuuuuguuuuuguuuuuucuuuuugagacaggguuucucugugugguccuggcuauccuggaacucacuauguagacuaggcuggcccucaaacucacagggauuuauccucuugccucugccucuugagugcugggauuaaaggugugagcuacuguaccugguaucagauauaguucuggaggccaaaaaucuaauaucuguaccccugagcugaaaccagggugucuacagaccucuugcaguuccuguggccaccaacauugcuuggcaggcgaugccauuccaugaagcucugccuacccacaaggcauuauuuuuaaucuguguaaucucuucaguuggguuuugaggcucagacuuuacuguuagaagccagauuccaugauuacaagcuucagaggacuugguguuuugagucugguuuugcgacuuaccagcuguguguccuccagcaugucaguuuaccucucugagccuuagugggauguugaauaggauugauaguagcaccuuauuccuaaggauuucauuuuuuccugagacagaaucuuguguagucuagguuaagaaugcucugacuugcuuccaccuccugagcgcuggguuacagacaucaugauguuuauucagugccagagaucaaacuugggucuuugugugugcuaggcaagcacucuccugucuaagccauaugcccagaccuucccacggugucuuuaguacucaaguaagauguugucugucaggaaaaaguagcucaguuacagaacaugugcucagugugcacgagguccuacacacacacacacacacacacacacacacacacacacacacacacggaaccugacacuuccugcuuagcaggugugacaguccagagagaggaugcugcaggcugaguugagaccugagacuugagcgcauagagugugacuugggaccaggaugcagugcugagcaggugaggugaguauuccaaacccucuauguuauguccuuccuuccugcagguggagauggggcccuucaagcauacuguggaugaugggcuggaugugaggaaggcugccuucgagugcauguacucgcugcuggagagcugccugggccagcuggacaugugcgaguuucugaaccacguggaggaugggcugaaggaccauuaugacauccggguagguagcaccaugccagaugcaagcccagcucagagcaagggaccaggcaacauuaggccccugcuguucucccugucuccuggcaccccaugaaagcagcugugcuuucugucaaggacaaggaaccagccaggugguagcgcacaccuuuaaucccagcacucgggaagcagaggcaggcggauuucugaguucaaggccagccuggucuacaaagugaguucuaggacagccaggacuauaaagagaccugucucaaaaaaacaaaaaaaaaaaaaaagaacgaggaaccagaucuuggauguuucuuagggugugcacuuugggcacaauagguccaagucuauuguaguguugaaauggcuuaugccauuuuuugcuuugcauuaauuuguuuuaaguguuaccaacauuuaaaaaauuuuaaaaauguauaugaaaaauuguauuucuuuugagaacaacccauaauguuagguaaauucccacauugccauuauauuaguuuguuucugguuacuauuauuucauuuugcuuuguuuuuuauuuuuauguauuuauuaugggcauguccacaucugggauucccacauaguacacugucacugacacaccagaagagggcaucagaucccauuacagaggguugugagccacaauaugguugcugaggauugaacucaagaccuuuggaagaguagucagugcucuuaaccacugagccaucuguccagcccuugcuuuguuuuuuuuuuuaaagauuuauuuauuuauuguauauaaguacaccagaagagggcaucaaaucuuguuacggaugguugugaaccaccaugugguugcugggacuugaacucaggaccuuuggaagagcagucagcgcuccuaacugcugagccaucucaccagccccccuugcuuuguuuuuuuaagacaagguuucucuuauauagcucuguauguccuagaaguauguguucucaccugaccuguuuucuguugcuauuaaaaaaaaaaaaaucuauggccggguauuccuuuagaaggcuguuuuagaucuuucuggagacucagaaucugguauuggcuggcaucuguuuuugcucuggaggcaucacaauggccggcaccugcagaaguucacaugguagaaucaggcaugaggcguguucuuguauuguuguuuuuuguuuuuguuuuauccagacaggguuucuugguauuaacagagcccuggcuauccuggacucgcuuuguagaucagggcagccuggaacugaacucacagaaauuugccugccucugccucccaagugcugggauuaaagauggaggcauguucauuuuauuauucacuuuugugggaacuaagguccucugagaccugaacuaaccccuuccagcaggaccaccuccagugaccuagccaccuccugcugaagacuccaucaccccucagcauugcuauacacaggcuuuugugauacacacucaagauguaucucaacugcagcauguccaagccagugucagugcaagccgaggagcugcuugguuccuucccagccugugccaggggcaugugaacacgugccuuuuguuauccagccauccucacacaacuaaaguuagcuggcaagauucagcaucauggugugcaucuauaauaggaaccugagacccagagaggugggagcccugggcagggcccuagagggacuugguugucgguuugugggguacaagccagagcuuccauugggucugcugcucugucugggugcuguuucaccaugagcuccaucugcuuccuuggguagaugcugaccuucaucauguuggcccgacuggccacucuuuguccugcaccuguccugcagaggguggaccggcucaucgagccacucagagccaccuguacugccaagguaagcccugcccugccuggacccuggagugccuguugacuuuagucaucacucacuggaccaugugcacugcagugcugggcuggcuguugccccagucuacacagcuuccugggcugggcugugagauuccuucauuaaauacuuccugggugcuggccugggagagggauccaggguauaacacuccacauacuagcuuccccacacagucuaugcagaucccaguagggagcagggccugccuccuaugguugauugauuggcuagcuacuccugcuacuacagagcaacugcuaacacagagugcaaggucuucuggaaaguuguaauauugggaacagccuggcacacucaggguccugguggagaccuguugaaugaaagaacucuguaugugugugagugugugugugugugguguuucuggaaaguuguaauauuggaaauagcauggcacacucaggguccugguggagaccuguugaaugaaagaacucugugugugugugugugugugugugugugguguuuauguguuguguaucuguggaggccagaaguugacuucaguggucuuccuugaucucucucugccuucuuucuucuccuucccccuucccagacaugguuucucuguguaacccuggcugucugggaacucuagaacugacaucugacugccucugccuauuaaaggugugccccacuauugcuaaacugggugaccaugagcugcagggaucugccugugucuaacacccaccaacuuccacauccagcucuugugugggaucugaacuuggguuuguacagcaaguacuucaccacugaaccaucucccuagucccugauuggaguuuuaagauuuacucaaaggaccaagaauuucagucuuuaggcaagacucagaauagugguuuuguuacccuuuuuuaaaaacaaacaaacaaacaaacaaacaaacuguucuccagguuagcaucaaauuccugaacuuaagugaguccuuccuccugucuugcuuuccauguagcuugugucuugaggcacauauuguuauuuuuucauuuucuuuguguguauguaggggauauuggggggggggggggcggggacgacaaaacacagacacucugguagcccagccuggccuuaaacucaguauacagccaaaggugacaugaauuucuggcccugaugcccuugcccccaaguguugggaauaccagcuguguaguacagcagauugguggaugcuggaucagguccccucuucccuacucagauguggauaucuaacucaggacuuugugcgugccaggugaaauacucuaccaacugagccacauacccagccccaaaguugugaucuucaaauagcagcacaguaguagaaaaaaaaugaaaucugauuaugcaucagauugaaauuaggccuuuauuugaaaccuauguuuaaggcgggcgugguggcgcacgccuuuaaucccagcacucgggaggcagaggcaggcggauuucugaguucgaggccagcuuggucuacagagugaguuccaggacagccagagcuaaaagagaaacccugucucgaaaaacaaaaaaaacaacaaaaaaaaagaaaccuguuuagaauggguaacagagacucaguaaggacacugucucccucugcaggucaaggcugguucugugaagcaggagcuggagaagcaggaggagcugaagcgcucagcaaugcgggcaguggccgcccugcugaccaacccugaggugcgcaagagccccacuguagcugacuuuuccgcccagauccgauccaacccagaacucaccacccucuucgagagcauccaaaaggacacagccuccggccccagcacggacucuauggaacucagcuagcugcccccaacacaagucucccuucuuaucccaauaggccuuggccucuucuguccuucccugucagccucagugccuuugcuagggcccccugcucacagccccagugccaaagccgggcccaccaacucaggacguucauucacgagcgucaugucccaccaccuuuacacugcaccccuccacucacuuaggagccagaauuggccuaugcccaagaccagaaggcaagcaggggguugacuuccuacuucacuuacucugaaguccaaaugucaguuagcacccugaaccuagccauggguaggguauguagagcccauacaagagaaccaauuuauacuuagugccucauuaguuagcagagugagaacuguuuacagggaagauaguguggcucauuggccagguguagguccacugucucaaacaucccuaaucccaucacccaggaguguaacagucggcuugugcucuucccgacuuuguaguuaguacugaaaauuuaaguauaaaugacagguuuugauuuuuaagacauuguuucucuuuguagccacauauggcccagacucaaauccaccugccuggaauuaaagccagcugaggccaguuaucugaguuaauaacauauacaaagcucuccucacaggauucuuauccauauugauucaguccuggaaauaacaaggccgauggcauagaccuguuauccuaauuccuuaggaggcugaggcuggaccacacacucaggucguagugaacaaauuuaagaucuaccuaaaagcaacagggcaggauagcucaguaccacgcccuccugguagcaacaacuuucuaaccuguccuaaaggacccuaugccuucgggcagacauauauacaggcaaaacaccaaaguuuaaaauagcucaguuguagagcacucuccaacacuacagcaagaugauaaaaccucauuucuacaaugagaacaaaagcuuaguaauaaaaaggcugggaugucuuucucuccagucauuuaagugucacccgugacagucaacccuucugaacuccauuacuguuucaaaagaacagcgagccagagauuggccuagauacagauggcacugcccuuguagugucccacguggcagaaguauuuaucagucucaugaaguucuaauauccuccaaagacaggauugucaauccugacugauugaggccaagcaggccaguuccaugaaacuaaaggcuucaucaaaaaagugccuuaagccgggcagugguggcgcacgccuuuaaucccaacacuugggaggcagagacaggcagauuucugaguucgaggccagccuggucuacaaagugaguuccaggacaggcaagacuauacagagaaacccugucucgaaaaacaaaaaaaaaaaaaaaaaaaaaaagugccuuaagcuagagcccaugcuagaguugggacaggguugagagcagagguuugucugguccccagacucaaguguaccuacacuguagagggucaaggccuuuccccucuuccaccugcagccaaccaagacuagcaugggauucugaacccugcugucucccccagaacaagcagcaaagaacaaucuccaguuaccaaaaacauagaaaauacgacggcagguuuugugauuuuauuuaaacauaaaacaugcacacaagccaucuacucauuuucuucgcugcguagccuggcguugggauuggugacucugauggccagcugugcugcucuuucuacaauggcuuuucgguucuuagaggacacauugugagcaaucucagcacaguaagaucugaaagagaagcaaaccaggaaaggucaccagggaaauggcuuaauucuuccucacacugaguaacccagaauucuuccacuggagccaaaggcuuccagugcaaccacuguaagguacacaguucaagcagcgugaacaacaaacacugcccguguucccucaaaguguugacaaucuguccuaaugaacacauucccagcauggagaugaccgugaagccauagaccgggagcugaggaaaaaccccuagagaagcaggauggcagagcuauggaaagcauacaaauggcaaauaccuaauacagacagacaccaccugacagauuuggggacagagugcaucacguucuaaccugaagcacccaucccgggccacaugcauuuauagcugucuagcacacucaccauucacaagucacaugcugccauaucccaccccaggacucuuuaccacucaggaaccaaugguuuuucuguaacuacccuccaacuugcccugcuccccagcuauacagaggaaaaugcccagagacagaacucagugagcggugcaccugcagggucugacaaggccaagcagcucuccuggggcagauguacccauuagaaaugcagcccccauaacacugcaccaucaacacugccucauggacugcugcuguacaacacacauucucucuccugcauccauccuuccaaaugaacuuguagcacuucaaggccugguuaaaugcacaacauaaucuccccauaggacuccucca

SEQ ID NO: 3313 - RNA, 19026 nt, Mus musculus
aaagauuuauuuauuauuguauaugaguacacuguagcugucuucagacgcaccagaagagggcaucagaucucauuacagaugguugugagccaccacgugguugcugggauuugaccuaaggaccuucggaagagcagucagugcuuuuaacuacugagccaucucuccagcccgagaaaugcuuuuucaaacaaaaagugaauugugagccagagagauagcucaggguguaaaggggcuugcugcgcaagccuggugacaaaaguuccauuccuggaacccacaaaaagguagaagaaaagaacugacucaaaaaauuguacuucauagacaugccucaguauauacacauacacaacuaauaaaauuuaauuguuuucugaaaguagaagguaccugaaccuucuggcuaauacaaguaccuguacauacacacacauccacaaaacaggaucccucguaaaagaggaaauauuugacuuagagugucuaguugucagauuucuccucauaucucagacuggaauguggcaucuggguccuauuaaaacuacccauuccuuuguuccugucccaacacugguacauuuugauggcagugugacagcuggaggguagcuuggcacacugccuccucacaguauggcccugcguuaagucagugaugucuagagaaacccagacugaagggccacaguucuaccccuucaccaccagagccauugguuagcuucacagggucucuaaucaucgcugccuucugcuccaggucuggguuaguucugaacuggagagcacuuuguaauccauguaggauaucuguuguauaagguauaacuauauacagucuuggaugcugugggguuccaugucccguuuaucucagguauauuaucaugaugaacccccucacuaaaccuuuaaacaugucuauggcugaauguugcauuucuuccaggugcacccugaagaccacaaguuaaauaaauaccaugacuggcuuugggagaaucaugaaaaauuaagucuaucuugaagcugccuguuugaaguuucccaugcgucgccuugugcuucgguuucuaagggcccuguggugugcagugagcucccuucccggcacguggauuuuuuuuuucaguuuguuagaagccaguguaugucuuaagccucugccaaaaaaaaaaaaaaauuguuagauaaugauccuaaaaguguucaguuuagguuuuccaaugaugaaauucaacacgccaaugcucaaauccaguuaccagcacuccugcuaaagaaagccuaaacauguauucuccuucuguauaaagugauauugucauguguggaaagccugccauucuuaauggguauuccaguguuauagcuuaaauagugaggcauuuacuuuagaaagauaucacuaacuaaaaaccgaauugaccuuacaugguggcacaccccuguaaucccagcacucaggaggcugaggaagaaggauggaaaguugagggccugccucuucuguguagagagagacucugccucaagcacaaacagggcagggccagcaaguggcccaguaaaugaagucacuugcugccaggcaugaugaucugaauuccaucccuggaacacacuccugaagguuggccucuuaccuucacuugagcucauacauaacauguuacaaaauacauaaaauuuucagaaauggucugcagagagaugguucaguaguuuaauaugcuugcugcuuuuauagagguuacuuuuuagcacccacaucaggcagcucacaacugcuuauaacagcuccuggggaucugucaccuucuuuuggcuucauuggguaccuuagcacauguggcauauauagauauaaagauauacauaaacauaaaaaaaaaauuaaguccuaauuacuuaacacuuuuuuuucuuuuugguuuuccgagacaggguuucucuguguagcccuggcuguccuggaacucacucuguagaccaggcuggccucaaacucagaaaucugccugccucugccucccaagugcugggauuaaaggcaugcgccaccacugccuggcuacuuaacacuauuuuaaaauguaguuugaaaauuaaauuauaucuccuccucaaggcaauauuacucaaaaaugcauaguauuccaccccauuuuucauuaauaaaauauauuuuucauuaauaaaauauauucacccaugccagucaucaugguauacuacuauaauccuaacacuugggagucuggagagaaucaugaucaaggccagccugggcuauaugguaagacccuauaucaaaaaagagcaaaaaaacaaaccaaaagauccacuaguggcacacacacagacaaugagcagaugggccuuauaauguauaugugaugaaaauacauacacaguaccugggaugcugaugcaagaggaccucugaauucaaggcagccuggcuuaugagagugugaaggcagcuuugguuacacagcaaaacccuguacaaaaaauacaaaccaaguuuguuggacuaaauaagcuaugucugcagaagugucugucugucuuguuuaauggaauucuuuuuuuuaaagauuuauuuguuuuauguauaugaguacacuguaacuguacagaugguuaugagccauaaugugauuguugggaauugaacucaggaccucugcuugcuucuggcccugcucuggccccgcucgaguauauggaauucuuaagauccuaauauacuuaugaaaccuaucacuuuguauuagguaguuaauaaaauauuuuuauuaaaaaguaaggucccuuuggcauuguguucuugaccacuugcauuggcucugaggaauuuuagauuugcccuuaauaucccugugcgaguguggcuuauggcuccauugcaacucacccuuuaacccugauccuuugugaaaccuucucucucccaauguuuggugccauuuccauggcaggugguauaccaucaugguucuaguuccgacgaucaauugucauucuaagguuugguuugaaaauuaaaucgaaugaaggcaaaguaaaccagcugucaggaagcuauuugucguaggauagcgaguggguauaggcagaugugcucuguugcaggcuaauugauuuuuccucuggugaacagguggcagcugugagagggaugcuggagguggagagaucauuggucacagaguagucagguucaguuccuagcaugucuauggaggggaucuguugcccuccucugggcacacaggucguguguauacaugcaugugaaauaaguucacauaaguguaaagagaugugauguggcaggaaagcuggccauaccucccacuucacaauaacccuuaauauuuucacaaacaucacaggaacacacauaagugcagagcucugugcuggggagggaaaaggaugagaaggcucuguagagaccucccaggaagagaacagugcuaacaguauggcagagaagacaaagugaggauggagauccagacacaagcaggucagaguccagagaaaucuuuggaugccugggccauggccaagguuagguggcaaagcaaauuucccaaaugucagcuaugagaugagauaaggcugcagggcagggccacuuaaccccccucucccuggucgccuugaaggggagcucugucuggccaauugcugggguuccagggcgacucuuucuuuucaggagauaagguugccugaccuccgugccuucccucgcaucucagugaaaccauggugccuugucaugguuuuguaaguguucagaggcuguggcucagaagggccaguagaagcgagugccucggguuguggggagucaggaggaugcuaaaucuagugaagaugguccccagcacagagaacuuguucaaauguugaucuuuauuuugugaccuacaguuuaaaauguuagaaucagguggguaguucagcaguugaguuuuccuggcaugcccaaggcuuagagcucagugcccagcaguacaaaacuuuuucuuuuuuucuuuuuuuuuuuuuuuuuuggagacaggauuuuucuauguagaccagacuggccaccaauucacagagcuccuccuguguacuaccauaccuggccagaccacauuuuuguaaguguuuaauuaaaugguuuuguuuuguguuuaacacauuuacagccacuaacacuagcuaacucaaagacauuucugagccuggcgugguggcacaugccuuuaaucccagcacuugggaggcagaggcagauggauuucugaguucgaguccagccuggucuacaaagugaguuccaggacagccagggcuauacagagaaacccugucucgaagaaacagguguaaggccugagccugagucuggauucuuccguuuacuagacuccuccauguagugugggucauguaucuuuccaugcacaccccauaguucaccuauuaguggagauuucaaagguuuauuauuaggacugguucuaaccuguuucuggcuuugauuaaagauaggcucucauugaguggcucuggcuggccugggacuuauguaacacaagcuggccucaaacuuaacgucuaucuucccgcgcugggauacaagugguugccaccaaaacuguugauuccagaccauaacacccagucauagcaccaaauaccugucuuuuauuugaccuugacugacuaggauucucagaacccaggguagaguuaugauacuuuuuuuaaaugagaaaagugaagccugaagauaagaucugugaaggaccugcagcuuacaagaaaauaggacauuuuuuuuuuucuucagaauagggggccaugggaagacugggacauauguaugauuucccaaaggaggcaccagccagagcuaagcaaaucgccgaagcuccugacuuccggguuugggagguggaagggaagaaagguucucccgccuccuucuugcaaguggaagcgcucagccaaucgguguagggcaucuauagucaugacaacagaggcuuacucucagcagguugagcagccuuuugcaaaaccugaagcuuauuuccaccaaacggcuaaacugggggcguacuucauaacgccaucuacaggaauccuccggcuccgggcggcagagcuguuggagagcuccaggauaggcuagaagccucauugugccgucuccauugugggauagggaguuccagaaggucacaaacggccuggauuccuaugcccggaccggaccuagcuagagaacccggcugagucacgugacuuggaaucaaagccaggcucuugcgccugggaaccugcauuuuucucaguugggcaacaaugcguucuauauugaaaaagagaccuggagaggagacagucagcugucugcccccaaacaagugcuuggcaaagguuugcaauuugagagguggaggguacaaacaaacaagaagaguuggaugccagaagacccaugcucuccgaaaaccuccuccccacccaucuaaugcuucgcagugggaugcuggucucucuagccaccuuuccaaagcacacagucagaauguggcagaaacccuggccaaacauagugggaagcaaaagaaaucauccagguuaugggaggcccagaaagccgaggagagaaaaagucgugugacuuucggcuugacgaucacagacgcugguaagugacagugcucuucauggagauggaaagugucugcaggaccugguuagaugagacuggaaccaggggacacguuuaaucuuagucguggacaccuaagacccuguaaacuauagaagugagauguuuucagaacaacuaagauggcaugguugugcugggaugggggugcucagcacggaggugagugggagaagcugccugguguagaguguugacacuuagaggagugaccaggacaacaggaugagcccaggaugacggccagaaaggaaggcagcagcugaggugugagucagggaaggagaacaaguguguuuucugaggcgaagugagggcucuaaggcaggugcuccugggagacacacaagggucaguaaauggggucuuauccagcauucgaggcccacagugacguucugggaauguacaaacagaagcaaagucagccagugacaucagaaaguguaccugugcaugcaggaguggaaauucagcgcuuucucuuccaacuccaccaucucuucuaaugacaggaugguagccucagccugucacugcuuggucauaguccugaagagcacuagaaagaaguggugugaaaagugagugggugguaagcaggccaccugucugcaagaggguggcugggauaacaccugauaggcuaaucacuguucuuugccgagaagagagacaaggcuucaaggcaacucuuaugaaagaaaacauuuaauugggggucuugcuuauaguuccagaggcuuaguucauuaucaucauggcagggaguaugguagcagacagguauggaaaaguagcugagauccauacccugauacacaagcugagagagagaacaccugaugggggcuuuuaaaaccucaaagccacuaggcacugguuguuagccuuuaaucccagcacucaaaagacagaagcaagaagaucucugaguucaaggccagccuagucuacagagguaguucuaggacagcuagggccauacaaagaaacccuaucucaagaaaaacaagacucaacgcccaccccuugugacacauuuccuacaacuagcucuccccuccucuuccucuuccucuuccucuuccucucccucccccuccuccucuucuccaccuucucaucuuuucaaacaguucuauuuccuggugacuaaaaguauucaaacaaaugagcuuaagggagccauucuuauucaaauuaucacacccuuacuaugaaacucaggauggguaaggcuggaagagaaaccucaaggaauaccaugcccuuuagagcacacagcaacuaggugaauggaacccaggggucagggaaggagaaaggaaaugugacugagcagaagaagcaauguagaaaagaggacaaggugggugugacauccugggagagaacaggggccaagagcuuuaggccacagcaguaauggguuaacuccuugagcaccaaaaagccagcugucuuaggguuuuacugcugagaacaaacacuauggccaaggcaucucuuauaagggcaacauuuaauuggggcuggcuuacagguucagagguucaguccauuaucaucaaggcaggaggagcugagaguucuacaucuucaucugaaggccacaaggagaagacuggcucccacaugauuaggaggaaggucuuaaagcccacacacacaagugacacacuuccuccaacaaggccacaucucuuuuuuuuuuuuuuuaaagauuuauuuauuauguaaguacaccguagcugucuucagacacuccagaagagggugaccccucuccucuucuggaucucguuauggaugguugugagccaccaugugguugcuaggauuugaacucaggaccuucggaagagcagucagugcucuuaaccacugagccaucucuccagcccaaggccacaucucuuaaguaaugucacucccuggaaaaaaucuacucaaaccaccauuccacucccuggcugccauaggcuuguucaaauauaugagucuauggaggccacaccuaaacauagcauagugaaaaaugcauuuaguucaacuuccaaagucuccauagucuauaggagucucaacaauguuaaaaguccaaaguucaaagucacuucuaagauucauccaguccuuaacuguaauccucaaagugagacuggaaaccaauuaggcaaacuccaaacucugcaucucuaugucugaugucaaagcaguuuucagaucuccaacuccuuuuucaucuuuguugacugcaacaaauuucuuucuccugggcagcuuuccuaacagguaucccagagcucuggcaucuuuaacauuuugggguuuccaagucaacuucagcuucacagcuccuauuccaaugucugggauccacaugaucuuccaggcuccuccaaagggcacaccacaucuccagcucugcccucuguagaacucuagacucugguugacuccacuccauuggugcuguucuugguggucaucucauggcacuggcaucuccaguauacugaggucuucugcugcaacuagaauucaccaauacccucucauaagcucucuucauggugccaagccucaacuucuuugcaugacccccuuagcccugggcugucaacugcaacuaaggcugcuccuucaccaauggccuuccauggucccucacagugccaaggcucagcugcucuccaugaccccuucauaucuuucaaaaccaguaccaccugggugauuuuuacacauuaccaaguccagcugcagcaugggguacaacuuuggcuaucucuagaacauagcuucuuugugcucucagaaaacaccagaggauuucaccucaaugauaccggucucuuccuaauuaccacuaauuucuuagcgacagcuaaccagcaucaguugucccaguagucccuucuguucuugacucuaaagccagagccacauggccaaagcugcugaguucugcuccuugcuaaggcuggaacaugccccccuugcucucuuucuagcuuucuguuucccaguugccucgcugccuaagcuuggcuguccuggaacgcgcucuguagguugaugugccugacucugucuccugggauuagagguguguaccaucacaccuggacuuaagcuuuuuuuucaccuagaacuugcucugucacaggcuagccuuaaacucaagagauaugcuuggcuuuaaucuccugggauuaaaauuguguaucaccacgccugaaccuaaauuuagcuaggugggaucuugccccaaagucccacuccuuuaaucuguuaucuccuagaacacaggauuugauuucauucuacuuccuggugccccuuuaauacuugaacuauauauuuuguauuuuuccuuuuucagcuugcuccuuuucauuaaaacauuuuucauaggggugaacuuuaggaaccaugcaacacaauuuauaccaggcuguuuuuuagacuuccuuuuucaaagcaauuaaucuaaaucucuucaccuuagccucaggcagacucuuaggacaauggcaaaaagcagucacauucuucaccaaaauaccacaaaaagagucucuagaccacuaaaauucuucuccacugaaacaucuuggacaaggucugcacaguucaaaucacucucagcaacaaagucuucuauauuucugcuaggauagcccauugagccucaaauaaaggcucccauugcuuuccaaaccaaaguccccaaauccacauucuuccaaacaaaagcaugcucaggccuagcccagcaauaccccacuccuggugccaacuuuugucuuagaaggguuuuacugcugugaacagacacuauaaucaaggcaucucuuauaaggacaacauuuccuuccuuccuuccuuccuuucuuucuuucuuucuuucuuuuuucuuucuuucuuucuuuuuuuuuuuuuuuuuuucucuguauagcccuggcuguccuggaacucucuguagaccaaacuggccuugaacucagaaauccaccugccucugccucccaagugcugggaucaaaggcgugugcaccacugccuggcauaaggacaacauuuaauuggggcuggcuuacaagugcagauguucagucuauuaucaagacagaagcauagcgcaggaguagcugagaguucuacaucuucaucugaaggccacuaggagaagacuggcugccacauguuaaaagaagggucuuaaagcccacuaccacaguggcacacuuccuccaacaaggccgcaccuacuucaacaagaccacaccuccaaauagggccauuccguggaccaagccuauucaaaccaccauaccagccuugguggugaaagucugucaucccauaauuugggaaagaaaggcauccuggacuaccuggugagacccuaucucaaaccaugcuaugguggaccuaaauguaggggcuguaaggggacccagagggaguagaaaaaaagagcugggaagauuucaagggauggugguaccugaucugggucugaaaaguaaguuagagauaauugggugaaggagcaggaggcaguauaugucagcuaggcugccugugcaguacaccaggcugaucuauugguacaaaugcaggugaagggcccguuacauugcucuguccaauccccagcacaagcaugggggauugaugguggcacaaaaccauuuagaaaugaaagccuugagacaugaagaucaagugacagcugaauaagcaaauagcugagaucuuggcucugggggcuggagagauggcucagugguuaaggucacugcucuugcagaggucccagguucaguucccagcacccacauggaggcucacaacuccgucaucacuccaguuccauguaauucaacaccuucuggccucuguggguacuguauacauguggugcacauacauacauucaggcaaaacauucauacacauaaauuaaaaagaaauccuaauacaaaaggucuugucuaugggacuaauuaagcucugcuaauaaucaacccagugacuuugggccucucugagccucagugcuccuaucugaaaaaggugcccagucauagcaccaccccuaugucugcaucugucacucaugaacuguuuagugaguucccauuacauguaggcacuaugguggagccaagacuccagaagagaauaagagagucauaggugggcuggcuguuuaaaaaaaaaagagagagagagagucauaggcaaggguguggucuucauggagcuuuuacuagagaaacaaauagguauugcaccaggagucacaaacaaggcaguuauuaaaugaaccaaguuuagcuaguagagaaugugggaagguacugcaagcaagagaggccacgccccaggcuacaguacuacagcuggagaccuuuaaagugucccaacagugugagcgcuaccagugugcagcccagacugcaugcaguggugucuuagucacuuuucuauuacugugagaaaacaccaugaccaaaagcaacuugggaaggaaaggauuuauuucaucuuacagcuuguauuccaucauccagggaaguuggggcaggagcugaugcaaaggccauggaaagagugcugcuuacuggcuuguuccugguagcuuuauuauaucacccaggacaaccauccccaucccaugaguggccccacccacagugaacugagcccucccacaucaaucacuagucaagaaaacacaacacagacuuuuccacaggccagucugguggggacaugcucucaguugaggcucgcucgcucucucucucucucucucucucucucucucucucucucucucucucuuucaagacaggguuucucuguauagcccuggcuguccuggaacucacuuuguagaccaggcuggccucgaacucagaaaucugccugccucugcuucccaagugccggggauuaaaggcgugugccaccacgcccagcaaggcucucucucucucucucucucucucucucuuuuuuaaaagggcucuagcuugugucagguugacauaaaacuagccagcacagaugaaggugaugguggcauggaggaauauaugggucaagguaugcagaguugccauggggcuccaacuaugagcugcggcauggucuaaggcugagaagaggaggaggaggaauaggaagaagaggauagaacauucagagcagagggagcagcagguagcaaaacuuuagacaggauagggcuuccuuccaucacagaggggacagaggggccuaagugagcuugggccacuggaaggaaaaacuggauagccaguaagucugugugggaguagauaagggaccucuuguacugaggacugcagcugucuggggaaaggcuucaugaugagaaaguagauuuugucaccagguauucaggucuguaaccugcucccugagcaccccuguauuccaaagcaaguuaagaaacaauccagcaguaagaaaaaaauggguuuguuuacaaguuagucaaacuggaaagaggaaauucucucucucucucucucucugugguugugugugcacgugugcgugcgcacacgagugcacacaugugugcagacuuacaaguucuagaaaagcaugagacaaaagacaaaaggcagguuagcugugagacuaaccagccaguccuuucuugagaggagaguggcuuggcuccagggugccugucuccauuagcagaacagagagucugcuauagcccuuaugcagauggguguuuugccagcauguaugucugugaacaaugugugugcagugcuuuuagagggcagaagaggguagcagauucucaguaacuggaguugcaggugguuuguucacuacuauguagacgcuuaaaauugaacucacauccucugaaagaacugggccaucucuacaacucuuuuuaacauuuauuuauuucagcagguagagaagggccugugccaugaugccuuugccauguggucaaaggacaauuugugguagccuguccucuucuuccaccauguggguuacaaggauugaacacauauugucuaacuuggcagcaaucaccuuuauccacggagccaucucacccgccuaccugauaugucauuacaaguuggggcccgaggaacauaguucaguggcacaguacuucagcaagcauaaggccuuggguucaagucuuagcaccaugaagaagagaacuuauauguagugaauguagauguguauauguauguguguauguggauacauauauaacagcacacugacuacaaagcaacucuaauaccuccauugccugauaaauuagguaacuauuauccccaucuuauggaagaaacugaaacauaggcuaagcaggaagcaguguuuaaguuuggccuuuugcuauguauuguaauguccaauguaauguaauauaauguaauguaauacugccccccaaggccugguugcucccagggauaagagaauucaaauguucaacaugaccuggcuucuuaauuuaaaacuauugguuaaauaaagaugcugauagucaauagcggaacagaagagacauaggcagggcuugggguccccuggcauagugucagaagagaaccauagggagagaaagagaagaaggugggguuggagggaugaugacucagugguuaagagcacugacugcucuuccagagguccugaguucaaaucccagcaaucacaugguggcucacaacuaucuauaaugaagaucugaugcccucuucuggucuguuggaagacagcuacaguguacuuauauauaauaaacaaauaaaucuuaaaaaaaaaaaaaaaaggaagaaaggaaggaagaaagagaagaagguggagaggggaggaagcugccaugggguaagugaaucauaaaaacauagccaugaguguuguguccggccagcagaccacaaccuggguucuagccuggaaaggcauuuuggaaaccuggaagagaagaggggcuagguggcgagagaaaagaauguagccaagacaguuacucugaucaaggcucaaauuuuauuguugcgacacuaguuaugaaggaagggggaggggacccgauucccgccgaauaaucucggguccaguagaaaggugcacguguguggcuccucagguuccagcagugggcguggcagaacgaaugagcaggaagcuccaccccgagcaagcagguuucaggcugggggaggggagacuacaucuccucccuuuuauuaacaaaauuuaaaaaaagaaaaagcuggccugaggggggaaaaauuuucuaugcucaauaguucugccuggaaucuagggcuaaagaaaaaacuugcuucacugggauucuuuaacuuuucuuaugguaaacuguaucuggcuuaagacuguccuuucuuaucuuagugaacaacuaacugaaaagccuggagcuguaggcucugacuuuauaaugcuaauuaguacuugguagguaacuuucuaguugaauuuuaaguagggcguuggaacuuuggcuaaguuugacugaacaaaugugaaauacacuauaauaacacuaaguugauauuucuccgcuuuuuuggaugauaggugggaaacagggagaaggaguucgaccggcucuuguaguacaaggccaauuggcuuuuuuauuugggugggaggcagugaagggcuugcccuuucaauaguaugucuccaaucucucuccccccuauugauuaaguuaaauaaggcaacgcuuaacugaggugaucaaaugauuuucucauccguagaugagugggcuuuuaaccuuggcuuggguggacauggacccgauuccucccguggguacugguaaaacccacacauguggcucucgguaucuuuuggggaggcgagguagagccggaaaauauuuuuuauuuuuaaccaaaauaugauaccaaccucuuuuaaaccggguuuaucucacaggaaacucagaaauggucaagcuggaccuucccuugcaguaguucugcaccaagcggugcccauacugaauuuguacaaucacaaaccaguaugcacaguucugagugcugugcagcuccuaaaggagaauuaucaaccucaggauuagcaaagccuaagcaagaauuaugucguuaguaacaccacgauuuguggcuaaaauaggagcuggaagucguuccuccucaucccuguuuuuuccacagccuauugagcuaaggacaccuugcaguaacagcaagggugaaaagccagaggucagcuaaggggcuaagccugucuaucaaaauaaaaaccaaucuuuauuaauauagaaauaucuacucuucuagcccucuagguaaaccuaaauuuuuaacucagacugaaaaccacgugcuggaaauguccugagacuggggguaacagcugccaccugugugcucuaggggggcggggauguacauccacugcuccgccucgagaauguugauuuaccugcuugaaagacaaaaucuugaaagacagugagaaaguaggaaagcagaacuucuuuuggggaacucuagguacuuuauuuaaaugcaaacuguaaagcugaggcuagucuccggccuccuguuggggagcuggcucagagaguagcuuuuucggagccugaguccucaagccgacuuuuaagcaaaagaguaauuuuaguccucaaggugauacuuuagaagauuuagaaucuguguucaucuaacaaauuaauuuaucuggcagccacugcgcucuaucuucaucucgugaaaaaacacaaacugagucccuaccccaaauuagaacuggaucuggacccuucuauucauuagucaggggguccuuccauuuuacuaauguauuaagugaacaauugcucuuuaauagcuuuuucuacuagcuguaaggccagcaauccuucugagguuauggaucuaggggaagugggggaugugcucugaauuaacuuugcuagguaauuuagaauauaggaaucucuaacauuggacugaauauuagaccagucugagauugaguuagaauggcuggucacacugaagaaaggagaaaaaucauuaugacucuauuaaaugacuaauuuuacuaagucugaauauacagucucugauguacuauugccauaaaguuaaaaggcuagaagcuagucuaaacuggaaaaaugacaaguaaggauggaucuaaaacaugaauuuaauuuaguuuuuuagucaauacaaucaggacaugagucaacuuaccuaccagcucgucacacgaauuaauauguuuuugaagcguuuuguggagaaaaccuguuuuucccuuuucuaauaagguagcuguuuuaggaucaaucuauaagccaauaaguagaucccuuuaagauacuauaaagcauuuauuaaacucuuugacauuaaaauauuagauuuugaaaauaaagguaagacuuaaauagugugcaugggaaugcacuaaauaguaugcacggagauacaauuucucucuuuuuugucuuuuaagaaguuaaaguuuuaaaauuuuacaauaccuaaaccuuugaauuaauaacuaguugacaaaacauuuuaaauacuuggcuguaaaggggcagugacuaauugcacuuuuaaucaauuuuuuuaaggagcaguuguaacuagaaggcuuguaaaguuauuaagaguuacaugugcauaauuuauuuauuaacuagaaauaugcauaagcaauuguaaauuugagaauuaauaguaucugagggaugaacaauuuaagcaauugcgagcucagagauauggcauugacuauuaauauacaaauuaagguuugauuguucagcauuuuaaaacaccaucuacagcacacaacuagaucaucugugcuggaacaggggaaacugugucuuaagacuccgccccacagaagcuaguugggcccacgugggccaacgaucggcugggaggaugagaaaaaugacuuuacaauaauguuuucuuuuuggccaaagaauuguuuugggcacaaccaauuuuuaauuaccaauuaauaacaauuauaaaagcuuuauuuuuuguagaaacuuuuguaguaaacuaaaacccuaaguaauaaaaggauauugucucugaaucuuuugggugagagcaaggauuuaagguaaacuucaagaagcauuaguuaauaaaauacuuuucacuuaggaaacaauauacacugaaagauuaaaaaucuuggcuucuuguauagaagcagaaacaauaacaauuuuuucuuacauaauguaaaguuacauuagccauaccuagaggcaaaauuuucuagugauuacaguucacuagaagcaaaacucuuugaauuuaagcauuauuuuaaacaucugaauagaucugcaacacuguuaaaaagaauuucucuugaacaccgggaaaaaucuuucucaggcacuguuugcaaaacaaaagaaaggccacaagcugcucuggggcugcccagagcccugcauugacucaaacguaaaauacuuuuuaaucugagcauccuggcccucuuguaauaaggaccgauucuagagaaacaauauaacugucuacgccuccaaauuuugauacucuuucuuaagaugacuuacaguuaaaacguucuucacaacuuuaguguugugaaaaaauugcccguacugcaguuuccugccaggcagcaacuauaaccaaacuguuugucuaaucuauuuacaaagacaaacauaacuagauaacucugucacaguuuuguacgaagugagcuguaugagcgcucucauaagaugauuacucuuguaauuaucuuaauuacaguauacaggugaauuaaagaucuuaaauuugaagucaaacugcaagcugcagucaauggaacaauagcaguuuuaaccauaauuuuuaaguuuuuugugcaagguuaggauaauaccuguaaccuugggaaagcaaaacccaaguuuaaaacaauuuauuaucuuuaaaaucaauauuagaagcauuacuaucauauuacgaaguuuggaugucaauuaauaccuaugaauaccuauuaaagcaagcuuuaaugcuuuaauaaagagacauugcuuuaaaucuuauuuuaaauuuuacuauuuaggauacgaaccacauuaauuauuaccuaaacuagaaauaucuuuagagacccagccucuugggcugccuuaugccaugugucggaaggacucuaaacuugaguuauuaaauuuaacacuaaccaucuguagcaauguaacaauuauuaaucuuaaccaacaacuuaugagcugauugugaaaacacucagagcacauuaucaauaaaaaagaaccaaaugaagcaguuacauuuagaccaaucagagaauaauaauuuuuguagcuacaaccauaaaaauaaaaaacacuuuaccauugucaaacacauuaaucaugaaccauuuacuagcuuuuuuacucugaaacuuagaggcugugcacucgcccuuauuuccuaaaacgaacaguuuuuccagcaggggcccucucgccacgugucugauuccuggcugaaacacguggcucucggcuuugcagauaaaguuuuuuauaccaucuuuauuauccaacacaaaacauagaacauucauucauacagacuggacacgaacauacaugaauugaacacgagaacagauuggugcaccggacauuagacaagacacaaaagggaacagaguacucuugcuauaaggcccagagagaaauuucucucugcuuuuggggacacuuuccucccuuaugaugcauuuuuuauuaacuggggcaauccgccuauuccuuuuaauaaacccuuucuuuucucacaccucauguagcuucggagagcuacggccuaccgccuauuacccagcuccucacugcugaaccuaagugaaccagcgcucggguuuaacgcugucucagcuuagcccauaccuucuccgguaugaauuucccuuauccuuuauuuuauggagcuccgaaccagcagcgucucuuccaaaaauccuuugccguuucucagucccgcguugguucgccaauuguuguguccggccagcagaccacaaccuggguucuagccuggaaaggcauuuuggaaaccuggaagagaagaggggcuagguggcgagagaaaagaauguagccaaga

SEQ ID NO: 3314 - RNA, 13027 nt, Mus musculus
ucccgcuccucaccacugcuccgcuuugucucuccacgucaacacggcccucaucgccguuucccucacgcuucgggccccuccucccagccucggcagcaacaggcuucuuuccacaaaccacuucagcuaccugcgcuacccuuagcaacgcacaugcgcaaugaaccgcgcaugaguuucccaaagcuccaagugcgcauguacaaaagggagcccaccuccuccgccgaagcgccgggcgcguagggacgcaggaggcggaagcguaaguaugacacgagcgauugguccggaaagguggguggggcggggagucuugacgacagaggguuugauuggcgggacccuggcuguggcaucuguagcugaagcgguggcgggaaggcugcuguguggguugauugacuuucacgucgguguuuggauucggcucagugguuugaguuguguuuuacuccaccucucggccuggagcugcagcugcgccccaguggaccaaagcagcagggauggagagcccaaaccuuggggacaacagaguccguggagagagccuaguuccagacccgccuugggaucgcuggcaaguuauuaaaccucucucgggccucagaggagucgcucuugugugggucuuccuaaccuuuaacacaagguggcaccuagagcugucgcccugugggaacaagacuaggguguacccgauuccuuggccgaacugacuggggagcuuggaggacaagggagguuuugugaugcaagcagguuagccugggccggaagggacccucagaaauagcccuaugacaagucacagaggaagcuacuguuguguccgggcuaaaaugaugcacguauuugcaugucccaaaacuugggcgcucaaacacuuuuaagggcugggcauuuaacuaaguugguaguguuuacguaguaaacacaaagccgaggguucgagcgacagcaccgaauauccgggcuuggcggcgucugccuguggaggcaggaggaucagaaguugaagaugagucucugguacgucguggguucaaagcuagccuaugguacauaagauucccggcucaaaagcaaacaacaaaacuuuuuuuuuuuuaaugcuacuuccuuuuuacagauggagaacggagauuuugagcucaaagugacuuucucuuuggaagaucagcuaauaauaaguagcgagcugggguuuugacccauuuuguuaaccuaacaguuuuguagggauucccucagguuucaguuaccuugucucccuauaagauccuucuagcugauaccuaacgccaaauuccaucuaagaaugccaugguucuaauugugguuagucucuaggucuugcuuagugucccuauuucccuauuuguagaaaguagguuggguuagaaggucucucuagagacccacuuuuuuuucuuuauguguuugucuauauacguagguguugguggagaccagaggaggugucagguucacuggcgcuggaguugcaggcaggguguuauaagcugccugauguggguacggagucuccuggaauaugugcucuuaaccacugagcuaucucuccaaccccucacuuuuaaaauguauaguuuagugauuaaaauacacuguacuaaacacuggagagauaguucaauuguuuaaagcacuuacugcucuucuguaggaccuggguuugguucccagcacccacagcagaggcucacauccaucuauaacuuggcuccaggggaucuaaguccauucaggccucagcaccuucauggugcucauaaauaagaauaaauaaauucuuuaaagggggaagagauccacugcacuggagguuuugugggaacuaucccccccccauaacaguaugggagaaguauuaggugggccuagguuucgggguccacucugcaggugauuugauuuuguuaucacacaauuugucaauaagaguaaaauaauucuuagagauuuauuuauuuauguuauauauauguuuuauauacauggggugugggugugggugcuuugucuugcauaccagaagagagcaucaggucccaugugauuacaguuagaagauugugagccaucgugugguugcugggaauagaacucaggaccucugcaagaguagcucguguucuuaacagcuaagccaucucuucaccacccaaugagaguacauuuuaaccucacaaagugaugagaaucaagacugaaagagagcuggaaguucuuaccagaaauuauguagcuuuuggagggccaugcuauuuuacaaaagugguaguuguugguucucaaaaaugcacacauaugugaaguguuccccuuacauguuugcaggaaagagggggugauucauuugagcaguuugucugaucucagaugaaaaguucaguuacuggcucauaucucagacuuccaacaacuguuaucagaauccuuuauugaaucccuauagugugaauuaagaaaaaguuuagcagguauacuguguggagaguccuaacauuuaaaaacccauguugagcuaggcagugaugguauaugccuuucuucccaacaucugggaggcagaagcaagcaaauuucugugaguuggaggccaaccuggucuauggagugaguuccaggacagccaagacuacacagagaaacccuguuugaaaaucaagguggaggaggacacucauguugaaggacaagaaguuguuagagcuggacaauccucauggcacaagacuagcucacugacuuuaauuuguauuuuauacagucucauacugcugugggcagaaacugaggaagcaggguaaaagcaauuuuaaguucaucacuuggguuuuguuuuuccagcaaggaagauauugcuguuggacugggaggagugggagaagauggaaaggaccuggugauaagcagugagcgcagcucccuucuccaagagcccacugcuucuacucugucuaguacuacagcgacagaaggccacaagccugucccguguggaugggaaagaguugugaagcaaagguuaucugggaaaacugcaggaaaauuugauguauacuuuaucagguaagcauuuaggaaggaaaauaacaauaccgccaagugauuuuuguccguaaugggaaaggauagcaagaaucugcgguugauaggcuaagggaaugacucagggaauaaagcauuugucauuguucagacccccagaguccaucugcagagcugagugggcacagcagcugccuguggcccuggcucucaggagccugagaugggauccccaggggaagcuggcagcuagacuagcuggauuuugugacuucugggcucagugaaaaacauugucucaagcaaagugaacaaggacaccugauuuuuaacuugaagcuuccacaugcacagguacacaugagaacacucauauacacaugcauauaccacacacauacauuuuaaaaaauguagcugggcagugguggcgcaugccuuuaaucccagcacuugggaggcagaggcaggcagauuucugaguucgaggccagccugguuuacagagugaguuccaggacagccagggcuacacagagaaacccugucucaaaauaaauaaauaauuaaauaauuaaaaauaaauaaauaaauaaauaaauaauguauuauaagaucauuacuguuccuucagugucacugguuguaucaagugauuuggggacagucacauauacacagugcugauccuguucucaaugguaaugagacauuuggauuuaagcuacauuuguaugcugauuuuauacuaucauagaagaaucuauugaaaagccauuuauuacuuuuuguugcuuuaaaaugccaaacaucuuuggugacauuuuaaaacuauuaauuggaauucugaaaugugguccaguucuuuuuaaaaagucacucuuuuuuuuuuuuuuuccuuuuaagcccacaaggauugaaguucagaucaaaacguucacuugcuaauuaucuucucaaaaauggggagacuuuucuuaagccugaagauuuugauuuuacuguacugccgaaagggagcaucaaucccgguuauaaacaccaaaguuuggcagcucugacuucccugcagccaaaugaaacugacguuucaaagcagaaccucaagacacgaagcaaguggaaaacagauguguugccucugcccagugguacuucagagucgccagaaagcagcggacugucuaacucuaacucggcuugcuugcuauugagagaacauagggacauucaggauguugacucugagaagaggagaaaguccaaaagaaaggugacuguuuugaaaggaacugcaagucagaaaaccaaacaaaagugcaggaagagucucuuagagucuacucaaagaaacagaaaaagagcaucugugguucagaaggugggugcugaucgcgagcuggugccacaggaaagucaacucaacagaacccucugcccugcagaugccugugcaagggagacuguuggccuggcuggggaagaaaaaucaccaagcccaggacuggaucuuuguuucauacaaguaacuucuggcaccacaaacaaauuccauucaacugaagcagcaggugaagcaaaucgugagcagacuuuuuuagaaucagaggaaaucagaucgaagggagacagaaagggggaggcacauuugcauacugguguuuuacaggauggcucugaaaugcccagcugcucacaagccaagaaacacuuuacuucugagacauuucaagguacucagugcaugaaaauucuguuagcuguguggugaacugucuacccucgcggaucuuguauuucgugccgggaugggguugagauagagaguauagugaagaagagucaagcgucagauauauucucccaguugaucccaauaucugcccuaagugauuuuugagaacaggguuucauguaucccagccagccugggucucacuguauagcuggagagacuuucgaaauuguauccuucugacucugcuuccugggugcugaaauuaaaggcaugugccacuaugcaaguuuauguggugcugggcacagaacccagggcuuaaugcguggcagcuaagcacucuaucaacugaguuacaucuccauccuguaacugaucuuugagcuuggucaucaggcccuuaauuauggcagagagguaaucagcuggcuacagccaggaugcucagcauuggaagacuggugugugauggcugcuaccaccucucccuggacagcagcuaagagguggggcuuuccacacuugcuaucuucucuuuuggcagcaauucuaagaccguaagggagauuuuucugagaagaauguagauaagacuccuuuuauaaacugaccaagaauagucggcaccuuccugccccuccggugcugcugcugugugacucccaauuuaauuucaucuguauuacauucuuuuucuucuguugcagccugaugcuucucuaaaaggccuuggagcuuucaauaauucaaaaguauaaucgcuuaguucauguauuauuuguacugugcucuucacacaagaguccugggcuuggcagacuugucuauacaaugccucagugaauaauagauaaaaagaucugagcagcccuggguuauucauuauacuguuacggcauaaugaauaacucuuaaagaagaauaguaauuuuaauuuuacuuagauuccuuugggaacacagccugcacagauugguggaacaaggguaacgcuugaguucugucuccagucccauccauaauugugugucuccucugugccugggauugaugcgucuuuaacagauggccacauauaccuaggaaauggauaagaauuccucaauguauguccuuugagcuucuuaaagcauuggauuguauagauauacugcaauuauaauggguagguuaaauauuaaaagcuucuucucuggccaauuuggaaguauccagcuuguccuauucugaauucugguucucaguguaggggaggugcuguuggguacuaggugcccacuagaaugaacauugcuuggcuagaaaguaucaaaccaacagguaauaaaggaggcugguuaguuagugugggaagccauggaaaacaucaaguacccauaaaaucauuuuccuuuguucuguuucaugcuuucuucuggacuuucccuucccagacuagaauagcaaaagccacugacaucauuauguggagaccuggauaauucuugcaguguuuagucaacucugguaucauuuucuggcaacgccuuuaagcuuuaguuucugaaaacuuaaggaauaccccaaauuaguucugguuuucauaucaagacaaaaggcagcuagagagauggcucagcaguucagagcacuuccugcucuuccagaaaaccgaaauucaguuccccacacccaugucagguggcucagaacugccuguaacuccagcuccaagggaucuaaugcccucugcuggcccccacagguaucacauguaacaaugcauaaauuaaaauuaaacaauuugggggcuggugagauggcucagcagguaagagcacccgacugcucuuccaaagguccagaguucaaaucccagcaaccacaugguggcucacaaccauccguaacgagaucuagcgcccucuucuggagugucugaagacagcuacaguguacuuacauagaauaaauaaauaaaucuuaaaaaaaauuaaaaaaaaaaaaaaauuaaacaauuuuauuauaagguagccgaguaugguguuacaugucuauagucccaacauuugggaguuagguauagaaagauggugaguugaaggccauccucagcuacaugguaaguuugaggagagccuggacuacccgaggcauugucucaaaacaauaacaaaauaauugugagguaaaaauaagaagugaaaaaagaugguuugaggguuuuuuuguuuguuuuguuuuuuguuuucaagacaagguuucucuguguagcccugacuguccuggaucucacucuguagaccaggcuggccucaaacucagagauccaucuguuucugccucccagggauuaaaggaaugugccaccacugcccagcuaaaagaugguuuuauaaaauacaaauguaaguaagauauuaacugauacucacaggguguagcuaaagggaguauuaugaccauuucaacuugagagaucgaaacuugagagguuugauaauaucuugguuaagauuuuuauuuuguauaugugggugacuggguggguguggguguccacagaaggcagaaaaggguauuagauucccgagagcuggaguuacaggcaguugugagccacucggcauugguguugagaacugaacauaggcccucuggaagagcagcaaguacucugagugcugagcagucucuccagaagcuuauuggguagcccaggcuggcucacggcuccuccucagcuucuccugugugccuccuuuuugguuaauacaacugaagaaccuuucaaguguggggggaaauuacagaagaaaagaaaaauuaccacuucuaacaaccacuguaccaucgugauucuauucuuagugucucuuuaugugugugcauacguacacuuacaaauucauguuuauaaaauugagaucauauguagaaucuugccucuuuuuuccuauuugaaguaaauaacaguagaaaauauucaugauagagucucgacauuuuaaugaccacauuguacaaauauacuagaauauucagacuugcaguuuucuauacugugagcuggccauguaaggccugaucuugagcuggucugccugcauucccacuguagcgcucacacgagcuguaugaccugggacucauuuagcuucucugugccucaguuuccuuaugaauaaaguggagauaaaauaaugccuaacugauauauuaguggacuuaggguaauuuauguagccuaggcuauccucagcauucccuaagguguagacuauaaacuaauuuugcuucucagaagacagcaucccacggacacaaguagaaaaaaggaaaacaagccuguauuuuuccagcaaguacaacaaagaagguacccaccuuucccuaagcagaauggggggggggcaagggggacauuccaagucuuuuaugagaacaacuuugacaacccuauauuuuuguagcucuuagccccccaagacgcaaauccuucaagaaauggaccccuccucggucaccuuuuaaucuuguucaagaaauacuuuuccaugacccauggaagcuccucaucgcgacuauauuucucaaucggaccucagguuugugggucauugucaucuuguccugguuagaagggagauaccuaaacugguuaagaagucuaaggucaagguacauuuugaguuugugaugucagaacucuuuacuuaugcaaacauuagacuggauaacagccaacauucuuuuuaauacugagggccagguggucauugauuuccuacuaacagguuagcuuugguuaucagugaaggagcaguuaauauuucuuccucuauccugcuuggaacuucccuguguucauuggauguuuauagugguuaucuagugagcugauuauuugaaaacuagccaguuucuguauaauuuguacuaauaaccaaguagauuaacaguguugguauuugguucuguaaauggcugcugguuuggguagugacuugacaauaagcaaggcuagggauauagcucagugguggaguccuugccaucaugcaaaauacccuaauuucauucccagcaccacaaacacaguaacagaaaugccacggccugaaguuuauagaugcaaaacuaccuaaauaagaaguuggccuuucccaagacaugugucugccauuguuuaugcuccccaggcaagauggccaucccugugcugugggaguuucuagagaaguacccuucagcugaaguggcccgagcugccgacuggagggacgugucggagcuucucaagccucuuggucucuacgaucuccgugcaaaaaccauuaucaaguucucagguaugguccccagcccaguggaaggagcaaacugugccuauugaaggcagccacaccuuaaacuuuaaugcccugggaugcuauauuaauugaggucauuuagcucaagcaccaaagacauuuaaaacaggccgcuugccccacaccacagacuccuacugacccaaaccauaaaucuuugcccaacacugaguagcccuguacauagaagagaagcauuuccucugucuauuuauauuucgcaaagcacacaggagugaugaggaagagguaggugauaagggcaaggugaucgaggcuacaaucagcacugcuucagagggaggggucaucuugccccauuacagguauaaggaaggugacuuucucaaggcugaccauguguuggauguguaucccucagaugaauaucugacaaagcaguggagguauccgauugagcuucauggcauugguaaauauggcaacgacuccuaccggaucuuuugugucaaugaauggaagcagguaagcccaccacuggccauauccaacauaagccaacauauucagcauauaaguccaccagugugccuggaucuaugagaaagaaguccuguuguagucccaaccagauuugcccucuguucaaagagcagcaggggcgugaggcuaugaguuguaguuauggacucuugagguacugccccaggcccugcacuguggccuacuacugacuugagcuucugacccuccuaccugucuguguucuguuuaauacugacaggguuccuuccuguuaaaaaaggagccccuagugcugagaggagauggcuuaguuuguaaagugcuugccaugaggacuugaguucagaucccuggaacucauggaagagccagacauggcaucguucaccuucuaucugauagauagaagcacugugggggcaggaacagcaggacgccuggaaguuucuggauagccucucugagcuuguauaccagauauccuacccuauguggguaaagcuccaggccagugagaaacgcuuuuucuuuuuuuuuuuaaagauuuauuuauuauuguauaugaguacacuguagcugucuucagacgcaccagaagagggcaucagaucucauuacagaugguugugagccaccacgugguugcugggauuugaccuaaggaccuucggaagagcagucagugcuuuuaacuacugagccaucucuccagcccgagaaaugcuuuuucaaacaaaaagugaauugugagccagagagauagcucaggguguaaaggggcuugcugcgcaagccuggugacaaaaguuccauuccuggaacccacaaaaagguagaagaaaagaacugacucaaaaaauuguacuucauagacaugccucaguauauacacauacacaacuaauaaaauuuaauuguuuucugaaaguagaagguaccugaaccuucuggcuaauacaaguaccuguacauacacacacauccacaaaacaggaucccucguaaaagaggaaauauuugacuuagagugucuaguugucagauuucuccucauaucucagacuggaauguggcaucuggguccuauuaaaacuacccauuccuuuguuccugucccaacacugguacauuuugauggcagugugacagcuggaggguagcuuggcacacugccuccucacaguauggcccugcguuaagucagugaugucuagagaaacccagacugaagggccacaguucuaccccuucaccaccagagccauugguuagcuucacagggucucuaaucaucgcugccuucugcuccaggucuggguuaguucugaacuggagagcacuuuguaauccauguaggauaucuguuguauaagguauaacuauauacagucuuggaugcugugggguuccaugucccguuuaucucagguauauuaucaugaugaacccccucacuaaaccuuuaaacaugucuauggcugaauguugcauuucuuccaggugcacccugaagaccacaaguuaaauaaauaccaugacuggcuuugggagaaucaugaaaaauuaagucuaucuugaagcugccuguuugaaguuucccaugcgucgccuugugcuucgguuucuaagggcccuguggugugcagugagcucccuucccggcacguggauuuuuuuuuucaguuuguuagaagccaguguaugucuuaagccucugccaaaaaaaaaaaaaaauuguuagauaaugauccuaaaaguguucaguuuagguuuuccaaugaugaaauucaacacgccaaugcucaaauccaguuaccagcacuccugcuaaagaaagccuaaacauguauucuccuucuguauaaagugauauugucauguguggaaagccugccauucuuaauggguauuccaguguuauagcuuaaauagugaggcauuuacuuuagaaagauaucacuaacuaaaaaccgaauugaccuuacaugguggcacaccccuguaaucccagcacucaggaggcugaggaagaaggauggaaaguugagggccugccucuucuguguagagagagacucugccucaagcacaaacagggcagggccagcaaguggcccaguaaaugaagucacuugcugccaggcaugaugaucugaauuccaucccuggaacacacuccugaagguuggccucuuaccuucacuugagcucauacauaacauguuacaaaauacauaaaauuuucagaaauggucugcagagagaugguucaguaguuuaauaugcuugcugcuuuuauagagguuacuuuuuagcacccacaucaggcagcucacaacugcuuauaacagcuccuggggaucugucaccuucuuuuggcuucauuggguaccuuagcacauguggcauauauagauauaaagauauacauaaacauaaaaaaaaaauuaaguccuaauuacuuaacacuuuuuuuucuuuuugguuuuccgagacaggguuucucuguguagcccuggcuguccuggaacucacucuguagaccaggcuggccucaaacucagaaaucugccugccucugccucccaagugcugggauuaaaggcaugcgccaccacugccuggcuacuuaacacuauuuuaaaauguaguuugaaaauuaaauuauaucuccuccucaaggcaauauuacucaaaaaugcauaguauuccaccccauuuuucauuaauaaaauauauuuuucauuaauaaaauauauucacccaugccagucaucaugguauacuacuauaauccuaacacuugggagucuggagagaaucaugaucaaggccagccugggcuauaugguaagacccuauaucaaaaaagagcaaaaaaacaaaccaaaagauccacuaguggcacacacacagacaaugagcagaugggccuuauaauguauaugugaugaaaauacauacacaguaccugggaugcugaugcaagaggaccucugaauucaaggcagccuggcuuaugagagugugaaggcagcuuugguuacacagcaaaacccuguacaaaaaauacaaaccaaguuuguuggacuaaauaagcuaugucugcagaagugucugucugucuuguuuaauggaauucuuuuuuuuaaagauuuauuuguuuuauguauaugaguacacuguaacuguacagaugguuaugagccauaaugugauuguugggaauugaacucaggaccucugcuugcuucuggcccugcucuggccccgcucgaguauauggaauucuuaagauccuaauauacuuaugaaaccuaucacuuuguauuagguaguuaauaaaauauuuuuauuaaaaaguaag

SEQ ID NO: 3315 - RNA, 174878 nt, Mus musculus
cguucuagcugucguucccucgcgcugguucgcgcucgcgcgccggggccguggcagcggcggcggaggcggcggcggcagcggcugaggcggcgcggggggcgggccgggagggggggguggucgggguggggauggaccgggcgcggcggcggcagcugcaggagccggcgcuggagaccgagccgcggcgcuggcggagacgccggcuguccgucgucucuccaccggugaguaggacuggcccaggccguggguggggacgggcgaucucuuuagcgcggcccgucgcggucgcggggccuccucgaggccuggcgcggaucggaccucuggucgcucuggcggcgccgaagccccgggccuccggccggaccccgcgucuccgggccuucugccugucauugggacaacccccgcccccgcccccgcucgggcacucucccccgcucuccuuugggcagagcugagcgaggggcgugugaggacucgcgcccaggcccaaggccuccuggcuagccgaggucugagaguccucccucguccggcccugcgguacccauaaguuggccaccgaaagucagcccuugccaccugaaaccagucuugcaccuuuuguuuugauuuugaacucgugguuuaacuuggaggaggaaacccgcuguccugcgaagaauaggugagaugggagucuaggugguuaggaugcccuuuauuaacccuuuuuguggagagcagggggcccgcagugagaugcauuucgcuacaaaaccugagauuucagccucagccaaaguguggacgguguugguccagugauucagugucugucccacuccaucccuggacagcguugauggagguuccccuacuggaucugcugcuggggcuucuggagguagcccacuugagcucuuggagaauaucucucugugcucuggugucacguuuuaccuuagucuucauagaucauaaccaauguccaggcuuagguuuuauuggaaaaaaaaaaaaaacgacuaccaugcaccccuucuaaaaugguuguugucauagccugacauaguugucaaaagauccaugugcacaugcgucccuggaauuccuaaauuggcuuuucuuuuaaggaaaaaagaaaaauagaaagaaaacaaacacaguaaaaaccccaagauugaaaaagcagguaacaacuuuagaauauagcacaaguuugauuuguuccucucccuguccuguaucuuaaauuuuagaaauuaaacuaaaccuuugucuuugaguguauagaauuugcauaaagaaauugucacaaagcuuggaggaaaaccuuaauagaaaugguaagauauaaaauccuccaggaccuggggucuuaccccccaacuuucauuuacagauugagacugaaauugugagugggugguaguuuuaucagugucucguaacagagauacuuagaggugggauuuuagaucaacaguaccuugcccuccaccaacagaauugguuguguuuuuugaacuuacacacccacucucuggcuaguagagaaagauuaaaaagcugcuucugguuugugggugguaaccuuuuaauuucuaaagaauucucaucugcuuacagacuagauaguugaugagccccauaggaaaauucuagauauuaaaaauucauuagcacaugaucuagauaucuugucauuauggacgcuuauuaaagacuugacgggauaucaguaccauguacucuguauaggaaaugagauuucucagaguauuugcaucuuaagauaaacagaagcacaaacagugacaguguuaugucaccucucaguuguugagucuuucaugagcauaaaccucuuggaguuucagugucuuggacuaguuggugaacaccagcaauuugaacuguuugguucaucucuacuggaaugauagcccuuuucuauaggagaaagcauaaacccaagaacauuuaugaaccauucacucauucaccagauauuuacugagccuuuacucuggcccagaauucuuuuuagauuauaauaaaggaacagaacaaggcuucugccucagugagcugcauucuggguguggagcagaggcauagacaacaaauaagcaggcaugaccauuucagugacuagaggacagcaggcaguaagcgcuuuggguuuguuguuuguuuguuugugaagaagaaaguaaauauuuuagcuuugaggcacacagccucuguuguagccaugcaguuauuguuucaguaugugcagcaacagacagaaaguaaacuggcaugucuauuuuccaguuaaacuuagacccugaaguuugaauuuucacauaucaugaaaugcucguccuuuccucuuucaaccauguaaacauguaaaacuaaucuugguuuacaagccacuuagaaaccuggggcaagcugaaacuagauuucuauagaaaaaguuugcaggucccuaaugaggauuaugauaaaaacaaacaaacaacaaacaaaacaaagaaaacacuagugugacaaguaacuaggggcuagguggaggguugcugagagaagccuugcuagggagaacuugaauuauggccugaaagauggaagagcuuuucugacagguggaagugugaagaaaugaccauguuccuugcaucgaaguccccauacaccaugcucuucuugcuuuugugccuguauguauguauguauguauguacuccauguauagcauggcauguguguggaggucagaggaggcuuagcaguaagcaccuuuauucacuaagccauuucacuggcccaaccuuugggucuuuucauccuguuauauuccacuaguuuauugcuguuccccaucaauuguaaaaaaucuuguuaaagaauuuuuuuuguuuuuguguuuuugagacaggguuucucuguauagcucuggcuguccuggaacucacucuguagaccaggcuggcaucgaacucagaaaucugccugccucugccucccgagugcugggacuaaaggcaugcaccaccacacccggcugagauuuuuuuuuuuuuuugagucaggguuucucucuguagcccuugcuauucuagagcuauguagaccaagcuggccuugaagagcucagagcuucugucuguucaccaccaugccuaguuauuauaaaaucuuacaaguuaaaaaaaaauaauucucacguaguugcuuucuuuaaauguucagagugguuuucuagccuauauaugaacagcuuuaaugauaaaaaaauucaugacuuccagguagucuaugcuguuauaaauguaacuauuacaauauucguucugugagauugaucuuuuuaccugggagggaaccugcaggugguuguaccucauuccaggcuuaggcuucaacauugguguguggacaaaaaucacucacauagagugcaaacuguacuugacaacccuuuaaacugcucagaaaauagugugcauuuuuuguauauauaaucauuuagaguuuuuggagacuccgagcuucacuggaggaagaaacaggagaaaggaauuuuuaugcagauaugcaggccuccaaacccuuugcuuuuaaaaauaguuaccuaaucucuagcagagugugggaaauggagaauuccgauggauugcuagcuucauucagacuuuaauucuauuguuacauuaagucuacaucacauuaauaaaugcuuauagcuuccugugaauauuaaggugacuuguagguaaggacaugcaugggacaaaaaguagcaauauauguauccgguccugugaaaaguugagaaaaacuuggccaccugcuuccugucuuucccucuugguauuuccuguuauggcucuagggaacagcugucacuuucuuugccuugacuauuggucacaucuuacagaagucacuuguguguuaaaugggugcaugaugauuauuuuugccacauggcucuuaaaguauuugagcauugccauuguguugccauucaacuuuuuacauuuuagggaugcuuuuuguuuguuuuucuaucaaagggagauguuuuuacauuuucuauuuuuuucauuucuguuugccuuuuucuaguuacuuuacuauauggauuguucuuauauauguuucuguuuaucacuucuucacuuuggugcccugaaguauauguuaugaugcaaacucaaguuugaucuucuuccugaagccuucgcuuaaaacuccuaccacuuuauacuccuaccacuuuauacuccuaccacuuuauacuccuaccacuuuauacuccuaccacuuuauacuccuaccacuuuauacuccuaccacuuuauacuccuaccacuuuauacuccuaccacuuuauacuccuaccacuuuauacuccuaccacuucucagacuuuuggcugugaucaggugcagacuuuaugucucuccacugucacuucuguccuuuaaugcuuucuuauauucuguuucaugcacuaucacuacuucacauugagaccuucaugaaagcaaagaucauauuuuaggcauuuuucuuuucuuuugugguucuggggaucgcacccagagccuugugcaugcuaggcaagcacucuacuaccaaguaacauuuauagcuuuucuuuugguguauguguauguguguguuugugacuguguauguguuugucuccuucuguguguacaugucugucugucucuguguuucugugucucagauccacugaguaaaauagcaggcauauauuccaucacaaaguguuuuuuuuuuuuaauucuuuaaaauuaaacuuauuuuaaggguacuauuggauuuccagaaguauuaugaagcuagaacugagaauucuugacucucuuguacuguuuucucuuuuaucagcaucuuguuuuuguuuuuuguuuuuuuguuuuuuuuuuuugguuuuuuuugagacaggguuucucuguguagcccuggcuguccuagcacucacuuuguagaccaggcaggccucgaacucagaaauccgccugccucugccuccugagugcugggauuaaaggcgugcaccaccacgcccggccucagcaucuuacauuaaugugcuuuuguuacauuuaaugaaucaauauuaauagauuauuauuaaauucucucuuuccagcccuuuuccuaaugccccuuuccaaucccuagaucccaccaaggauaccucauuacacucaguaguuuuuccaucuccccucuucuuuugcuugggauaauuucccagucauuucuuauacuuuugaaaugacugcucagauguuuuuguagcaugccuuucaauuaggguuugucuguuucugucauaguuagacagguguguaauguggcuuuggaaggaagaucacagagguuaaacauaauuuuuuagaaaaacuuguguauguguauguguuuggguuuggguauguccauuugagugcauuuaccuguggaggccagaaguaggcaucagauucucugaagcgagaguuacaggcaguuggaugugagucuucuacuaagugcucuuaaccacguagucaucuuuccaaacaccuagaauauuauucuuaccagcugucaagacuguagcaauucaguguugauguuaaucuguauuaccugccugggaaaaagucaguaugcccaggucacuuaggagugaaaaguucacuuauuuuuguuugucagacuguucaagcuccaggagcucuuuugcucagcuucuuuacaugucccacuguuguauauauguguuucauuucucauuuuccuacagugugagauguccaagacucagccuguagguuuucuaguccaguccuauaaauccuagaagccauggugugguuguugggugugcuuauuugcuccuggaaaguugucacucccagacucucucagaugauggagaaaggaguugaugcagcaugcaaagucuuugacaccauguugucacuaaguauuucuauguauaaaaauacuagagccugugacucuauuaaagcaaacagaagggcccaaugucccuaacucuuaaccacauucuccuccuuguuaacugaauuuuuauuuuauuuuauuuuauuuuauuuuauuuauuaguguauggguguuucaucugcaugucacaggugugcaguguccaugguggccaaaagagggcauuggauucaccugggacauuauagaugauuuucagcuaugaugugggugcuggaaauggaaccugaguuuuauauugauuuggcaaguauugugaaaaauaauagaaccaagaauuggcuaggaggcuguuggcugucagcaguccuuucucccuagguuauaggcuggcuggaaugacacaugaaauucuagucuugauuuuucaaaggggcuuaggaaaguuuuuuguguaauuccuguuuauucucaaguauccaguguauguggcuccuuuagucagauaaggagaguggacagggguggcuagauccaacuugguauaagccucuauggaagacuacuuuuucuucauuuauuuauuuaaagguacuguugaguacucuaauaucuggugguucuguucuagguuuuuaagaucuaauguguaaaaauuugugucuuauuagaguuuauguucuaguggauaugcaguagcagauugaggccaaaacucguuuguaaacuuuggcuaguacugucauaaugcaguggguuucagaaagcccagggaggguuguuuuaaguuccuuuuacagacauuguggggaaaacaggaagcaauugagcagcuuccugacagacgugauugugcagggagauuaagaucaccaaaguuuauucucuccuguuuaagauucuucugugcauuggcaguugaugagagugaucuuguggcauuucaaaucagcagcaagacauuauagucaagacaguaugccagaugaugguauuuagacaauaauauuuaagaaucuccuugacaggucuuuguaaugcauaauauaauuccuaaagugguuuuguuuaauuuuuuaauacaauuauuuuauauauagagaugccuauuccccacagaagucaccuuggguccccugagaaagcaaguacuuuuaacugcugugucauuucuucagcccccugguuugaaaagggcagcagcuccgcuggaacuggaguaacagagucuuaugaaccacccugugaguauuaggaaccagacccaaguccucugcaaaagcagccgaugcucuuaaccacugagcccuuuguuugacuuuuguuuuguuuugaauuuuuuuuaagacaagauaucucaugucauccuggcugggcucaaacuccccauauaguagaggaugacuuugaaauccugaacuccugccucuacuucccuaguaugggauuacaggccugccccaccacacauggcuuaguggugcuagggaaggaacccagaacuuugugcaugcaagaaagacauguacucucucaucugcucuacaucccuaguccccaaaaugguuuugagauauaaauuuaaaaugauacuaauaaauuuauauguguaugucugugucucuguauggguauccucaaaguccagaagacagugucuuauccaguccucuggagcuagaguuaugaacaguugugagccaccuaaugugaguauuggggacuaaacuugggucccugggaaagcagcaaaugcuccuaacuguugccuuucuccaacccccuggugugaauguuuucuuaaacuacacuuucuuuaacuaagucuggaguagagcaugugcaucugucuggagggcaaaagacagccugcaggaguugguucuuuccuuuuaccaugugaguucuggguauuaaacucaggucauuaggcuuauuggcaaguaccucuacgugcuaagccaucaugcugcuuauucuuuuuuuuuuuuuuuacuucuaacuuugauuugaguagguauaccaaaauuuugaaaccauucagaaaugacaccuuccuguuuuguuuuuguuuuuguuuuuguuuuuucaggacaggguuuuucuguguaauccuggcuguccuggaacucacucuguagacgagccuggccuugaacucagaaaucccccugccucuguuucccaagugauaggauuaaaggugagcaccaccacugccuggcaacaccuuccuuuaaucucugauucacaacacaauuuuaaaccaguauuuguaucuuccauauauuuuauauacauacacacaucuguauuauauuuuaccuuuaaaaaaaaaaaacccucagaagcccacuuacucaaacacuuugaccuuuugaggguuguuggguuuuuguuguuguuuuucuuuuauuuuguuuuaauuaagauagauuacuacugacaaauugucuuuuuaaacagcuguauacuguauuaugcuguucuauugaauuccaucaguaggaguguaccacuuaggacaaacucaguaguaaacggccacagcaaacuaaauucaguuauugauugaaucagugaagaauuagugaucucauaagacagaugcaagaagacagguaauucagaacuaguguaauguauaagauuuagauauuguauuuugccuuuuauucuugucccagcuccaugcuggcuuugcagcagccucauaucaccauauguuuguaaaauguuugucucaucuguacuuaucauagcuaauagcauuuaaugcaggcaauggagggcaaaauaguuuucugcuuagaaagugauuucaauauaauugaagagaaaauaauuucuagaagucucucaaacaguacucugugaacuccaguguuaaaaacucaaauucaggguuucuugaguuuggaaugggccuuaagaauuuguauuucuaucacauucccauuagauccuaauguuauggaccagcaaccaugcuuugaguuugaguuuaagucauucacuacccuguauaauauuuccuacuuuuccuuggagauugaauuauugcuccugacccugacuguaucuggaaaaucaacaaccaugaacaaaauauaaguucuuacuaauaagcuaacaaauggcaauacuucuguuacuaguaauaaugcuuccaugaauauccgugugccaaagaaaagauagauguaguuaauauuuuuaaaauuuuauuuaauuauauuuugugugugaguguucuuguuugguuguaugucuguguaccauuugcaugcccagugccugugaaggccagaagaggcauaggauccccugggaauuacagaugguugugagacauuaugugagugccagaaucaaaacuggauccucugaaagaacaagugcucuuaacuacugagucauuguguaguuaaaucuucuucuucccuccuucccucccucucucccuucuuuccuuccuuccuuccuuccuuccuaaguuuuuuugagaaaggguuuguuacuugauuuuacagugaaaaacauaugagauguaaauuucucaucugcuacugaggguaggcucagauguuuuguaguucuggcuguccuggaauuugcuguguagaccaggcuggccucgaacucagaaaucugccuaccucugccucccgagugcugggauuaaaggcgugugccaccaccgcccugcucauuauuuucuuaauugaggucucagaucuuuucucccacaugcaaaugcaaaggguaacuuagucuuucauuuucugucaccugauuauuguuuguuucuuuuuucauuauuagucacuuguucuuuuuuccugagaauuuguagaaaucaaccuauuacuaaggguguugcuucugucuugguuuauuugcuagucggugacauaguuugcuguugaguuugauugagauuauauauacuguguguaaacucugcuguuauaaaggccuguagaucuagaucuuaaaugacaguaaguaugcuugccaaagauuugcagacacuaaucaaacagggagaauuaguuaaguguuuaauauguagcaucaaagaaaguguagcuaauaaaaucaagauggagccaaguagaaaguaugaaagcaguaggaagguguaacagaaauguaaggguauuuacacagaccuucuggcucagagugaauugguaugccauaaaaaugaaauuuacuugccagacauuuaaauucugcagugugacuugacaaaaacaucacuuuucugaugggaauaagauucuuuuaagauaaaaauuacauuuauuuauuguguaugucuguauguaugggguaugcaugugccucaguguacauacauguggagguucagaggacaauuugugaguuagauccuguccucuaucaugugauuaucaggucuucaggcuugagaauuauugcucaaauaggucuuuuuuuaauuuucaaagcuacaaaacuuaaggugaauuguaugauacugcugugaaaagggcaaaugugaugaacauuuacagaugcauggaacuagauaaagagaugguuugaccauggucccugcacaagacagaauggcaagagcucuggguaauguauccaaugaacguuugaggaauuagaaaaccuaacuaaauauauuucaaacaagaggguguaguccucuccagagaacagauagugggcagaagcuucugcagagauugcagucaucccacugugggaaagagcuuucucccaguaauuguaugucaaucuacauuucugccuagcugauggguugcuggaauguugccaauauggugcucagucccaguccaaguuccucagggugagaaacagcaagaucugggauggauguugugguucccaaucuccugugcuuuauuccagacaccacugggaacugugaggauuugagaauaguaguuuccagcuucuugugacacagacacugcucuaggaacagggguucugcaggcccgcacuucugugcaccaggcaguuccaaaugagugcugaaaguauaaaggggcuggaaaagaggccuuccccagaagauuuagguaugccucuucaugaagcugcaccuccaguggcugucuuuuuuuuuuuuuuuuuuuuuuuuuugguuuuucgagacaggguuucucuguguagcucuggcuguccuggaacucacucuguagaucaggcuggccucgaacucagaaauccgccugccucugccucccgagugcugggauuaaaggcaugcgccaccacgcccagcuccaguggcuaucuuugaugaaggagauggucuuggcuuguucaaacugcuuuauuuaugguggagguaaauguacacaucuuacucagggugaaccaggaagagaugcccaggaagggaagcucauuggcuaaacacucagagccuaucuagauaaccucaguagcauggagaacucuagguuuuaugcugugugaucaguugucauggucucuuaguggggcaucaugguuacauguuucaggauagguagagccuggcugggaacugguuguagugccugcuguccucaacuaugagauauacuagcauuuugaaccugcuucaaccuuaccaguucugucagguggcauuguccacuugccucaaauaguauacuaagcccuggggucucugcuuuaggcccaaugacuguguugugaugaugcugugaaagguguccuacaggaacauagguuauaaauaccauagcuccucucccucccagcuccuaagauuuucugaucucuuuucucaguggucucucuuuucagugcuaauauugauagugaugagaaacuaauggaagucuuacugacuuuaguuccuuaguaauuggggacaaaagaaacugaaauuuucaauuaccauucgaagaauacaguacuuuaaacaaagaggcaaguuuuuuuuuuuuuuuuuuuuuuaaagauaaaaaauagggucuguagagauacucaguguuguguguaacuuuaaaaacacaauucuuccuuuccugggagcucagccucccucugaccuucccaguucccuuugcuccauccagcuuagcccaagaucaaacacaaccaucccccaacccaggaaaagcaggaggugcuguccacuccacuggcucccucagcuucucuuucauuccuuccagcaagccaccagcuaccgcuaggcuuuucucucccccccccccccaccuuugcuccucagaagagaaacauucagacagcuuuauuaucuuagaauuugccagauagcacaauuguugggugcagaucuccuaaacuuauuagcuaaccuauaucagccagcuucagcugaccuacuugguuaaccaugguaguggaggcugcugguucuuguuccccaaagaucuuacaugacugcuacauuuccaaagcuuggcuguaaaggccacuucccuuuccuccaaucucuuuuuccucuugggaccuggaagucgaaccuuuaaccuuugcccagcaauuggcuccuaccuucuuuauugacacaaucaagaaccaguuagggaaucagcaccucccccuucaacuccgcuguuagagacuuugcugcuuuugcaaaggacuugaguuuaguccccagcacucacauuggcaacacauagcugccuguaaauccaucuugacggguucugagaccucuuucugaucaucuugggcacugggaugguuugaauaugcuuggcccagggaguggcacuauuaggagguguggacuuagagaaaguaugucauugugugcuugggcuuuaagauccucauccuagcuccuuggaagccaggcuuuuccuguuugccuucagaacaaguuguagaauucuuagcucuuccuacaccaucucugccuggauacugccaugcuccugccuugaugaaaaaggacugaaccucugagguuguaagccaacccuaauuagagaguugccuuggucauggugucuguucacagcaguaaaacccuaacuuagaaguugguaccagggacugggauauugcugugauaggccuaaccauaucuuuguuuagaagaauguagauuuugggacuuuggauuuggaaauccuauuaggaauauggaagaugguagugcugaggguaauuugaacuguguaggccugcugucccaagaaguuucaauggaaaagaauguuauuaugucaucuacacacuguuuuugugauauuuggaugaagaacauggcugccuuuuuaccauuguucaaaggucugccugagacuaaaaugaagagauuuagauuaguuacuuugacaaagucucaaaacagccugguauaaauucuguugugugcuuacuaaaauuaacucuuaugaagagaacauuuugaugaaaaggagcaagcuuagaaaggaaaaguaugaaauauaugguaauaauaaagggacaccaggaaguaaaauggagcugaauccuguguucaaggagauaaagguaguguugaucucaggguaauauucuacccacugaagcuuauuguuuguauuuguagaugaauaagaacuaguuuggacuuuuaaucuggaaugaaauacaauccagaaauggagggcacaccugugauccagaucuugaugcuggaagacuuaggcuguugauccagaucuugaggaacaguggccaugaaaaguuuaggcccaggcauggugguacacaccuuuaaucccaggagauaaaggcaagcagaucucugaguucaagaccagccuaggacagagcaaguucuuggugaagaaaagcuuaaaucuaggaguacacacccuuuaaucccagcauucaggaaacagccauggagaucugaguuuaaggucagucuacagaguaaguuccaggacagccaaguuuaggcaaugaaggaguuggaaaacagaaagcugauaauaaaacaagggggcucccuccagcaaggagcagaauucggcagcuucagccacgugacucuggcuuuagagucaaaaauaaaagggacuacuugacaauucacauugguuagcuggaucuaagaaauuagcggugauuaauaagagaccaguaucacugaggugaaauuuucugagagcacaaagaagcuguguuccagagauagccaagguuguaccuugugcugcagcuggacuugguaauguguaagaaucacccgggugguacugguuuugaagguaugaaggggucauggagaacagcugaggcuuggcacugugagaggcuaggugaaggugcagccucaguuucaguugacagcccaguacugaagggucaugcaaagaaguuuggcuuggcaccauaaagagagccuauugagaggcuauuggugaagccuaguugcagcagaagaccccaguguacuggagaugccaguaccauaggaugaacagcagcagcagugggguagagucaacuagagccuagaguuuuacagagggcagaacuggagaaaugaugaugcaagcccuuugaaagagcccagaagaucauguguggaucccagacauugaaguugccuuggagacccaagauguucgagaugccagagccaugggauaucugucacagaaaacugcaacaggaaguagaaccagccuaggaaaagaaguuuguugcaaucaaggagaugaaaaggaguuggagaucugaagacugcuuugacaucagacuuggagaugcagaguuucccagcugguuuccugucuugcuuuggggaucauaguucgugauuggaugaaugucagaagagacucagaacuuaggacuuucaacauugucgagacugcuauagaccauggggacuuuggaaguuggacuaaauguauuuuuuauuaugcuauggcuagguguggccccuauaaacucauguguguaaacaggccuaugggggccagggaguggaaugugguuguuugaguagguuugguccagggaguagcacuauuuggaguuguggccuuguuggaggaagugugucacugugugugugggcuuuaaaaccuuccuccuuaccaugugggagccagucuucuccuaguggccuacagaugaagauauagaacucucagcuccuccugcaccaugcuccugccuugaugauaauggacugaaccucugaaccuguagccagccccaauuaaauguuguccuuguaagaguugccuuagucauaguguugguucacagcaguaaaacccuuagacagcuggcuucuuggugcucaaggaguuaacacaccuccugccauggccuaaagcucuuugccccucuucucccccaugaagugaaauuugaggucuguacaugaaauuucauuuuauuucugugauuuuuaugacaaucuuugaagacuaguuuuccauaaguacacuuuagaauauauuaugcuuaguaaucauuagaauuuauaauuuuauacuauauaauaaaaaaugaaggcuacuauaauguagacagaugcagggauuaaaacugaauuuaguucccacuucuguuacuugcuuguacaguaaaaaaaaaaugagguuaauuucucuguuauuagggauggaauuggauuuuuagaguuuuuugcacauaauuuaugcuuggcacauuaugaccuugaguuaauaccaucucccuuuaguaaccacuguucucauagcauuacuuacauucuuugggcuuccuauuuguaaaugauacagcaaggugagcuaggagguuaugucaacaaaucuauuugugucucuaagcuuuacaaguauaaauuagaaauuacuagaaaaauauuuuuuucucucagaucauuaccaacucucuucauuauucaguguuuacugaauaucucaagauuccuucaguuguuuacacugauugccuggaguuaccaucagauucuuuccaaguauaaagacaguuccacaagacugugcuacuccagcugcaaguucaugaccacccauauuuuuguucaacuuggcugcggauucuaagguuaccauuaaucuuuccucucauuaauuugcuagugacucauagaccauuggaaaacauguuacuuaaauuugaugguuuacuuuaaaggaugcaacucaguagcaggcagguagaagggagaacaggccacacugggagguggggggugggggguguccugcagagcuugugugcacaucuuguagcuaccgccuuguuuucaccuauucacaaacucuccauauuccaucaguuaguuccuuuccagcuccucuccuuuucaccuagguagagguguuaagucccauauauagguuuccuggcaaccagcccuacccugaaggugucugaaagcccaccuaauuagccagcauaaacuccaguaagguauaguuuaaaggagcugauauuuguggagguuacucucuuuauugccagcuugccuagauuuggaauuaucugagagauaccccuuuggauaugcuugaagaccuuuccagaaaacucuagggaagaaagauccacucugaauaugggugacacuguccuuuuggcugagauccauacugaguaaagggggaaaggaggaagccaggugagugccagcauccauuuuucucugcuugcugacuuugaauguaaucugaugaacugcuagcuccuaccaccuugccuucauuugccaugauggacugcaucuucucaaaccaugagccaaaauagccccuucuuuuugucaaguaaucaaacacagcagugggaaagguaccuaauacagaaccaaagagucuuuucacucagaaagugucaaggaguuuuaggaaaucuagucauaaaguaggagaaaacccacauauaucauaccugauucucuucuauaaaacuaaaucuuuuuucaagggcacagagcuaguuuucagaacaucaauauuaaauucuuuuaggucgcugauauguuccuugaaugacugcucugauucuugaucauguaauaacauuuguuuugagcuccuuguaugaagauagcauuggaacagauucccaagagaugagucacauucuagucugucugucugucugucugucugucucucucucucucucucucucucuuucuuucuucuuuucuuuuucuuucuuucuuucuugcagacucagauggcuauacucuaguucugugacaaagcugauucuauagugugauaugaccaaauacaucauuuuucugacaagaauaagccuuauuuuuugugaaauuuggauagaaguuucuuuucacaguuuuaaucuucuuuaugacaauaacaugugccuuuucauacacagaagguaaauuguuugagauuacgaauucuuuuuuuuuuaaagauauuuucguuauuuacauuucaaauguuauccucuuuccugguuuccccuccugaaacccccuccccccucccuguccuccugcuuaccaacccacccacuccugcuuccuagcccuggcauuccccuacacaggaguauagagccuucacaggaccaagagccucuccucccauugacgaccaacaaugcuacauaugcaacuggagccaugggucccuccauguguacucuuugguuggugguuuagucccugggagcucuggugguacugguugguucauauuguuguuccuccuauggggcugcaaacccuucaguuccuuggguccuuucucuagcuccuucauuggggacccugugcucuguccaauguauggcugugagcauccaccucuauauuugucaggcacuagaagagccccucaggagacuauaucaggcuccuguuagcaugcacuuguuggcuuccacaauagugucuggguuuggugacuguguaugggauggauccccagguggggcagucucuggauggccuuuccuucagucuccacacuuugucucugaaacuccucccauggguauuuuguuccaccuucuaagaaggaccaaaguauccacacuuuggucuuccuucuucuugaguuuuaugugguuugugaauuguaucuuggguacgcugagcuucuggacuaauauccacuuaucagugagaucauaugugagaccauauguguucuuuugugauggguuaccucacucaggauaauauuuucuaguuccaucuauuugccuaagaauuucauaaauucauuguuuuuaauagcuauguaguacuccauugugaaaauauaccacauuuucuguauccuuuccucuguugagggacaucuggguucuuuccagcuucuggcuauuauaaacaagacugccaugaacauaguggaacauguguccuuauuacauguugaagcaucuucaggguauaugccaaggagugguauugcuggguccucagguaguacuauuuccaauuuucucaggaacugccaaacugauuuccagagugguuguaccaacuugcaaucccaccagcaauggaggcguguuccucuuucuccacauccucaccagcaucugcugucacuugaauuuuugaucuuagccauucugacuggugugagguggaaucucaggguuguuuugauuugcaucuauuggguuuguugaaagaagauuacuuucuugcuuuuucuaggguguaguuaccguccuuguguuggcauuuuccaucuguuauccuuuguagggcugguuuguggaaagguauuguguaaauuuggauuugucauggaauaucuugguuuuuccaucuaugguaauugagaguuuugcuggguaugguagucuggguuggcauuuguggucucuuagggucuguaugagaucuucuagcuuucauagucucuggugagaagucugguguaauucugauaggucugccuuuauauguuacuagaacuuuuucccuuacugcuuuuaauauuuuuugcuuuguuuagugcauuugguguuuugguuauuuuuuuuuuuuuuuuuuuugggauaugaccuuuauugagcuuauccaccagaguggaaacaaugucuguacaaaaccaaaugcuuguuacuauaacuucugcaucacaauuaaaauccaaacaguuuuuuaaaaacagucaacucaaucaaaacccacuacuucagaaucaauagcuucuuugaagccacaguaacacuuaaauaugguuaagacucgaaugcagaaauuugguugguuggaaggcuaauuaagccuccaacuugcucaaauagaauuacaaaaaggcaaaauuguguuuuucacagagauacaguccacuggaaucaccaacacuggacagcuguuaggaauauuuagaguccugagauaauaaggaauccaggcauccuuaaacagucuucuguuguccuuucuucccgaucagcgauuuguggaugugugggaugacaccaccaccagcaaugguagcuuugaucagagaauccaauucuucaucuccacguauagcaagcugcaagugacgaggggugauacgcuuuaccuuuaagucuuuugacgcauuuccugccaacucaaguaccucugcggugagguacuccaggauggcugcgcuguacacagcggcggucgcgcccacacguccguggcugguuguccuagauuucaggugucgaugaauacggcccacagggaacugcaagccggcucgcugcgagcgggaaaccgccuuugucuuggccuuuccggaguccuuuccagccuuaccgccagccaucucggaccgugcugaagcuccgacgagcgaggaagagacgaggccaggcggacgcucagcgagaucccagcgcccacuccuccgucggaccgugauucaaacugccgguguuuugguuauuauguaaugggaagaauuucuuuucugguucaaucuauuuggaguucuguaggcuucuuguauguuuauggguaucucuuucuuuagauuagaaaaguuuucuucuauaauuuuguugaagauauuuccuggcccuuuaaauugggaaucuucacucucuucuauaccuguuauccuuagguuuggucuucucauuguguucuggauuuccuggauguuuuggguuaggagcuuuuugcauuuugcauuuucuuugacuguugugucaauguuuucuaugguaucuucugcaccugagauucucucuucaaucuguuguauucuguuggugaugcuugcaucuaugacuccugaucucucuccuagguuuucuaucuccaguguuaucucccuuugugauuucuuuauugcuucuauuuccauuuuuagauccuggaugguuuuguuuacuuucuucaccuguuugauuguguuuuccuguaauucuucaagggauuuuuguguuuccucuuuaaggucuuaccuguuuaccugugaucucuuguauuucuuuaagggaauuauuuauguccuucuuaaauuccucuaucguugggcuggagagauggcucagcauuuaagagcacugacugcucuucugaagguugugagucugaaggucgugaguucaaaucccaggagccacaugauggcucacaaccauccguaauaagaucuaaugcccucuucuggggugccugaagacagcuacaguauacuuacauauaauaaaucaauaaaucuuuuuuaaaaauuccucuaucgucaucaugauaugugauuuuaaaucagagucuuguuuuucugguguguugggguaaccaagguucacuguggugggagaacuagguucugaugaugccaagcagucuugguuucuguuccuuauguucuugugauugccuuucgacaucugguuaucucugguguuagcuggucuugcugucucugacuuuggcuugucccuccugggacaaucuccugggagaucaguucuuucagggaggaacuuggguauggagaacugugguacagggucagcucuggggugcagacagagaucagaaggauccugucccaggcugauccuugguuccuguauccugaugacucugugaggguuccccuugggccaggaauuugaagagaagugguggucuuaccugugcuacaaauguguaggcacuccugggagaccagcucucuccugacaguguuuauuauguauguaucucuguggcacaggaucagcucugggcacagauggagacuggaaggcuccugugccaggcagccccucgauuccuguguccugaggguuccagguggguuccucugagcagcaguggugguccuaccugcacucacagaccugugcgcacuccugggaggcucccucccucccagcccuauuuguguauguagcucuguggcagaggaucuguuacuacaggcagagacaaaaccagaaggcuugagauuuuuuuaaugguauggaugauuccccucuucauucuccuucuuuuaccucuccuuguccauuuuaaugugcuuguuaagacaugauggcauacuuuuagcugaauacaggaauuuccuuuggauguaauucuuuaaaaaaaaaagauuuguuuguguauguauauagauguuuguugcaagauauugacccacauugugagcccugagauugcauuauguacuuuaaaagacuuguuucuaguugugcuguggcuuagccuuagcacacacuuuuaaucccucugguggggauacagacaagcccuuuguacacuccuuuaauccuaaacaaugaagguaaaguuaguuuguagaaggaagcacccauguuugaaaguuauagaccaaaguaaagaaucagaggaagauuuggcagaauagaguaugcccaacucucaggagaagugagagguaagagagucaacauaagagggaacagcagaagagaaagagaagggaguuuuaccaggagaguuuuacagacagguugaugaguaaacaagcuagacacugaugaagaccaaaugagccagagaaugugaaggagccagaagauuaaaacagacugccaguuaguaugaggcuaagcagaacaguuaaggagaugcccagagaaggcagauugaaucauuuaucauggagaggaguuugugcuagaacagcugaguugaaucagcaagccagagaucagaaagaacuaggaagggugagcuuuauuaagaaaacauucuaagccuagguacaauuguauggaagcuagaagcuuccaagacuaggccuagguuagcauauggcuguaagccucaagacaacaauuauuacaggagaauaaaaaauacuuuuuacagguguuuugucaguacgugcaucugcacauuagaagagggcauggauuccaugguguuacaguuagaguugugagccaccauguaggugcuggaaauugaauuuagccuuugguagaacagccaaguacucuuagcugcugaaccaucucuccguucccagaauguaagucuuaaagaaaaaaaucauaagugguuuugaacaacaguaggaacugaguuaagaacaagugugggauagccuggugccuggcaaaaauuauucuauuccauguaggugugagcaccuaucucuaccuuguuagucuuucuaacacuuaggguuucucaguguucugaccaaauaccuaagaauuaaaaaaaagugagaaaggagagauuuauauuagaguuuagagaauauaguucauugucguaggaaagguuuucagguggacacuuucauggugacgaaaucauagaaaucacaucucagcaaguagagagacaggagcuagacuaucaacuucaaggccugacccccagugaccuacuuccaucagcuggggaccaaguguugagacacauaagccugcagggacuuucuacacucagauuuuaguagucuuuauuuuuaauaauucuauccauggugacuuugagguguuuuaaaaacaaacugaggcagucaccaggcagugaccugugauacauggaauaacuuguucuucauagcugcagucucuccaguugucuccuuguuuaagaguuacuuucaguuuuucuacccauaucauguuggaacuaaauauuuaccaaauaaaagagguuuuaggaccuaccuuaaaaggauagaaaugucgggcgugguugugcaugccuuuaaucccagcacuugggaggccgaggcaggcggauuucugaguucaaggccagccuagucuacaaagugaguuccaggacagccagggcuaaacagagaaacccugucuugaaaaaccuaaacaaacaaacaaacaaacaaacaaaaggauagaaauaugagcaucauauagugacuauagacuuuuuuagucauuuaugucccuagcuuguacugugugcaggauggcugauaucuagagaaacacugaauguuguuuguuugcuuguuuguuuaauuuggagaauacugugcuaggcuuuguagcuaggaucuuacaauugacuaggcauguauuaaucuagguuugaugaaacucuuucaaauuuuucauaugcuuuccuguguuuucaguauaucagucagugacucauguauucaaaaguaguguuaugauugccaacuuuuuguguuuauuuguauguauguauguaugcauguauaugucuguagugugcuugcuugugugggguauauauagauacauauauguagaggucagaaauugacauuggauaucuuuugauuguuuuccaccuuauuucuugagacaaacucucucacuagaaccaagugcuugcugauuagaauagucuggcuauccagcuugaguugagugcugggauuacaggcuaucucaucauuuaugugugugcuagagauaugaacucagguucucaggcuuaugcaacaguugcuuuauggacuggaucaucuccccagccuuuuguccauuuuuuuucccaccuuucaaaaaucuuguuauuuugauaguuaggcucuuuguuguggccuaaaugagacagcagaugugaccauguaaaaaucagaauucaucuaaaauagauaaagaagaggauucuucccuucucuaaaauaaaauacgucuaaauuuaagaucgauaucacugauuauugccccagacauaagcauccucaaagaucuaguaucugcuaguaaaaugaaaaacaaaacaaaacaaaacaaaaacuucuuucugguauuggggcaguagaaagaggaucagacucuucugaagauggaauuaugcuugcuaagcaaauggaaguaggcagacucacaggagaacaggccuacaaaugcccaggcacugcacaaacaugaaacucaaagaggauuaauuggugaaggcuuaaacaucaucuucauagggagggcaguaggcaacuugaggagggguaguaaaugguuuuuuagggguggagaauagcccuggagagcaaacaacagcugggacaaaaucuuucuggauuaaguguggugguuucugucucucuaagacaccaguucaggcugguuuggguaguggcuuuucagcagggcuugaaagcaguuuugaucccuguggcagaacuuguccuuaaguagguaaaggagcuucaaagaagggccuucucuaacuuugcuguuagauugaagucugaagcagcauuauuuuggguauuguuuugugagcuccaguagcaguguagaggugagauggauuaggaggccuaaccugggcuagauuuagaccuggcauugagcagguaaaugcuuagugagugccaacucaaugcucaaauuuuggaauuuggauuugauucuuuggauuuggauuggauuggauuuuuuacaggaagcuucacuccaagacugggauaucuuaguaguaguccauacucaaggcccuagguuugauuccagaauugcugaagccaaaacaacaacaaaacucuuauucuagugguggaaaaggaacacaugggaaaaaguggcuaagaccucgguuugcacuaggugaacucuagggaaggaacauguaaguguuggauugcuuuaugagauuguuugacucaggacuauuugauuaacaacaauaugugaagaccauaguuuuuuuuuuuuuaaagauuuauuuauuuauuauauguaaguacacuguagcuguuuucagacgcaccagaagagggcaucagaucucuguuacaggugguugugagccaccaugugguugcugggauuugaacuugggaccuuuggaagagcagucgggugcucuuacccccugagccaucucaccagcccccaagaccauaguuuuacaagagcauucuguacuuuuagaggaacuucaccugcuaaucuuuuauuagagucaaagcuuaauuuugaguaagguuaauuuaaaguccaaaguguagaauuugagaauugaguugaaacaaaccaaacaaguuuuuguucaucuauuuucauucagagguggaaugaauuagaggggcaaagaaaugugcugagguacagacaguuggaaguuauuaaaauaaguuauaagagauauuaaaaacaucugacaauauuguuuauugacaaagauugcacucucagaccaguugcagugaugcauuucuguagccccagcuaccugagagucugagaugggauaggaucuauagucuagacagacaagguaaguuaucugucuguucaaaagcauuucauguuucaagcuggaauuuaaaaauaucauuaacaugcaauaagcuauuauuuuuugucuuucugauaauugaugccaaguguauugaauuuguggucuucccuucuacuauggccuguguacucuguagcaaacagugaaacugucaaauauaaagcauagcugugggcauuuguguaccacagggaaacagacaagaaacagacuacccugcagagauuguguuuauuucguaacuuaaguuuagaaauaaguggggucaaggucucauuacaguguccagaaguguaugguguugaccugcauuucguuaccucuucugcuucugguuaagugcagugcugaaacuuguuagauucugcacauggcaguaaggcagcucagcuuucugcuggaggcuuucuugggauuagacucuugaaucugaaauuucauccuguauuucuuagugcuuucuggacucuccacuuggugcucuggugggucuaaaacuaagugucuuugagcauuuuguacugaucugaugauuucuuugccaucaaauaccuauacuaauuaaagcuuuacuucuauugauuaaugucccaauaaguccacaaaacuuggauuuauuuucugauuuguuuugucuucggaaacauuucccauugagccuuuagaaggaauugcuugcucauucauacuuucauugauuuggcuaucuauauugaacucgauucugcaccagacacuaauuacacaagguguguagaagugaauacgacaggauuuucuucuuucagaguauacaguacaggcucucgucauuuuuuccaucccuauuggacuauuauagacauccucaguuuaugggggugagcauaaugcauacuuugaagaaaagaaauaacagacauguucacacaaaguugaaaacuucccauauuuuuauacuccugaaauacuggugauugaaaauuagauaugcauuuaucuagcuauuuucccaaucaauaacuuuauaacacaucucuuucauuuccuuugccuccuuuucuuucauuguauuacaaaugaaagagauaacuuuaagaaacaauguaaucccacuuaggcuaagacuagagacuagagcuagaagucagccugggcugcaugaauauugauuggcccuuagcagaauuuuucucaacagcaguuuucuaucucuaacaccuacaugacaaccgcagcccauuuaggauuucacugucugcuuuucucaucuucaaaauguggccagaauuggcccuucuuagaagcauagauaaaagauuucaaguacuguaugauguauuugcuucucccaaguccugaauaauccucugagcugugaguuggugagauggcucaguaguuaaaacaguuuuguuuuuaaccuaaguucaguucuaagaacucacaucaguuugcuuaugacggacugucucuucagcuccaggagaucacacucccucuccuguacuccacaggcacuguacuuagguucacagagguggggggcgggggggaagaggagguauauuuguguguauauguguguguguguguguguguguguguguguauacacacauauauauguauguauauauuucuauguauaauuuuaaaaauuaaaaguaaucccauguuguuagaauggauauaugugaauuauuuaccuuuuguguaagugcucucugacuuuucuuacuuuguugacaguagaauaaaacaaauugcaggaauacccaaagguuaacaugggaaagugugaagaagcuaaaagaucugagauaauugagauaauugccaggaagguuuuuauaaauauucuuuuucacaugugucuuugaaaauauguuuaccuauaaauauaugaucauaguacaguuuuacaaauaaggcuauauaguaaugcuggcuuuuggauuugucuuuuugcuucagacauauguuuuguaaauuuuacacuguagaaaguguuuagaauaacauguuucaaagaugaggagaagccugugcuuucuggaacaaauacugcuuaggagaguaggaacuuuuuuaguuccuugaccuucuuugaucagauacugcuccuuuggcuuccacugugccuuaagugucccauugugaucuuuaacuaucuuguguuguuguuuuuuuuguuuuuccucucccugagcagauccaagugcccuauguguagcuccuuguauucuuugggcuuaauguaaugccugacugaugcaggcauuucagugucucuccauggacuggauaauauacauugcuucucacuucagaugaaguaguguccaauuccuuaggggauagaguguagauaaaauguagccaguaauuguguguacuuggugugcaaguaagaggaucugaguuuaauuguuagagccccauaugaaaaaggcuagaugaagugaccuuuacuuguaagcuugcuggggaggcagaggcaaaguggguggugccuaaggaaugguaucugaguuuauccuuugaacuccuuugcauaugcucauguacacacacguauacacauauauguguacacauacaaacaaacauacacauaccaaaaaguaugcagcaaacacacaguagcccugucaaccuuauucagaaaucuauucuguaacuaguaggaaagcacuuugauauaaccgugccuuauauauuucuuuaaaaaauguuucuuacuugcuauagacaagacuuuauuaucauaguguucaagauuugauucugagaaaacauaaaaaaaugucaagauguauuuucacuggcuuaauaugaauaauacugcaagguucaaaguguucagaaacaacauggacaaacuaaacccugaaguucuuugaugauaaaugaaaaaauuaaacagagaaaagaaacacguaagagacucaggggaagguucuuacugcuaauccuaaggguuugaguuugaucuccagaacucauaagauggaaagguagaaccaaauccugcaaguaguucugaguuauacacacacacacacacacacacaaauauauaauuuuaaaaauaaagaugauugagacaguauacuuguucaaaugaugaauaguauguauuccuagguaguagagaacaguuuuuuuaauugauuuuuauuuuuacuuauuuauuuauuuauuuauuuauuuauuuauuuauuauauguaaguacacuguagcugucuucagacacuccaaagagaucaucagauuuuguuauggaugguugugagccaccaugugguugcugggauuugaacucaggaccuuuggaagagcacucggcgcucuuaaccacugagccaucucaucagcccuccuuuaauugauuuuuaaaucacacacacacacacacacacacacacacacacacauauauuaaugggaaguuucauaaauuugaucaccaugucaauauuaugaaaggagagaauuacuguucagaggaagcuuguuuuugagcagggaagggaagaaaggcugugccaacuuacucuggagcacacaagucagaagauuagugcaucugugcauuuuaaaauguuacuauaguaccuucugccagggcagaucaucagcuugucugccucucugaagaccccacagucugaaggccucccaggagaucugcuguaccccgggcaaggaagguaaaggacccucugaaguaaccacagcagcugggacuacugaggagcucaacagacuuaggaccuauccccuccacuugaauuucaccuccccucuggucugcaccuucugccugggaagaucaucaguuuaucugccccugugaagaccccacagccugaaggccucccuggagacccgcagcaccccaaggacacagaaagcacgcuccagagagagacaaccaagccaguuaacaccagagauaaccagauggcaagaggcaagugcaagaccauaagcaacagaaguuaauauacuucagcacccucagaaccaaguucucucaccacagcaagcccuggauaccccaacacacuugaaaaucaugaugcuaaccuaaaauccuaucucaugaagauaacagaguucuuuagggaagauauaaacaacucacagaaagaaauacaggaaaauacagggaaacagguagaagccccuaaagaagaaacaaaaagaaucucuuaaagaaauacaggaaaacacaaucaaacaggugaaggaauugaacaaagcaguccaagaccuaaaaauggaaguagaaacaauaaagaaaucacaaauggaggcaacccuggaaauggaaaaccuaggaaagaggucaggagcuacagaugcaaguaucaacaacagaauacaagagauagaagagagaaucacggcauagaagauacccuagaagauacugacacaacagucaaagaaaauacauuaaaaaacuccuaacccaaaacaggaaauccaggacacaaugaaaagaucaaaccuaaguacaaucggaauagaaaaaagugaagauuucuagcucaaaggaccagaaaaugucuucaacaaaauuauagaagaaaacuuccccaaccuaaagaaaaagauggccauaaauguacaaaaagccuacagaacaccaaauaaauuggaccagaaaagaaaaucuucccaucacauaauuaucaaaaagcuaaaugcacagaacaaagaaagaauauuaaaagcuguuagggacaaaaggccaaguaacauauggaggcagacuucucaacagagacccuaaaagccagaagagcccagacagaggucacggagacccuaagagaacacaaaugccaggcaaggcuacuauacccugcaaaacuuuaaaucaucauagaugaagaaaccaaaacauuccauaacaaaaaccaaauuuaaacaauaucuauuuccuaauccagccuugcaguggauucuagaaggaaaaguuccaacacaaagaggguaccuacaccaaagaaaaagcaagaaauuaaucaucucacaacaaaaccaaaaggagcaaauaacauauacacaaugcuaccuacaacaacaaacauaacaggaacuaacaaccaucugucuuuaauaucucucaguauuaacacacucaauuucccaauaaaaaaccauaagcuaacaaacugaauaugcaagcaggauccagaauuuugcugcauacaagaaaacacaucucaaugaaaaagacagcuggagagaugcucagugguuaagagcaccgacugcucuuccgaagguccugaguucaaaaucccagcaaccacaugguggcucacaaccauccguaauaagaucugauguccucuucuggugcaucugaagacagcuacaguguacuuagauauaauaauaaauaaaccuuuaaaaaaaagaaagaaaaagacagacacuauuucagaguaaaaggcugggaagaaagucuuccaagccauagucccaagaaacaagggagaguuaccauucuaauauccaauaaaauagacuuucaaccaaaacuuaccaaaaaagauaaggauauucauauucaucaaaggaaaaaauccaccaggagagucucaauucugaacaucuaugccccaaaugcaaggguauccacauucauaaaagaaacuuuacuaaaguuuaaaacacacauuaaccccacacacuauuagugggagacuucaccccacucucaccaauagacagaucauugaaaaagaaacuaaacagagacacagugaagcuaauagagguuaugaaccaaauggauuuaacaaauauauacagaacauuucacccuaaaacaaaaguauguauguucuucucagcaccucaggguaccuucuccaaaacugaccauauaaucagccauaaaacaagccucaacagauacaagaagauagaaauaaugccauucauccuaucagaucaccacggacuauugaagucuaaagcuagacuucaauaacaacaaaaacaacagaaaauccacauguccauggaaacugaacaacucucuacucaauguuaacucggucagggaagaaaugaagaaauaaagacuuccuggaauucaaugaaaaugaugacacagcaaauccaaacuuaugggacacaaugaaagcagugcuaagaggaaaauucauagcagucagugcccuuguaaagaaauuggagagcuccuacaccagcagcuuaacagcacaccugagaacccuagaacagaaagaagcaaaggcaccugagaagacugcagaaaauagucaaaugaaaucagccaaauagaaacaaagaaaacuauacaaagaaucaacaaaagcugguucuuugagaaaaucaacaagauugauaaauuccuagccaaacuaacuaaaggguacagagauaguauccaaauuaacaaaaucagaaaugaaaagggagacauaacaacagaaacugaggaaauuuaaaaaaucaucagauccuacuacaaaagccuguacccaacaaaacuggaaaaucuagaugaaauggauaauuuucuagacagauaccacguaccaaaguuaaaucaaacuaucuaaacagacccauauauccuaaggaaauagaagaagucauuaaagaccucccaaccaaaagcccagggccagauggcuuuaguggagaauuuuaccagacuuucaaagaagaacuagccaggcgugguggcgcacgccuuuaauuccagcacucaggaggcagaggcaggugaauuucugaguuugcauccagccuggucuacagagugaguuccaggacagccaggacuauacagagaaacccugucucaaaaaagaaaaagaaagaaaaaaagaagaauaacaacacuccucaaaguauucuauaaaauagagacagaaggaacacuaccuaauucauucuaugaagccacaauuacucugauaccuaaaccacacaaagacccaacaaagaaggagaauuucagacuaauuuugcuuauaaauaucgaugcaaaaauacucaauaaaauuuuaccaaaccgaauccaagaacacaucaaaaccaucauucaccaugaucaagaaggcuucaucucaaggaugcaagguugguucaguauacgaaaauuaauguaauccauuauauaaacaaaaucaaaggaaaaaaaucacaugaucaucucauuagaugcugaaaaagcauuugacaaaacauaacaccccuucauguuaaaaguauugaagagaucaagaauucaaggcccacaccuaaacauaauaaaagcaauauacagcaaaccaacagccaauauaaaauuaaauggagagauacuugaaguaaucccacuaaaaucagggacaagacaaggcugccuacucucccaguaucuauucaguauaguacucgaaggucuaguuagggcaguguacuggcuaauuuugugucaacuugacacagcuggaguuaucacagagaaaggagcuucaguuggggaaaugccuccacaagauccagcuguaaggcauuuucucaauuagugaucaaguggggaggucuccuugugggugguaccaucucugggcugguagucuugauucuauaagagagcaggcugagcaagccaggggaagcaagccaguaaagaacaucccuccauggccucugcauaagcuccugcuuccugaccuguuuugaguuccaguccugacucccuuuggugaugaacagcaauguggaagaguaagcugaauaaacccuuucuuccucaaauugcuucuuggucaggauguuugugcaggaauagacacccugacugagacaggcagaaagacaacaaaaggagagcaugaggauaaauuggaaaggaaggaaucaagguaucacuauuugcagaugauaugauaguguacauaagugaccccaaaaauucuaccagagaacuucuacagcugauaaacaacuucagcaaaguggcuggauauaaaauuaacuccaacaaaucaguagccuuccuuuauacaaauggcaaaaggguugagaaagaaaauagggaaacaacauccuucacaauagucacaaauaauauaaaauauccugggauaauucugaucaaacaagugagagaucuguaugacaagaacuucaaguuucucaagaaguugaagaagaccucagaaaauggggagaucuccaaugcucuuagauugguaggauuaacauaguaaaaauggccauccuucugucuuaguuauaguuuuacugcugugaacagacacuaugaccaaggcaagucuuauaaaggacagcauuuaauugacuggcuuacagguucagaguuucaguccaucaucaucaaggugagaguagagcagcauccaggcaggcaugaugcaggccaagcugagaauucuacugagucuucaucugaaggcuacuaguagaagacuggcuuccaagcaucuaggaugagggucuuaaaacccacacccacaaugauacaccuacucccacaagaccacaccuaauaguuccacucuuuaggcugagcauauacaaacauaacaccuaccaaaagcaauuuacagauucagugcaauccccaucaaaauugaacacaauucuucacagacaaagaaagagcaauucagaauuucauauggaaaaacaaaaaaacccaguauagcgaaaacaauucuuaacaauaaaagaacuucugggggaagcaccaucccugacuucaagcuguacuacagagcaguagugauaaaaacugcauuguauugguauagagacaaacaggucgaucaauggaauggaauugaagacccagaaauaaacuccacauacuuauggacucuugaucuuugagaaagaagccaaaaauauacuguggaaaaaaaaauaaagcaucuucaauaaaugguguggucuaacuggcagucggcauguagaaagaugaaaauagagccauauuugucaccuugcacaaagcucaaguccaaguggauuaaggaccucagcauaaaaccagguacacugaaucuaauagaagagaaagugggaaagagccucgaacucauuggccuggggugaagaaauggaguuuccuaaacagaacuccaauggcuuacucucuaagaucaagaauugauaaauggguccucaugaaacuggaaagcuuauguaaggcaaaggacauagucaguaggacaaauuggcaaccuacagauuaggaaaaaaucuucgccgggcgugguggcgcacgccuuuagucccagcacuugggaggcagaggcaggcgaauuucugaguucaaggccagcuuggucuacagagugaguuccaggacagccaggaguauacagaaaaacccugucucaaaaaaccaaaaaacugaaaaaaaaaucuucacuaaccccacaugcaguagagggcuaauauccaaaauauaugaagaacucaagaagcuaaccucccaaaaaaacaaccaaccaaccagaaaaugggauauagagaauucucaacagaggaaucucaaaugucugagaagcacuuaaaggaauguucaaaguccuuagucaucagggaaaaugcagaucaaaaugacccugagauuccaccuuauaccaaucagaauggcuaagaucaaaaacucaggugacagcacauguuggcaagaauguggagaaagaggaacacuacccaaugcugucaggacugccaucugguacaaccacucuggaaauaagccugaaaguuccucagaaaauuggaaauagaucuaccuaaagacccagcuauaccacucuugggcauauacccaaaagaugcaccaucacagggucaugugcucuauuauguucuuaguaguggccuuaucugugauagccagaagaugcaaacaacccagauaucccacaacggaagaauggauacagaaaaugugguucauuuacaccuggaauacuauucagcuauuacaaacgaggacaucaugaguuuugcaggcaaauggauggaacuagaaaauaucauccuaaaugagguaugucagaccaaaaggacaugcaugguauguacucacuaauaaguggauaucagccaaaaaaaaaguacagaauauccaggauacaauucacagaacucaagaaaauuuacaagcagaagggcucaagugaggaugccucagucccacuuggaagggagaagaaaacaaucacgggaggcagagggaaggagggaccugggugggagaggggagggugaagggaaaaggagaauaugaucagauauaggggaggacaggagagaagcugugagggagcagaaugaaugaaaauauguauccccaaggggugggaggaggggggaacccgcuagaaaguacuagagaccuuagaguugagagacucuuaggacugaaagggaaggaccuuagaugaaaguggggagagggaacucaauagagucuaccuccaguagaaagacagggcaucaaguggaaagagggggguugccauuccacagucaaaaacccugacccagaauuguuccugucuaaaagaacugcagggacaaaaauggagaagagacugagggaaaggcaauccagugacuccucaaccugggauucaucucaaggggacgcuccaaggccugacacuauuacuaaugcuauggugugcuuacagacaggagccuagcauggcuguccuccaauaggcccaacaagcagcugacugaggcagacgcagauacuuacacccaaccauuggacugaaguuggggaccccugugauugaauuagggaaaggcuugaugaagcugaagaagagggugaccccauaggaagacuagcagucuuaacuaacccagaccccugagaucucucagacacagccaccaaccaggcaacauacaccaucugguccgaggcccaccaccacuaccaccaccaguaccacccacacacauacacagcagaggacugcuuguuguggccuugagugacuugaggccucagagacuggggaggccuggcgggaggguuggggaaaaauccucuugaaggugguggugggggugggaggaagaaugggaugagaaacucugggagggcagaccaagaugggggcagugacuggacuguuuaaaaaaaaaaccuguugcuauagugacaauaacacaauuuugagguuuauuuuccucuaaaguuuacaugcauuuauuauuguggaauaugaauuacuguaguguuuguggcaaaaugaggaaaaucacauuauggauacaucagaaucuuaagggcucagugaguaaaagugcuugccaccacaccuacauuguggacagagaagcccuucuguucagcauguauacauaaaugcacaaaaucuuuuuuuuuaaggacuuuuaauuguacuauauaagauuguuuugcuucuuucagauuuugcuagauuuguuuauuugccucagauauuuuuuugucaguuuaccauauccucuauuguugcuuugugaguuugagaagaaaaauuugaauauauauuaucacuccauuguaccuuaaucauguguauaagauuauaugauaauaaguuacuuguaugugugugcacauguaugugcaggugcauguagaagucaguguugcaugucuuccucagucacucuccacauuauuuucugagacagucuuucacuggauagaguucacugcuuuucagcuagacuggcuagccagcgagccccagggauuccauuguuucuggcucccauccccaccccagugcugaauuacacgugcgugcuuuuuauaugggugcugacaauuuuaaaucagauccucaugcuuagaugacaguuuauugacagccaucuucccagcccccaguguaagguuacuuaaaguaaauggaacuuaaaaguauuggaagaaagcuuaaaauugauuuauaucuaugaauuagaaaggguuuguauguuuuaauuauuuuuuuucucagcuucuugaucuuccuacaugcuuuguagauguuaaaaugugaggauauuguaagaauuuggggugggguguaguacuaaaaauauuuucuuauaagaaaaaaauguaaaauaagagaugauacaaauaacccuuacaguccuauaguuuauaauucugcgguugaucucaucauuugaguaugggaacacuguucacuaauuugcucaguggacuguguucagaaauucaguuagcaaccuaaagcuugccccguuuagagaggcagcugcaguaguaguggagauagaagcuccugcuuucuccuagcuggcuuuguaacuuucaacaugucacuuaggccucauuugcuuguggaaugugugagaccccagccaguaccucacagcauugugagaaucaagugaaguaguguuaagaggcccugggaagcugcaugcauaaugcuauauaacugaguggugcuagaaggcuccagacuugaacagaagaagaacaguaguuucuuacuuuucuuuuucaauuauugaucauuuccccccuuucccccacacuauugcaguguguguguguguguguguguguguguguguauguauuuuccuacuuucuacaaauuauuuauaauuagauucaguuggugguuuccuuuuuuuguuaccagguugagcagagaauggugugaguggcaagaaccuccuacagggaaguugagggcgucaggaccagagugaugagaagcagcccacacugagaaggagguggccugcagacacuacagacacugggccauucugaucacagcuaggcccuguucuggauauuuucuguccaguccucauagugacuaucugugaagugcugugaagagaggugucagauuacuccugguggcuaauacuacggucuugaaacuaacuuacuuacuuucuuucucucucucucucucucucucucucuuucuuucuuucuuucuuucuuuugagacaggguuucucuguguagccuuggcuguccuggaacucacucuguagaccaggcuggccucaaacucauaaauccaccugccucugccucugccucugccucccaagugcugagauuaaaggcgugcagcaccacugcccagcuugaaacuuuuucuuaagggcugagucuaggcuuccuguccuaauuaacaccaggaaaacacuauuguaaauuuuaccuuuaguugcuucuagaauacaggauagaucuggggauaaauuucagaaauaguauuuuauuuaaauacuaaauuaaacaaaaauuaaaacaauaggugaguguugauuaggcaugcuaguagugcuucauaaauaccuguuuuucacauuugucagagguguaauguuucgcauuuucacauucuaacauuaaaaacccgaaguucaaagcauguacugcucgucuaguguacccaaguucaguucccagcacccacauuggggaguacagugcucccuuguagccucugauggcacagcacuaaugugcacacacucauacacauacagggggugggggggcgcgagggcgugaggggaggacaaagcuuuuuaaaagccauuaaaagguuuucgucaaucaguuuaugaaaucuaacauccauuugaggggcaggccuuggccaccauacaaauccauccauacugauagcuagauguucuucuaaccagcuaagcaugguguuggcacagaauuugugacuugacuuuguacucuuuucacagcaccuacuucaucugcauguuuuugcugauuuagagaagcggcuaguugaggguauaucucacaaaagcuuggccagaguaaaagucuugaaagaccaaugcugcuuaaucuuugguggauaaauucaugguguuauauaacauugguuuauuuugggaaacaacauuucucaacuguuguuuuucuguuccucaucugagugaaaucauucuugaaauuuacuguauuguuugauucuuuauaauuuuagauuuggugccuagaaaaccugaauugcacuguuaguguuagcaaugagcaggcagagacacagcuuucuacugccauccucaauagccccaguucccauccuuuagagaucuucacuuaugucaaacugagauucaugacuucagugcagaaaaagauuucaggccuaguuaacuugaagcagaguuggaaauuuuaauguaggcacagacaaaagggcuuggagagaauaggaggcacucagaagcaguaagacaucccugagcacuaguguaggcuucucugguagaguuaaaaauacgacauuuaaguggggaaucacuauuaauugucucagcauuagccaaguauaccauuugguuauaucucucuaauuacauuugaaacaguuacuaagaaaucuuuuuuccucuuuccuuguuuuuaaaaaaauauuuuuguuuuaagaguauuuugccugcauuuaugucuauguaccaugcuugcacaauucucaaaagagugcaucagaucccccagaacaggaguuaaaaguuaauggguaugagcagccaugugggugcuaugaguugagccagaguacccugagagaacagccaguacuccugaauugcugacccaucucugcagcccccuuuucucucuuucgguaagugagaauacaugucucuuuucuuguauauggggaccuagaaaacgucagguuuauagcuggaagagggaggccuuuugguagccuuuguuaacugagcucuaaguuuugcuuuccugguaagaggcuucaacuagacuuccaggugagagguuccucuucuugugucuccauaauuuuccuuguuuuuauuagcuguuucauuuccaguguuguuaaggucagagccugggcccuggaauucugaacaagccauguuuggccaugcaaacucaauagaccaauucaagaaacaaguaauacugaaaaacaggaaaaggagauuuauucauagcuacauugugaagaggagcaaauaaugugauuuuguggacaacauucccuucccccccccccccaaccacaaccaugguuuaucuucuaggacccugacaugaaguuuagauuuaaacugaggacaagaggcauucuggccaggauguggucuugcccaucauugauccauuauucucugggcucuagucuucuguaagauggucugacuguaaguuguuagaaaugugaagucuuuuccugggagacucuccuuuuguuagcacuagcuuuagccuucuccuucuuguaugagauuuccagggaaacucuccauuucuucaggacuccacugccaucccaacccuguaggucuguuagccaaagggaagggcacaaaugugucuuuagaauaucuucauaacugcuugaaguacuucuuaaugguaugaauuuuaauuuauuuuguuuugagacagaaucucaccauagagcccugccuauacuaugcugucuuccuagcucaagucucccaagugcugggauuacaaguaugggccaccuuuccuaagcauuugcuuuuauuuuuuaaauaggauguuuugauaguaaaaccucaaaauuaauauaaagcaaauuagaugcuauuaggggucaguguagucucuauagucaggcugucuuaguugggguuacuauugcuguaaugaaaaggcaugaccaaaagcaaauuaaagaguaaaggguuuauugucugucacuuccacauuacuguucaacauggaagaaagucagaacaggaacucaaacauggcaggaacccagagcaggggcugauggagaggccauggaggggugcugcuuaccagcuuauuucucauuauuuccuuccuuccuuccuuccuuccuuccuuuauuuauuuauuuauuuauuuauuuauuuauuuauuuuugagacagggucucuguauguagucuuuacuguccugaaacuugcucuguagaccaggcugaccucaaacucauagagauccuccugccucugccucccaaaugcugggauuuaaggcaugcaccaccauugccggcucagccugcuuucuuuauagaaccuaaacccaccaucccacaucaaucacuaagaaaaugcccuacagacuuguacacagugcaguuuuauagaggcauguucucaguugagguuccuuacucuccaguacuauuaguguaucaaguagauguaaaauuaaccagaauagagguguaguugccacuaacacugucuuuaucucaaauaucagccacaaguuuaggggucuggacaacaccagacuacaaauucaggacuucccacaaccuuuguguguggaggccagaagacauguggaaucccauggaaauggaauuagaggcaguugugaaccaccacacacggacacuaggaaucaaaugcuagucuucugcaagggcaguacucacucuuaaccucugagccauuucuccagcccucaaaucuaccuucuuaaccauuuuuuaauaaaaacuuaugucaucuauguguguguuuauguauguacauagacauguggcgccuaguggucaugucaggagucuuccucaaucacucuccaccuuacuucuuugauaggguuucucacugaaccugcagcucauugauucagcaagacuaacugagcuccaaugaucuuuuugucucugcuuuccugguacuaacuagaauuacaagagcacaguuuuuauguugaggugggggacugcaaacuuaggucuucaugcuuguuuagcaagugcuuugcugacucauccaucucccuaucuccuucuugaccauuuuuuuuucuuuuuucuuuuucuauuuuuuauuagauauuuucuucauuuacauuucacaugcuaucccgaaaguccccuauacccucuccccgcccugcuccccaacccacccacucccacuucauggcccaggcauuccccuguacuggggcauauaaaguuugcaagaccaaggggccucucuucccaaugauggcggacuaggccaucuuuugauacauaugcagcuagagacacgagcucuggggguacuggguaguucauauuguuguuccaccuauaggguugcagaccccuucagcuucuuggguacuuucucuagcuccuccauugggggcccuguguuccauccaauagaugacugugagcauccacuucuguauuugccaggcacuggcauagccucacaugaaacagcuauaacagggucccuucagcaaaaucuugcuggcauaugcaauagugucuggguuuggugguugauuaugggauggauccccaggugggguagucucuggaugguuuauccuuucaucuuagcuccacacuuugucucuguaacuccuuccauggguauuuuguucccuauucuaagaaggaaugaaguauccacauguuggucuuccuucuucuugauuuucuuguguuuugcaaauuguaucuuggguauucuaaguuucugggcuaauauccacuuaucagugagugcuuaucaagugacuucuuuugugauuggguuaccucacucaggaugauauccuccagauacauccauuugcccaagauaaauucauuguuuguaauagcugaguaguacuccauugugaaaauauaccacauuuucuguauccuuuccucuguugagggacaucuggguucuuuccaguuucuggcuauuauaaauaaggcugccaugaacauaguggagcauguguccuuauuacgaguuggaacaucuucuggguauaugcccaggagagguauugcuggaucuuccgguaguacuauguccaauuuaaugaggaaccaccagacugauuuccagaguggauguacaagcuugcagucccuccagcaauggaggaguguuccucuuucuccacauccuugccagcauugucaccugaauuuuugaucuuagccauucugacuggugugaggugaaaucucaggguuguuuugguuugcauuucccugaugauuaaggauguugaacauuuuuucaagugcuucucagcccuucaguauucuucaguugagaauuuuuuguuuagcucugaaccccauuuuuuaaugggguuauuugaauuucuggaguccagcuucuugagcucuuguauauaucuucuuaaccauuuuuaggugugcuguucaguguuuaaauaaauccacacuugaucuagguguuucguuccugugucucaccacucagaagucaggaagauuuugagugauguacauccauuauuacuuuccaucucuauaguuauuuugucuucagaauuaaaguguuaaucucauuacaaaguaacuccuguuucuuuccauuccugucuuucuuaaucucugacaacugcuguuaaacuaacugccugacuaugauacugacuguucuaagugcuucaugugcaggaauuauacaguguuuauccuuuugugauuggcuuuuaucacuuggcagugucucuuuguuaguauauuguaguuuuccauucuuucuuucuuuccucuuguauauaaguuccugugugccacaguguguuuguggaggucagaggaggucagaguugagccaguucauucucuucuucucucaugggagucccaggaauugaacucacauggucaggguuuggcaucaagugcccccuacccacugagccauccuguuauucccacauuuuuuuuuuuuugagacagcauacaguccauuguauguguauacugcauuuauccuucaccaaacucuugagcuguuucuacauuuucguuaugaaucgucuugcuaugaacaugguuauacagaccccugagacuguacuuaauucuuucaguuuuguuguugguuauuuuaugaguugggguuucucuguguugccuucacuguccuggaauuugcuuuguagaccaaacuggccucauacucagaucugcuugccucugccucccagcuggugcugggaucaaggcaugugccaccacaccugacucuuuuguucuuagaaguagaauugcuggaucauaugguaacuugaucuuuguuuaguuuguuuuugaagaaccugcuguaccauccauuuuauuuuccacuaacaguuuacaaggauaccuaguuuauucuuuacuguguuccugguauaugugugcauauagggguguaugugcauuugaguaugcuucuggguuucugguuaugugugccauggaguguauguguauaugugguggucagaggaugauuuuuugccucuucaacuucuacacuguuucuauguauuaaacucguugucaggcuuccaugacaggcaccuuuauucuugaagcaaucucacuggcccauggguucuaguuucucaguaucuuuagcaguacuuauuucugugauuuuguuguugguauguucugauuuguuuguuuuuguaguaucuuaauguauguuuaugauagaugaacauaugugaacacuuuuagcugagaucaaaggcaugccaaaccauucagagcccuauaggcacuuucuaaauccuuuuauccuucaagaaauuaaaauucaccugcuccuguaugggcuuugcuuaugggaguccuacguguugauguacagaugcuuggaccucuucaaaaaaguaguauugcauauaaccuacauaaugcauauguacauuaugcaugcauaauacaaguaugcauucugcauccuugaaguccuuucaggccuacuuacaguaucacuucacaacagaaaggcuauugaaagaguuaagacaaggaaaugccauucacagucaggucagauacuguuguucccuucaaacauacuugauuuuuggcuggccgaauuugcagagguagaauccaugaauuuggaauguucacuguuuccgggauuuuugucauguugccuuuuauagcuuagcauuucugcuaagcagauguuuaauaugguuuauauaacaaauagcuuuuucuuuauaauaagcaacuuuuucuuuuuauccuguuagaagguugagccacacaacugacaguuuuauuuuuauuuuugcuucaaaaucuagaacuagaccgggugggggaaacauuugcuagaguggacagagauguacaugggccuguguggagcaaauauucaggagcuuuguaacuggcuggccuagaucugucaaaacaaugugugaaugguucugguuuucugugcauugucuuucuuagauacuucagaguagugauccugggagugaguggauuauaaguauuauuucaaaaauaauuguuaagacugcucagggagggaaaaaaacagaaacacuaauguuaaaaaggucuuuaaucuucugugacugcugcuguucaaggauuaaucuuuggauaagagacuaauauuuucuuaaguuauuucacaaaguggagucugugauaggaagguaaaauaugaaauuaaauguauucuuuaggucugaucaacuaagcauagaacugcaguuucaccaccuaagugggugcuauugacaaucagugggguaagugcaaaguguuucucauuucugucaaccuaacuagaauaaugcaguauguugccuuuuaaggcauucauacauuuguuaauuugaauuacgugaaaaguuaggcauauaggacauuccuugcuuuugaacaauauaguuauaggaauaugagcugauagagcugugguagucuucuauacuuuuuuucuguaaugauuuagacuguuacagauuuuguguauguuguuagaaaaguagaccuuucaauaaaauauaaacaauuaugauaucaaguaucuaaauguuaaagucucguguuaaauauaauuuuuccuaauggauauguacacauacguguguacucacauauauauauauacauauauauauauauccacauauauauguauucuuauuauuaacaauguaauaagacuguauaguauguuauaaaauuagaugcauuaagaaaagucuuuuuuaaguguuguuaaaguuacuucacaauccugguucacguuuuuuuuuuuaguaaaagugaugacagaagcaucacuuacugggaguuggcugacuuugugcuaggcuggggaucaagugcuuuccauguaugcauugucucaguuauuguugucagcaaugcuaugggauaagaaguaguuuugucuccuuuuggugguccaggaucugucugucuguuagccaacuguuucagugacacagaguugaauggaagaacagggagaagaauggcuguuaguuugaagaaagaagagugaaauaaucccaaggguuaggagagugacuggacugcagacaugcagucggauuagagaacagcaacagugcucauuccguguuagaaguaugcaucucaguugucuuuggucagcacagaucucugaaggguccccucccccuuugucauuuuuagcuggaagaauuuacuuagggaauagauggauggauaguuggguuuuuguaggauuggagcuugggcaauuguuggaauaaaaagguggacagggaaguggagagaguguagacaggacuguuuagacuugcuggaggcuggguagcuuauaaagaaaggguugaauagagggggugaagcugguuuuccaugaagagccauucuucucaacaaaugguacuagaccaacuggggagccauguacaccagguguucuuaacuuuggucuacaauggaagacuuuauaauacacaugcacagaaauuaacuucaaauaagcauaggccuagauggaagagguaaggcuguaaacccacaaaaaagacaggggggaaaaauuuagugaucuuggaacuacacccccccccuccaaaagaaagggcaggaaacaguagcugaugggcuugucaucguaaaaauauuuagagcacgugaaaagucauguguuggcaaggauggaaauuguaagucucuguugcuggugggaaggaaaaaggaaugcugcuuugaacaauugagcagagcuuuuaaaacaauguaaaugucguggcuggaaagauggcucagcauuuaagagcacugacugcucucccaaagguccugaguucaauucccagcaaccauaugguggcucaugaccaucuguaaugguauuuggugcccucuucuuuuucuuuuuuuuugggggggggugcccucuucuggugugucugaagacagcuacaguguacucauauaaauaauauaaauacaucuuuaaaaaaauaauguaaauacaugucacauggcccacccauuccauuucuaaguaucucuaggacaaaccaaagcauauagucacacgagaacacauauucuuagcagauuuauugauagcuaaguauaucuaacuaucugagugucaaucacaagucuaugaauaaaaaaauuguguccuauuugcacaaugaaauauugcuuagcaaugaaaacuauugauguucuccacagcauaaacagaccuuaaaaugauuaggcuuacugaaagaagauagacuaaaggaaaguauacuguauguuuuacuguguuuaaaucuagaaaaauguaaacuacucuuuugugucagaaagcagauagugcuuacagggagaaggagcaaggaaaggcuuuaggaaacuuggguaaccauagaaauguuugucaucuugaguaugguaauaguaauguuaaugcauuaaacuguaugugugaaauccauuaguuuguauaaauaaguuaauacuucaaaacugugaaugacaggcugguuagaauaguuaggaaagggagagggagaacgacaggcuggguagaauaguuaggagagagagagggagagagagagggagagggagagaggagagguuuguagguuuguauaugugugugaagggcugaggagagaauacaaggguauauauugagaucaaaggacaacuuccauaucagucuuugucuucuaccuuucuuugagaaagggucucuuuucugcuguaacaccuggcuguaccaggagcuucuaggauggccugccaucuccugccugccaaucucaggagcacugggauugcagauacauaacaauaugcauccagcuuuuuugugggugcaaauucagguccuugugcuaauggaacaagccauugggccauuuccugaacccccacuuuuaaguauaaucuuuaucuaauccuuauuuaauuuucuguaaguguuuuuuuacugccauuguucuuuuccuguuagauuuuuuucagguucuugcauaugcuguuuuauuuuguugguaagaauauguuauuuuuauuaacaaugugacuauaaaaaaaggcuaacuuuaguugacacaauuuggggcuaaaauuucuuuuuuaaagagaucuaaguguugauuauauccaauuucuuuuuacauuuuuguuuucuuacuauacuuauuuacuugggagaauggggugggggcaggggggagugugccaugguguucauguggaagucaucuauucucuguggagguugguuuucucuuuuucaucauaugagauuaggagauuacacucagcuuguuaggcuuacuuggcaggagccuuuaccugcugagccaucauaucagcccauugaagcuaaaauucuguauaugcgugcuuguuggaaaaguuuuauuuuggacauuuagaaugugccacauuugcucuugaaaguauguuugccugaauguucuugucuugguacugaccuccacaguucacugagugugcaaauacaagguuugcccucacagauacucuuuggagacauuucugugggagacuccuuaugucauuuucauccuugccauaaugcccucuaauuuguaauuuuuuuaugcuuccuucucuuaaaagucauuagcuauuuuucugcauaagaaacuaggcauaauuucaagguuauuuucucuaacacuucacagacacuuaagcuuuuuggagacauuuuugugggaugacuccuaaugucauuacgguccuugccaaaaugcccuguaaccucuaacugugaaaacugagguuaacaaaugcugucucaguucucacacugagaguuuaccuccuuuuguugauaugaauguggcuagucugucuucagcuuuauaauccuccugccucugcuuccugagugcugaaauuauagauauucacuacuguugggugauauacuacuacuggggauaugugaauaagcaucucacuccugaacagaggaaggauacuacugaaguccauccuagugaaccggaauuuauuuggguuauaugcagggcaaguaugcaugaggagucacuugcuuacaagagaagaaaugauucagauacugacauuaccaaaaccuacccaugggugacaguucacaaaaacuggaaacuuggaauggcaugcacaaccagagggcaguucaacaagggucucuuuggguagcucaucuugucugagaguaugauucagaaguccuuacuucuuguaaaugugugugguggugaugggugccuagugaaucuugucaauuucaggagcuuccugaaaccucugaguuucccuguaguagcuuuccuucccauuuagugcacuugugccuuaaggaugccuucccucuaugauggaauguuacauuucaaaagaaauuguuacacauuagccaccaugccuagauauuugucuugaaaagauuaauacuauuuauacuuuaaugauaguguucauuucaaaaaaguauuugaagauuauagacuguggaaaacuggugucuucccuuuaccauggggaugaaagagaaguuguggaaguaucugccgccgggaaauguuuuacauauuaucuauacccuuuuugucucugauuuuuuuucuucucuuaaaucacugauacacacacacacauauauacucaugaacuuaaagccugacuugccauguaccuugguuucuggacaaauaagcuggaaaugggccagaaacuuccuuccugcuggcuaucccucauaguauuggaagaugcauugauggagaauugucagugaaagucuuauucaaguguguaucguguguacaacaauacugaccagucaggcugcaagaugagcucauuguugcagggcuauugugaggguaacaaacugcuuucugauucaguugaaugccuguuuuaugguugggagauaucucugccacuguaaaauugaugaaaauccuguggcugaggugaauucuaagcccuaaugaggaagcagauaguguuauuuugcuaaaugacauaaugugccugucaaauuaugacauuaaagugaguccaggauugccuucuaaagaacuauuugugccuauacacuaguggugaugucaguuuuggucagaaaagcuuuuugcagaaguugcugguaagagauucacaaauggcuaaccuacagagaauaaaugacuguugaauaccuaguuaugagugguaacuauauacaaccuccagggcucagaaaauguugugggaaaaggggugagaaaaauguaagagccagagaaaaguagggggagaguguagagugcugacuccugggcaugccauggcauggcugcuuuugaacucacacaguugugaguaccugucaacacugagccguggaaggaggaugauuuauacagaaucaauaguucauggagauucaaugguauagcuagcuauugguaaguuguacgucuuccuauaauaggcuaccauugugcugcuauaaacagcccuaaugugauucuuuaaguuaaaaaaaaaccuacaaggcaccaaccacagauaagaaagugugaaaacaccagaggauaagucccucaaaacaggcaugagcacaucauggagaacugaaaggaagccaaaggccaaaagagcaguuaaaaaaagggagagaaagcacagcacauagcagaacagugguaacuauccagguaaacaaauagacaaauugccccuguguuugcuuucaaguaaaagcaacaccggaagaaaaaguguguaaugggguucuuggguguuuuuugagguuaagauaauucauuuucuuuccuuuuuauauuuuaauuccgcuggccucugguguguuuucauuuucccccaaagauuuggaguacacugugucaguauauguuuaagugccuacuauaaggcauuguucuuuagccagguggugaguguaaaagccuuuaaucccagugaguccaggauagccagggcuacacaggagaaaguuugucgugaaaaacaaacaaaaacaacaaaauaaaaaagaaaaggcauuguucuuuggcacuguguuuucaauuauagcacuuccauuuuuuuuuuaugauuucuauuucuuuguaaaauucucacaugcugucugccuuuuccaucggagccuuugcugaauucacacugcuuuauguuccuuggcuauuccaaaauguaggucaugggucugggccugaugcuuguguuguuuuuacaagguguguuuuuauugcuaccuuuaguauauuugcuaaauuuuuguucaaagagguauguguuuuuuauaauaaaauacugaggaaaauaacuggauauauugaccucaacuucaugucuauuugugggaauuucucuacuagaguggggauuugugucauucuauuuaguguuuggcuauguuuacuacugcugugggcuacugaauuugacauucauuguugccaugguaaccaaagauuucccuuuuuuuuuuucuuaguaaucuuuguucccugugagucugccuuucuuuuugugccuuuucucaaaauaccauuguugucuagcuuucucaguuguguuccauuguuauuuguauuuagauugauguugguaguagagggucaggagagguuugugauguucuagugaagccucagauuugugcagaaccugguucuagggauguagucaucacaggacuaaacaauacccccuuuguuuuuccaugacauuaguggguauccagcaagugacuuuuaaacuauacuuagauauugcugugagguaguacagcucuccuaauuuguuuuugugguuuuucuguaguuuuuacuuuuuauuuuguguuguccuguuuuauaagugaguuuuguaaguaacaaaaucuuuucauuaauacuuucugucauuugguacuuuaauacuuaauaugugucacaccuguucgguaaucuuccuuucucccguuuugaugguuuuuauguuuaaauucuguuuucauuuuguaccaguguaguggaucucuugcuggacuaauggaauaacuagucacccguuccucauucaagaaugaaaucguuuauguauauaaaauacuguucacauuuaguuuuaaugguagcauuaauuagcaguuuucuaucucuuugguaguagauugugguauaccuauuccuuuggccauaaaagauuaauggaucaugcuaguuuuuuuuuaaaguauuuccuuaaaauauccucagccuaacccaggaguuuacaacuguaaacuuuauuuuuccuguguuacuuaucuuguaugaaccauguuaagccaggugauuauucagguuaaacuaagcauauauuaaaagagugaaaaacuacaaggaguagaagaaacuaauuuuuaaauuuuuacugaaaggggagaauuucaacacuguaaauaaaacugugacaaagaaacaauagucauaauagaauguuuacugagaacuuuaugcaaagggaucaagaagauaagaguuggauauuaaauauuuugucuaccauguguacuggucacucucuguugcuguggcaaguguuugacagaugcagggaagaaauauuuauugagaccugauuucuaauggugacuguaauauuuuuguuuuucaagacagcauuucuuuguauaacagcccuuucuguccuggaacucacucucccccucccccucccccuccaguuuccacucccccucccucccuaccucuguguguguguguguguguguguguguguguguguacacucuugagcacauguacguacauguucauguuacuauggggauggguguaugugcuauggagguuaguggcuaggagucuaggugccauccacuuuuuuuaagacaggcucucccacuguuaccaacuugccuggcuagcaagccucagggauccaccugucuuuaccucccuaauggugcugggacuacaaguguaaauguaucacaccuaacuuuuuuuuuucuuuuggaauaacuuuggguuuucuuguuuuauuuuauagauuuauuuuuuauauauaguguuuuaccugcauguauaucugcaggccagaagagggcaccagaucucauuauaaaugcuuaugagccaccauuugguuucugggaauugaacucagggccucuggaagagcagugugcagacacugcucuuaacuucugagccaucucuccagccccaacaccuggcuuuuuauguggguucugguuuucgugcuuuacugucucuucuguuucuuguuuagcucucaaucuauugcuuugugcaguuuuacacaucuuguuuucugugaguucccugagaguaaauuugaauuuggccucuauaauguugaguacauaacauauuucuaugauacuucucuaaauacauugucuguagugauggcuauuagaagcuaguuuuccagggaauuuucaauuugaugcauuucaaaucucaguugaacauaguaaauagauuuuauaauuagcuucccuuuuccuuccuuucucuacacucccaguuuuugagauaggcucuccccguguacuccaggcuggccuggaguuugcuaggugucccaggccagcucaguuugugaucuucauaaguucuggagucauaaguguuaggccacuaugccuggcuuuagaauugccuuuaaugaaagcuuacagauguuugugacaaaaaguacuugaaaaaauguuuaugaaguugugcuuuucuaugcaucuuuuaaauuuucauguucaaggcuauagcugauacgguaucuguuuguuauucagaaugaucauauuaaaauaguuauuuguaaccugugacacccuccacccacccacucauguguagcucuggcuaaccugggacuugccacguagacucgauuggccagaaauuggcaguuucugccuguagacuacuaggaguaaagaaagacguauaccauuacacuuggcuuuuuucuuuuuucaguguuguuaauuuauauuuguuuacaaaguaucuucuuucuugauuacaauuuuuguuuuacuuuuuaaaagugagaagaugcugauaaaaacuaaaaaaaugauuccaccccuuccuacuaguagaacauaaaauuuuaauauuucccgugcauucaaccuuuccuugucugucuguaaaaggugagcucccagcuaaguuucacuucguucuuaugcuugcuuuucagcuucuccuaaaaggacaucagugccccaaguacgugcuugagggagagcaaugaaggcaaguacccaaguuuucaugaccuaugaaugaaaauaacucaaugccaaaagcuuuggcuaccauguacaaaacaaaaaaguuggcaagagaaaggaauaaaaaaaaauguauauauaauuuagaauggcuuuguggaggacccuuuuaaauauuuguugaauuuuacaaagcaauuuucuacuuuauuucuaauauuaauucaaagcaacuuguuuucuuagugugcauuuaccaaauacugugugcuaagcaaaacugugguagaaaaaugaauugugggaaauucuaagaauugacugaaaugaccagaaaugucugguguguucauggcugcuucuuacucuuuucuccauauuucaucucucuucugucaugucauuuugcucuuuuccuuuucccauuuacuguaagaaugugacacuuuaaagauaaugaacaaaagaaaagccaaauuccugucuuaucagaguauagcuagcuucuuguauauguaaagccgggaauauaaauguaauuuugacucuuuucauaaacuaauuaacagcuacuaacgaauuacuauuuuagagaagaaaaugacagagcauucaaaaguguuuugagauaacugaguuucaugagugcugacauucuuaccaucagcauuugcaguuauggcaguguuauguuauugucuuugguuauuuuguuaucauacuugguucacauaccuugauccgaggacuuuagagauuucuguacacgggcuggaggagccuucacaauuuugaccauguucuaugugugugaugucacaguaaauaauagcuguuccacuugccagguuacaucuaucagaaguggguaaucacaacuuacugaucacagcuuagcuugaguguauuucgggcugccugcuccacaagccugugcuaaguagcguaauuaaaauaagucuugcucuuagaagucuugagauacauucucucaucuuuauagcugugccuaagagccuucccuagggauggcagcaucucuuuguagucaaccauuucagcuuuaaaauacaaaaaagccaauguacaaauacuagugaaaccucacaugaaguuaacugacauuugaaauguacuauauucuccaaguuuuuagauaggaagcagacagaugguugauuagcucuccauucugcccaaagaaaggugugcuaaguagucaauuccuauaauacuuaaugugugagauaaguaguaguucauuuaguuccuuaguuaccuuaguaacauucuuuuauucgcaguaucuuuuagucggacgggguaaacuggcuuuauuuuauuuauaacaauaaccagaucaguuguacaguguagcuaauauaguauaaaaugaggaggaucacaaacuaccucccgucgcccuuacuuugauauccucccguauucucagucucagcagcccaguaugagaauaauuugacagacguacacugucacucgugcugguuuguugaucacacagccuuuuagccuaagauuaauacaauucaguaacuuaguuugcgaggcaaacuuacgagggaaggucaggauaauuaaacaugcauacuguuggcaaaaguagcccauagaaugucccagaaaguugcacuaaaucuuagccaauaaguuuuuucucuuuguggucccaaagggagacuaacaaaccaauguaaauguagacuuaggaaagggguaggggugcaggacacggagcuuccccacucaaacagcugcuuucaguugccuccuuccggaaugaagaaacacaugguguuuagaaaguagaaacguacuggugagagaugagcauuuuuaaccccaucacucugucuuuuugagucaugaagagucagcagauaaggaaauagguuugaaagaauggggaccauggagcacagggccaguguccauguccuauggugaaaaguccugagaauagucacccggaauugugaguggauuuguguuuccugucccucggcauauguuuagcccauguugacagugggcucauuuaugcuuucuguuuugccacuugguggcagcaggacucauaccacagaacaggagccugcagugcuuaacuggcaauggccgauuguguucagguacucauuguaauguaggcauuuuuaaagucuucuaaacaacaacaaaaauugagagaaaauacgcaaaaccuccugcaucauguuuuguccucuguaguaacuucuaugcauuucuacaauuuuauauauuugcacaaacucaauaaaaauaaaacacuuuauuaaaaaaagagaucugaucccaguccauccaccccuucccucugcaugugauuucaguaaccaugacagcuaugcucuuaguuucagcuuccuuuuccuauguuuaauacuggcuuguggcagcuauuuggccuuuaaccuuuuguuuuucucuguuguuugauugcaccuauuuacuguucuacgucuuuguuuuugaguuuauauaaauagauaggaaucuucugucaagaauacuguugaaagaaucucuuuucuguuuucuuguucuuuuuuuuuaaaucagugucacuguauggcccugacuggcuuagaacuugcuguauauuuaguguagauugaccuugaacucuccaucuuccuguguuagucuccugagagcuagaauuacagguacacaacacacacacacacacacacacacacacucacucacucacucacucacucacucacacagccuccuucaaaucucccuuuugacaguugcuauugagcaaaacuuuguucucucugaagagugaccugucugaacuacucauuuauuggggccaaaaagggguuuuguuuuuuugggguuuuuuuuuugauuuauuuauuauuauaucuaauaucuaaguacacuguagcugucuucagauacaccagaagagggcaucagaucgaauuacagaugguugugagccaccauguaugugguugcugggauuugaacucaggaccuucggaagagcagucggugcucuuaaccacugagccaucucuccagcccugguuuuuuuuuuuuuuuuuccuucagcaagaauuuaauuuacaagauuuuucuuugcuuuggccucccaaaagaacauacucgucaccucuaauuaccauugagcuugaugaauauagauggaugguagcaaaagguuucgaauuuuuacuaaaauccauguagauugggauauuuaucucucacucuccucugaauuugcugaguuucagcauguugauacucagucaugauuauaaaaaaaaaaaaaacaacagaauuuaauugccuuagaaugacuaaacauacaugaucuguucucuugguuuucuaagcaguggcuaguuguccugccuacugcuaauagggagucuauuccaagauggccccuuaguauccuucuuuauauugaaacuuguaaaggaucuuaaaaaaauguuauuuucauuuucuguguccuuguucugggcuuuuuauuuuagaaaauaacauaaccauuaucugaaaaauuaucuuuuaaucuucugauuaaagauugcuuaauuauaauacuguuuggcuagcugcaugguuuuuuuguuuguuuucuuuuaacuguaguguuucuauauuucugcauggauauaugauacaagguuguuuucuuuuuuuucuuuuuuuuuucuuuuuccuuccuuuuuuuaacauuagguaggcaugaagccuccaucucucagcugcaugcauugucacucuugaagcaaaugccuaccuaauuugacagucucgguguguuuaaaauuuuuugaguuugcaaauaagcuuauuaagcuuacugauggagccuuccggcagugaacaguuauaugaggacccugauccuggaggcaaaucccaagaugcagaagccaggaggcagacagagucagaacaaaaguuaucuaaaaugacccacaaugcucuggagaacauuaaugugauuggccaaggcuugaagcaucucuuccagcaccagcgcaggaggucuucagugucuccacacgaugugcagcagauucagacagauccagagccugaaguggaucuggacagucagaacgcaugugcugagauugauggugucuccacccaucccacagcucugaaucguguucuccagcagauccgagugccacccaagaugaagagagggacaagcuugcauaguaggcggggcaaaucagaagccccaaagggaaguccccaaaucaacaggaaaucuggccaagagguggcagcuguaauacagucaggucgacccaggucuucauccacaacugaugcuccuaccagcucuucugugauggaaauagcuugugcugcugguguguguguaccuggagaggaggcaacugcagaacggguaagucuguuagauuucuguuaacuugcuguuuugacaggcaugcacaagcacacauaugacaaaugaccaaucugauuuuuaaaguaguauuuugguuuuaguuaguuuuuuaaaaaauuuuauaaaaugggucuagugcuaugcacuuguaauuccagugcuuggaaggggaaggaucaagaauugacuguguuugaaaccaaauaucuuuuaggccaguguaugcaaugugagacuaugucucaaaaaaaaaaaaaaaaaaaaaaaaaacgaaacagaaaagaauucaguuuuauuuguaccaaugugcaaaauaugucuuugacaugaugauagagauugaauaugguuagaacaaucaugggauguugaucauuggagguucugcauuuuuguuuuucauguuuguguggaggggcauaucacagagaguguguauaugccagaaaagaacuggcgggcguuuaugcucuccuucugucauaugagguccaggaauugaacucaggucaucagucaucuccugguggaaauaucucuugugguucaagccagccucaaacuuacuguguagcagagggcagcuuugagggucuaauccuccugcuuuuacuucccaaguccuagauuuuugguuuuguuuguuuguuuguuuguuuuugguagagggguugggugggccuuucuguuuguuuuucaggacagaguuuggcuauguagcccuggcuguccuggaacucacucuguagaccaggcuggccucaaacucagaaaucuacaugccucugccucuggaguguugagauuaaaggcguacaccacuaucacucaauccaagugguaggauuuuuaacccugcauuaccauauccaguugauccagugcuguggauuaaacccagguccuuguauucuaggcaagcacuuuaacaacucaacuacccagcccagugguucugguuucccuuuuuguuuacugggaucaauuuuucccuauugaaaaaccguuuuaacauacucaaacuauuuguuacaaauguauuaaauuaguugucucaucuccacauaugucuguaauacagaugggcagaauaaacuuggucaguucacaucaguuagagaaucaucuuuaaaugaguucacaaaagcaauuuuucucaaaagugcucuguacuuaaaauuuaaaaacuaaauguuuugaacucuaaagaaaugugcucaguguaaaaaacuuugaaaauguagaaaggaaaagaagaauaaaaauagcucuugacaaaauuuuaguaggauuuuuuuuuaauauaguacuugcguuugaaaaacaauugaggaaauuaaaaaccuuuuuuucucaguauuauuaauucuuaaaguagaaccagaaacucauucaauaaugaguuuuuuaaaacuguaacugugauuuuucuauaucacaauuucacuauaaauuuuuacugauuauauaauacugugauauaccuugcuguaauauuuucguuuaugcauuuuauauauuagagaauaugaaaauacauuacaauauaguugucuuaaaaauaauccuugaaauuaagaguuaggaguggaccuuaugguauguaaugauauucaaaaugauagcugcuauucauuuauuugcuuauaauguugcaggaaguauguuuaaacacauguaaauuucucuuugauguucaaacagcccuauacuuggcuuugauagcuuguuuuuucauuguuguugaugagacagcagaaacauaggaaguuaaguaugcucauaguuucauaacuaacuuguuucacaaccagaaaguuucagagcuuaaguaaucuuucuuauuuauuuauuuauuuauuuauuugcgacagaucucacuguguagcccugacuggccuggaacucacuggagaacaggcuauccuugaacucacagaggucuaccugccucugcuuccugagauuaaaggugucugacaccacacccagccuuagauggguauguuuucuagcuacuguauucuguguacaagaaugucauaguuuuucuuucuguaauuuauaaaauuuauauauaauaaaauauuagcaaauggcauuuaguuaugaaaauuuagaugguuuuauuuuaaacccuuugauuuuuuuaaauuggcuguuuuauaaaauuggcucaauuuuaauaguuugcauuuauaguucuccugcaauauuuuugauaauucucugauccuuaccuaugaacacacagaaaaugcuuuugggcucucuauauggaguuuauaugcacauaugcccgcguccaaucuggguucuagaguuggggguuugaacucagguccucaagguuucacagaaaauauccucuacccacugagcaaucucuccaguccuucuaccagaaauaccuuagaacauacauggcuguggccacagauaagcuuauaaagauucaaaaugcuaacacucgaacuucaacaaaaugucaauacuacccauagaucagauucuuuugaguauauauguggagccccaaggucuauguuggaucucuuaaucaaccaaucuuuucuuauaacaaagacuucauuuuaagauuuaaucuuagcuaagaggcccaaaagcaguacaaauacuuaguugcucccuggaaagcuagggcuauguaaguuaauucuuuauaccuuacauagaauaagcagaacuucaggagacauagagaaaaaauuaauauacauaacuaaauuuaaauuuuuuagcuuaggaauaaaggucugagcaaugugaguggaaagcuaaauuaguuugauaaugugauuggaaauagagaaguacuaaaauuuucugaaagggacuugcauguugaaaauuagagauucuuccuugagggagauaaauuuuccucuucuuaguauuuccugguugcccguagcugucuagggcugagaucccuucuauguuaguuaugucccuugguguucagggcuugucugauaagacuucaugggccuguagcuucucugacagaucuuuacaaucuuccuccuccucuucugauaugaucccuaagccuuagguacaggaauucuauuacagauguaauuuguauuggucacaaugugaucucuuguuuucuguauuuugauugguuguaguuuucuguaauaauuugucucuuacaaaaauguguuucuuugagcggggaaugguggcacacaccuuuaaucccagcacucgggaggcagaggcaggcggauuucugaguucgagaccagccuggucuacagagugaguuccaggacagccagggcuacacagagaaacccugucucgaaaaaagaaaaagaaaaaaaaaaaguguguuucuuuaaugaggagugagaacuaaaucuaucuauagauauaagaacagauauuuagcauguaguuagaaauuggaagagcccgccugauugguuauuuaauaccaaguaguuaucccugauaucauagauagcauaauaauaccauaaguagcauaauauaagcagguuguguuuaggaauaaaguguauguaauauauauaguaucaauaauuaaccaugaauuugagaguaaaggggggauaugugggagggauuagagggaggaaaugauauauuauacuaauauuauaauaaaaaaccguuauaaguaaauuuugaaaauacaagagaguuuuuuuuucuaguuuuauucauaauggaauaacacagaagaaaaucuagcuaagguuucagagagcuuagcugugaggugacggucaugaagcacaauuguuccuauggguaaagccacucuaaauuucaguuagaaagaaaugguauauaugaagauugacacuguaggccaaaaagccauucuucuaauaucuuguuagaaugcugucugcacccugugcuacgugcuacagugugaucacauaguaagugcagcaagaaucuguccuuuacacucugcugcuuuuauaaaauagaaagaaaucaaaguuucugagaacaaacuuagagggacacgaaaaggucaaugcaaaucuuggaucuucuaaagaaaaaaauuuggagucauugauccuuguuauugaaguugagaauucacuauuuguuuuagaauucucuauucucuuuucccuuuuagagacaaaauuaagagauguacuauuuuuauuaggcuguaguugggugcucuuugggauuaacuacuauaauauauauauauuauauauuauuauauauauuauauacuauuauauuauaguagcuauacuauguuauaguaguauauucacugcuauauuauauaauauauaaacaguaaguguuuugagggagauauaugugauaaguuauuucuuugccaguguaaugagccaguucaagccacauuauauuuuauuaaauucagguuuauugagaaguuucucagguuguccaguuuacuggccccaaggacugauccaggaaaguccagggggagaaguggggaaagggaagagaaagagagaaauggcaccacacagagagagggagaaggagauguggggugugggagggacccaaacuaucuggauuauagggaagagcugcuggggaaaagacagccccagcccaugggcugggaaguucaggguugggggcaggguaugccagguagggacugaggaaugcugggagaaccuggaggccaggucggcuuugauauguaaaauaugcaccccagucucuugucccaggguucaaagccaaacaguaccuguuaaagaaauugcuagaauaguaucaguuaaccaauaaacuaaucuaguaaaccaguguuuugugcagggaaaaaguagaaagggugauuccuguugcuguccacuaggugggguccuaggccaguacaggaggagaugagaaauagggaaugagauuuaggaaugaagcauaugcucuuguaaauugaauugacuugauuacuauagcuguggaacaaauaguagaagauguagaguuugacaauugaaaugggaaaagguaaggaauuuuaagcaauaagauuugcuuagaaaccuuaaggaaguacuauuuauuuucucaauuaacauuggaaaaaugcuguguaguuuuuauaaacucuagcaaagaucuuuauauucuguauauuuaauauuguuuggauuguugauaccuacaagggaauguuuuauagacaguuaauaauaccgacuagaaaaguggccauaaauuaaaaaugaaaacauaauuuuggucucuuacaacugaucaccaaguuaaguaacuuugggauuguuagucuuuagcccuuagagcuggaguguguaguuacauccuuuguagacaaauuuaaaauaauguaaugugaauguggugaggucagggaguuggcuuagugggcagaagcacuuggcuguacaagccagacaacuugaauucagauuccagaacccacacagaaagccaguugugguagggcacauguguaauugcaguguuacuguggugagucaggaaaucacugagaggcuugcuguucaguguguccaugguggucccagaagacuuuguuuauagagcuagagagaugacucagcagguaggagcacuugcuuuuugcaggggacucagguuuccagcacccacuucauaggucacaaccaccugucacuccaguuccaggaaaucuaacuccaucuucuguccuucaagagcacaauacaagugaguuacacagaaauacaugcagucagaauagucauacauaaaaucaaaauaaaucaauccuuuuuuuaaaaaagucaaucuuuaaugugguuguuugauuggaaguaaaagaagguguuacugacguugauaaaugaaagacaugacaguggauaucaaugaaaccuaaagaaucuuuaggauauaccugagaaacuuacauuccaauacauuggaaaauaugaaagaaaugagugaauugcgcaaaguuuaacaucauagguagauuuguuauauguuugucuuucaaaucugaaucauauuucuuauguucagaaacagcaagguuuuuuuuuuaaagauuuauuuauuauuauacauaaguacacuguagcugacuucacacgcaccagaagagggcaucaaaucucauuacggaugguugugagccaccaugugguuguugggauuugaacucaggaccuucagaagagcagucagugcucuuaccugcugagccaucucaccagccccagaaacagcaaguuuuaggaugaagauuaauauaaagcaaauuggaguccauucuuuaaguuuugagccauucguaguagugcuugcuuauaaucaaucccagcucuggggaggcuaggcaagaggauccaaguuggaaguuggcucagcuucuauagagagaccuugcaugaaaacaaacaaaaaauuaaauuuaaccuauuauccuuuaucuuaaaaaguaguccuagcccggugugguggcgcacgccuuuagucccagcacuugggaggcagaagcagguguauuucugaguucgaggccagccuggucuacaaagugaguuccaggacagccagggcuauacagagaaacccugucucaguggaaaaaaaaaaaaaaaaaaaaguccuaugcuuuaggguaaagggaacucuaaaggaauuuaacaugaaugugguuucuguucacagggccuugguccuuugucauaaccuugaguuuuaaaagcuagaaggaaaacuagcuucccaaggagaucaccauucuuauuaucuagaacacuggcaaggccucacuuuaaagagacaaacaaugcucagacauuaaauauaagacaaucucuagaauaaauuguuuucauuagugaucacagcauaacuuucuuaagaaaaacaggcagcuuuggcaaguuggcacagaagugaacuuagcaaaguguguauuucagaaauugacaaauauguguuaaaauuuuacuugguuguuacaucagcaugaccuuugaucucacuggucaauuuaagcagauaagauuucacuuuugaaccuugacauuuaaaaagucauaauuacuacacauuuuacauuaauguaugccucuugcuuuguguauagguaagacuuugaaaauaucucuauagucuccugucucugcccacccccagucucuccagaagagugcuggcauccaccacaucuagccucauguggguugugagguuugcagcagaggcuuaagucugcugagacaucucccuagcuauagaguuacuuuuaauacuauaauuaaaauuugaguagugauguuguauaugcuuauguuucuaaagaaauuaacaaaggguuauuuagaaugucuaaaaucuaucuuauuuacugugauaaccagcuaaauaagcaguguuugugaagguauuuaugcauugugaguauggguggguguggagaauucauauggaaaucucaugacacaauacaacauuuuagaguuauacuaagaaaugguaaugaaggcaaaauccauacuuacguaaccuuauuaauaugccuugacaauauugacuuuuaacaggccauucaaugaucaagcuuuuccugauauaguugguauauuauuuuguaagguuguuuaccugcccauagccucucuuaaaauuauguaacuagggccuggagacaugacuuaggaguuaggagcacuugcugcugauacagaguaguaaguucuguaaaacaugggcugaugcagcagggagggagggccuuagcaggcccaugcugaggcauccccucuaagguaccagcuguacaauaggguuaguauaaaaugaaguuuauuuuggagcaugggaagugggguugagaauggaguacagggggaaaaagagaggggacagagaaggacagggagagggaggggggagaaggaauuggccugccaugaauucauggagagaagggggaaaggacaagagaggccagagagggaggccagagaaagagaaagggaucagagagggagaaagggaggccagucuuuuuauagcaaccauggcuguugcuagguaacuuaucagugccuagaagaaauguguaacacaggggaucuaggauugguuccuagcaucuacauggcaguucacaaccauccaaagcuccaauuccagggaauccaacacugucuuauuaucuccacauggaauuagucauacucuugauauacagauguauaugcaggcaaaaccgaguaaauaaaucuaaaaaaaaaauuuuuuuaaugaguuaauuaggaucuagggaaaagucaaacuucuucaugaccagagugcuaguagaacgguggauaaguucuugcugcuuuuuccauagcacggauaguuuaauauuggcugguuuuuauugugcaucuagaguagacaguauguucuaaguucagaagcuauggaagaucuuuaaaagaaguauauuggcaaaaaauuaaaugaacuacaaacuaauuuuccuaaaacgacaaaaaggaaaauauugaucuuaaguaauugacaaaagguuugagacaugauaguuaguuuauaaaaagaaacuuagauaaaauggaaaacucuguuuccaauuuguucuucuaucuacaaucaaaaagucacagugaaauugccagaaagccacuacugcguccccucaaaugauguguauauguagaaaauagacuauuguuggcugauuuguuuuuguucuuuauaucuaaauacucaaccaacugcacuacaauauauaaucaaugggaugggggggggacaccucaacuuccaugauuuuuuauuuguuuuguuuuuguuuuuuugagacaggauuucucuguguagccuggcuguccuggaacucacuuuguagaccaggcuggccuccaacucagaaauccgccugccucugccucccaagugcugggauuaaaggcaugcgccaccacugccuggcuuccaugauuuuuuaagccuucacccuuuauacuucaauuuuuguuuaugguagguauguacaagaaaaacuucuauguguauaauuuguaacuaagcauaaaaguuuuagagauauuugaauuggcaaguaaguaaauuucagucuauagagauaagacuuuuaucucucccuuuugaguauuaaacaucauacauagaauccuaccuguaagacuaagauuguacuggcuaguuuuauguaaacuuaccacaugcuagucauuuuuagaagagagaaccucaauugaguagaugcuucuaccagauuggccuguaggcaagcuuguggucaauuuaauuaauugcugauugauaaguauuggaggguccagccaguuuuguacggugccacuccuaggcugaugguucuggcauguauaagaaaguguguuaagcaagccauggggaacaagccaguauuucuccauagucucuguauuagucagguuucucaagagucacagaacuuauggaaugucuuaauauaauuaagagaauuuguugugauugugagguaguccaaccaccccaacaauguaccccaacugugagugggaaauagauuccaacagauguguuggcaaguaaaugcaagcaggugaagaagagcgaaucuuccuucuccaauguccuuguguaggucuccagcaaaagguguggcccagauuaaagguguauacuaccacaccuggaucugggacuuguuuuguccuaggcagaccuugaauucacagaucuccuucccuuguuuccugggguuaaaggcauguacuaccuugccugggccuaagcuuuucguagccacuaugccucaagaucucaaugcuaagauccaggucagaaacuugugucuuccagauucaagaucuggaucacaggugagcccuccaauucuggauuguaguucauuccauauauaaucaaguugacaaccaagaauagccauuacaaucuaccccuugucaaccugacacaaauaauauuucauguccacaugcaacaauaacaaggucaucaugaauacgcuuaacauaauauaacuauuccuuguacaaucacaaaugcauuuauaaauuuacaaugaggcaauguccuuuggaaacauucuuuuagugucucaacauaaauaccaauuaauguuaaagaaauuggaagaaagcacaaaaagcuuauacuauacaaauguguucuuaacaaaauaaaacagaagcauuuauauuacuuuaaaauccucauuucugcaauuggucacguggccuuagaugguauuuauaacuaccuuccucuauuacucauucuguauuuccuccacucucugcaaguaccucagcaggucuuggcucuuuuccuggaggagugauccaugccuucauuccugauggaucuguguccuuugucaucaugcuuggauuaggguuguaguuucccauggacuuuaaucacagaacaugguaguacuaaacaacacccuaagggaucuccugcacucuagacacaauccuacuuaccuccagugugaagaggcaguccaguuuccccaugguaaucuggaucuaucaccccuccuaacacugauauuccuuucuuauccuguugguuuaaggacauagaagcccagcccagggggaagucugagcuuccgguucaauagaauguuuguuguggcugcugguaggagcacucccuuuucuggaaccaaaacuucuaggcaagcagaaccuaggguuguggggacaggaagugaagauuuuucuagaggaucacuaggagugauaguaaguagaacuauucccuuuuccacaccuugauuccuggacccaugaauccuggcuaugggagaaacuguacuuuauauugaaugcugauucaaagcauauacugccuucugaagaacacugccccagcccuccauugcugcugccaccuaauuagugcuguaacugugucuucaagcagaguguucuuguuuugguuuuuucgagacaggguuucucuguguagcccuggcuguccuggaacucacucugucgaccaggccggccucgaacucagaaacccaccugccucugccucccgagugcugagauuaaaggcgugugccaccacuaccuggccauaacugugucuacaaaaggccauuccaucuuucugucagaccaguugcuucaggaugguagagaaggaacauacaugguaaggccaguggguucuaugaucaugggcccacuguugcacuuuucuggcugugaaaugaguuccuuggucagaagcaauacuauguggaauaccaggacaauggauaagggauuuugugagcccacagaugguggcuuugguagaagcauuacgugcaagaaaggcaaauccauaaccagaauaaguaucuacugcaguaagaacaaaauguuauccuuuccacauaggaagugguccaauguaauuaacuugccaccagguugcuggcuggucaccuugaggaauggugccauaucuggggcucaguguugguuucugcuguuggcagaucugguauucaauagcagcuguaggcaggucagccuuggugaguggaaguccguauuguugagcccaagcauaaccuccauuucuguaccauggccacuuuguucaugugcccauugagcagugacagggauggcuggggaaaaaggcugacuguccacagaacgggucgucuuauccacuugauuacugaacuccuccucacccgaagucaccuuuuggugagcauuuacaugggacacaaauaucuucacauccuuuacccuuuguagagaucuauucacauacuuuuuccccagaugucuuucucaccaauuuuccaauugugaucuuuccaagucccugaccauccagccaauccauugucuacagcccgagucagugaacagucguacaucuggccaguucuuucuccaaacaaacuguaauaccauguguacugccugaaguucugcccacugugaagauuuucuuucaccuguaucuuucaggauugucccagaaaggggauuaaugcuucagcuguucacuucugcuuggugccugcauaaugugcagagccaucgguaaaccagguucuagucuucucuucuucaaucagcugaccauaggaaacaucccaugaggcuauaggcucacgcuuggcagcagaugacauuguagcaggaguagaaacuauagggauuugagcaacuucuuuauguaacuugcuuguaccuucaggaccuacucagguccuaucauguauauaccacuuccauuugauaauaaacugcugcuguaccaacuccuguccuacgguuuuuuuuuuuuuaagauuuauuuauuauuauacauaaguacacuggagcugucuucaaacacaccagaagagggugucagaucucauuaugggugguugugagccaccaugugguugcugggauuugaacucaugaccuucugaagagcagucagugcucuuuacugcugugaauagacgacaccaugaccaaggcaagucuuauaaaagacaacauuucauuggggcuggcuuauagguucagagguucagcccauuaucaucaaagugggaguauagcaucuagacaggcaugguacaggcagaacugagaguucuauaucuucaugugaaggcugcuaguagaagacucacuuccagguaguuaggauuagggucuuaaagcccacacccauagugacacacuuacuccaacaaggccacaccucuuaauaugucacuuccugagccaaagauauacaaacuaacaaagccacugcuuuguuggaugaaugcaguacucuaacagaagaucauucccaccuucucuacaugcaucugauuucuaaaacuucaguuaaauggaaaccuauuagaacaugcauaacucuuuagagcucacaugguuuauuaauuuaaaaaaaacacacauaauuuguaagaccacuaugcaaauagauguugaaacaaccuuuuuauagccauaggauagaacaacuugcagguuucauuucuuuccuuccacuaugggcuucuacuauugaagucaaauggucauguuuggugguaaggaccuuuaucugaugagccaguuuaucagcuuacaacuauauguucuucuaggcugagauauccaaguuuccuaguccaaauaaguuacuuuucucacugcuauaaaaaaauacuuaucaaaaacuacuaaaggggaaaaggauauacuugggcucacaguuuugcaguggucaguccauguuugcuuugccuuguaugcauagguagagugucauggcugcaggagcaugugguaaaagagcuuuuuauauaggaagcugaaaguauaacuagauaggaggggcuuaggguuauaauacuccucaaaggcuuguucucuaugaccuguuuccuucaucuccuaaaguuucccacagucuuuuauaauauuccauuaucuaggcaguaaacaucccaaacacaagucuguaggaaacauuucauauugaaaucauagccugcuccauggagcuguucucuuuuuguggugauacaaagcacaagaaauggguguguacauggguuuguuaggucaguuugacugucuaugacaaaacauuucuccauaauacaaugcuguucaaucuucauuuuccuuagaugucauaaacucauuagauuaaugauucuuuuagaaauaaaagguguccucugaacuugauucacuuucuugucauguagaagagcacuaguacuguuuucuauugucaggaggauggcuuugugagccugggaauaaagguuuucucugagccgauuagagcuaaggcgaauguaggucacagugucaccuguuuuggaucugcaugcugcugacgauauuugagucuuuguauuuugcccaugcuuuuuaugccaguggacuugcugcaccagagaagagauuuauagauuggcaagcaaauucauaacaacuuugacuuguuuuuauuguuacaaggauuuuuagcucguguaucucauuaaauaaaaccaauacaguaaauuaguuaucacauuuagauauaugacucacaucuagugugucuaaguaaauuuuuugaguaauuuuuuuuuuuacugcuuuaguggaagaaaauuaaauaagaaaaaaaauuaaguacuuuuggaaaccccuuccagacccucccccaaaucuuguaaaagguagugcaauucagaggaaaagaucaaaagucauuauacuuguguauuuaugaaugguuuaagcauucuuuuuucuguaaacacugucuuuaucucuuuccuuuaagauuuacacacuguuuuuucuuucuuugucuuaguuuguaucuugcaucauucagugugaauggugccacacuucuauauuauucuaguaccauuugaagagucagaugaaguugugaaaagcuuugacagaggaaaacugaacuguggcccuaagaccggugaugcagguuggccacagggacaguugucccugugggcaaccugcaucaccugacuguccugaaacucacucuguagaccaagcuggccuugaacucagaaauccaccugccucugccuccuaagugcugggauuaaagguguacacccuauugcccauccugacuuuauuuuuaaagcaacauauucuuauuuuauaaauuuguuuucuuuugucuuuugggaauauuuucuuuugcuuccuguaauguguuugucuccccuucuuaacccauguuuuagucuuccauuguuugaaaccugccucaaauaucuagucagucaugguuuucuccucacaccugagagauccaucaguuaacacugagagacucagugauuuucacuacugaaagugugaaauguguagccauaagaagugcaaaacacucucugagacaggauuuuuucuguauaagaacccuggcuggccuggaauucucuucagaccagagauccacuugccacugccucuagaaugcuggggccaaagucaugcugcaccauaccuggcuaaaauacuaagucaguuguacaguuggaaauuagcacuuuaccugcugagcuaucuccucagccugaguuaaucaaucuuuaaaguguauaauaugcuaaaauuuucacugggccugucguguuagcaaaugucauuaauuccagugcccgggaggcagagacagacagaucucuggauuugagggcaggcuggucuacagagcaaguuucaggacagccaggacugcacagagaaacucugucucaaaaaaaaagcacacacaagggcuggagagauggcucagcgguucagagcacugacugcucuucuagagguccugaguuuaauucccagcaaccacaugguggcucacuaccaucuuuaaugggaucugaugccuucuucuggugugucugaagacagcgacaguguacucauauacauaaaauaaauagauaaaugggggaaaaaagcucacacaaaugcugauucuucagaguuugccaugagagauccauuagaugguguauuuuuggugagaaccuguaugauaauagauuuuguuauggcauaauuagaccaauuuuuuguuuuguuuuguuuucagacccuuaaguuuuaucaucuauagguccuuucuuguuuuuucuucauuuaacccuucaccuuuguguuugaguggcugcuguaaugggccuggaugcuugugcucuagaagaccaggagagacauugaaagucccaguuugugguucaauuccauuguccuuacuuuagcccucagcaggauuagagucagcccagcauccuucugguugguugauucagucucauuacagugcagagcccugaccauuaggcuuaguguguauuaaaauauugaguugguauguuuaaccauuugaaucagcccugcuuuuaaagcagccucauguguucccaguccucaacacaggauuguaguuugggaacaguuggccggcuucuuguuguuuuccacuguagcaccugcuacguaucuaucugacucaaaaaagcugaaagcaagguuuauuguuucacuauguacauucauuucgucuucccaaguuuuguugacuucucuuguuuauugcuaucuccuuuccagucugcuuugccuuguaaguuuauaccuuucacuaaucaauauuaguaauaaucgaaauaaucugagcaguccuauguuuaguccaguacuuuccacuuaaggaaaaaagucugucuuuucuuucuuuuuuuucuuuuuucuuuuuucuuuuucucuuucuuucuuucuuucuucuuuuuuuuuuuuuuaaauuuuaaacagggucucuguacauaaguucuggcuggcuguccugaaacucauuggguaaaccaggcuggccucagacucacagaaaucuggccaccucugccucccaggugcuuggauuuaaaggugugcaccccccgccauaauuagcuuuaaaggacucugacacaagcuuguucuuucauuucuucuagcagcuacaacaguauuucuagauaacuuguugauuaucuucuuucuacuaaagaacuaaacuugaauucucuuuggucuagcauauaacagaauaucuuacauuuugauugggaauauuaagucaugguuuuauauauacauauauuuuaagauuuauuuauuuauuuauuuauuuuauguauaugaguacacuguagcuguacagaugguugugagccuucaugugguuguugggaauuaaauuuaggaccucugcuguugccagucaaccucgcuugcuccagucagcccugcucgcucaggccuaaagauuuauuuauuauuauuaauaaguacacuguugcugucuucaggcacaccagaagagggcaccagaucucauugugggugguuguuagucaccaugugguugcugggauuugaaaauguaagauauucuguuauaugcuagacgaaagagaagagaauucaaguguaguucuguaguagaaagaagguggugcuucggaagagcacucagugcucuuacccgcuaagccgucucuccagcccaagucuugguuuucucaaucuuggcuuggugaaagaagaacuagagguuuucuuuugagcaguguucuuucuucuugucacuagagcuguuucuguguuuucuuccuuaggucuggcuuuuauuauaucuuauacugugaaccauauaaaauugucaguaguuaagcuguuugggccuacaaaaauaaauuuuaugugaucagcuuuaagaguuaaauagcuuagcagccaaguuaauagacuacucugucuaguguagaaauucauucagaucauucacaggaauauucuaguaggaggaaagguugagacaaaugggaauucuuuuuuuuuuuuuuuuuaagauuuauuuauuuauuauauguaauaaguacacuguagcugucuuccgacacuccaggagagucagaucucauuacaggugguugugagccaccaugugguugcugggauuugaacuccggaccuucggaagagcagucgggugcucuuacccacugagccaucucaccagccccaaaugggaauucuuaauguuaaggaggggaaaguuguaauccucacugaguauaaagcuaucuaagcuagagccauguuagaguccugugugcagcagaagcugcccagugccugacaauguggccacggcaccauaucccuuaauauuggcugcuaggcuuauauacgauuugagcaaauaucaagguagcugaaaucauaguauuacuuuguuuauucuguauucaguuuucuuuugaaugccacccugcccuauuuauuauaaaauaaucugcauagauuuuuuuuacuugcaugucuaccaguguaccauauguuaugaauugcgaugugagugauggaacagugcgcugaucuaucguucuaucccuuaugugauuuucuuuagcaauagagcuuuaaaguguuuuguuuguuuguuuguuuguuuguuuuguagaaguaaaacacacacuaguaaauggacaauuaucugaguuacauuguuucuuuuguuuuuugagacaugguuucucuuuguagcucuggcuagccuaaacucaucauguagacuaggguggccuugaauuuagagaucuuccugcugccuccugaguacuacuaggauuaaagggaagugcaguuauauccagcuaaguuauguuguuuuuaaggacuugaauuauuuggggucuuguuaagauagaauguaagaauuaagaauguguauuguaauugcaaaguaaucagucaaagacacaaugaauaagacugcuuaaucaaaaagaauuuaagagaaaaacagauaugcuggguauggugguguauggcuacaguccuuguacucuacugaagcuggaacaguaugauugccagauauucauugccagccuggacuauguagccagacugucaaauugagaagaaggauaaggaggaagagaggaaaacagagaagagaggaggcaaggagggagaacaaagcuaacugauguauaggaaauaugcaucaguugucccuugauauuugaagggggaauugguuccaguuccaucauuucagggacacuaaauuuaaagauguucaggucccuuacauaaaugguauauaguauuugcauacagcuuauaaccuuaguauugauuccuuucugcuuucuuacaauaucuagcacaguguagaugcuguauaaauaguugguacuuugguauuguguggcuaauaauggaaggaaguuuaugucucaagaaauuagaaucuauugcuugauuaaacagauaaggacugguagguacuauguaaacacuacccaaagagaauccauacaaauagcacagaaucaaacaagcuagacuuuaaggaaagaaauacaggcuaagugugguagugccuuuaauuccagcacucaggaggcaggggcuggugguucucugugaguucgaggccagccugaucuacaaagcaaguuccaggacagugagggcuguuacagagaaacgcagucucuaaauaaaugucacuaaagauauagaacaagcuuaaaaugccaaaauggcagaucauugcccaaacuguaaccauuuucaugugguguuuggggaaauucuuguggccaguuuugucauuugccacucuggagauguuucugugguauagagggauaguuuuuuuugugugugugugugugucauuaacugugauaguguucauauuuaauauguugugugucacaagcaguugcaaaggaguacugugaagagucucaagcauaauaacuuuaauguuguaccuaaucuuuaauaauuauuauccuuuuaaaaaugcuaaguauaaaaagaaaauuuaggugaugacuaagaagcugauuauuguuuauuuuuugacacaagaucucacucuguagcccagagugccuuugaauccacuguguaguccaggcuaaccucacauuugcugcaauccuccugccuuagccucccaagugcugagaaauguauuaugacuguauauguguauacgugugugagugcugucguuuauacucguacauguggaagccgaagguugacagcagcugucacauuuaauuugcugucuaccuuguuauuuugcauuauuuaguguguguguguguguguguguguguguguguguguguuuguaugcaugugugugccuaugcauacaugcuuaaauaaccauggcacauguauuucacagugcacauguagaaguuagaggacaacuuauggcgguugguucucuuuuuacuauauggauuuuggagauagaaguuaggucuuugaguuuggugguaagcaccuuuacugacugagcuaucuccaaaguccuuuuugguuuuugacaguuauacuuauuuuucauaucagauagcucauaggucauuucuuugcggauuuuguuuuguuccuauaguugaguaauguuucccccuucucuucuagggauuuugcuauauugugcaaauuugccucaaauuucugggcucaccuucauauaccuuauaauuccuuugcugggauuugagaauuuguagagauagacaacuuucccaaucuuuguguucugacuuuuugcauagaaguguuuuuuccaaaugguuaugagccacuguuuaggugcuggggacugaacucaggucuucuacaagagcagccaaugcuuuuaaccacaucacuccaacccacaaacugcucauuuuuaauuuguacgggaggcauccuuaaugcaugagaaaccaagugaaaguagaaagucaaguagcucauauauagugugagaacuauaugcacuuguaucaguuuuccagacaucucugugaguuaagaagcagcagaaauaaugagaagcugaaauggaugagguuucaggaaaaacuaaguuguaguuuugguccuaucuuaguaucagccaugaagaaaagcuggcucaugcaggcuuguauaggaaguguugucuguaggagcagaaaugugggaaaacucuaaaggucauucagaguggcuagguagacugcucuuugcccaugcugugagauauuugacagcaacagaaaaugguauauggaaaauauguaggccauauguacugagaauagcuuaggaguaaauuauuggauuuuuaauuuucaacauuuuauuuuguauuuuaauugacaaaauuaaacauuuuaucauaugcagugguauuuugauauauguauauaugcacauauuguggaauagaugaaguaagcuuauuaucauggauauuaccacagcuauauuuuuuauagaaagaacacuuaaaauuuguuuuacagaaaaauaauuauuguuacuaauuuuaggcaccauauuuuauuauauaacagauuucuuaucuaacuaaauuuuuuuauuuuguggccaacaucuccccaguuaauucagcauauugaauuuuuuuagaaaggaguuugaaaccaguuaggaggcugaggcaagaagguaaagaggucuaggacagccugaucuacgugagaagaaccaggggaugggaggguuggagaagauacaguauaagcuggauuagaaagccaaaccaacaaauuugugacuacaguaaaauuauguuuuuguaaguacauauguacacaaauucauaauaaaggauguggauuacaaugauuauaacagcuaaguacucaaaaauuaauugcagauuuaaaaaaaauaaaagcucccaauggaaauuuaucaacuuacuacaauauucuaauugguuuaugaaugaguuuaucuugauuaaaggcaugugcaaccaugcccagcaucaaacauugcuuuuauuuaaaauaaauaaauaauaacccucaagagacuggaggccccagggaguuuagaggucagguggggugggggauggaagcauccacguggaguugggguggaauggggaggaggugugggaugggaagggauggggaaugaaauauggaaaguaaaaaaugaauuacaaauaaaauuaaauuuaaaaaaagccaaauguuucaauguaucuuaaauaacauguagagaucaacauaaaaacuugaccuggugguggcacacgccuuuaaucccagcacuugggaggcagaggcaggcggauuucugaauuccaggccagccuggucuacaaagugaguuccaggacagccaggacagccagaaacccugucucgaagaacaaaaaacaaaaaacaaaaaaacaaaaaaagaacuaacuuaaccuaguaaguguggcugcuccuuaacuuagcugcuauuagguucucaggguguuuuugguugguugguugguuuuugguuuuuguuugguuugguuugguuugguuuuuugggaguuuuuuggcuaugaacauaauuuaacuucuuacagcuuaaugaauugugcuucuuccagggcuguuuaaaacugacaguuucuuggccuuuuacaaauuacagaaguuaauuugcuucagguaucuguuaccuauuaggagauuaucacagcaaauuuguuuuuacauaacaaaaaucaguaucaccucagagcuuggauugcauaagaaacccuacaacugguagcauuauugaugaagauuucuaaauaucgauuucauccuuugcuugaaaaccagauaaugaagaaucauauuucuuuuggaauaguuuuuagaaauuaguuuacauauguguacaaauuuaaaauuaguaaauuuuauuagcauuuacauuccuauucuacagauauuuaacaaccauuucauaccucugucuuuucuugugccccccgcccccacccccugccuuucuccuuuugaguagggucucacauagcucaggcuggucuugaacuugaacuuuugacccuccuagauucagucccccuagugcugggaucacagaccuaugccagaauaaacugucugucucaugaacuacuuuugcucucauucauuuacaaaauucuuagagaaacuugaauauucaaacuuccagacuuuuuauauaccaaaguucaucacuguuuauaccuccuaucccugguagcaccauugucccagauugaacgcuccuaagaguguuucaucccauuccuaaauguauggcauccagaaguccuugcucugaaaugauguguauugcauaauaaagucuuacauugaauaauuaugcucuuacaauuugauugauugauugauaauuggcucugcaguuaguucuacuagauuuucacaaaaggcugguuaaaaucugcaguggaguuggaagaauacaauuuguuucacagaacucuaagacaggacaccaaagugguaaaguacauagcuaaaguacguuagguguguccggcuuagauaacuccccuguaacguagaauguggaaguucaaguucucaaacuguuccugagcuuacuggggagagcagaguggccuuaaacucacuaggaucuaugugcccugccucuccaaguucugggauuaaagcauaugcuaugcccaucuacuuucuuuguuucuugauauauauuuacacgugaauagaaaaacaacuaaagcuacauguugccuuuauaagggugguguuuaagugugauucaaaaggaauccguuuuuuuucuacaaaguaauaaaaaucuacaaguuuuuuuuagccaaacugaggauauacacaaagacuauugccagcuuuagaaguagauuauuugacaaguaagagaaaaauauugagaguuggggcagaaauuucaaagacaagcagaaaacaaaauugcuaaaugacugauacucaucuucuuuacuccugaugggcuauaaucuaguuauggagucuguguuuuuccagauaucugaaccauuuggaauguauuuacauacugugauggucauuaacauagucaucaccuuuugcuccaggaacugaguucaucccuuuaacuaguucacaaaggguguggggcucuagugauccuauggaggacucuucucuuuuuccacagaaauaguuaaguguugccgauuuuuuuucacaaucuacaaaaagaagggcauuguuaauugaguacuagaauaugagagagagagagagagagagagagagagagagauugagauugacuauaaagcuguggucuuuugugucucucuugauguuauuuuguuaccuuuguuauagucuauucauccaaaaacaaaaacaaaaaaacaaaaaaaacaagaacaaaaccaaaacaaaccagaacaaaauaagccagauuuggagauuuuuuuuuuuucccuaguggcucagguaguuaagauuuuacuuuuuaaacuaaggacuagguuucacauucauucauaaugauauuuuaacauaauuaguugcaucaaagcaauuaggcuuuauuuuacuaggcaaacaaaugaguuuccacaagaaaggcaaucaaguuugaucuuuuuaacccuaagucuuauauuuuggaacauuaagcauuuacauuccuuucaguucaauuaagauucuuauucucucccuuuuuauuuacccagugcuacccagugcuggaugcuuuaacagugaacuuaaucucuagucuccuccccuccucuguucaugauugauaccuaauguguacugucuguugucuuuugacauuuuuuuuuuaccugguuccauuucuauuuuugaauagaaagaaucuuaaaacuguaauaugggcuugguuuuagaucaccauguuuccugacacacauguucguucucucucucucucucucucucucuuucucucucucucucucucucucacacacacacacacacacacacacacacacaccucuuuccaagcagacuauuuuuuccuuuuccuuggugacaggaucucacuguacaguccaaauugacuuuagcucaugauccucucuguuccaucuccugagugugcugggauuagaggugaugggucaccaaguucagcuccagagacuauuucauuuucugugagaagaaaaagcaauuucugcagaaguucacucuaagccaacuaacuuugcacuuugaaauuauuuuaauccaguaugccucaaccuugcuaaugcugcucuaccccuuuaauacaauuucucauauuauggugaccccccaagcauaauuuucauugcuacuuaauaacuguaauuucacuauuguuauaaaucaugauguaauaaauaucugauauucaggauauuugauaugugaccccgugaaagggucucacaauccccaaaggggucaugacccacagguugagaaccacuguuuuaaucuguuuguuucagauucagguuauuuugcauacucuacaucauaaauaugggccauuuuccacuauuagucauaguugcucuaaguuguuacuuuuaagcuuugaaacuuauauuauuuuuuuaagcaggaaaacccuuuuguauuuaugacuuuuaagaggcaagauuuauguuuuuggagccugccuugguuuaaauuugguguaacuugucagugaugucaaagauacuaugucucuguagaaugagaugagagcaucuugcauucuauuuguaaguaauuggaagccagugcagggaacuggaguaauuaagaauagccuugcaagaaacuugauuuuguuuucaaauuaauuuuuccacuuuucuugacugaagaauauaauaacauauaauaauuauauugagguuuuagagaagguuccuaauuugucugaaaaguccucuagcacaaacuugaaagggauguuuugagaagucagugggacaguagaugugacuucugauuguacaucuggaguuuacaccuaccaaagccacaaaccuaguacagguccuaguccugcacacagaaauagagagcacuguaggcacuaaacccguggauaccaaguucuguccucauuuggaagaagaggcuggcucauuuagaggaagaagaguggccagcgaucuuuggaucuccccugagguugucacuuuccguuucccuuuauuugaauagaugcacucuaagcuggucuauuugauuugugcgccaguuuuuuaaaauacuuuguuccaacaagagaggcauucaccucuggaggccgccuuacccuuuaacuugagcccggaguuguagucaccguccaaguaugcucccugcaccugacauuccuucccacuggagccuuucggugaauaagaggaaaggcucggccaauuauacuagacaaagccgcacagcugcgagucagcugggaggaguuuccguuuggagcuggagcugguggcggcuggcgcucccaccuccuuuuucccccucgccaccauccccuucuauucucagggauuaccuggguggaggccgggcucugacucucgaaccgggcagcagaugcugccauaccggcaggugccacccaccucuagccuccgccucaagagcaaagaccggaggcucaggugguacccggcacccugccugaagguuggcgggaggggaaggggugguccuuacggcuggacccuccagcugacacaggaagugcggggagagccuggcacugggcugggauccgccccgccugccgcuccuaggcugugcugucuccgcagaacaaugaagugcuuccaaguuugcugagacuccuggggaaugcaucgaacucugucagccuucaaaugugccgccagugacuucccccaagaagcuguguuuuaauaaaagaagaaaaagacacccuuucuggguagaucgcuuuguuaggagauccucacgaccaugguccagcgcuuuagccucaggcggcagcucuccaaggugggucaguuuucuggugugucuuacugggaacucuggcuucugcaggguuuccuuuuuugaugggacuuuuaugucaagccugccuuucucuggugcuaaggaaggucuggggaggaagcucugccuuuuguucuuugaucugauggacacaaagcugaagguugccugcacugccagccccaggcuguaugccccuaaaacuguagcugucaucuucaaaucuggaccaacuugucauauuuaccccugacaguuucagaagaauguggguagguaguaauuguaggucagauguauauauuuaauuagcaaaauaauagcuuguaaaucaacagaagaaagccugccugcucuguggaaucaggacuuucauacaaauuucacuaaacucaaaaaaaaaaaaaaaaaaaaaaaaaagcacaaaacaguugaagaagccaaaagccacaggaaaaucuuaaaggugagggguuguguagagacuuagauaccuaguagaguguguaggaagccuuccagggaagcugguggagcagcucuuuagagaguucuaaaaagucaguuucacggaacacuuucaaauauaaaauaaaaaaguguagugcccuuuaagaaaagguaguuuuuaucggugggcucucgugggugcgggcccguauguaguuuuagcucuauccuuaguuaaugcagaggcuguguggaaagagaagguaagaggugaacuuuauuucagaaaccauuguguucuucauaggcuuuauuuuaaagacauggcaguugguggcuaaauugugccacaguucauucccuguagacagaaguauaaacaaacaguccaucuguagacauucuuaacuuuuuuugacugauaaucagaauuaucaaccuugcaauguguuaggauccugagaggaaauguuagcugcccacaggugacagcagugugacugaagcagaaggagcuccacacuugcccagccucagcugugugagccucaugugucaaccuggcggggacuuuaggaauauugaaaugugucuuccauccugugugccugcauguggaggcacagaaggccgccauuucuccuaaacaauaugaagaagaauccuguguuauuccuucaguauucuuuagugguguauuuucaaagauuugguacauguaauaaguagaugcuauagggauuuuugugacacugcugcauaggaaagucuuaacagcuaaggccaaacaauaaucacuuaacuagaauauaacucuauucuggauauuuugcugcugaugcuucucuccagguuauuauuuuuagcuuuaacuacuccucagugauuauuguguguuacugugacguacuuacacaggggcacuuagggguaggagcacggucuacguagaaucagggacgggaagaaagcacagucuacauauaauuggugaaggaugggugcacagucuacuauagagaaucagggaagggaugggaguacagucuacauagaaucagggugagcagagcaguucuuccacucaccuuaacgguguuuucaguucuuguuauaaaugguugugaaaaagccuuagggaaugugugcccuugauucagugguauucaguggugagcaccauuuguaaggcacuuugagcaugaggaagaaccugaauagaaugucacugaauuuuucccaugcucacugagauuuaaagaccucacuaccucugcucuaccauacaaguaguuuugcuaaucaaaaagaaucguguacaagaauauaauuuucuuaauaucucaguguuuuaauaggaauuugugucagaaaauuuguggaaggaaauauuuguaaagguuugugguggauuuaaccuccaugucuauugauccugaauucacuugccaugugauuccuguagacuauucauuguucaccgaugggcuaagaaaaaaagaagggaaacauaaagguacaggaggaguaaagcucaucucucuuaguaccuuucauuucuagcauuuggaaggcagacacaggcagaucucugugaauucaagggcuuccuauucuagguagcuaguucuagaccaaacaggacuacaugaugucagaacaaacaagaacucuuuaucccgagaaaguguguuugcugagcuccuugagcagaucccagcuucuuugcuauuucagaucauuuuccuccuugcuaguuucccccccuguacguuacuaaagagaaauucacuaaggaaacuguucaacaucuccuagaugagccaaaaugaucuagcaccuuccagugugggaauuucacuuaguucuccuauugauucauaaguugauugauguuucagugccuuuugauuuuacuuuugagugauaacuauuucucagcauugaaaaaguaaaaaaaaaauauaaaugagauuuugcuuccaaccauaucuuuuuauggcaaucacagcccuacauccaaagguagcauguuuuuguuuuuuaauucuuuguuuauguaaacauauauaauuuuuuuagcuuuauuacaugaaagaaaaacaaauaaggcaaugcuuguugucagcuuuaccuuuuagacacacucugaauagauuccacuuaguucagguuucauauuuucauucaaagugguuaaccucagagaugcccuccuucccuuucuccauuccugucuaccugguaguuccuucuggaauugagauuauaggugugcaacaccaugcuaagcacucagaguacuuuauguaccuucaaucuugaugauuucucuugccgccauaccagauuuucuucccauuccaucugagaacuuuguuauauguaagucuuucauaugguggaaacccagaaaauaugugcaguuaugccuugaguuugcccuuaaagggaauacuaagguuuggugccaagguccuucccaguuuuguuguugauuugcugagaacaaucuagguguauaaagcaacuaaugauauuuuaguccacaaauacccuuuccacauuucauaguguccuguuuugcuaccaguuuguugucagcaaaagaaacuuuggaguuauagcuauucucuaaaaauauggauuauucauaauaacuugaauuuucaguaaaaacuauuuuuucuucagaagucauuuauugaauuuuuuuuggcuguauguauauaguggcauacaugacuuucuuaaucuuacuguaaauguauucuuaucaauaaaaauaaaauggaucuuuuauuacuauacugaauagauuaauuaacaucauuuaugaguauucuuuauaaagggcuggggaaguagcucagugacuaagagcauuugcucuacaagcauaaagaccugagcuagaacucccagcucgugcauuaaaacccaggaaugacuaggugcuucugaaaucccagcacugaagcagagagagacaggucaugaaaguucacuuaucuuucauuauaaccagaacugugagccugucugaaaggacauaaaacagagagugauagaagauaaucuggcauucucucuuauuaccucucgauagacauauguacucgcacacucaugugcauguaguacacacacacacacggaguggggcuaaaucauguuauguuuauuuuacuacaauuaaaaauuuguguguggcugagcaguaguggcacaugccuuuaaucccagugcucaggaggcagaagcagacagguuucuaugaguuguaggacaaccugcucuaaauaguucuaggacagccaagacuacauggagaaacuaugucucaaaagaaaaagaaaaaaaaauuguguguuauaggggcaagguauagaugugaaggucauaggacaaaccauggaagucaguucucuccuccaccauguauguggguccuaagguucaaacucacgauuguuuucagacuugacagcaaguguccuuacccacugacccaccucacuagccucuacuauuuuuaaaaaauauaguaaacuugccuucucaaugauaaacacuguggauacagcaaaugauacaguauuaugugauuacaacuucaaguauauagguugggagucaguauuggguuggugcuuccaagcaguagacaugcagcaucucuuuuugucaucaucucuuuuuuuuuuuuuuugucccuuucauuuaaauuguccuuguuaaaucuauauacugcucaacuucuuaguuugaaaugaaauacuuugcauuuguauuuuauuagaagguaaauguugcauuuuccugauaaucauugacuuguguuuuaggaggcuuaaaucagauagugcugugugacugguugcugugcacauaucacuaugcauucugaaauuugaacucaucaaguauaauauauaaaauacuucugaugaauuacaaaacccaaauaggaauacuaauggcauucugaugcaguaaaugagaacuuuaauaagauacauuuugaacaugcaccuaugucaaggguagagaaugguucucauaugcaaauacaaucagcaguaagauauacugaaauagaaauauaauuaagauauauguguaguguugccgugaagugauuugguaauggagaugacagcuuaaaaguuuaaaauaauaauaaauucuugaccauguaaaggaaaugcuuccuaacaagguuguuaaguguuaaguuaauccucagaggugcgccaguucuuguuaguuauguuggguauuaguuucugggagagguggcuguauuaaauagcuagguuggaaccggaauauguguaccuaagcauuaguuuugaaguguacaguguacagacauacuugaaagugucuugaaaacucuuaaaggacuauauuaauuuaaguacuaagaguggugguagugugugugugcaggccugucugucuguauuugcauguaugugcucacacaugaagucagcuuucccuucuaguuuguacauccuggggauagaacucagguugucaggcuuagcagcaagcucauuuagccacugagacaucacucuaucccugauggaguuuuauauucagaauuuauacuggcauuugagaaagauaugcucuuuuuuuccauuuucuuuccuuuuguauacuuaugagcuauaugcugucuuugaauugguagcagugcuguccccuuaguagaggacaugcgagacuuaggugugagaauaucuuacagauuuacaagaaaauuccagauuuucuugaaaacuaucaccagcgauuuuauauaaagauaaugauugagauuugauuugauguucuugauguccuccuagccccaaggugggcacagauggaagcuccucuuuauguacaacacagaaaucuacaguagagaaucacaaacucaaaaaaaaaaaaaggcagacuucggucuauuaauaugucauaguaaguaaaugaccucagaauucucagacucuaaauguuauaguuugcuguuaaaacauaucagcuuagcaggaugugucuuguuuauuacucucugcuugcuaagccugucugccuggaagaugccuuuaacccugcuacucaacaugauauagauaaaagaacuaauagucuguuagagaagaacaaaagagaagcaagaaaaauaauuuuucuuuagcuagaagauuucacuggaccguugauggcugaaguucaggcagaaucccagaaaucaaagcaagucagugggaagcaguguauauuagaagagggggcgucugcucggagccuggacuacaagucauggaagguaggagaucagcugcauauuucccucuaaacuguccaaguuuaggaaaguccaggagucuuguucuggaauaaguacaaggaucuuguuuuaagagacaaggccugugugugggccuucugagucgggccugggaguuggagcuuacuugcuaugaugguuugaaugaacauggcccccaaagguucauauguuuguauauuuggucaccauuuaguggaacuauuugugaaagaugagguguagucauguugguggauuaucucuggcuuugagguacaucauuuccaguguacucucuaccuucugcuuguggaucaagaugugaacucucaucuccugcucucacugccugucccugucuaugcuuuugugaugcugugccuucacuccaccaucauaaaucauaauccucuguaaacacuagcucaguuaaacguucuuuuauaaguaaucuuggacgugauguuucaucacagaaauagaaaagaaacuaauacauuuuggcuugcacugaaguaagucugaugacucacuuuaaaucauuucagggcuuugugcacuugcuaaaaccaaccuggagucuugggggaagccuugaaguagaaucugucuguagauuucccauaaagaaaaccauuauuuuauuauucuuagaauaaacaaaggacacaugcuccacuauguucauagcagccuuauuuauaauagccaggagcuggaaagaacccagauguccuucaacagaggaauggauacagaaaaugugguacauuuacacaauggagaacuacucagcuauuaaaaaugaugaauucaugaaauucuuaggcaaauggauagaacuagaaaauaucauccucagugagguaacccaaucacaaaagaacacacaagguaugcacucacugauaaguggauauuagcccaaaagcuccaaauaaccaagauacaauucacagaacacaugaagcucaagaaggaggaagacaaagcugggcaucgaggccagccuggucuacaaagugaguuccaggacagccagggcuacacagagaaacccugucucaaaacaaaacaacacaacaacaacaacaaaaaaccaaaaagaaaagaaaaaaaaagaagacaaaagugugggugcuucaguccuucuuagaaggagaacaaaauacaggagcaaauauggagaaaaaguguagagcagagacugaaggaaaggccacccagagacugucccaccuggggauucaucccauauacaguuaccaaacccagacauuauuguggaugccaagaagugcaugccaaggagucugauauggcugucuccugagagaggcccugccagagccuuacaaauacagagacggaugcucacagccaaccauuggacugagcgcaggguccccaguagagaaguuagagaagggaccaaaggaguugaaggggauugcaaccccacaggaagaacaacaauaucaaccaaccaguccccccagagcucccagggauuaagccauuaacgaaggaguacacauggcuccagcugcauacauugcagaggauggccuugucaugcauuaaugggaggagagguucuugguccuaugaaaacuugauagaugccccaguggaggggaacugagggcagggaggcuggaauguggguggaggaacgccaucauagaaguggggggugggggguggggugggaugggauagggggcuucggggggggggggcugggggccaggaaaggggauaacauuugaaaggugggggguggggugggaugggauagggggcuucggggggggcugggggccaggaaaggggauaacauuugaaauguaauaaagaaaauauccaauuuaaaaaaaagaauaaacaugcauucuuggaucaaaguguuccccuaagaagaugcugaaauuguugagggcugcaugugucccgaguauugauuuuucucaucagugaaagggauaugcuuugacaggaguggacgugagucgggggcgucugcuguauuguagauauuguaaccagcaguugauggauaaaaucucauuauuccuucagugcugggagggcugcaguugggauugagaguugcucuggcaaguugugccauugcuuaaauaguuuugcacuauuuuuucugguuaauuuuuguauccgaguguuguucuccccagcacaugguagguaccuaaaagaugcauuuaguaucugacuucauguuugcuucaccuuaguaccaaacugcuuuuucuaaugagaagucuccucugugacacuaagaguuugcuauacuuuucuaguuuucuucuuuuuucugcucuuucuuuuuccccuccucccuucugcucauucuuuaaauauucaugugaauuuccucuguuucagagguuguuuuguuuuuuuguuuuuuuucauucugucccaguacuucccaugggcauuaaucauugcaacaauuuguuguuccauauggaagauaucuaaaucaaugucuccaguggagaacuuucuucugagcuaagcuuuguuucuguuuuauuauuuauuaacucauuuagcauacauuaauugaauauuguaccaucuguacaagguaugaaaccauaagucacuguucucagguagguugaagugacuagucaaaggagauuacagauggugauaaaagcuacaagacccuagaucaggguaauaauagauuaauguuagagaugagaugugagggcaaagaccagagguuucuguucagaggagaagauguaacgaaagugguacaacuuuuaugcaaagcugaggagaaacugccuaauguaaauaagcccuagccagcagacuugauagagaggaaaggguccauaugagguauagauuugggggcaauuauagggcguuugauucauuuuaaaauuuaguagggugaugugacucaguaauuguauaccaaguauauguccccuguguucaguuuccauuacugacauaguuacauauauacauacauacauacauacauacauacaugaagucuuuuaaaguuuuaaauagagaauaacaugagauuuauacuuuuuaaagagcauucuggccacagugugaaguccagagaaggagacagcaaugccuugcaauagaggcacagugaagauauggggccugugagaaacucaguggauuaaaugugagaaaugagggaugagccaguugccuauuugacauuuguucuaggauauuuccuacugaauucauuuuucccuccccuuuucuuccuauaccuaccuuuccaaguauuugacugcuuuaauuugggucugaagucaguugugcuccccaccccaccaaguuauauguccuagucuaaaguaacuaccaaagggcgcaugcugagacuuggcuaccagcugugggccuucugaggguggucgaucuuuaaauaguguaggcuagucugaggacuugaggucuagggacacacccuugaaggagauaguaaaauucuagucucucccccucucaguuuaguucugucauaugcuucaucaccacaaccaugccaugggcuaaaaccucugagaaugacagaucugcucuuguaaguugauuaucucaagcacuugugucaaugacagaaagcuaagcaugugccuuacuguauaucaccugcugugugugcccuguugcucaaugcagacgcuaugcauuaucuucuguuucuucucccccacauacccuaacccaacagaggucaucaguucugcuuucugaaugcuucccuaauagcacauuucuugguguccaugcaucugcccuaguauccuucuaacuaguuggucuccuagcuccugucuuuucccgugucuguugaaauugauucagaaagauuuaaucauuacacuucugugcugaaauccuugacugauccugaggaucacaucgaaaguccuagcaggaucuagaaagguucuuaggaccuagucccaugaaccucuucagcuuuaucuuucagccuuccaguccauguucccaccagccacacagagcccucuuucacuugccugugagcucugcucuagcuguccugugcuugccuacuucuccuagcccuuuccacucacucccuugcauuccuaacaaaaagcaaaccuacagagguucugguuguucugggcucacuuaaucauucugaccaacuugccuuaggugaauuccucugcucccuccaagaaauaccucacuguuuucauucccuuuuguuuuccacggaaugagagcuucuugaggcucuuacagaugaggaugaugaugacgacgacgaugaugaugaugaugacuccucuucuuuuuccuccaauguauuuuauugauuauuugggaauuucacauaauguacccaaucaggcucagcuucuuaauucauauguugaaagugaucuacaggaagcaagggaguguauuagcuaagcauaguggcaccuguaauccuaaaacucugaagagaacuggcaaauuuaauauacauggcaaguuccaggccagccagagcuacggagagggacuaucuuuuaaaaaaacaaaaccaaaagcaacacuaacaacaaaaaugaaaagugguucacuaauugaacaugcauagcaugauauuuuuauagaaaacuacagaguauauagauuauuuuacuacgcugaucaacuaaggaaagagacuuuuaagugucugaacauggucuuuguuaucacagaaacuaaggaacuauucuauucagcacauggucuuccuucuccuuagaagcgcugccugugcacauggcaucuuuguggugccuagauggcagcugaaaggaaacaaaccucuuccuuguguuaauucgucaauuugauaguguugagcuaacuggcaggugggggcuuuguuuugcuuuuucaguuaucacuuuguacacugaguuuggggugagcacauuuuuguuuagucuuauaaguauauagaacauuuacaugguuaugaaauuaauucuauaaaauagcauauucacuauuuguuuagucuuacaaguauauagaacauuuacaugguucugaaauuaauucuauaaaauaguauauucaauagucuaguugcuuuccuuauccuuauauuucuugcuaucaguaacuuuauuuuuucccuagucuugauguccauuuucuucuugauuucauuuucuaucuugauuucuacuuggcuccuugucccucaacuuuccuggaagucccaccucucccaauagguuuccuuuuaaaaauggagauuuuaauacacuuauuuccuaugauuuuaucuauucugaggucucuugacccuuuuccuuuuuuaaaacugggagcuuuuuucaguguggagugauaauagacuuuuauuuuucagacuuuuauuuucacaaguacagcugcaguuagcucacuuauucuuuucuuucuuauuuaauauuuuuauucauucagucauuuuuguuguuguuugagauagggucuuccuacguagcucugacuaaccuagaauuugcuauguaaaacaggcuggucucaaaacuauuugacaugcguguuccuucauccugaguacugaggucaccaaagauauauacuucguuuuguuuuguuuuguuuuguuuuguuuuguuuugugagacaggguuucucuguauagcucuggcugaccuggaacucacucuguagaccaggcuggccuugaacucagaaaucagccugccucugccucccaagugcugggauuaaaggcaugcaucaccacugccuggauauauacacuuauuauuuuuaauuauguguaugugccucuggacuaugugcacaugaaguacaaguaccuacugaggccagagacuggaucugccaggagcuagaguuauaaucuguugugggucaccaucugggugcugggaacaaaauucaagucaucuggaagagcagcaaaggcucuuaaucacuaagcuagcuuaaucacugucuagcuuaguuguucucuuuucauauucuuugcuaguuuaucuuuggauuacuugcugagaguaauuuugcuagguucugugauacuucugucaaaggagggcauauugauuuuauccuaucaacuauuucugaggagggcaguuuguagcuuuuccuuuuugucaaccugauauggcagaaacaguguuucacugugagucuaaucuaguucaguucauugugagcagugcugaguaucuuuccuguguggaaaguuauuuguauuucuccuuagcugcuuggaucuccuuagacuuuugcaucuuuuucuuuauaaagaaaggauaguaauuuuuuuuucuguuaaauaagugaccuuuuuuacauugaauuuucucucuuccuuguucuccacacugaguaauucuucuguguuuguuuuaggugucuuucuuacauuguuaccauuuucacagccucauuuaggucagaaucacuuucggguuuuguuuuguuuagauuuauuuauuuuauguauaugaguauacuguagcugucuucagacacaccagaagagggcuuuacauagaucccauuacagcccuauuuuauuuuauuuguggagauagagucucucugugcaucccagucuaguuuaaaacauaagaguacucugcauccguaucccugagugcuaggauucuaggcaucugccgucaugccugucacacuuuuuuuuuuuuuaaaauaguguguguuaauucuacaaaaugaugaauuuuuuuauuacauuuucagacuugugaagaacacaguuugaucacauucccuucuccuguuacuuuuaccuauucuuucuccucacuuccauuaguccccuucuuuuuauuuuccgagucuauacugcaggaagauuuugauaguguuucaaguauuauaccaacugaccuuuuauguaaauauauuuaagcuugagauuuuugcuuuuuuauuuaauugcauaggagaggucauuacagaaucucuuagagcuucaaauaacuguccuagaaagguuaguauugcugugauuaaaaaauaugaccauaaccaaaguaucuugggggagaaacuuuacuguucaucauggaaggaagccagggcaggaacucaaacagggcaggaaccuggaggcaguagcugauacagaggccauggagaggugcuacuuacuggcuuguuucucaugucuugcuuagccugagcugacuuucuuagagaacccagggauggcccuaccacaaugggcuagguccuccccaucaauuacuaauuaagaaaauaucuuacagacuugccuacaguccaaugucauggaggcauuuucuuaauugagguuuucuccucucagauggcuuuaguuuaugucaaguugacauaaaguacacauccuuagaagaucuauuugcuuaacaaggauaauguggguuuuccuuuaaugacacauaggaaauauaaguuacauuuuggccagcuaugguagcucauaccugugaucccagcccuuggaaaucagagccaggaggauuaccaugaguucuaagccaguuaagggacagagugagaccaugccaaauaaaaaacaaaccaggaaauggaaaauaauuuuuuuuggccaaaaaugcauuguguggaagaccauuugcauuuauaacacacaugaccaguagaggccuagaguuguaacacacagagccaugacaguuacugcuucauugcugaagagcagcagaaugauguuaauugcuuuucacccaaggacuaauaagaaagagcauuuacaaaggcuuuguugggaguggggggcuguuuguuuguuugaagcuguagacugaauucagguccuugugcucucuaggcaaacucucucaauauuuaaaucugcaacccuugccuuccucaaaaguaguuaucaucaucaucaucauuaaaguauuuuugaaguaaaaugagaagugaaaacuuacuuuuuaaaaaagauuuauuuauuuaauguauaugaguacacuauagcuguucagaugguuguugggaauugaauuuaggaccucugcucgcuccggucagcccugcucgcucaguccaugcuagcucuagcccaaagauguauuuauuauuucuaaauaaguacacuguagcuguuuucagaugcacaagaagagggcaucugauuucauugcaggugguugcugggauuugaacuuaggaccuucggaagagcaaacagugcucuuacccgcugagucaucuugccagccccaaaacuuagucuugcuuuuuuuuuccuccugacugaguaaaacacacaaauuucuguugccuucagaugucagcaugaaaacauggacaaugaaauugaaaaccuguugcuuuaggugagcaaagugggcagagaagagaggagcugacuguauuacugcagugcauuccugagcuuucuccuggccugguaugugcaguguguucaaaacccuuaccuucucuguuacuaagguugucaguuuguagguuccaaguaaaugcaagcugucuuccaguccugcugacaaacuuuaucuucauacucuuuaugccuguuacaaaagaauucaagagaaagacagagguggaaagaccuuaaagcuuacauaauuaaacccuuuguuaguggauacauaacccagcuacugagaaugcaagaagagaaaagcuuuacacaaguaaauaaccagguuauagccuacucuuauuuucucuuaugggauauauuaauuucauuuggaacuguaguauacagucucaacacagacccauguuuuucucgaaaguucucaaauuguuuuugaaacagauaaagaguaaaugguguaaguuucucagggcagaggacaauaagaaagggaaacaacaaacugaaucugagugaaaacaaauacccagaucuaguugcuuaagucgugucuuauuaagcauuucucaccaaacuuguuuauaaaaaaacucaugggccuauuaaaguccucaugccuaagcguaugcacaguuaaagcugauugucagggcuugagaacaugguucaggggauaagaaaauucgcugcucuuagagaggacacagguuccaucucucgcacccacauuacgcaucucacaaccuccuguaacaaagggauaggauugcucugugaucguuccugaagauagcuauacacacaggaagcacacacacauaaaguaaaaaaucuguaagaaaaaaaauguagacaccgccucuccccaaacuaugaauguuggcucagcaguuaaaaaugcuugcuguguaacccaggccuugauucccagaacccucaauggaaggagaaaacugacuucugguaguuguccucugggcuggagagacggcucaucgguuaaagguccggaguucaauucagucuuuuguuguguggcuuaggugucagggugacuguggccucauagaaugaguuuguuaguguuccuucuauuucuauuuuguggaauaguuucaggaguguugguauuagcucaucuuugaaagucugguagaauucugcacuaauaccaucugguucugggcuuuuuuugguuaggagacuuuuaaugacugauucucuuuccuuaggaguuauaggacuguuuaaauaguuuaccugaucuugauuuaauuuugguaaauguuaucugucuagaaaauuguccauuucauuaagauuuuccaauuuuauagaguacaggcauuugagguaagaccuaaugauucuuugaauuuccccagugucaguuguuaugucuccuuuuucauugcugauuuuguuuauuuggauacugccucucugucuuuuaguuuggcuacaaguuuaucuuguugauuuucucaaagaauuggcucuugacuuuguugauucuuuguuuuguggggggguuguuuuuuuguuguuguuuguuguuuguuguuguuugguuuuuuuucuuaacugauuucagcccagauuuugauuauuuucugccuucuccuccucucugcugugcuugcuccugcuccugcuccugcugcuccuucucccuucucccaccucguguccuuucuccuuucuucuccuuccuccuccuucuuccuuccucuuccuccuuccccuucuuuuuucuucccccuagaacuuucagguauacuuuuaaauugcugguaugagaacuuuguaauuucuuuaugaaggcacuuagugcuaugaacguuccucuuagcacugcuuuccuugugucucauaaaucuggguauguuaugccuccauuuucauugaauucuacaaagucuucaguuucucuuuguuucuuccccgacccagagaucacugaguagagaguuguucaauuuccaugaguguguaggcuuucugguauuucuguuuuuguugaagucuagcuuuaauccaugguggucugauaagauacaagguuuauuucauuuuucuuuuuaucucuugaggcuugcuuugugaaagacuuauggucaguuuuggagaaggauccaugagcugcugagaagaaaguauuguuuuuuuacguuuaagaaauuuucuacgacuggugagauuguucaucgguuaagacuggcugcucuuggagcuggagagauggcucagcaguuaagagcacugacugcucuuccgaagauccugaguucaaaucccagcaaccacaugguggcucacaaccauccguaaugagaucugacucccucuucuggugugucugaagacagcuacaguguacuuacauauaauaaauaaauuuuuuaaaaucuauuuauuuauguauaugaauauauauacugacauauacuauguucagacacaccagaagaggguauuggaucccauuacagauaguuaugagccaccuugugguugcucggacuugaacucaggaccucuggaagaguagucagugcuuuuaaccacugagccaucucuccagccuaccaucuguuuucuuauauugaguuagcuaaaggauacccccgucuguauugcuaacuaucauuauaagaaauaaguauuuuauuuaucauauauauuuagacaucauuuauuuuaaaagaaaaaacaaagggaauagagucaaauuuucuaaaaguuauauguguuggaaauuacaauaauuacaaucugcuccuuccugacaucuaaaaauguuauuugucaaaacaggcaauaugcuggaaaauaccaacauuagaaacacucuucugcccagucuuucuuucuuuauuaagauuuauuuuauuauuuuauauguauaaguguuuugccugaauguauaugugcacaccacauacacacauacuuaaggaggccagaaggggaaauuggauucccugggacuugaauccaccauguggauucuaucaccauauuuuaucauaugugagugcuaggacuuaaacucaggaugucuggaagagcgaccaaguacuuuuaaaugugaaacuaucucucaaucccuauuauuuuucuuucuuccauuuuuauuuuuaaacaguuauuuucaucaaaaguaacccaagccagccagaggguuugaaaauuugggaaugucugaagagcuuacugucauugucuguguaacucuaauuucauuuuaaauaauguaucaugccuaccacaauaguuuuaauucucuuugacaaaagcugucauucuuugcuggcagcuucugaguagugccaucauugugaggaaaugcaaaggucuucccuuauuaccauaugaaaacauucacuguauugucacagaccaagggaaaccaucuuugauaaucaucuagaugagugcuucucaaccuuccuuaauguugcaaccauuucauacaguucuucauauuguggugacucucaaccauacacuauuuaguugcuacuucaaaacugcaguuuugcuccuguuaugagucauaauaugacugucugauguacaggaucucugauaugugacacccagguuaagaacuguugaucuaaauccuccugccuuagcuucccaagugcuggcauagaauuauagauaugugucaucaugcccaaugucuccaaauuuacaaaaagaaguagguguucaaauacaagaagcauuacagaacuccaaauaggcauggcuaaagaagaaacucuccacaacauauuauagucaggguguaaaaaauaaaaagcaagaacaaaacaacaacaauggcagaaauauaagaauuacccaagacuuuuuaucagcaaccauuaaaaaauggaaugaacuauuucaagcucugaacauuaaaaaacaaaacaacuguaaauguuguacccugcaaagcuuauuuuucagaguuuauggagaaaugaagguauauuaagacaaacacaaauuaagacaauuuauaacaagcaagccagcacuacaaaaaggcucuuaauggaauauuuuacaggaaagaacaaagauagccuucuucgugugaauguauaagaguaugugccccaugaaagcaacaaauaaacuagagaaacauaaacaaacaaacuugggaauaagacagcuguguucaaugcaauagcucaucagacccucaaaacuaauacuggagaagggaaaaaaaacaaaacuguaacccaacaacauagaacaucaccuagcaaauuuauagaaaauagugaaguccuuuuauaaucuuaaauauaaauauaaacgaccucaacucagcacuaaaauaguauagacuaaugaacuuuauuauaaaacaagaagcaacuauauguugucaccaagaaacacuuagcaaaaauacccaaaaauuuagugucaaaaaauagaaauuaagcaaauggaagcaaauagaaaauauaaauaagcauccauagcucuccuaucaaaauaaaacuuuaaauuaauuauaagagauuaauggaauacuauauauuaauaaaggaauaacucauuaagauauaacaauaagccaggcagugguggugcaugccuuuagucccaucacucaguagacagagguaggcagaucucugaguuauaggcuagccuggucuacaaaguguguuccaggacaaccaaggccacacagagaaacccugucucgaaaaaccaaaaaggaggaggaggagaaaagagggggaggaagaagaaaaggaggaggaagaggcggcgguagaagaggagggagauauaacaauaguaaacauuuaugcuucaaaucuuacguugauuuuggugaugaaugauuauucgguuugggugacuugagaaaucuuguguagggauauauuuaauaaauuaucaaccauugugugcuauaaauauggguuaacuaauauauaaugagugauagguuugacccagauccaaguaagaaaggaaaagguagagucucaggguuccugcagagagaacagugcauucuguuauugaagucauucacuguuccugcuccagugguaucaagagaauuggccuagcuuuacuacugauaucuggguaacagggaugcugguuuuggaaaccaaguuuaaggauauucuuacauaguggaagcauucgcuucuuucuaaauuuaugaaaguccagauuauccauaacuuaaauaaguuuucuguccuucucacauguaaaagcagguagacucccugacacgggggcugcugaggcuccucauuccucaggauaggaagccuaacaucuuagaacuccaacaugaauguuggaaauagaaaagacaacacccuuucagaguuguuuuucugaugcgaaacugaaauauuuacgucuguuuccauaggauagcuccuuaaaaauggacaguaugaugcaaaaaaauacacacagauuuugagccgaacaaaacauucuuugauuuagaggauaaaagcacucuaugacaguggcauaucaaagaaaguauuccugauacaggccagugaaacuguacagaaaaaaaauacauuuucuauaaaaauucacgaugaugcaguguuuaugucugcuaaaagaguacucuuuugacaaaaaugaacuuaccauuuaaaaaucugcaauauuaaaacaaaacccagcagguccucagaguauuggaauuuuuacaggaaagaaugugucugucccuggcaggauucauucuguccguauaccuggacuucugucugaguacacauauguguuucuagaacauccauuugucuaaaaacaaagagguugucccacuuuaagggaauauaucauagaagucaugcuccauauuagacauuccuuuuccauauuauccuguauaccacuucagaaucaaacuggcauaacaauaggguagauguaguagugaacaucuuuaaccccagcacuuuaaauuaugaguguaguguaaaagauagcuuuaaaugaagggauuuauuuauagacaaaccagauauuauguauaugcuccuuaaaagagcugucaaguguuauuaagcuuuugaaagaaacaugguuuauaaggcaaucauagaagcugaaggaagaguuuuuuaauuaaauaucaaaaugauaacuauauaagacaacuuuugaauaggucuuuuacagacaaauuucuucagugaaugaguaagguuuuacagaacaaauaagaacuuagaucugaacucuaucggguuauguuugauaagauuagacugcaguucugauucuggucuucaugagagccaaagcaaaagguuacuuaaggaaccucagccuugaauccaggucuauucugggcuuauacauaaauguauauguauguccauuuguuccuggagcaagaauggguugaauuauugucauuguuguuguugcuaucuccuuuucagaauaugaucaccuucaaaauguugaaauguauuuuuuauauugguuacuaaaaggacuugaauuuauuuuuagaaaucuuuauagucuauauuaaugggggcauguaaauguaaaaauuuaaucuucaauuauauggagaauuagcaauuuauuaguauaugccuuaaaaauuacacugaucuauugauauauucucacagcaguaaauuagaguaaauaggaucccuuuguacugcuaagacagaaacucagauuaaaacacuagcccaaguucacaaaaccaacaguagcccugaaagguagcaguuguuucuuguuccaguuugcuccaacccagagccugcuaugggccuguauggguugccgaugagguaauauugaccagaacugaaccuugcucuccacacuggaaaagaauucaaaggaaucaaaguacagagaacuaaaaaacuggggccagugagauggcucagugaguacaggugcuugccaccaaguucaaccugaguuugauuucuggaauucaaguaguggaaggauagaacagacucccacaaauuauccucugaccucuauucaugcaauguuugcauacacacauacacaguaaauaaauaugagaauuaaacuaguguaacuucuucuaauccuaaaaacaaugauaagguaauuauuucuacacuuaauauugaccccuuuuuuucucuuccugacaucuuuaugggaaagcaccuuuuacacaaguuuacaaguugaagcaauguauaaauaugacuugacccacuguugagugcauuaacagaaacuaguuuuagaucaggauugcuaauacuucauguugcacaggagucuacauauuuucaaaaauaaguuuuaagacuacauaucuauugaaucuucuccaggauaccuuuuuuucuaucucucagcugaggcagggauauggguggagggcuaaaacccugaggauccaaagugucuggcaacguuacccuaggggacugcacaccacagcuguagaugagcacauuucccaucggcauuugcucugagcacaggguucuuguagaaacaacuagacuaaagaagucagagcugcuuuuagcagagguugagcuucagggcuaucuaugcugaggcacugccccccagucuucugacuauggacuugaaagagagccugccgagugggugauggauaugacggcgaggugcuuuguaaucucuucauacaagccaaagagaagagugaguuuccaaacaugaauacauguggaaagcuguaagaacauacucuucuguuguguuugucuggauuuugugcucuuaaaucagaaaaucuauuauauuggauggacacauggaaucuucaugucauucaacacauaacauguacuauuuucugagaaauugcauucucuuuguuacaucauagagauaaaguuguuucacuuucugaaaugugaauuuuacuuucugugaguaauaauucuugcugugcucuaaaauuuuagcaaaaugggcuuucuacaaugaaaaaccuagauuuugaauuccuucuuugucuccugucaccuguuauccuaagcacauuucuuguccucaaagcuuuaucuuugaguugaggauuuuggugcuaaucaugaccuaggccuguuaggacaauuguguucacuguauauaaaacccauggaguagaauccagggacuuauaugaaacuacaccccuaacccauagaacucuauauggagauguguguuguuauugcacacucacgucuauuuucuguagaaaauuguaaagauaaauguguucuuucaacuuaaaacuacuugauguucuaaaaacucugugacaagccauccucuuugucacugguuccauguguuccuuugacuuagcaaagcuguuagaccucacaguauuauuaaaaauacaggaugaagauguagggcuccuacgucuuacaacauguaaacauucauuuugugccuaauaugguacauggaauaguauuagugaaaaugaaucuguguaaaaacuuggauuuuuguuuuggaguuuauuguuaauacuauuauugcugcugcugcuauuguuaaguugguuuuugguuuuugaaauaagauuccauguaaagcaugcuagccucacucuaguuggaguggaccuugaauucaugaucauuuugccucuguguccugagugcugaaauuacugguuuguaccaccagacccagaaaacuugaauaaugacuuuuuaaaauuauuuuaaaauccuuauucuuugaugucuuuggaguuuaagaguccuuucacuguggacaguuucauuaagaaucaugccuuuggaaaacaugugcagcuuggcaaaugaaacuaucaaaaugcaaaggaaggcuuugauuuuauaugagagguuuucuuuuuuaucucaaauuauaagauagacaggaggguauggguguuacaugaugaucuuaaagguuaugaacugaacccacaaaugccucucaaccacguuuaauuauuuguuuuuagagauaugagugaagauuuucuuuaaaugugguguuagguaggaggcaaacaagaacuaggcaugcacuagguaagcgcacugccucagagucacuuuccuagcccgagaugguuuuuucuugucagaaaagaguauuuuauagacagguuaaacaauuuuauaugccaacuauaauaugcaugcaucccugaucugcuacauauaauagagagguaaacuauuuuuaaggugaauauuacuacuacuauuacuauuauuauuauuauuauuauuauuauuauuauuauuauauaacuguagagguaggggugugugcauguugaagugcaggaacaaaaauagccaucucucuagcaccaagaggugacucuuaugagagacucaguuccuaucaagaaucucugucucccaguaguagguauuuuguuauucacuuaaaaagaggaggccagguaugguggcacaugccuuuaaacccagaagaggcagauggauuucucugagcuauaggccaacauggccuaauaaguucuaggccagccaggaguacauagucagaccuuauuucaaaaauaaaaaaaagagaagaagagaauuuccacaaagggaacuaacucagagacuuccuaagggcuguggcaguugggcuuugaagaucacaguggccuuggauguguagaugcaaaagguaccacgugaacauuacaguggugaaauaauccaguuguguugagcuguugucacggugugguucugauaacaaugaaaguagggcaguuaccccuccaguaggauauauaaguuaagaugaagcaucuuccuugggaauugguuaaucagcugagauaggccacaguaggggaguaugaaaagcaguuaaauagcauguuaaaguugagcaaguaagucuaagucacucucucuaagucuuaauuuuuuucaucuucaaaaaugaagccaauaaauguggaugugggauggcacaugccuggaaucccagcacccaggagacugagauaggaggacagaaaguucaaagccgguuuggccuuaagagcuuagcauauaaguggucacaauucuuuuggugguuaugguaauaauaguacuuguuuuuaacuuuaagucaacauuuuauguuaggcacugggaaaugguaugccuacaugacaagcucuagauugaucuaucuucccuugcuuucuacacuauuuuauauaagggacuuaaacauuugcagauuuugaaguucagggaaaauggauauagccucugguccuccuugaauacugaaggcugacucuguuaaauguacuggugauaacacgagcugauaguauaugugucucuguucuucaagggaugcaggauccuuauaaagaaaccugugauuaacuguucugaaaguuguacauguggaguagaaauacaguacuaauccaguucugccugaugucuuuauugccagcaugacuguagcuggaaagauaauagauucugggaggaauaggaugaaagauuaagauuauuagauaucuaagagcuuaagguaccuuuccaaaaggguggugaauucuaagguuggugaucucagugguaagguggagcagugcccuguguucacaagaucaaaggugcccuaugugauuaaucugugaggcccagaagagcugagcuuggaagcacagucacauagagcuuauccaguugccuuucuggaaacucugcauuucuuuaagucaaaggaaaggcaggaucagugaggugaugaagucacagugggcagaagagguaaguacugaaagcugaggagcaaagcuugggggacgacagacuuggcuuugaaauaugaagaggucauuucuuagaagucuccuauuuaaauugaacauuuauuuuugucuauguaguaaguaucauucuguaccaaaauucuguaucuuucaauaugucagaguuauuuuaaaauuuuugugucucauuuccuuauauccugauaugaggauguaaagucacuuuaauaggcaucaguaauaucucacagaugcagaaucuugaauaaguuaaaauuaaguuaagauuguagaccaguauguuacacacaagaacagagagauuccaugaaugagggugugacagauuugucuuugcuguuucuugguaaccucaucacuuucuaugucuuuacaaaacuaacucuuccagcucagaaaagcuuuuucuuuuucucuauagucauuuuucagguguugcuugauuuuucuguuuucugaaguuuuguuuucugaacuucuuuagaguuuuguuguuuuuguguuuuguuuuguguuuuguuuugcuugccuaauucugggucaccagaaauugguuggaagaauagugcuucuuguuaugugccguguggcaggaguagacuauugucaccuuuuguuugauuugaguacuugcaauuugucaugaugggucaugucaguggguggcugguucccuggcaguacaagcauuuggcagcugcuuccucacaucucagcuaaccaagaagcuaagacagaccugauugauggucaaacucauuuaagccuuucucaaccuuccugugguuaguucucuaagcaucuuuuuaguacuuuguaaugaagcucugaucuuugagcagucacuguagucggaaaguaaauuuuuucagcauuccugcuuuuaagguuuugguguugggaaucuaaccuaggaccucauucauacuaggcaaaugcuuuacuacuaaaccaacauucuugauuuuuauuuaacacaaaacuuaaauacucguggguacuuggaauaaacuauguuaaugaucauugcauacuacuucuuccaauaguugagagcuccugggagcugggcaacauugucugggaauauaaacuaaacagauacaccagaaaaagaguucuuaaagaaagaccauauccacuuuuauuccuucaucuguccugugcuguuucucuuuugacaccaagugcaaagguuaagcuuugucgcuguacugcauccacugcugcugacuugaaguuauuagguggcggaacugcugcucuuugaugaaguuuaccucucagagauacugacauguucacuggcacagagaugcccaggacuuugaacacuaauucugaucaccuuucaguuucuucaugaaacguuccaugaauggacuaaaagaguagaucugagauaaaagaauggaguaggaaagguaacugguauauaauugagcuuguugucaacgugaggcauuugaaucacgugaagaccaaguaaagaaguuuggaaaucacggacuuugcuuuuacuuuuauucuacucagcuucccagaaguagcaggacugaguaugcauacauacauacacacacacacacacacacacacacacacacacacacacacacacacgacauuugaucuuaaaaaggcauuaguugagacaaagcaaauaauugcucauuuuguguacauuugcauguaaauaauucuuuaucugaggucccacuccuguuuaaguaguguuuaggaucaagguaucugaaauugcagaaugguuuucuaaaucuuuucuuugaauagcucaucaacacagcaaugggccuguuaugugaugggaaacuaaaauguggagaggugggggugauuccuuagcuguuacuacauaauuccuuccuggugcccccaaugaauucaacuuuguguugaccaucuucuguuaaaaacccagauuaaacucugacauuugaaaccaguaugcaaagagguauaugagcugucugucacuuagacuguuucccaguaucaaggaagauuaccaaaaagcugcaagcuuuggcugguuccuguauugaauauaagauucuagcuacuggggcuggagggauggcucagccguuaaacacuaggcucacaacgaaaaauauaagaaucuagccacugaacccugauuguacagcaagcccuugcuuuacuuuauagacauaaauaagaaugacgcaugaaggaugccuuccuaccuuucauaaaaucauuguuaauuuuucuuauauauuuaucuacauauauauuccuugcuucauuuaaguuccugaugaauucgcuaacacuuuuuuuuaacagcuaacaaaaaauuagagugagaacugguguugccagaaaaaaaauccaaagcgcucaaauguguuuacuuuaguuuauaucagucuguaguucaauuaucuuucuucucuccuucaaccccccccccccauauacccccacagagcugaggacaaaacuuagggccuugcgcugcaagcacucuaccacuaagauaaauccccaaccccuaccuuucuucuuauuccccuuuauauuuuguucuugaaucauauuucuuacugagcuuuuaaaugcacauaaacuuguuuuuguuuuguuugaaagagccuuucaccagguagugggagcacacuccuuugaucccagcacuugggaggcagaggcaggugaauuucugaguucgaggccagccuggucuacagagugagcuccaggacagcuagggcuacacagagaaacccugucucaaaaaaaagaaaagaaaaagagucuuuguaauccaggcuaaccucagauguguaaugaccuuuccaccuaccaaguguuguagcuacuagccugugguaccaucacacauaaacuuuguaacuuaucuuaaaaucauuuuuuggaaauaaaguaagaugugaauuaauaauucaccaguuauuacaacagaauuaaaaaauaacaugcaacaaaauuauauaauauacaaaagcugagucaggauuucuaguccugaaauacaugagcagagauguacuuuuugaaacacagcuuuagaauuaaggaaccaacugugaaggucaaaacuccuggcucuaaagaaaaaaaaugaaggccugaagauuaucaguuuuuucuccugcccugaauaguaugagacauauacuaauuggcuccaagccuuugaaacaguggacuguugucauuggucacugagaccacacaucucauauagauguuuuuagucuguucaaugaaaccaauuucuauucagcugucaucacugcuuggcuuuuggagacagaaucuugcuauguagcuggggcuggucucagacuuucaaaugcuaggauuacaggugugugccaccaccaaucuccaggguuuuuugcuuuugcguguguguuuuugguuuuuuucuuuguuugugguacuaggucuuguauauguaccaugcuaggcaaacaaucacuggauugcauccucagcucucaugucuauauuuauaaauauucuggacuguguaauuuauacccagggauucaguuuuggaguccaagaucaagguacaagcagauuaauuuuuguggauggccuguuguucccuuuuggauggugcuuucuuguuguauccucaugugguagaagagacaagggaguugcaagaagucuuucauaagggcacugauucuguuucugaaggugauuaagaagucacuugacaagaugggggggggggcugaucaccagcauuugagcugugggcaccgagauccauagguuuagcaguaugugugcauauucuugacuaaggcagggucagaauauuggggcuguugaugugcuuuugcucugcugggaauucaacccagggccuugcacaugccaaacagguacugagccacuccacugggugcgagcagcauaacuggcauauaaacuguguagguuuuccuuucuguuucuugugguauaaauauuuuaagcauaaaaauaaagagaauaacauaacaaacaccuaauaacaguggccaagcuuuuuacaguauuugcuugauguagaauuuacuuuuauguacuacuccuugaucuuuagaggcaguuuucuaagauuuuuucaucaguacacauuugucuauguauuacuuaaauugagaagcacccaggagauuaguaaaguacaccucuaggugugucuacaaguguugcuaaaggauugaggaaggcagagggugucacacucuuacugugccuuuuauuucaucuccgcuugaggcccagaugaaauaaaaggcaaggaggaaggagcucaacuacaggcuucccucugcuucccagccuccaggacagcucuguccccaccccagcugauagcugacauuucaggaaaugugagcuugugagcccgaccgucacagggcuaggugguucagccuugugcuuaggcugggacauaagauauggcuuguuacccuagugcuuaggcugggauguaagauaggucuuguuaccccuuugcugugucuuccccuccagcagguggcugagcugaaugcaauuguagcacagugguauaagcauagaaguuaugauuaaauagcagguaaaagggguuuuguuguuguuucugguuuuuguaauaucauacuuguauuggacacaucacaugaagaagcugguaggauugacugaacauugcucuaggugagucagggaaugaagugcguugacuaaaggacuauacauuucuguaauguuuuguucuuaggaugcaugaaauuuuuuucuucaguaauaaucuaaccuuagcuuauuaugagucauuuuacuuuguagacuuuuuuauccuuugauaauaacacuuaaaacccacauacaugcuaagagugguggcucaccaccuuuaaucccagcacucuggaggcagaggcaggagagucuaaauucagccuggucuacauagucagcucuaggauagccaguacuauguagaaacucuguguguguguguguguguguguguguguguguguguguguguguguguguguguguagaggaaaagaaaagaaaguaaacauuuuacagguguuuaaaaauauuuucuuuauaugcuaaguuuagaagcuuuuuuucuaugcaguuuuuuuuccuuuuuaaauuuuucuuucuuuuguuauuuguucuuauuuuguuaacagcuuaaggauggagugggcuggaccagaugguucaucagguuaucaaaggccaucagucaugggcaaucugaauucaagguggaaggagaaauuagaauccugcuaguugugcucuaaucuccacaagaguaccaugguuuccccuagcccauguaaccccuguaaauaagcaaaaaccaacacagucuaucagggucaguuccacauccuauccuagaagucaagcaaaggugaacugcacuaauggauuuccucuuaccuucuaugguaacagugucuucuagauucugccugauguauauuuaaaaacaaaaagcuaggucuacagaacaggacaugcuaugaacacaggaaccacagcacacugcuuaccaagugcucuauacaucauugcauuguaugucuuuuguuuuguugguugguuuuguuuuuguuguuguggcuguuuaguuuuuuuaaacaggaucuuacuauguagcccugacuguccuaccacuuacuauguagaccaaacugguguuuggucacauucagaaaucugucugccuuuaccuccaccuccuaagugcuggaauuaagggucaugcucaacauuuuuguuugguuuugcacacuuuugauugucuuuguacugcuuaggauagaacucaugguuugcuagguaagcaucauugagucacaucuuuaauccuuuuuuuuuuaaagacagaaucucuaacaccuaccauaaaacaacuauuugaaaacucugaaagguaugcuguaaagguaauuucuuuucacagaaauaaugcuucagaauccagucuaggcuaacaagcacaugagacaagaaguauacuugguuuuauucuaauacagguggagacugugucuuuucccuguugucuggaguauggccuuauagucuugaaauucgcuaguuuuaaaagaauuaaugagccgggcagugguggcgcacgccuuuaaucccagcacuugggaaacagaggcaugcagaucucuaugaaguggaggacagucaggacuucauaguaagacucugucugagagggggaggggugggaagggaaggggagagaaggggagagagagagagagagagagagagagagagagagagagagagagagagagagagaugaaauuacaaggugguggagggauuauuaguccuuaguaggcaggccaccuuugaugggggaggguaauuuuuuacagaauuaggacuuuauuuauuguccuuccauaucuucaagauuuuuccacaacccauaauuggaccucacugugaguagagaaaaucccaagaaaagcccugaguucaaacugaaggaaauggaaaaagcaguauaauacucagaaaaaagcacagaaaggccuuguuuuucuuuuuucuguuucuuuccucucaugcuaaaaaacucaaacaguucuauaguaacgauagacugaaguauagcaggaaucuggggguggaaaccauucucucugaucaguggaaaggggucccaagagguugaaaugaacccuguuugcuuucuccacugagcugcuugccuccaaacagucacucuuuagaaauuauguggcugagagaaggguguucucaaccuucugacuggauaaggaggaccccauuugcccagaaaguagugaggagaguacauuuacgggaguuggaaaguaacuccuuaaauguuuucacuaaccauucaacuugccuaugugcccacauucaugcuauucaugcacaauuuggccccaaacaggcuuugagaagcaaaguguggcuuagaccauggcuagguaccagacuagugauagggcuuggugcacaaguggagcaaaucugcuuaacauugcaaagacuuugacacuuaguucagguuggaacauagucuacagaaggcuggcuggaaaaucuaaacugaggacagcuggguugucuccacugagauaacaguguuauucuuuauauguacuuaucauugccuggauuuuuacaacaguaaucucaguaucuagaacacaguacaaaguggacagacauaugaaauaguaauaaagucaccaguucacaaggaguaagaaaaagaccaagauaacacugacauuaacaccaaaugucuuaacaauaccagagcuguagaacuaugaaagaaagccaaucauuccacagauuaauaacacagaugacuggucuuagugauuuauagaacccaguaggcaggaaggaaagaaagauccagaagagcugagcaucugcucugcacuagauuuuagaacgugugaaacaacagaauaugugcuacuuugaaugucuguaaaacguucauccagaugggcccugccugucaugggucacaacacuaaaaguuuuaaaagugauuuaaaaucuauucuucaaguaaaacaaauuaggggauaaauugaccuuaaaaaucauaagucgugucaaaauuagguagaaaaccagacauggcagugaaccccuucaaucccaacauuugagaggcagauggagugaauugcugugaguucaaggcuagccugguuuauauagugaguuccaggauaaccagggcuacaugauaagacccuguauuuaaaacauaauaauaauaagguagaugcagggcuaaggacauggcucagucuguaaacccuucccgagaacaagcucaaggauguccagaacccauauaaaaaccagggcaguggcacauuuguaaccucagugcuaggggggaagagacaaggauuccugguguuugcuggucagccaaucuaacuuaaaucugugaguucccaguuuggugaaagacacuaaaagguggagaacauuugaggaagguaaccaaugucauugaccucuaaccuacacauugaccucuaaccuacacacacacacacacacacacacacacacacacacacacacacacguaugcauaaauuucuaauguccaaaaagaaaugggcugucaccacacuucccaugauauagcaagauugugaaaggaaccaggaggaaccaggaggaacccuguauucauagucuccauagacucaccaaaaauaaaguagauaaguuuuuuguuugagacauucucauguacacgaggcugaucuaaaauuccauauguagccaagggaugaccuugaauuucugauccucuugccuccgcuccagcguugggauuagaggguuacaccgcuaugccuauuuauacugugcugggacugaucccagagucaugugaguucuaggugagcacucucccagcuaagccauagcuucacccacacacucacauaacauuuuuggugaacuaagaaaugguauaugugaaguugggcagaugugaaaagugaaguuauuaggcauaccuucagucccacuguguguguguguguguguguguguguguguguguguguguguguauguguguguccccauuaccaaaggcauauuuucugaauguucaaccugcucuguauuaaaauggcagagaggguuugaaacuccucagguaggucacagggucuagaaacaggaggcuuccaaccuccuguccagucagauucaggauguuugugauaucaguugaaugaaucaauggcuucuucagauuccucacuuccuuuuuaaagagaacuuuuuuccuaucuuuuacuagugugagcuguuuaugaucgguguugaagguguuuuuuaugucauugcuuaauuggacuggagauaaucucaugugacagcauggagcucuuguuuuggaguugccauuacuuucuagaacagccauucuguauagcugccaacaugcccuggguacucuugcuucauauugcagugauacugcuuugucaggguagaauucagccucacagggcuagagucagucugcugaccucaugccacaguacagcauguucaaaccugggagaaacccagggguuacucggcauauucuuccuccuuccuuacaagcauggaaccgucacuguccucggaaaccguauguuguauauguguguguaucugucucuuuauaaaucuccucauuacuguaguuauacagcuuuaaguggggggcugguugcggacacaggaaacugaccgagcugcuagaacuuagcacuucucaacagcaaagcucagccagggcaugugcuauuuuuagacagugaauuugagauaauagagaauccuguuauguuuucuguuuguuucacucauagcuauucggacugagugcgaggggguuuguguggcuauguaagucaugauuggaucauacuaaaguauccaacacucggguaugggagccuguuuccaugccgaauagacguuguuugggguguuucaggguaaaaaguuaccagaaaauaagcauucccuucagugaacaaaagaguuucauuugccuugacggauugggaaaggcuuggguuaaaugugaagaugccaggcaugcauaacaaauaggaauuugaguuaaagccaguuugaaauauuucucacguucuucuuuuaauaaaaggauucuuaucacugagcuacuuguuuucagagcuuuuccugugacacaaugguuuccugaauuaugaauuauguacaccucuguuaauuuucaucuuuugaucaacaccacaggacuguguaaugaacuaaacaggaagaugauccagcuuuaugcaacaucccccuauguucacauuucauauuuaguucugaauagaaacuaggccauuagauugaauuuacuaugggucgauuuuauaaacacuacauaauacuuuauagaacaugauuuuuuuuuuuaaagcaaaaccaguucuuuagagggacacacacacacagucuaaaauuaauacuguuugcuggugagcaguuggacuuaagcuccaaacagauuuuuuacucuggaguuugauacuuuaaaugcuggcuuuauuagcagauuugugccugugaucuguacucucuuuuucuguuuguucuaauucuugaauccuaaaaccuuggcagaucuuguguuuguucugaaguuauaaaaggucaguuuguuuaucaguguuuuauuaagaaugcuaauacaugagcgggagagauggcacaguaguaagagugcuuacucuuccaaaggacccaaguuugguucugagcacuuacagcaagugaaucucaacugccuguaacuccagaacuggagaaccuggcaccucuggccacgguggaaguugggacucuuauuuacaaacacauaauuaaaaauuauaaaucuguaagaaagaaaaaaagaaugguagugcaggaugagcugggugauaugaaggaaaguauucauagaagugccuuaagagagagggagacaccaucaguugcaucuuauacgccaucagugccaauguggggcagagacaugagacagaauugaaacacuucaguugccuuuaccuaguacuuccauuaacuccuaauguagagaucuuucuagaccuggggugaccuaacagaauuuagcucaguuauagauacuugcauugcaugcagaagcccuagguccaguucucaguauccccuacauacacacaauuuucugaaacauaauguaccugaguuucuuagauuagacuauauccuuaguucacuaucaugucucuuacucaaccuaauaaucuacucuggucacuaaagugaucucauugaaacaaaaauguaaauauucagcaaugagauaccugcuuccagcaucucagcuuccugacaggacuaaagacaucuagaggcuguaaacugagaucugaauuccuuucuacacuacagaauuaacaauucggagaaaaaauucacaaaaugaaaguguagcugacuguaggaaaccaguguggaauuugaagaaaggggaacucuaguagucaaugucuccagaggucgguccauucuaaagauuucugcccauuuccuuucucaguaacccugcaauggccacaccuuuagguauuauuguuaaagccacauguauaauacagacauuuuagacaauuccuugacuguaucaaaugagcuuuuucuacagaugcucaaauauuuauuguggcaacuuagaacaaguuagccacauacaaucgcuguacuuaaguauauuuuaaaguuuaaaguacaguguacuuuaaaccuaaguuuuauaucuaguaagcuguuacuuuaagugguuggguuuuuaugauauaagauuucucucacagucagaccucugacacguggaggcuaaaggucaccuucaggugcucuucuuuaggagcugucuaccuugucucuuuacaguagggucucuuccaugaaccuugaguuuaccauguaagauaggcuggcugaccagcaagcuccagaguuuggccugcuccugucucccuagcacuaggauucuauguguccucgugccuggcuuuuuuauguguaugggaaucaaacccagaaccucagucugugcaacaaaagcaagacuuuacugacugagcgagccuucuccucagcuccuuaacuuuccuuauuaacauaaaaccagggggcuggagagauggcucagcaguuaagagcacugacugcucuuccaaaggucuugaguucaaaucccagcaaccacaugguggcucacaaccaucuguaaugagaucugacuccuucuucuggugugucugaagacagcuacaguguaguuacauauguauaacaauaaauaaaucuuuaaaaagaaaaaaauguaaaaccaggucagaagauuggagaaacaaaagaggauagagguuuuuuccuaaaccaaugucuccuuugugcucagaagaggguaucacaucccuugcuccucugcaagagcagccacuguuaaccauuaucaaccagaguugagcucucuguccaucccccagggaugguucuuaaugaaauugcccaauaccuguuuaucucgugauugucccuugugggagcagugguaaauuguuuguguuacuuguuuucuuguuauucuccauugaauuaauuauauuccagauuacuucuguguuuuggggcuaaauggaggaaagaggagauaggauuuacaacuaagaacagcuuuugacauuugcaaugaggagaucugaagagcuacugaacuacuuugaaguguaaaaacuggauuagaauccuacagauaccucuguggccauguggucaggguucagucugaacagaagcauuuuucucaagacaggguuucucuguguagcccuggcuguccuggaacucacuuuguagaccaggcuggccuggaacucagaaauccgccugccucugccucccgagugcugggauuaaaggugugcgccaccaccaccuggcugugccugcacuuuuauuucuuauuaugaaauaagauucacuagaaaaguccuaaggaucuuccaauuuaggguacuuaaaugaguacauguauaugcucacacacaaggacagauuuguauaaauuggcuuuuaagauaaaguaauauaagagccagcaaguaagaacacuugauaauaagccuaaugcacaugagcaaccccacccucuuucacacauacacaauuaaaguaaaauggcuuaaaaacaguugccaccaagccuaauguccuaaguauuaguucccaggguccacaugguggaaugagagaccugacuucuaaaggaggucugagguuguucucuauacacacacacacacacacacacacacacacacacacacaaaauaaagcaauguaauaaaacuuuuaaauaaaagugauauauuucccuauggcucucagaaauagauauuuaagcuacaaaccuacauguauucucugguuauauuacuuuuagaaaacaguuuccuagggcugguaagauagcuuaauagguacccugccuugcuaccuugccugacagaccugaguaguuugauuccccaggauccauauaguggaagaagaaaacuagagaaccaaguucugcaaguugaccuuuaaccuccacauauaugggauacaaaagauggauggauggauggauggauggauggauggauggacggacggacggacagauggauggaugggucgacagacaauaaaaaacuacuuaagacuuaaucuucucagagagagccagaugucucuguaaguguguugggagccagguauagaucaaaacugaaccauggcugaggagagcauaugaaggacuuagacugaacauaccccagccuuacuaucuuucacagaaaacauuugaucucugauucaauaucaguaauugcuaacauauauguguguaguuggugccucugcagagaaaagccuuacauccagguagaguucugugcuuauguaaucaaccugcgaguucauuguuguugacuugacugcuuaggaucagccacaagagaagacaaaaugcaguuaucaacagcacacauggauuucgaauguuagucucagauuuagcuucauaucuaaguaguccuuagucuuuaaagcauuccacccccacauuaucuucaggcuccucgaguuaaaacugaagaacagcugaauugcaaacaacauaggugaaaagccuacuccuuuaaccuaaaaguagauaauuuuuaguauuuagguacauauuuuuuuauuuagugcauaugcauauaaccauuuguguaagagacuaggguuuuuuuuuuccauuacaacaauucagagaauuugaauuuaaaauuagaauuuucauucgaagaaauaacccugcuuucaauuuccauauuggagucucauucucuuacgcuggaaacaaaggccccacuguucuucacuuuucuccuucaucuccagcacuuuuuaacaucuucugaucguugcacucuaugugugaguaauccucuuagcagucucuuuuccuccaaccuuuuggcccuuaaguaaaaacuaccaaggcagaagaucuggaaacaauguggagaaacauugcagacaagguagcuuagccugagcucauccagcacaggauagagcaacguuccuuuuuccuuccuaaucccaaagaugcaugguuuuguucauagcauuuauuaaauacaugcucugucugguguugguaaccucaggcagcucacuggccuuugacagcucaccuugcuguccuguguaugcuuugucuguucucuuccugguuuuuugguucgaaacuuugauuuauuguaauugcagucaguuuucugcugccaccauguucuggagcuaaaacccagcucaucagguuugacggccagcgccuugccuguucuucugccguccugugggcccuggcucuguuaagcaccauaaaucacaguuucagagggaauggguggaaaaaauaaggacucaaaucugucuacuaggcagacuagcacacuucaaacccauuuacuuacuauguauggccuggugguuugaacuuaauguugccaaacaauagaguucugucaugugauggcuucucaagaggaagggugaaaggcuaagaaacugaucgccugguccuucauugguaauaagcucaaagaaguugacaagauuuccuuuaaguaaguugccagcuaauagcuacuuuucauuccuguuuccucuuccuucuccuuuuucucuuuuuauagcucuuuaucuucagucugcuaacuaucuuuaauauuuaaaagauguuucuuugaaauucugggguucucugcaacuuaguggcaaagcaacggugaugagguuaaguaauuaaaucaugucaugguuuuguacuuuuucccaagauaucugugacaacugauauuuuacaaagaacaaauuaaauaaaucuuuguuuccacgucagauaacauucuuauauuuuuaguaguuuucuuauuuucugaagauguauuucauacuuauguaacuaccuauugaaaaggaauuauucaauggugcuugguggagcaucgugaggcaggcuguagggaccacauguagugucccacaguaaggagaguacaauacgagcaggagcuguagguuacggauggucaugauagaagauggccaagagaggagaggguucugaaugacuuagcugggcaagauuccucccagaggcaguaagacaggacagagagccaggucagacacugaggaggauacauacccagaaaggauuucuagcugaaacuuacuuagcuaauuuugcuagaauuguauuuuuagaaaggacacagauaugccuaggaaaaaaagcucagaaagcuuugaagacucuuugucaaucccugacuggcauguucuucgccuaagauuuagaaaucaugaaauagcuaucuaaguggaguuucaagagaguuuuugucccuguaacaguaguucaauaaaacagcuuuucaugugguaaaauaacagugcacuuaaaaagauuucuuuuaugaguguuuugccugcauguauguauaugcacuauguguaugccaugccugcaggggacagaagagggcaucagauccccuggaaauguauuuacagauaauugugagccccuguguggaugcuaggauucaaaaucagguucucugcaacauuagcauaaccucugugcauaaccucugagccaucucucaaccccuuuuuauguauguagauggugcauauguguuugugacuacaugugcacaugugugaacauggauguagaggaauaaaguugaugucaggugucuucuucaguuguucucuacuucauauauugaagcagagucucuccauuugagccucaauuugucucuggcuagucuacuccaccaguuugcugcugggauuacaaguaggcuaucacacauuaacuaccuagcaguuaccaugggugggagugggggucuauggauaugaacucaagacaucugauauuugccugacaagcacuuuguccauggaucaucuccugcccuuguuaccuuuuuuuuuuuuuuuuuuuuuuuuuuuuugguuuuucgagacaggguuucucuguguagcccuggcuguccuggaacucacuuuguagaccaggcuggccucgaacucagaaauccgccugccucugccucccaaaugcugggauuaaaggcguacgccaccacgcccggcuccuuguuaccuuuuuuuaaagaauaguuuacccaugcuuccucuaaaugauaguuaccugguaguauacugaguuaugaugauucacugucugcuuuugaaagugcugcguuccuuuauuuagcauggaagauagagcuucauuuggaagauuaaggcagccuggguuccaugguuauuugcucuuucccuuguucuuaucuugaaccugaauucuuguacaugcuaccauguacucuaccauggagagacagccucagcccaagaaucuuguuuguuuguuuguuuguuuuucuuccugaagaagcugcucuacugaaacugucaaaucagugaaaugucacuugcauuggaugcuuacggucuagguucaauucuuagugcauccaaaaaagggaaggaaaagggaaaacauuuauaauguuuuuguagcauuguauauuaucuucauuuaaaauaacaacaaguaaaagacuuagacacagguuuuuuuuuuuuccuccuccaaauuaagcccaggcugaccacaaacucacaaucuuaauagccaguuauauuucugaauagcacuaauguaguaauaccauguacaguuccacauaaaauuaaguagauugaaugucauuuuaaucugucuaaagguaaaagugcccuggaccuuugagaaccuugaaaacaauugugccuugugggcuuuaggucugcagacuuccucuagucucauuaccuuaagaauauuagacucuucaucuuacuuacaaaguaaauuucuacacaccucuugauuugcuaggaaggauuucuugggaguuucccagcacuuccucauguaaggcccugugucaccaugcaggauuuauggugucugcugcuaggaaaucauucccugcagcacccuuuguuuaggugguugucauagauuaaaauguacccucuaagaguucaucugauaaaacaugauuccugggcuggugagauggcucaguggguaagagcacccgacugcucuuccgaagguccagaguucaaaucccagcaaccacaugguggcucacaaccauccguaacaagaucugacucccucuucuggugugucugaagacagcuauaguguacuuacauauaauaauaaauaaauuaauuuaaaaaaaaaacaugauuccucacaucaaauguuaaugguauuuggaggaggagccauugaaaaguaauuaggauaagauaaaauucuagugguguccucacaauggccugagcagcuucauggagaaagaacacugucagcaugcuugccccaucucaccaugcaauacccuguacuguguuagggcaucaggaaggcccugacccaagugccagugcuguacacuucugcauccagcuuccagaacuguaagcuaaauuaauuuguaucucuaucaaucacacaguuuuuuaaauuuuguuauagaaacagcacaccagauaacagugaaugauauuauaaugugugguucuuuugaaauaggcagcaccuuagcaaguagucugaaaugcuuacuauacuguacuuucacauguuuacauuuauuuuuagguaugcuugcaugugucuacauacauguaugugcagauacauguauggauucuaggcaucaaauucaggucauugaguuccucuacccacagagccucccuauacacuguuguugagauggggucucuagauaacccaggcuguccuggaacucaguauguagaccaaguugaccucaaacucacagagaucuaccugccucaacuuccuaagugcugggcuuaaacaagugccaucaugccccaucucuuuauuaguuuucaaguaucuuuuuagcuagucugaaguggucaguaacaauauuccuuuuuggaaaucuuauaacucugcuacuaagaaacaacucugucguucuccauucugaaguaauugguucuaacaguaaaagaaaaugcuuucccuguugaggugcucauaugaccauuuccagguccuugcuuuguaguuuuucuguuucccugccuacuggcugguguuagcuuuuguguaauugagagcugcugaacucaaacaaaaaccucccucucccugaauucuagcggaaaguuaauacaauuuuggacuuugagcugagcuagcuucugaggggagaacaaaagaguccuuggggggagaugcagauucucagcugacuggucccuugucuuaucccaaugccccuugacuccaaugcucuggcuguccuggaacucuguuuagaccaggcuggccuugaacucagagagauucaccugccuuuaacuuccuaacugcugguauuaaaggcaugcaccaccauacucugguuauaggaguuucugagaugauaucucacugucuauuuccuauguaaaccauguuggucuuaaacuuacaauaauccuacagccucauccucacaaaugcuauaauuuauaagauuccgucuuauaagcugggcuagagaugacucagugguuaagagcaguugacuucucucuuccagagguccugaguucaauuuucaacaaucuuauggugucuuacaaccaucuauaauggaaucugauugcuucuucuggugugcaugaagacagaguauucauauguauauaauacauggauagauaaaucuucuuuaaaauuaaauaaaguaaaauaaacuguacuaccagccuagauuuuguuuguguuuugagacauccuggcuggccuugaacucagaagcaauccuggucauuucagcuaaaaccauaggauaugucucaugcccaacacccugacauucauuuuauuaaaaacaaguacuauaguguuaggguccaagaauugcugaaggaagaccccagacucaaaugguauucaaaggcaaagaguguuuauucugaagaaauuaccaguaugcaggggucaaccauucaucaaaaugguugauggcaacaacuuguauucaaggcuaggggaauuuuccagaaggguuugguaaccucuaauaugauugguaggggcaaagcagugacauugguacaauuuugauugguugcuauguuuguuaguuucucuauauuuggugaggccuugaagaauuuuggaagccagcucaguccuggccuuguuaucuccuccagcuaggugucucgggaacugacccagcuccagacuuacccugccucaguaagggccaucauugacuaaaggcucauugucagugacuccugaggagcccaauaugcuacccagagaauggaaaucuuuauucccaagguuuuuaguccucucaauaguaagaauaaagcuggucgugguggcgcacgccuuugaucccagcucuuaggaggcagaggcaaacggauuuuugaguucaaggccagccuggucuacagagugaauuccaggacagccaaggcuauacagagaaacccugucucgaaaaacaaacaacaacaaaaaaaaaguaagauuaauuguaauguuuuggucaguaaucuaaguuuagaauguucugauaauaaacccaagggacuaugcuggggccuagcaaacacauaagcggaugcucauagucagcuauuggauggaucacagggcccccaauggaggagcuagagaaaguauccaacccuauaggugcaacaacauuaugaacuaaccaguaccccagagcucuugacucuagcugcauauguaucaaaagauggccuaguuggccaucacugcaaagagaggcccauuggacuugcaaacuuuauaugccccaguacaggggaacgccagggccaaaaagggggaguggguggguaggggagugggugggaggguaugggggacuuuugggauagcauuggaaauguaaaugaggaaaauaccuaauaaaaaguauuuaaaaaaaaacaggagaaauaagaauacaugcaguacucaggcuugauauucugauuucuacccgaguagaugaaugugugugugcugguauuguuuuccuaucguuuuagacuugggcuuaaacuccagguaccacccauguuaagugacauucugccacugaacuucucucccagacuguggauuugaauucuuuaaaugcuucugaacuauuagauggauuuuuuccccucugucuauaauguuugaaguuuuaaacauucaugacuuuauuuuauuguaacuuuagggauauuuaugugcuuauuuagcuuagaaagccaauaaaguuacugcauaagagucuccauaaggauuucaggccggggggaguggggggaggaaacgacauugaaaucuaacuuacuaauacccucaaagauaguguauuagucaggguucucuagagucacugacaaccaggaauagccacuacagauaggaagacguuucaugcuaacagaagccaugaccuuucugaauugcaaaaauauacacagagaucuauggcuacaguucuaacagguacucagccauuguccaaaguaaacacacacacacaaaagaccucacuaguccccaucuggaagagcucuuccuucauuguaugaaccaaauuuuuuacucaacauaaauaagugaccaaaaagaagagccuaacagacugaauugccuucugguuucuggcugcauggagacaacagauacgugucauaccucucgagucauauuuaaaaaauaaaagcaaauucuuuuucagggcuuccaucagggaggacucauuaauaacugauacauaaaccagaaacaaagccagaaucaaagaaaaauauugagagaagaaaucagcaaaaucuaaaagguaccuccuuuuagagcaaagaagauaacauagccagauuuaaguaauccacaagcccagccucuccaggcaacucacugauucaauucuccauucugcaaguugaauccauuaauaucuuggaauaacccuuaaauuuaugaaagaacuuuuuuauguuuugugcgccuuuguuguugauaaugaaucucauauagcagagacugaccucagacuuacuauguagcucaagcuagucuugaacuucugacccuucugcuucugccucuagaauaaugaaaauauaagcaugaucaauuacacuuaaauacugccccuuuucuauuccuguuuauuguuuggggcuuuuuuuuuauuugugguguuguuguuguuguuguuguuguuguuguauuagagcuuggugcucaccaggcccucuaucagcuaagcuguaucucuagccccuuuuaaaaaguuuuuaauagcugaguaguacuccauugugaaaauauacauuuucuguauccauuccuuuguugagggaugucuggguucuuuccagcuucuggcuauuauaaauaaggcugcuaugaacauaauggagcauguguccuuguuauauguuggaauacaugcccagaagugguauagcuggguucucagguaauacuauguccaauuuucugaggaacugccagacugauuuccagagugauuguaccagcuugcaaucccaccaauaauggauucuuucuccacauccucaccagcaucugcugucaccugaguuuuuuaucuuagccauucugauuggugugagauggaauuucaggguuguuuugauuugcauuucucugaugaauaacguuguugaacauuucuuuagguguuucucagccauucgguauuccucaguugaaaauucuuuguuuagcucuguaccccauuuuucaauaggguuauuugauucucuagagucuaacuucuugaguucuuuguacauauugaauauuagcccucuauuggauauaggauugguaaaggucuuuucccagucuguugguugccauuuugucuuauugauaguguucuuugccuuacagaagcuuugcaauuuuaugaggucccauuuguugauucuugaucucagagcauaaaccauugguguucuguucaguuuccccugugcccauguguucaagccucuuccccacuuucuacucuauuaauucucauguaucugguuuuauguggagguccuugauccacuugaacuugagcuuuguacaaggagauaagaauggguuuauuugcauucuuccacaugcugaucuccaguugaaccagagccauuuguugaaaaugcugucuuuuuucuacuggaugguuuugaaauucuuagacaaauagaacuagaaaauaucuuccugagagagguaacccaaucauaaaagaacacacaugguauauacucacugauaaguggauauuaacccaaaugcucagaauauccaagauauaauuuacagaccacaugaagcucaagaagaaggaagaccagaguguggguacuucaguccuucuuagaagggggaacaagggcuggugauauggcucaguggguaagagcacccgacugcucuuccgaagguccagaguucaaaucccagcaaccacaugguggcucacaaccauccguaaggagaucugacucccucuucuggagugucugaagacagcuacaauguacuuacauauaauaaauaaauaaaucuuuaaaaaaaaaaaaaaaaaaaaaaaagaagggggaacaaaauacucaccagaggaaauauagaaacaaaguguggagcagagacugaaggaaagccuauccagagacugccccaccuggggauccaucccauauacagucaccaaacucagacacuauuucggaugccaagaagugcaugcugacaggagccugauauagcugucuccugagaggcucugccagagccugauaaauacagagccaaccauuggacugagcacagaguccccaauggaggaguuagagaaaggacuaaaggaacugaagggauuugcaaccccauaggaagagcaauccucucuuaggauuucaagcaugcuucaugccuguuucccuaaaaaaaaaaaaaaaaaaaaaaaacauacgcaugagugaacagugaggugaauauuucucacacaaagguccugcuuuaggccggagaaacucauaugguagaggcucuuacaaccaaggcacuuugucucacaugcuuuauugguaaaaugagagucuaagaagcaagccucuuggaaaugcuuugaccagaugacaugcucccugccuuucuuucacaauccauugguugcaaguaaucacaggauuacaagggaaauguuaucuugcucaugugucccagaaggcaaggagcauuaaaauaucaaucacugggagcaguuuugcuacaaauuguaauauuaaccuuauaaauucaauacaguaccuauccagaggagaggacauggucucuagcauucagcuaauuauuaagaaaauucuucccuaauagguuuuauauuagguugaacauaauugaauaguuaaguaaauauuuaacauguuaccucaaguuuauuuaguauaugaauauaugauauuacuuaagaaaaguguuuauucucaaaauaaaaauugaaaucauagccaaacaugguaguucacaccuuuaaucccagcacccaggaggcagaagcaggcagucuuuauuaguucaaggccagccaggucuacaaagugaguuccaggacagucagggcuguuagagaaacuuugucucaaaaaacaaaaacaaaaacaaaaaaccaaaaaaaaaaaaaaaaaaaaaaaaaaacccaaauaaugaggaggaggaggaagaggagaaagaagaagaagaggaagaauaaaauugaaaucacaagagcuacugguuuugauaacagaaaauacaugcauuuauaaaaauugaaggaauagaaaucacaguggcaggacuggaggagauggcuaugugaagagugcucacuucagaaguaugaggaccugaguuaggguauuaggacccacauaaaaagucagaaauggcugccggugucuauaaaaucugcaagcuuugggucagagacagaugaauuucugggacuugcuguccaguuagccugcauuuaaaaggaggggaaggcaagcuucagguucaguaagagacccuuucuuggggaaugaggagagugacugaggacaacacagaaaucaguguugauuucuuugagacuaggaaaagcagaggaggaucuugaauacaaccuggccugcguagucauauccuuccucaaaaaacaacuuaaagauggugcaguggagcaguaggugccuaagcagaccaaacccaggccugggcucucagcaugguuuuugcauucauuauuggaucucagaauugcaguguuuucuaaaaagaagugguuucuccugucuguagugucugguuuuaggguuucaugccuucuugccuauuucuugcucacuguuuuuacuccuacucaauugucauugcaucguuuucuaaacagaggauguaaaauagagaugaagcauugagaaaguggaacugccuccugguguuugauggaaaccuuuccuuuguguuuauuggacuaagcaacccccaaguguuauuuuauugagaauuguuuuuacuuugucugcucuccucaaccacacuucacuuaaaugaggaaacaaauguuaaugugggaaaaaaaaauguccuguagcuuuaaauggaaccaguuggaagcuuuugucuuuuauaaaagaugcucacagcuggagcagagaggcagauacuaucugugaucuuugcucucacagucaaacuguucauuugcauuuaacaacccuagcaaacugcauaauugggugcgugcaggagcucaugcgcgcgugcgcaaauucacacacacacacacacacacacacacacacacacacacacacacacacgcagccuguuaggcugaagcauucuguuuauucagcacaguccucccagacgcccagauguaaggcuacagaguugaugcagaacugaacuguacauagaccgaggugggcacugcgcugcagagcauccgcuaugcaggauguugaugugaugcagcucugccugccuguugugugcaagccacugcucuaagauugaaggugagaagcccaaggaucgccuagaagcuucauugugcccagcccuuugguagaagaugcguccccagugguagcugcccucauuuacagugugcaagagugacagagucugccgaugcuccucuacaauuuggaagcuggaaaaaaaaaaaaauggagaaaucuuacagccaagagagguugugauuuguuuacagaauccaagcuuuuucugguguucacacacggaggaugggcuuugugacaagcaaaaucaucagacugccugacagggguuuuugguaagauaaauguguuaugaagaggggggguuucuuguguuuuuuuauuuuucuauaucagcuacauagaauugcaccuuaguaguauuuauucugcagaaucauguuggguggaaaggguugagcaaaagagccagaaaaaaaauauuuuugcugcuuauccgaguugugaccuucagauauauucaucagguuuucucagauaaaugugagcaauuagaaacuuggcauuuuuagagugugggaugcucgcuuacaauucugucuuuuucuuuucuuucuuuucuuuucuuucuucuuuuuuuuuuuaaugucuuuggauaguuguaauuaccucccccuacccccaccucccagaauuuuuuuaaagucugcaguggagaaaggagaggaaaaaaaaaaaaaagcuuucauccuguuacugggucauuccccuggaacaguacuaggcugagaacaugaguauagaugugaaggaaggcaugaugagcgagcggaggccugucucuggcuccuugucauugcuggucaguaucccacagugguuuaagcuucaucucuuugcccucuauuauaacugaauuuccuuucauguuugcuuuugcacauuuuucuuugccagacccaauucugucacagagccuuuuucuguuauuguuaauacacaguguucuuuaucagagaauggacagguguagaaaauagcccuagagcacaaaaccuggggcucauauaguccagcaccacaggaaaagagacaaaacaauccucaaguaguuuuuggucccuaaaacaaaauaaugaacgcuuucucuuuaaaauguagguuuugauuuuagcagacuuaagcuucuuaauuuuaaaccuuaauuuuauuuuaacuaaauuuauuuuaaauuuaauuaaaauuuaaaaagcuaaauuuuaaauaaauagaauuauuuaauuuuagcuuuuuuuuaaguuaaagaaauguaucuuuauagagaguuccaggaauaaauaaauaaauagaaaagagaaagaaggaaggaaaggaaagagagaagauuacaguagguccaugaaguccugccaggaucaccuggcucuagucccguucugagcuggguacuauuauaauuucuaaggauaaagguuuccuuuucuucacuauaacuuggccaugugugguugggaggucugugaccuauuucauugaccaagcucaaauauuguccuuggaccccuccucucaccagcaggcacagccaaguuuccuagcagcuagagugggcacagaagcuguccauugacaccugccuuucugcugacucauugguuauguaagccuugaacacagccauccagacacccucuaggcugggaaauagggacugccuguuuacucuccuugagcucuccccucaagccuuuuuguucacaugguuccuaggcuucauugcagugaauagauacacccuuuuucucauuuugaauugcugcauuuuuaaacucuaauugcaucucuccauaaugaaauucccaucuguucucuuggcacaugaaaccuucaaaaauaguguuuucucuuacuucuugccugauuaaaguaaggacuuccuuuucuaucuuugagggcucaguuugaaugccucauuauaggugccucuggacuuuccauauaaaguaggaagguuuccuuuuucuguuaccgcuuuccucaaaguacccuguucuuuucuucauggugguuucuacaguugacauaguugaguuacugguuucuguguuucugucacuugccauucaacugugagucucaagaaggcagagauauuucauucauugguaaauacccagcaaaucacacaguggagcuuacagaaggacugguagacaguaacaugcacacacaccagggugaaagcaaauagggugaacacaguguggagaaagccuaugugaugaaggugaaaagugagagacuauacauugaggcucggcgagaugggaauagauguagggccaaagaacauaagacugcagaggccacauucagauucuugggguuugcagggucuggggaauguuugagcguuguugguuugggugcuggagcuucauccaugauuaggcaaguacuguacuaccugacuauaccccaaccccaaacuuuuauucuuuauuuugaaaacuggagggcuaagcuuggcagugguagugcaugccuuuagucccagcacucuggaggguaaggccagccuggucuacagagaggguuccaggauacccagggcuuagacuguuccagggauuagacuguugcuguugugaaaccuucagugaugaucuuggggaugcagguagggcaguaguuuagaccuguagauugcagcuugucucucaucauagccucucccugagccaugcuguuacagccucagguuuuacucugucauucuaaaguucauuucugugccauuccuuauucgaggcugcuagcuugaaaggucuuuccuuauuccuucugucaaaaacuucuuuugaggcucauuucaccaucaccuccaagaagcuuucucuguuuccuuucccuuguuuugcuguguuuauguuuuugagacagucucuuuaagcucaguccacuuccuucagcuuuccaagugcuggggguauaagccugcauugccacacuugguaccuucagggaauauguuggccaaaucuaccauguugucuuaauuggaccuuccuuuccgugguaguuagguuuuauugguuagaucaucuguucuuggagaacagagauucaaccuuuauugaauggguuuuuuuacaaagaagcaaacaauaacuauaaaauuaauugaaccagguaauauggaugugugcauacauguguguauacaacccacaucuacagugucuaucacaacaccaugaugugcuucugcuucuaucccuaucugguucaauaacccugucaagacugucccacaucuuagcagaaacagcucaguuagaauauaaaauauaaaaugucuuuuaagagguuuaaaaguuaaaaaaaaaaaaaacccugaauuuguccuuuucaucauuuucuuuuaauuuauuuguaauuugugagaaaaaucaaggucuugcuauuauucaccauuuguaaaugaguggccaggacaggaugugacagcguccaugcuagcugcucuuguuccugagcuucuucuuuuccuuuccccaucauuuagaguaauuccagaaugugugcaguaucuuuccugcugguuguuuuaagcauuuaaaaugaaguaacuugaugggccuagugguuuaugcuuaccucuguuuccagccucugccacuguucugugacuuuuccugaugaagugugaauaaaugucuguucacccuagcuauaauaccaacaacaaaccaaagaaacuaacccacauucaccuugaugugccuacuuaacaaaagugugggugacgcaaaggcaguugugucacuaaaaggccgccuugcccugcguggcugacagcugacaaaagcaacaucccuggagcaccugccuauuagacaguccuugagagcucucccucuccccgcccccuccccccagugauuauuacugcuucaauaaccuauaaucuugggaagaaguucuaaauuugauaacuuuucaagcuuuuuggcccuucuaaauuuuguuagcuccucaaguguuacaaagagcuuccuuccucaaggaggguuucaguuggaggagauagcuacagugaguuauaggccaaccuggguuacagagugagacccugcccacccuacccaacuccaaaaacuaaaaaucacacaaaaaaaaaagagccauagaaguguguuauuucacuauaauaucaacgcugggaugcaaagauaagaggaucaccaagggcacccuaggcagaaaguagaaguucuggcucaagagcaacaggaaaggaaggaaagaagagaaagagacaagguuagcacagagugaaugaaaaguaucaacacuguagugcaggaggaaugccuguggcuggcuggcacucucucucucucucucucucucucucucucucucucucucucucucucucucucucucuguguuuguguguguauaacuuuuuuuuagauuuauuuauuuuguuuauaugaauacacuguagcugucagacacaccagaagagggcaucagaucccauuacagauaguugagcaaccaugucauuguuggggauugaacucaggaccucuggaagugcagucagugcucuuaaccacugagccaugucucuagccuccugugacuguuuucuaagagaccccuauaugucaggagagggaauaguaucugugucccucugucaaucaguacagguccuucacccccacaugcagccacacacuaaugugugcguaauguagaaauacaggagcaucauaggaccuucucauuucagauuccuucaaaaagacaagcauucagcuugcuuuuucagacauuugaauaauuaaaauuucuugucauuuuaauugauaucaguaugccuucccuaaaaucuucuggugccuuaauguuggugauuucuuacaccuguuagaaaguacagauaacuucauuuuaaaucucagaaaugguugugcaacuuggugagaucucaagugaagauuuauaaaaaggacuacagcuagaucagugauagagcacuggcuuagcaugugcaaggucccagguuagagcuccugcaccaaauaacugagauuauguccuuuauguuccugucugagggaaaaauaagcaaaucuagccauuauguugcaaaagaagggguauaaucaaaguaguuaauguuucuaggaucuuuaaagccacagauaaccauguucagauauagagaaaguuguuaaaacagauacaaacaccaacugcagaaguguaaagauaguuguuaaagcaggcauggacaucagcuggagauggguaaucacuuuauucuguugucuagaaaagcaacugugggacuggaaagugcuggcgcacgccuuugaucccagcacuugggaggcagaggcaggcagauuucuaaguucgaggacagccuggucuacaaagugagucccaggacagccagggcuacacagguuucugucucaaaaaaaaaagaaagaaaagaaaagaaaagaaagaaagagauagauagaugaguagcagacuuaaagagaacgaucccucuucgacaacaaauagaaaaaguaacauauauugaagauacacagaagugaacuguucaaccccaugugaaugucguucaagggucaguuuagaaacuugaugccugcaugcuaagaauauuauaggaggaaauguggcucagugggagaguaauuguuuagcuguucuggcuuugaauccuaaugcagguggaguauaggagcuauugaucaacugucagaacaaguacaaaucauccauccgcuucacagugaagugcucacgccaaaagucagaggugcacaggagagagcaaucuggccagguguacuuaagcuguuacugcuaugagaaaguguagauggauggaaagcaugauccugaaaagcuaugucuucuauacaagugcugggagacuacugguuuccuuguuuuugauaggcaugaagugugagagaguuaauggccaaauccagccucaaagugcugauacuaaacugaaagcaaagcacccugucuccuaagacaggaacuuaugcucuucgauguccugccucacacaggcagaaaaacacaagcccacaugaccaaccagcauagcuugaguuuacugcuuacuaacuauggaacauauuccuuugugguucuuaaauugaggccaagauuaugagucgcugaggauuauaauuugcaaguuuagccaggcacaguagccugaauaccuguauuuguuagcacugaagauacugaaaaaaagccgagcuacauagugacuuccaugcuagccugaaaucaaguaagaucuugucuuaaaaacaaacaagcaaaaaugcagauuugauuuuggaggcaauauucuaaaagucaaauauucaaccguaaucccuaccaccacugccucaugaauauguaaauuaagcccauacuccaauucugauucaaaagcaaagcugucucuaucucugacauaaaguauuggcagaacugugaaacuuggucugcagguguucagcaucagcuccaacaggcaguggcacaaucugcccuauaaaaccuugcccuggaaaagagcuauuuucagaagagacacacuccuaacaaagcuguguaugucagaugaauuacaaagacuuccccauuuccaucuguuuugguuuuuuuuuuuuuucuucauuccaaaggacaugauguguguuguuuaauguguagaauauaagauuuccaccagaacuuggcauugaagauaaugauaugaguccaggauugggggcaggcgggggggggggggggggggaagcugaccuuaccugaccugcuggccagguaaggcgguaggaaaaaguucccuuguuguuugccauaggcagagauguaguacuugguguauuacucucaguuggcuuuucuugaaucaugaagcauuucauucuguagaauacgcauuccaguaagucaaacacaggaagacuagcuucuaaagacagagaaggggcuaacaagaugccucagaagguaaagguguuugcugcuaagccuuccaauuugauuucaagccucagaacccacauauaaaagaaaagaaucaacucccacaagcuguucucugaucuccacacaugucccaugguacacacauauccacaaucucagagacagagacagagacagagacagacagacagacagaacuugaauaagaaguagguggucagccgggcgugguggcgcacaccuuuaaucccaacacucgguaggcagaggcaggcggauuucugaguucgaagccagccuggucuacaaagugagcccaggacagccagggcuauacagagaaacccugucucgaaaaaacaaacaaacaaaagaaguaaguggucuuuaaucacagcacucaggagacagaagcaggcgaccccugacuuugaggacagccuggucuacagagugaguuucaggacagucagggcuacucagaggaaccuugucucaaaacaaacacauaaacaaaaacaaaauaaauaauaaauagauguaauuuaaaaauuaaacuuagaacauuuaacugucuuuucagaggaccugaaugugguuccccgcauccacaucaggcaacucaacaaucacuuguaguucuagcuccagaggaucgaaugcccuccucuggaugccacaggcagcugcacucaaaaaugugcauacccacacauauaggcacauuaucuugaaacguaaaauauauauaugacacacuucccacaacaaggccacaccuccuaauagugucacuucccaugagccaagcauauucaaaccaucacagaggcacagcacuuauuaggcagagacgugugguuaucugugaguuccaauccaacaaggucugcauaauagggugagaaacaaaaggugugacauuuuuaaccucguccuguugggauccagucuaggagcuaaguccaaagcagugaucaccugucauuuuuauuucaugcuauaugucuuaggcauaaucuaacacuccccugguguauguucuuguugggcucaagccccaggaccucucuuggaccaaguaguacucuuaauacuugcuguauauauccaguccccaauuuaauauauucaacaucuuuucagaacagucuuagggaaauaaacugagugaaaaacuuaagcucugaaaggacacaugggcaacccagagucacaacuggugaauuuggaaaguucauagugaacucaaaccauuguucuuugcgccauguucuggaauauugcugugugcuauugugucuuccugucucugccuuuugcccuuagauguuaugugugucugucuaucucuugucugcccugccuaggauuuccaaagucuuccuuguagcccaggcuggcuuccacuuaaaaagcaaucuuuaauauauuugcaaaugaaaacuugcaaagcaguuaaaugcuuugucagguacuaugcuuuaauugacuucccucugucccucaugaaucuuuucacauuuucuuuuaguuauuuucuggucaguuaacuucuaccaguagguaauuuuagucugauuucuuaguagagagaaacaaauauauagagcagugugaccuguagcugcugcacaggagccgauuugcaaugacaacucagagcagcagagaaaaauacagcaggugguuaucugcugccuccuccugucugcugacagcuggcugggggagaugcuuuccugacauuguuuagagcuuauugugaggauuguaagguuguuugaccaugggcuaagccacaaagccaacuuucuuucucucucucucucucucucucucucucucucucucucucucucucucucucucucucucucucucucucuggguuuuugagacaggguuucucuguguagcccuggcuguccuggaacucacucuguagacuaggcuggcaucgaacucugaaauccaccugccucugccucccaagaucuuggacuaaagguaugugccagcacugcccagcaaagccaauuuucaaagugugaccuucacuauagaauuuuaccuuuguucuggauucuauguagcuugcuuagaagugaguaugaucuggaaucuacuaaugaugagaucuuuaauaagaacagcucacgagcuauuucaguaauagccagugccaaaagccugcucugccaggagcuacuacagcacuuucacacucaugacuaaucucauccuuaaaacagccuccugacuguucccucuccuuaccguugagcaacuuauggcccugucagugcuucagggcagaguaugucagucaucuugcucuuucacguuuaugccuuucaagaaauucuagggcaauaccacugcucaggaaguugaggcaggagggcuauaaguuugaggccagcuuagggauacuacuaucaaaauacuuuauguuauguggcucagugguugagugguugacucaggguuucauccucuguucccccuuugguagagguauuuuuuaguaucaccuuugagaacuuugcuucacauuuggaacugaguugccuggaaugaguuagggauccaguucuguauguuaccuauauccagcggcaaaggaacugcuuuuugacugauagauucauuucucgaggccagguauucaugcuuggaguacagacuucccuuuuagaacuugguuccugcuccauuucugaauuucuccccuuuaaaaauugauaccuucccaaauuaggagauauuacugaauauugcagugacuuucaguuucuaaugucaacuggccuguuacagguguguuugucuauguuggaacucuucauaggaagacacacuugcccuggguagaacaggaauuaaagagagucuguuuuauuuaguuauuuuauagagaaauagaauucuaaccaaaugugaucauuuauaaacauuuguauaauaaaaauuauugauuuccuuuuaaaugguugaaccuugauccuugucucuaacaguuuuuauuuuaugugcaugagugcuuuaccuuuguguuuguaccacaugcauguccagugcccuugaaauggcacauacuaugacauuauguaaaugcuaggaacugaacugaggcccgcagcuagugcucuuaacuguugagcuaucucgccagccuucuccaacaguguuuucaccaguaugaucaauuucuuuuuuuguuuuuuuguuuuguuuguuuguuuguuucgagacaggguuucucuguauagcccuggcuguccuggaucucacucuguagaccaggcuggccucaaacucagaaauccgccugccucugccucccacaagugcugggauuaaaggcgugugccaccaccgcccggcugaucaauuucucccucccccccccccccccccccccgaucaauuucuuuuuuguuguuguuguugcaugagagagaggugggugggggggguuaggacaacuuuaugggaucaguucacucuuucuaccauguguguuccaggaauagaaguccgguucucagacuugacuacaguaugugucauuacccauugagcuaucucccuagacccugauauggcuaguuugauuucacagauucauaaacuugaacacagggaaagcuugguugaaaauucuucauaucuucuguggaauauauguguuccauauauucuguggcagauuuugagcuuaauuauuggacauagauaagcagaaugguauuaugcacuuuaguuauaagauguuaaaucuugggcuagagagauggcucagugguuuagaucacugacuacucuuccagagguccugaguucuauucccagcaaccacaugguagcucaucaucuguaaugggaucugaugcccuuuucuuguaugucugaagacaguuacaauguacuccuuccuaugcauaaaauaaauaaauaauucuuuuuuuuuuuuuuuaaaugcauuccuccauagucucugcuucugcuccugccuuggcuucccuugaugagggacuguaacuuguaagcuuagauaaacauuuaauuaaaaaaaaaaguuuaaaucucauucagaaggaaaauccagcaagugggagcuuaugcagcuagauuugcauacacacacaugcaaaugauuauauagcaacaacaaaagaaagaaauugcuuauucugaugaaaguggagaaggcuggagggaugacucaacaguuagagcacuaguuguggaccuggguucaguuccuauagagcaagguguuuucagaauuuuuacugcggcucuugacaccuuguccaucugagauucuggcugccucucccuucacagucucuagccacuguguuccucaaaggugaaucaguauuguuggaaguaaugcaaaaggcauuguacuagucucugucaagggugucugucucuugcuguguuggggauggaaggcagggcucuuccacugaucuguuuuccuaggcccaacauuuaguuacauugaaauaagaagaaaagaauacuguuggcuuuuuguucucccccauccuccaguauuagucaucacacccagagcuucauguacuaggcaauuacugaaguauagcccuagccaauaugauugaacuacauauauuuauaaaagcucagaggucaguauaaauccugcccagaugauaaaaugaggcucuguauaucuaagaugagagaggauacuuugagacaacagguuaacuauuggcauuuccuggguauauaagauaaugaacauguagggguugaccucuguacaguucuuacuggcacauugucauaggacaaacuauggaacagaaccaagaaaacaguauuaugaccuuagucuacagauggccaaguugcaaccugacccucacacugggcauuuuuuuauugcccuaagaggcuauuuuauauuacuacccuuucugcuacuacucuaaagagcaguuaauaaacucuuccuuggauccuacucuaaaugaccaagccacauacaggggcacccuccaguuucagcuaccugcuuugacauuuaaguuuaagcuuuugcugggcaguaauggugcauuccuuuaaucccagcacuugggaggcagaggcagguggauuucugaguucgaggccagccuggucuacagagugaguuccagaauagccaggacuacacagagaaacucugucuugaaaaaaacaaaaaaaguuuaagcuuuuaagucugagcacuuguccuuucuuccaguccuuguagugacucucauccauaugaaagaacagugugugagcuuuguaguuccuuuccuaaagcaagcuuuuuauuggauaaaacacaaaauuugggccccaaaagaucugaccuucgccugugauuuguuuaaucacuuaccuuucacugucccuaucuauuccugcugucuuucuggguauaccacaguuauuuuaauucaguagcauucagcagcauauccucugccugucuuccacugcaacaaaaugucccaagaauagagaaugaucucacuacucuggguuugacuuaugcaaacaaacacugugauaacaauugggugcuuauaucuccguaucaacauagcauucuugcuaaccuuuucaggagaccaauuugugaguguggcucaggauggcugauugugucugagcacuagaaugguuuucauaguauuacauugaaaaaugacaugcuaucuuacauagauuugcuucugggcagaaguaugcauaggaaugagaauuaauucauucucucaaccaacaaagggagcuuuguuauuuaaagaaauccuguauaaagacuagccaagagggcagcagggcuuuuacaggacaaggggaugugcaggucacccaucugugcugagaauucagcauagacauauuuucagcacauuuuagcacauugauucuagacugcuucuaauauccaccucuuguuuuuaaaauguuagaucgagcguuuggaaguaagcagccucgcccagacuuccagugccguggccuccagcacugauggcagcauccacacagagucuguggauggaauaccagauccucagcguacaaaagcugccauugcacaccugcagcagaagauccuaaagcucacagaacagaucaagauugcacagacagcccgagacgacaacguugcugaguacuugaagcuugccaacagugcagacaagcagcaggcugcucgaaucaaacagguguuugagaagaaaaaccagaaaucugcgcagaccauucuccagcugcaaaagaagcuugagcauuaccaccgaaagcuccgugagguggaacagaaugggauuccccgacagcccaaggaugucuucagggacaugcaccagggucugaaggaugugggugcaaaggugacuggcuucagugaagguguaguggacagcgucaaagguggauuuuccagcuucucccaggcuacccauucagcagcaggggcugucgucuccaaacccagagagauugccucacugauucggaacaaauuugguagugcagacaauaucccuaaccugaaagacucauuagaggaaggacaaguggaugaugggggaaaggcuuuaggggugauuucaaacuuucagucaaguccaaaauaugguagugaggaagauuguucuagugccacuucaggcucaguaggagccaacaguaccacugggggcauugcugugggagcauccagcuccaaaaccaacacccucgacaugcagagcucaggguuugaugcacugcugcaugagguccaggagauccgggaaacccaggccagacuggaggacuccuucgagacccucaaggagcauuaucagagggacuacuccuuaauaaugcagaccuuacaggaagagcgguauagguaaguuaugcaaaaucuaaagccuaaaguauuuguucccuuuucuuugaauaugaaaaagugaauuuuaaagaugucugucucuaaaguguucagaucugucuguaacagccacaagaguuuuucgucagucagcaaagcaguuaaacaacuccuagaucacacacagaugcaacauuucuuaacuucucagucuuuuaucccaguuuaugacuuuaacgcgaagcucaagcuuucugagguauuucuucaguucacugagaugaugaagcauagucaguugaagcugacuggauuguauucagaacaucuuaauccugagaacuuuguaaacuuuguaaaaauacagcccagccaaaauguagugaacuuuguauguauuuggccuuaaacauacuuaugugagcaauuaguuuagaaaaauuagauuagaaguaaauccagacaaaugucugugauguuuauaaagaacuggcccauuuggaugagaguagacagacauaacauuaagucauucuccugcaguuagaaaguguucaaagagcucagagcuuuucagucagaaucuauaccaaaguugagagugggucuguaggauggagcccagggcuuuauccaugaccauccuuccuauacugagucugguuuuucacauuguaucauagauuccugcuagaccacucuuagcaagucuccaaaaccuugcccugucuuccuaguauagacauaauauccuccccagagaaaucacucagauccaaauuugugggccaaacacuggcagccuccucaugcagaucaauaaacaguguucugagagcugcuucucugcauauaaagccuuacaagacuugaguuuuagucugucccaguuccuaaguagaaggaaucuccaguacuuuacuaagacaucaggguuugaacagaggaagucucuuccaccucuugaaaaguaaaagcaauguuuuaaaacuuuacuuuuaugaggugaccucagugucugaaguaaauuguucauguuuaucauuuggcucuaaagauaacaacaacaugcuuguuucagaugguauuuaaaaaaaaaauacuaagcagcaauccagucugccuccuuuuguaaucuucuugaauucucauugacacuuugagaggcagggucugaggcucaguugguagagugcuucccuaacaugacuguaucacaggauaucucucuaauuccagcacuugucugcugaaagcaagaucaaaagcacuugcugcucuucaggggacccaaguucaguucccaguaccuauuucauguggcuaacaauuaucuguaucuccagcuccagggguuagccaucuuuugucuuuuauugucugacaugaacaaacauguggcagacacauagauaacacaaaacuacaaauaaaauguguuuguuuguuuguuuguuuguuuuucuuuggguuucuuguuguuggguguuuguuuguuuguuuguuuguuuuggagacaggguuucucuguguagcccucacuguccuggaacucacuguguagaccaggcuggccuugaacucagagaucugccuccugaauccugggacuaaaggcauacaccaccaccacccagccuccuuaaaaaaaaaaaaaccaaguucauccauaggaaauuuggggacaaccaggaccacaugagaccuaaucuuaaaaaauaaaaguagacauuuuaaaaagaggguagguaguggcagaguguuuaccugaccaccaaaaagaggguaggaguacuacuggcaagguaguccagcagguaaaagcacuagcugccaagaucuaaguguagcucccauaaguugucauuagcaccuuugcauacacgcacccacacacauacacacuaaauacaauguaguggguuuuguuuuguuuuaaagauuuauuuauuaauuaaauguaaguacacuguaacugucuuuagacacaccagaagagggugucagaucuuauuauggaugguugugaaccaccaugugguugcugggauuuaaacucaggaccuucggaagagcagucaguacucuuaacugcugagccaucucuccagccccauuuuguuuuuccauaaagaaaaagacuugacaauggugaaaaaggaguaaguuuaggaaaggaaaaaagguauauguauuacuauuuucaucaguguuuucuauauuuaauagccugggaaaauaguguuuaaguggacugauuaaaauuaagacacugguccuuuuuuaccauauuaaaccaaaauuccacuaccauuucuguuacuagcugugaaaaaaagauuaacaucuguguaagggcuuccugccuauaucauaacaguagcaaaggcccugcaaaaaauugcuacaacacugaaaugaaauagugugugaagcuugcaagccagugcuggcccccaaugcugcagugaugucagguagccacugcugcugagccccagacccacccuccagaggaccucuguccauuauuuaaaaaauuaauuauuauuccuguuauuaaauuccucuaggacuuaaaauucauuuagagauuauuuuuuuucaaguuagauauugaccacugugagaaaaggagagcaacacaucuggaaaagucugccuuuguuugucuauuagauuaaguccgagaugggucugucaucuccucucagugccuuaggauugugucucagccccucgugcacaugaguagcauucucccuuuguuguacuuugggaucucuggaguagccagguuucaaggaauagaaaguaaagaagccugaacccuguuggauguguagucucccucugcucuccucucagccucacaaugauuuuuccuuauaacaaaauccugaaggcuccauuugaaaaagccacaauaugagacuccauuuacauauuuauacacacagacacacucacacugacaauugccuaaaaacagcaguaaaaagauuggccuucuuuguaugucuccauuacagcaaauauauuuguuuagcauuguucaucuuuuaacaguuucacagaaaugacacucuucucaugaaugaaaaccuguuuuagacaccaaaacuuuuccaauuuuaagcauuuuuggagacauuuucuaguaacacuugacaaaauaacccagcugagugaugauagcugagaagagaagcagugcagccaggagugcucugggcugacagggcuuaugugguuauacaugucugcagaaaaugcuggcagccuuuuguuuguguguuuguguucuagcuugucuucuuuacauaguuucucuccauucccuaccuguuccaugcuacacuauuagggagcugccugcagcagccccuaauuuguuuuguacccccuuuggucuuguacaugcuagauaaguagucuaccauuaagcuacaccccagcccauauauuuauuucuacuuuguugcaagcuuggauugucuaggaagaaaguacaggugaugggugaacuauaugaccaagaauuaauuaacuuggacauggcugcugcauugucuuuuguguuucugugcuuuauccuaccagcaccuaagcaggucagcaaccaguguuuuagcuuggaugguaauggggaggaggaggaggaagaagaaggaggugguggcaguggugguagagguagaguugauaaaacuaucacuuuuagaauuugcugaacugcugugaugcacauucacuaacccucccagcaacuugcagguaggcuguguuaucccauuuuacagucaacaaaauugagauccaauguggggagguuuuuuguuuggugaguuggcugucuggcuuuucaauacagaguuucuuuguauagcucuagcuguccuuaaacucacucuguguguacugggcuggcucgaacucauagaucuacuugccucugccucucaaguugcugggaauaaauaaaggcauguaccaccucacuagaccagugugguugguugguuuguuuguuuguuuguuuguuuuuuaauuugcugaaggucaacagcaaagccaagacuuuaucucaccuaaaauccaguguucuauaacagcacacguuguuuuucaaucucaacccugcuaucugugauugaaugaccguuguaauuuugagacgcacugaugacugcucuggaugcuagcaggcuuucccagguuagaguguguguguguuuauuuaaaggugagucgcuauuuugaguauauuauagaauucugugaaagcuaauacaaccaaaacuaauauaacaguguagguagugaaaucuccuugagacccuggagcccucuuccccuucagagccauucucaucagugccaccacuugcuuccacgcuuccacuguguucugccccugugaacuggagauaguuugcuuaacucugccaguaaucagauauuccggugccucugucucacccacacacuugugccugacaggcugggcagccaugauagcaaagccuacaucugggcucugcuucacccuuugaaaggaauuaguugugagucuuuauaagcuuugcaccagaccucuuuuuuuuuuacauauuuuucaugugcauugguauuuugcuugcauaucuggguuuuuuuuuuggggggggucagcucuucuggaacuggacuuacagacaauugugaugugccauaugggugcugggaauugaacucugguccuuuggaagaguagucaacguucuuaaccacugagccaucucuccaaccccuauauaggacuuuaaauuaugagugagauccgugaggagaaaggaaugagguuuaauaaaguuuuaagugaugagagcccuguggacuucauauuuccuuacccaguucccuuugucaucucucuaaaguuuuaguauagguuugcuaguggcuccuggauucaaagcgcuacucagagaaggggcuucuguaugugguugaaccugaugacacaugcaugcacugaggccagaaaagacaaaugguuucaccaugucacccaggaaaucgcuucacaugcacguaguuaccaguagcaacugagaggucuaggcuuguuccccgagucaguauauugguuagcagacuggugaagguuaggcucagcuauagcaaaugcacugacaguaugaaggauagaaagcucuccuguagaacuccuggcuguguuugcugcugguaugagcaguuguauagagugggcagagguguugaugagcaguagugcaauuuaaaaagcuucuauuuugaggggauuacuaugcuuuggaaccagcuucugagacuauugguauuaaggccaaggauauucuauaccacacugagucacaagggcaaagggagagggagaagcagcaucacaugcaguagagcauugaguaacguggcugacccagucaggccaggcucuccuacacuauguuauguaacuuuuauucgccugaugucauugucaucucugagguuuacugccuccucaaucagcuaaccuggaccuaguccugaaaucuuuuagccucuguacaauguaaucuaggcuuugaauguuuucagccucugagacuugcuacugaauaagcucacccuuucaagcucuuucugucagguucagcucagcuagcuguucuggcuccagcuccucuccaaacugaugaauucaaucuaacuucucucucaggcacugacuaaauugcucugcuuggccucauacuaacugacaaucuguucuaaucuucuggccccuccucauucucuggcucauucucuuuucaccagugucuagcuuguucacuuuucaaccugucuguaaaacguucccuucucuuucucuucugcacuguuuccucuuacauugucucucuuaccucucacuucucgugagaguugggcauacccuauucuaucaaaucuuucaccgauuugucacuuugucugccacucaauuagauaucacuuaaaaaacaugaguguuuccuucuacaaacuaacuuuaccuucauuaugugggauuaaagguguauacuaaaggcaugucuguauuccagccagagggauaaagguggaugcuaagacugagucacaacacaacuggaaacagguuuuucgaguaaauaacacaaucucaggguucacagugugaucaguauuucaacauaacaauguaaguggugguuuaagcaugguuuuacugucauuggauauguucacauguaguuguuuuaacccccuuucaacuguuaaucaacugaaaauugaucagcaucucuagaguugugggcuguacuuaaacaauaacuuugaaauagaagccaagauuauuggaaucggguuagccuuuugcuuuaaaaguguguauguagaggaggguccuaguucagagauauucuuauaaaagguaagaccugcuguguacaaagagauucccagguguguucuuccuagcuuagucauuaaagaguuauagaggaggaguauggaaagaaaaaagaaauuaauaauaccuauuaauuaaaucaucagaucuggacaagcuugccaguucugauacuucuaaauuacauggccuugaguagaucauacaauucauuugagcgucaguuucucugccuaugcaaggugauauuuauuuaaaagugucauaaccauuauuaaauggaauggaaaggggaaggggggaccauguacauggaaacaucuuaguagggugcuugauuuaaguagaacucaguguugaggguguagaugaaugguagaauacaugcuuagcauauuugagaccccaaaaccaguuaccaucaauaccacacgcaucaccacgcuagguguucaauaaacaacuguguuuuuuuccaaguguguccgaauugcuacacaguuggcauugccugauauccaaauugccagaaucccuauguagauuucauuuccaaugcucuuugggcaccucuuaucuuuguauuaagaaaaauuaacuguuuaaauucuuaagggacuaauauugugcucugcucuccuuuuugagacaaggucucacuagguagacuagccuggcugaaauuuucaguuguccuucuucaguugugcaagugcuaggguuaguaguucacuguugccuagccuccucauguacuugagcacagugaagucauaagacauauaccaaauuauccauuuccccagcagaggcugcaauuguucacauucccgcauuucauauuccauacucagcugugacucccaauucuggucaaaccuugucagagucuaccugugugucccaaaugcauuugggaaaugguacaggaguuugcucccaagauugccugccuauuugugucaguucgugugucucagaacuugcuccacaaaccuuaccagacaucuguucuacugaccucuugucuaaccaaaaaagccccacgggcucaccaggugacuccagauuuuugagccacacccaaaaaagcuuuagauugaaguucccagccuaggcauuuaccuaguuucuuuuucauuagaaauuuaacccagaagaaccccugguuuaucuuugaucaaggaagaugcuguguugcccauuccaaagaccaaaaacauuuacuuccaacaucaguaguuauuuaugaauuauuuaccuccacagaaucuggacauagccaaugcaguuuuuauuaccagcaagggaugauuucagccugcuuuaaaaaccaagcugcacucaagaggcagaggcagaguaauggcagagagugaguuccaggauagccagggcuacacagagaaacccugucucgaaaauccaaaaaaaaaaaaaaaaaucugagucagcucgacagugguucaagucacacagucacagugagggcugaauguggcucuguugacaugauagcuuaaagcuugaccagaagagggcugaguaagaguauagacagacucagaugggaaagauaaaaucaaguauuaacaaaaauaaaacaaaacacccggcuggaagaaccauuauguuccauuagugagaacuuuaaaaaguuauuuaacaaagaauucccauaaagccuauaacaucacuccaggugcaugugucagagaaauggaacuucuuuguacauaugacaugaacagggaugaacuuauaguaccaugugacaguguccuagauauuuccagauucuguauccuaaagugcuugcaacuugcuguucaguuuaguguuucccacuguacuugauacucacaggauaucaggauaugaagcaggggcuaugcuuuuccacuaccuguaccuaauuccuaagcccugacuuuugccuucauccccuaauguggcuacuacagacuguucacuugggaagcaaagugcccaugaucuuuucauccuuuuuccacauguuaaauacacaggccacauacagaggugcacacgcguaaucccagcacuugggaugcugaggcaagaagacugugaguuccagaccagccugguuauacacagcaaguuucaagccagaccgggauacacagugaaauuguuacacuuaucuaaaacaaaacaaaugaaaaacauuucaaaggggcuggcacuguagcacaguugguacagcaggccuuacccagaaugcaugaagccuuucagguccaucuucaccacuacacacgcacgcacacgcgcgcgcacacacacacacacacacacacauugugugugugaauaguaguccagugauagauaucuggggacauggaaacgacaucagaaggguucaaaguuauccuugguuacugcgagguaaaaggccagccugggcugcuugagauuuugucucaauagacaaauggaaagccaaaucauuaaaaacaaaauauccuaaauuaugaauuauguuauccuacaagggcaguugcaaggcuugaagcauucucuggaaggagccugugauuucuaauuuggccugauggcaucugcuuggccccacuguccauuccuagggcaaaaucaacagcagagaaagcaucuugccuuuaugucaagugagguguuaugccugaaaucccaacacacagaaggcugggaaaggaggauagagcauuuaaggcuugggcuacaucauuuaaggacaagcagaauugugagacugccucuaaaacaaaaacaauggcauuuuguuuuuuaccaacaguaucuggugagagauaccauaauuuauuuguuuugagacauugucuccaagcccugaaugccccauguaguagaggaugauuccugaacuucagaucuguccuccucaguguuggguuugcugguacaucacagcucacccagucuaugugguacugagcugggaacccauggcacugugcauucuggguaaguaagcauucuauccaggaagcucuauccccagugccagaaaugguuuuuuaaauuaguuaguuaauuuuaauuauguacuaugcacauguagcugagucuguuuaguccaggguuuggauucaaauccaaucuuacaacuuacuagucugagacucugucaccugccaugcuauaaacaagaaaucucccuauuucaaagcaaaaucaugucacuaaggagacagcugguaaaagccuggagaggcaguccaagcuacaagacugcacaggcuucaauacucuuauuuugugaucuuagucacucaaaaaaucccuaggaggggcaguucaaaaaaaacuucuuggguugccaggguggcucaguaggaaaagucccugcuacuaaccaauguucuguccuagaacucacaugguggaaggaaagaauaaaacuauagcaaguuguccucugucccccaacuacaugcagguggcaggugggccucucuucgaaauaaaguaaguaaauguaacagcagcagcaacaagacugcuagcugacuuugucacauggucuccagcagugacgauacuacuuacugcucacuaguucccacacagaauuuuuuggacccuaagucuucauuucccuccauguucucaauuuuaguuaaaguuuucacuguuuuuaguaacugaaagguuuuucuucuauuauaucacccaaauggacuacugggcacauaacccucucaaccuucaguuacuuauuuuucugcagcacacaaagcuuuugaauuuagagugaagcaagaugcuguggacaaggcugacaaggccccagaaacuccuuagccacaacuaaccagugugaguuuaccuuuucacaucaaacaauuaccuggaaaaugaggacuucuggaaaaagaacagaaaguuucugcuguuauuguguagcugaaaaccuacuaaacuuguaaaacaggugcuucuuauuagcauagaaacaccucuaaucugcaggaagcaucaagggaggaaaguucauaagccacagagagcauugcaaacuccuaggcacagagaguuuggccgcuuuguuggugucuuggaaugcagaucuccuacucagaucauugcuuuguuaaaaaacaaacaaacaaacaaacaaaaaacaaaaaaaacuuuuccaagcuaggugucuguugcacaccuuggggaaggcugaggcaggaggaucauugacugaggcaggacagggcuacagagcaagacuauugugauaaacaaguacgaaaacacaccugaccugcguuuuucacuggacuccaggcagcugucacuaagcuuuauucacaccccuacuuccugcuuuuagauuuauuuuauugucuguauucuuuuucugaguuacuaaucaaauucaaagucuguacaacaaaggaaaggaacacugcaucagcuagcucccucaccugaccauucaauugcuaaggcccaaucagcagcacuggcacuaacacgguuacugacacagccucagcuaagguucuggucugaaacaagcuggcccgaagagcccagcagaaaugcugugcuauucucuuuggagggggagugagugugggggaauucaagauucaaucuaaucuacuuauucaucaugagcaccaaaacuuccaagugcuggccccugacaguaacagaaagguuaacucugaacccuucacugcagggucugccuccaagcacugacauuuacaaagcuauuucaccaacaccuucauucccuccucaauuccacaaguaaggaaauaggaggcccaggaacuucuuaaguuucuuuaaauucuuuugugaggugggcaagugucugacccaccuugccaugccucaguuuguuuguuuuuuugguuuuugguuuuucgagacaggguuucucuguguaguccuggcuguccuggaacucacuccguagaccaggcuggccucgaacucagaaauucaccugccucugccucccuugugcugggauuaaaggcgugugccaccaggcccggccgauuuuuuuuuuuuuacuuuuuaaaggaccuuguagaucuugacuucuuaucuaguuucaaaauggcauaacaguauagaguuuuaaaauguagguuuuuaaaagucaaacuuggauucacaucuuuccuccuucacccuguggcuuuagaagauagcucuaggaucucugaauuuuaacuguuucuucugaggagaagauaacgccucccaccuuccaggagcccugauggguuugcagaguagugucugaggcagcuguagcugucugcuguuuccagucugcucuucaagcacaugaaccacauuuaauucacaauaaaauguucuagcgaucuuuuugaggggcugggggagggggacaguuguaugguuuuuuuguuuuguuuuguuuuguuuuguuguuuuccaaggcaagucucacuauguaacucuggcuguccuggaaccuacaauguagaccaggcugaccuugaucucacagugaucuacuaccucuaacucccaagugcugggauuaaagucaugauucacuacacccaacacccaguaguauauaaacaccagaaaguaugugaaaugggcugugauucaagagacuguggugcagcccugucaccaugcacccuacuagacgccaccacccuguucccuuccuagcuccaauuacugaccaugcccaagaauuacucuggcuuuugguuuuggguuggacccagagcucacuaaauauacauuaccacugagcuuuaccccggcaagaccaggaguuaguaucguuuuaaggggcuggagagauggcugauggcucagcaguuaagagcauugacugcucuuccagaaauccugaguucaauucccagcaaccacauaguggcucacagccaucuguaauaggauccaaugcccucuucugguaugucugaagacagcuacagugugcuuguauaaauaaaauaaauaaaucuuuuuaaaaaaagaauacuauuuuaaauuucaaugcccuuuugguaaacaaaggcaaugaagaaagcuacacauucaaaauaguagacuauuuaauagaguguucaccuaguauguauaaggcucuaaguucuagcacacacaucguaccaaaaauaaauaguuuaaaaacauaguauauuuguaaaaccuuacagucucugaugaauuuaaguuuuagcagaucacguccauagcugacaccugucccagaaucccugagacgaugagaagaaaaggcagagguccacaagcauagggggugcuguucuauaacagcaggauggaaagagcacaacagacguucugucgaggguaaagaaggacuaaauaggguuuaauaacaugauaaaaugaucagauugauuauuuaaauuaaaguuuauuucuuuuuuuuaaaguuuauuuauuuauuauauguaaauacacuguggcugucuucagacacaccagaagagggcgucagaucuuguuacgggugguugugagccaccauaugguugcugggauuugaacucaugaccuucagaagagcagucggugcuuuuacccguugagccaucucaccagcccuaaaguuuauuucuuaaggaguagaaguaaauagaauauaauuauuguuuauuauaugauaauuaaaaagggauaagagaauagaguggugacucuggcuaagaauauucacuaugcaagcuuaggagcugaguuuggauccucaacacucaagugaaaaagacagauaugaggucagguauggagacacaugccuuuaaucccagcacucggggacucuauaagguccagaccagacaggacuauauagugagaccuugucucaagaaaaaaauuaaagaaauaaaaaauaaaaggcauauuuggcugcauaggugcugucacccaagcucuacuagaacagagacaaaagaaucccagaggcucauugguuagcugucuagcugauuaaugagcugcuccgaguccagagaagagcugaaugugacacccaguaucuuccucugaccuucacauauguguucucauggacugcuugcuacagacagacagacccacauucacauacacacaugcaaagaugcagagacacagagaaacacagaugcugcaacauaaaauuaucuuagagaaauuuuuguauuccuuaaaaguggauaaacucgccaggcaguggucgcgcacaccuuuaaucccagcacuugggaggcagaggcaggcggauuucugaguucgaggccagacuggucuacagagugaguuccaggauaaccagggcuauacagagaaacccugucuugaaaauuaaaaaaaaaaaaaaaaaaaaguggauaaacucagccacacauggugauagaugccacaaauccuagaauucauagauagagacaagaggaucacaaauucaaggccauccugggcuaaaaagaaauacaaaacuuuguauaucauaggugugaguaguaauaagaguaagguuguagcuguaguccaguaauagaggccuugccaggcaugcauagugauagcuuccuuccacuguacgaccaaaagaagaaagaagagaagguaggagacuggagaaaggaagaaaggaaggaaaggaaagaaaaggcaagcaggcaggcuuacauguauguguaugcuugugugcacuagagauaauaagaugaauaaaacuagccuuccucccaggaacauucucuguuuucauuuuguagcuucucaggcagacgccagcccuuacauaugccaaauaugauaguuugaauaggaaugcccacaguagaaguguguuugaauacuugaguggcagggaauggcacuauuuaaagguguggcuuuguuggaauagguguagucuuguuggaggaagagugucacugugggguuggacaaugagacccuccuccuaacgacguggagccaguauucuccugucugccuuuagaugaagauguagaacucuuagcucuucaugcaccaugcccuuggaugccuugacgauaaugaacugaaccucugaaccuguaagccagccccaauuaaauguuuucuuuauaagggcugccuugaucaugaugucucuucacagcaguggaaacccagacuaagauacuuaggguuuuauugcuaugaagagguacuaugaccaaggcaacucuuacaaaggaaaacauugaauuggaucuggcuuauaggcucacagguuaaguucauuauugucauggugggaagcauaguggcaugcaggcagacaugauacuaaaggaggagcugagaguucuacauucugaucugcagacaaaagaagugagugccacagcucaccuagcuugagcauguaugagaucgaaagcccacccccacagugacacaccuccuucaacaaagccacaccuacuucaacagggccgagauuccaaauagugccacuaccuggcccaaguauauacaaaccaccacauuccauucccuggcccccauaggcugguucaaacacaugagucuaugaaggccauacuuacccauagcauaauaaaaaauauguuaguccaacuucuaaagucuccauagucuauagcagucucaacaguguuaaacguccaaaguucaaagucucuucugagauucaugcaaucucuuaacuguaauccccaaaguaagacagaaaaccagcuggucaaacuccaaacucugcaucuccaugacugaugucaaaauggucuucaaaucuccaacuucuuuuucaucuuguugacugcaacaaacuucuccugagcugguuccacucccuguuagcagcuuuccucagcagauaucccaugauucuagcaucuugaacaucuuggggucuccaaggcaacuucaguguuacagcuucuuguugcgaugucugggaucuagacaugaucuucugggguccuccaaagggauggcaucacuucuccagcucugcugucuguagcacugugggcucugguugauuccaccccacugcugcuucuguucuugguuaucauccuaugguacuggcaucuccaguacacuggggucuuccacugcaaauagguuuuaccaguagccucucauaggcucucuucaugaugccaagccaaacuucuuugcaugaccccuucaguccugggcugucagcugcaacugaagcugcaccuucacuaauggccuuccuuagccucucacagugccaagccucagcugcuccccaugaccccuucauaccuucaaaaccaguaccacuagagugacucuuauacauuacugaguccagcuacagcacaaaguacagccuuggcuaucucuggaacacagcuucuuugugcucucagaaaauacuucccagaagauuucaccucagugauacuggucucuuaaucacugcuaauuucuuagcuccaacuaaccuauaugaauuguccaaguaaugccuuuuauuuuugacucuaaagccagagccgcaugguugaagccucugaguucugcuccuugcuggagcuggagcauagcccccuuguucuauuacauuaucaccaguuuucuguuuuccaacuccuucacugccuaaacuuggcuguccuggaacuugcucuguagaaugacccugaacucaaagaucuacauagcucuugucuccugaauucugggauuaaagguguauaccaccaugccugggccuaaacuuuucauuaucacuguucuucaagaucuggaucacaagugcacuacuccauuucuggauuauaguuaauuucauauuaaaagucaaaacuauuccuuguucaacugcaaaacacaaauaagcuuaacuggguaagcacagcuuccuuauccucuuuaucuccuugaacacaggauucagcuccauuuuucuuucuggugccccuuuauuauuucuugaaccauacauuuuauauuuuuuucuuuuuaagcuugcuaugcuugaucaaaguguucuuuaguuagucaugagacuaaaccagagaacaaaaucucuguugggcuuuuuuuuuuuuuuuuuuagauuuccuuugccaaugcaauuaauauaaaucucuauaccuuagccucagguagauucuucaaauaagagcaaaaagcagucacauucuucaaaauaccacagaaauagucuguaggccacauacugaaauucuucuccacugaaaucucuugggccaggucuggacaguucaaaucacucugagcuacaaagucguccauauuccuacuagaauuucucauuaagccccacuuaaagcauuccacugcuuuccaaaucuagagucccaaaaucuacauucuuccaaacaaaagcuuggucaggcuuaucacagcaauacccaagucccugguaccaacuucuguccuaggguuucuguugcugugaacagacaccaugaccaaggcagccaaugauaaagacaacauuuaauugggguuggcuuacagguucagagguucaguccauuaucaucagggugggggcauggcagcauccaggcaggcauggugcaggaggagcugagaguucuacaucuucaucugaaggcugcuagcagaauacugacuuuuacgcagcuagaaugauagucuuauaacccacacccacaaugacacaccuacuccaacaaggccauaccuuuaaauagucccacugggccaauuauauucaaaccaccacacuaagacaccaaccucauuccuguuuuaacaccucccaagcuucuguuucuaucauucaggcuuucucucucauucuugaagagaguuaagaagucuuuccugacccuccacuaggcauuaccauagcucccugccagucuuggcuacaugaaauccuacugauguuuuucugucuccccuuucccuguagaaugaacgacaggcagauguuuuuucuugcuuaccacagugacccaguacuuugaguaugccuagcaugcagcagacucucaauaaguggauugacaaaugucccaagcacucauugcuuggccaugaggaugauggaccccacuggcucuggcuuucuggggcuccaaaucacaaacaucugggugaguaaguuaucaaguguugaaauaaguuagugcuaauagugaggagguccauuuccauuuguucacugauucucucccaaugagauuuccuuaaugaguuucuguuuccuccauacucagagcagacuaagaacuacuucagcaucacaggugcacagagcuaaccagggcuguggagaaaacuggaaagucgugaugcuguaggauggcucugugacagcugccuuucuggagacugaaagcuacaacugcuggcacacaguagucugggcuugcucaagcucugggcuucuguuuucucuuauagaaaggauuuaggaauccaucuaaauuauaucagggaggaugcaaaauguuuaaaacuccaaccuuccuuccuuucuuagaugugagcgacuggaagagcagcugaaugaccugacagagcugcaccagaaugagauccugaacuuaaagcaggaguuggccagcauggaagagaaaaucgccuaucagucauaugaacgggcccgggauauccagguuaguaugaacaauaaguaagaaacaagaaaggaagaaaaugggcaaagacaggagucuggagagucaagaaaaguuccuaucaguuggaacacaccugccuugacccaguaaaguccaugccauuuggggagguauagcucuagauacugacagaugucuuagagacagagcagucccugagaaaaauuagaauaucucaucauugguugcugcccuggagcucuucagacagugcucccggccaucuugccuaucuuuugcuucuauauaaagggcauuugucccuaaucucuaacagguggcacauuacauggcuugugagaauccuccauuguuuguuuguagguuugugagaaaucccagcagugaaguugaagguaaacaguugauuucacuucucuauggggagaagugaaauauugggguuucucugguuucuauggagauucucucagaggucauggucgguuuuaugaggcacauugaaagaagcuaguauauagaauaggaacuuguagaacaccuacccauaggaaucaagguacuguccugacuguuugcccagcugacaucuuuuuuuauguucuugaauccuauuuacauuuuuuuucaucccaaguuaguucuggagugaguagcauccauuauccacucuugagcuagcuacagccugaugcuaucuggaccuuaccuuacauccuaggaaaccaaauugaacucaaggcugaaaaaaaucccaugguugcaaccacuaguugucuugggaggaugucugucauuacuaggggagaagguuugguuuccugagugguggaaugcaguuuacauaaggccuuagggagagcaggucacuuuaaugcccucaguagagugugaucauaguaucuauccaucucagagacugaccugaaaaggaacugugcccuccuuacagcagggucacaauucccuuacuccaauuauggauccuuuuugaccuaaaaacaucagguaaugugugagugaagcacacuacaucauuguuagaguggaaaaauaucaaaaaaaaaaaaaaaaaaaguccuauagagggacuuaacugcugguaaagugugacauacccauacuaugaaauguugcauaguaaguagcuuagaaaaaaaauaagcuagagcuagggagauggcucaguuggcaaaguauuugauucauaaguucagauucccagaacccucauaaaaagucagacgugggagccagcuagaagucacaacauaaaaagggugcuuacuauguaagcuugacaacugaguggaaggcgggaacuaguucaguccucagauuuguccuuuaaacucuauacuuagccauggcacacccacaaauaugcaaacacacacauacuauaacaacaacagcaauaaauguaaaaccaggcacagugucaugcacuuguuaucccagcaauggcaagaugagacaggaaaaaccuuggagcuuacuggucagcuacauggcaaaguugcaacuagugaaaggcccugucagaaacaaauagugaaagguaccaaaggaccacaauugucuucugaccaucacaugaacaugcacccguguccaugugcaugucuauacacacaagaauaagguggauccauguauuuuggacauggugugaucaagacccucuauuaagcagaaagagagagagagagagagagagagagagagagagagagagagagagaaaauaaaaaggaauaaguuauggauccguucaaguagaauacugugcacguuaugguaggaaacgccuguaauaaccccgugcugggcaaauccacacguacaguuaaauacagguaaaggguaagcgucccagucugacggcgcugccagaguagcagggacuagaacugagaacacugagaggcuguguuuagaggcaaacacguggauaugucuuguguaccuuagacuuauaauuucuaaaaggauaaaauucauauaauugaggucuucucauuaaaauguucuaggccacucaggaaugauggcacaugccuaugaucuaagcauucaggagauggaggcaaaagaaucagaaguucaggguaucucagcuauguagcgagcauauaagagacucuugucuuaaauaaauaaauuaaguaaauaaauucuaggcaaaauaaauccuaguauguccccugcuccccauaguuguucuccuaggagugcaguagacgggaugggaauaaugucaccugcgagugcugugcaucuggcuuuucauauccagggcuuauauauagcuguuugaaaucguugucguggcucaggaugcaccuggcuccagggcauauccagcuguacuucugagaguagaagccuaaucauccccuguuuggcccacaggaggcucuggaggccugucaaacccgcauuuccaagauggagcugcagcagcaacagcagcagguggugcaacuggaagggcuggagaaugccacugcccgaaaccuucugggcaaacucaucaauauccuccuugcugucauggcaguucucuuggucuuugugucaacaguagccaacuguguggucccccucaugaagacacgcaacaggacguucagcacuuuauuccuaguggcuuucauugccuuucuuuggaagcacugggaugcccucuuuagcuacguggaccggcucuucucaccccccagaugaugcuggcauggaacgcagugcucuucaccgucuggcgagugcaugccaagagagcuagacagcagcauuacccacucugaaguuuucuacaagagaguugagugaaucuguuuacauuuaggauaauguuuuuuucuucaaaagacgcaauugcaauaguauuuuuuagauuuuauccaagaaguuuuuugggcaaaaaucuuggaucauuuuuauguagcaugauuuuccuugggaugcaaaucugaaacaguccuuuaacaugaacaaucugcagcacacugaagggcauucugaauugaagcuuggagaacugcacuaaacccacuaaacagaugcaaaaaccugaccaggcccaacacccacccugccuggcuccucuccucauccagacuaacucuacugugaagucccaccacauuccagguuggaauuuuagauucaggguggauuuucccugccguggaagaacacaggcaucucccuagcuuucucacgcuaacccugaaguaugaucacuucugaaccugcuccuuucuuaacugccaggauuggaagcaagagcaucaagcccauaggaugacugcgcaauccuguucaguauugugaaguagcccuuaauccuaacuuuuaagcaaaaucccuuggccgcacuuuuaagguuugguuguuuuuuauauauauauguguauaguuaccaacuuaaaaauaaaaaauccgaacaacauacuugaagaauguaauacucaaacucucagugcuuccuuauaauuucuaauagaauuuuuuauuauuguuauuauuauugggguuuuuuugguugguugguugguuggucggguuuuuuggggggugaaggggacuggguugggagggucuuuuauuuuuuuccucugaaauaaagcagugcuguuuucaaaugaagccguguggauauuucagcgugcugcucccuguugucuggaaacaguugaguuggagccuguugccaaugcugcccucugccacccuguggcugcccuggcucucuggucucuaucacccacacagcaccaucuccccggcuuggcuugguuagaauggugagggguuuacaggguaaggggacaagacuacacacacuagcgugguaggacuagauuuuuguuuuccccaccaaguaaauguucaccugugaccuugggcugggauucucuuuaggaaaaaaggcuacuacuauguuaugagagucaaaaauaacuccuuguguuugcuuaauuuauuguuuaacacccccuaacugccgaaaccaaagugauacggagucgucuugucugcauuuuggccucagcaucauuaacuucaaagcuuuauucugucugccugagaggauccauggaagaugauucucccaaaaagcagaaaaagaaaugucagguuagaaggacccaaguucuaggugcacacuuuugcaagcuuccuacaagcccagacugacuuacacuaaccuaacugcucaguggcugucuagagacacuuuaggaagauaaacugagcuugauccucaucauauagccaguuccaucacucagguagugccugaaucaaccuucagagccugauuagucacauaucauuggaggucaaacgccauuuccaguggccucucugugugcccacaugaugcaaaggggucauguacuaugcccuggacaaagaaguauguuuugccuauguccccauaccaggaccuucuuucagaacgaggguaguauuacccuaucuguuggaaaggaugguuuacauagcaguuccagccuccuuuugcuuuggccaguuggccuucucacuuugauaguuuaacucagguacccagucuucacuccauccccaggugcuuguucaccucauuaaugagcaccuagagcaaggaccaaaagaaggaaaacuaauuaaaaccaaugcauauucaugccaaaacaagugguccccaagccuguuuaaaagguuaacuuggcccgaaaauauugcagcagcuucaugcaagaauugccacaggacacuauggccuugcugggcuagcauuugcugcuguaaucuaguugcucugguauagaagagaaccccauggggcugugggagagacaauucaguggcagcccacuggcuucucuacccauuccacaggaacccuauuccuacccccaccccugcccacaaaugccacugugauccacagcugaaguuguuucuaauugccuaaaggcagucucugugucuggagcuucaaagagacaggcagaccugcacuaauucccuucuuccucuagcagacugccuugggaaggaccuucaguccaggacagacccugucauggcuucuugcugucuuacccuucucacucaccaggcccacagucgccugcacucagugcuguuuguaacacaucuguuauucugccuaccuguacuuuuugcugcccaucccuguugccuuugaguuucuuggaauuguggcuguccucggaaucucuuuucuauucacagcccuucuauagccuugcucugaugguuuuagcacuugaucugagagaagcuugcccauaauuuaaugcuucuuuuccuuaaaaaauaaaaaaaaaaaucaaaaaaacccacuaaagugaagcauuucuugauucccuuuuccaugcuggugccuagcccgggugagugaggcuggcuguguuggccugggugacuugugguuguagaguuggccaucauucugcacuguugauagcugucugcuccaguuucuggucuuugguauacucaguguggcccggugaugaaggcuuucuacuccuuaacagguacaguuggauccaucgcugaugguguuucuuuagccccaucccaauuggccuaaaacauuugucaccagaacaguggggaaaagccuuccuuuccagccaugucugacagugagcaugcuuugguguggucuucacugcuuuugguuuugcuucugaucuuguguucuaagguacucagugaauccuggauucugaguaaguuccaggguucuggccuugaagccuuggacuacacacauuucaaacaaaaccaaaugcugucgucgacaagccagcacaggcgaagugaugguucccacagcacccccaauaaaaacugggauuuugaauguggcucuacaaguuaaacauuucuguguguuguguaugcuaggugaugcccucagaagggacugacuacuagacuguaaguguguuuuauacaaguguguaagacuaagacucacgugcacgaaucgaagaguaaagagacaauacuugugaacgugugaacguuaacacuguaguugcuagaucuuaagcugcuaauugucgagagagaauucaguugugugcugucuggcugcugugccuucucagcagcacuuuugcuguacauacaauggaaauaaagaccucagcuagaaaccugccaauugac

SEQ ID NO: 3316 - RNA, 844 nt, Mus musculus
uagacaaaaucucacuaguaaacuagacuggccuuaaauucccuaagaucugcuugccucugcuuucuuaaugcugagauuaaaggcauaugccaccaacgcaagcuaacagugguuucugaaugguacugcgcaugugaaauguuugaggguuagcagcacuacuuggcaaggauucagaggugucuuuguugaagugggcguggccuuauuggaggaagucugucugcuaccugcuuugcugauaggguacuaaaccuuggaaacaguaagcaaaccuaaauuaaauacuuucuuuucuuagaauuguuuuggucccuuuucccuuucugccaccgccaugccauccggacugaggaagacccggaaacuccgaggccacgugagccacggccgcauccguaagcaccgcaagcacccaggcggccgcgggaaugcuggaggcaggcaucaccgcaggaucaacuuugacacauaucacccagguugcuuugggaaaguugguaugaggcauuaccacuugaagaggaaccagagcuucugcccaacagucaaccuggauaaacuguggacauuggucagcgagcagacgcgggucaaugcagcaaaaaacaggacuguagcugcucccaucauugauguuguucgaucaggcuacuacaaaguucugggcaagggaaagcucccuaagcaaccugucaucgugaaggccaaauucuucagcagaagagcugaggagaagauuaaggguguuggagaugccuguguucugguggcuuaaaagccacaccggagguuaauuaaaugcuaacauuuucaaaaaaaaaaaaaagaauuguuuugg
